United States Patent 8,362,325 (NUCLEOTIDE SEQUENCES AND CORRESPONDING POLYPEPTIDES CONFERRING MODULATED PLANT CHARACTERISTICS) - sequence listing, part 2

SEQ ID NO: 1936 - protein, 818 aa, Sorghum bicolor
  misc_feature: Ceres ANNOT ID no. 6017458
  misc_feature (377)..(567): Pfam Id: AAA Pfam Desc: ATPase family associated with various cellular activities(AAA)
  misc_feature (574)..(790): Pfam Id: Peptidase_M41 Pfam Desc: Peptidase family M41
  misc_feature (190)..(351): Pfam Id: FtsH_ext Pfam Desc: FtsH Extracellular
  misc_feature (377)..(512): Pfam Id: AAA_5 Pfam Desc: ATPase family associated with various cellular activities(AAA)
  misc_feature (373)..(507): Pfam Id: AAA_2 Pfam Desc: ATPase family associated with various cellular activities(AAA)
  misc_feature (194)..(811): NCBI GI: 145351544 NCBI Desc: aaa-metalloprotease ftsh, chloroplast precursor [ostreococcus lucimarinus cce9901]
  misc_feature (253)..(805): NCBI GI: 75908451 NCBI Desc: peptidase m41, ftsh [anabaena variabilis atcc 29413]
  misc_feature (253)..(805): NCBI GI: 17232428 NCBI Desc: cell division protein [nostoc sp. pcc 7120]
  misc_feature (253)..(797): NCBI GI: 22298071 NCBI Desc: cell division protein [thermosynechococcus elongatus bp-1]
  misc_feature (269)..(536): NCBI GI: 49388451 NCBI Desc: cell division protein ftsh3-like [oryza sativa (japonica cultivar-group)]
  misc_feature: The sequence is a functional homolog of SEQ ID NO. 462 in the 11/188,298 US application
  misc_feature: The sequence is a functional homolog of SEQ ID NO. 471 in the 11/188,298 US application
MACAAAETLASFPIASPSRSLLRPFPQRPAAAAAAAGRGAASIRISAVPPRGLGLALVHRRVRRCPPAARANVERDGDGASGNGEPSSSSGDGGDRDAAAESGGDTTSTSTTSAAATPPPPSSKRGENKWRRRLIKGGGGVGRWLWEPIVQGREMGFLLLQLGFAIFALRMLRPEIALPGSEPRPQTTYVSVPYSDFLASIDKDQVKKVEVDGVHIMFRLRPEVESQVRVVQTPTQRGADAVVDNTGASRRIVFTTTRPVDIKTPYEKMVENMVEFGSPDKRSGGMLNSALVALIYVVLIAVVLQRLPISFSQNSAGQLRNRKNSNSGGTKVSESTDIVTFADVAGVDEAKEELEEIVEFLRNPDRYIRLGARPPRGVLLVGLPGTGKTLLAKAVAGEAEVPFISCSASEFVELYVGMGAARVRDLFARAKKESPSIIFIDEIDAVAKSRDGRYRIVSNDEREQTLNQLLTEMDGFDTNSAVIVLGATNRADVLDPALRRPGRFDRVVMVEAPDRFGRESILKVHVNRRELPLSKDVNLADIAAMTTGFTGADLANLVNEAALLAGRLNKEMVEKIDFIRAVERSIAGIEKKHAKLKGNEKAVVARHEVGHALVGTAVANLLPGQPRVEKLSILPRSGGALGFTYTPPTTEDRYLLFVDELRGRLVTLLGGRAAEEVVLGGRVSTGALDDIRRATDMAYKAVAEYGLNQRIGPISLATLSNGGLDDSGGSPWGRDQGHLVDLVQREVKVLLQSSLEVALSVIRANPAVLEGLGAYLEENEKVEGEELQEWLKSVVAPKELTSFIRGQQEQVLQLEASS

SEQ ID NO: 1937 - DNA, 717 bp, Sorghum bicolor
  misc_feature: Ceres ANNOT ID no. 6017480
  misc_feature: Encodes the peptide sequence at SEQ ID NO 1938
atgcaggcatatatggagggaggccagttgagtgcttgccttcctggcttccttgtgccggatcactacgccttccctcttcctctcccgctacaacttcctagcagccaaaacaagcttttccagatgccgtttgtagttgaccaggaagcagagaccgaaaaccatggcggcggcgggatgctctcctccgaccattgtggactatacccgctgccggcactgcccttcggcagctgctccggtgccgccggcgccgcaacagcgtgcggtgggaagcctacggccggtttcatgcccagtgctattgtcgctgaggaggtctgcacctcggtgactactaaattaggttgcaacgacagtaatggcacatggtggaagggttcggcagctacaacgatagcggagagagggaagatgaaggtgaggaggaagatgagggaaccgaggttttgcttccagaccagaagcgacgtggatgtactggatgatggctacaagtggaggaagtatgggcagaaggttgtcaagaacagcctccatccaaggagctatttccggtgcactcacagcaactgccgcgtgaagaaacgggtggagcggctgtcgacggactgccgcatggtgatgaccacgtacgagggccgccacacgcactctccctgcagcgacgacgcttcctccgccgaccacaccgattgcttcacctccttctga

SEQ ID NO: 1938 - protein, 238 aa, Sorghum bicolor
  misc_feature: Ceres ANNOT ID no. 6017480
  misc_feature (162)..(221): Pfam Id: WRKY Pfam Desc: WRKY DNA -binding domain
  misc_feature (26)..(238): NCBI GI: 14140117 NCBI Desc: wrky-like dna-binding protein [oryza sativa]
  misc_feature (1)..(238): NCBI GI: 115459728 NCBI Desc: os04g0545000 [oryza sativa (japonica cultivar-group)]
  misc_feature (5)..(238): NCBI GI: 116310242 NCBI Desc: osigba0101c23.2 [oryza sativa (indica cultivar-group)]
  misc_feature (5)..(238): NCBI GI: 38345955 NCBI Desc: osjnbb0038f03.13 [oryza sativa (japonica cultivar-group)]
  misc_feature (136)..(238): NCBI GI: 46394322 NCBI Desc: tpa: wrky transcription factor 34 [oryza sativa]
  misc_feature: The sequence is a functional homolog of SEQ ID NO 10 in the 10/412,699US patent application
  misc_feature: The sequence is a functional homolog of SEQ ID NO 1017 in the 10/412,699US patent application
  misc_feature: The sequence is a functional homolog of SEQ ID NO 124 in the 11/479,226US patent application
  misc_feature: The sequence is a functional homolog of SEQ ID NO 204 in the 10/714,887US patent application
  misc_feature: The sequence is a functional homolog of SEQ ID NO 204 in the 11/435,388US patent application
  misc_feature: The sequence is a functional homolog of SEQ ID NO 22 in the 10/374,780US patent application
  misc_feature: The sequence is a functional homolog of SEQ ID NO 231 in the 11/479,226US patent application
  misc_feature: The sequence is a functional homolog of SEQ ID NO 521 in the 10/374,780US patent application
  misc_feature: The sequence is a functional homolog of SEQ ID NO 858 in the 10/225,066US patent application
  misc_feature: The sequence is a functional homolog of SEQ ID NO 88 in the 10/412,699US patent application
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 1017 in the 20040045049 US patent application
  misc_feature: The sequence is a functional homolog of SEQ ID NO 88 in the 20040045049 US patent application
  misc_feature: The sequence is a functional homolog of SEQ ID NO 204 in the 20060015972 US patent application
  misc_feature: The sequence is a functional homolog of SEQ ID NO 1017 in the 10/412,699 US patent application
  misc_feature: The sequence is a functional homolog of SEQ ID NO 521 in the 10/374,780 US patent application
  misc_feature: The sequence is a functional homolog of SEQ ID NO 22 in the 10/374,780 US patent application
  misc_feature: The sequence is a functional homolog of SEQ ID NO 231 in the 11/479,226 US patent application
  misc_feature: The sequence is a functional homolog of SEQ ID NO 858 in the 10/225,066 US patent application
  misc_feature: The sequence is a functional homolog of SEQ ID NO 88 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: The sequence is a functional homolog of SEQ ID NO 86 in the 10/412,699 US patent application
  misc_feature: The sequence is a functional homolog of SEQ ID NO 1640 in the 11/479,226 US patent application
  misc_feature: The sequence is a functional homolog of SEQ ID NO 2 in the 10/225,066 US patent application
  misc_feature: The sequence is a functional homolog of SEQ ID NO 254 in the 10/374,780 US patent application
  misc_feature: The sequence is a functional homolog of SEQ ID NO 30 in the 10/714,887 US patent application
  misc_feature: The sequence is a functional homolog of SEQ ID NO 30 in the 11/435,388 US patent application
  misc_feature: The sequence is a functional homolog of SEQ ID NO 808 in the 10/412,699 US patent application
  misc_feature: The sequence is a functional homolog of SEQ ID NO 202 in the 10/714,887 US patent application
  misc_feature: The sequence is a functional homolog of SEQ ID NO 202 in the 11/435,388 US patent application
MQAYMEGGQLSACLPGFLVPDHYAFPLPLPLQLPSSQNKLFQMPFVVDQEAETENHGGGGMLSSDHCGLYPLPALPFGSCSGAAGAATACGGKPTAGFMPSAIVAEEVCTSVTTKLGCNDSNGTWWKGSAATTIAERGKMKVRRKMREPRFCFQTRSDVDVLDDGYKWRKYGQKVVKNSLHPRSYFRCTHSNCRVKKRVERLSTDCRMVMTTYEGRHTHSPCSDDASSADHTDCFTSF

SEQ ID NO: 1939 - DNA, 801 bp, Sorghum bicolor
  misc_feature: Ceres ANNOT ID no. 6017482
  misc_feature: Encodes the peptide sequence at SEQ ID NO 1940
atggacgggagcgccggctccttcgtcgccgtgcgccggctctccggctccgaccgcgccgccgccttccaccactcctcttcggcggaggtcgtgacgggatcaagcgcatggatcgggagggggctctcatgcgtctgcgcgcagaggagggacagcgatgcgcgcctctccttcgatttgacgcctgtgcaggaagaatgcctacagaggttacaaaaccggatagaagttcagtatgacagtgcaaacagagagcatcaggaagcactacaggccctttggtgtgcttcttttcctggcaccgagcttcgggggctaatatcagaacaatggaaggagatgggttggcaagggaaagacccatctacagactttagaggtggaggcttcatctccttggagaatctattgtacttttctaggaactatccaaaatctttccaggaacttcttcgcaagcagaatggtgaccgtgcaatctgggagtatccatttgctgtagctggtgtaaatataaccttcatgctcattcagatgcttgatctccaagcagttaaaccgaggtcattgtttggagcagttttcctaaagcttctttcagaaaacgatcgagcttttgacattctctactgcataaccttcaagctgatggaccagcaatggcttgacatgcatgctacttacatggactttaacacggtcatgaagtctacacggcgtcagctagaaagggagctgttgattgaagatattcagaggattgaggacatgccatcatacaggcttctgggccggtag

SEQ ID NO: 1940 - protein, 266 aa, Sorghum bicolor
  misc_feature: Ceres ANNOT ID no. 6017482
  misc_feature (85)..(246): Pfam Id: ELMO_CED12 Pfam Desc: ELMO/CED-12 family
  misc_feature (1)..(266): NCBI GI: 38345956 NCBI Desc: osjnbb0038f03.14 [oryza sativa (japonica cultivar-group)]
  misc_feature (1)..(266): NCBI GI: 116310243 NCBI Desc: osigba0101c23.3 [oryza sativa (indica cultivar-group)]
  misc_feature (1)..(266): NCBI GI: 124359479 NCBI Desc: engulfment and cell motility, elm [medicago truncatula]
  misc_feature (1)..(266): NCBI GI: 17981659 NCBI Desc: at2g44770/f16b22.26 [arabidopsis thaliana]
  misc_feature (1)..(200): NCBI GI: 70663961 NCBI Desc: osjnba0079a21.3 [oryza sativa (japonica cultivar-group)]
MDGSAGSFVAVRRLSGSDRAAAFHHSSSAEVVTGSSAWIGRGLSCVCAQRRDSDARLSFDLTPVQEECLQRLQNRIEVQYDSANREHQEALQALWCASFPGTELRGLISEQWKEMGWQGKDPSTDFRGGGFISLENLLYFSRNYPKSFQELLRKQNGDRAIWEYPFAVAGVNITFMLIQMLDLQAVKPRSLFGAVFLKLLSENDRAFDILYCITFKLMDQQWLDMHATYMDFNTVMKSTRRQLERELLIEDIQRIEDMPSYRLLGR

SEQ ID NO: 1941 - DNA, 714 bp, Sorghum bicolor
  misc_feature: Ceres ANNOT ID no. 6017483
  misc_feature: Encodes the peptide sequence at SEQ ID NO 1942
atggtggttgcaatgggaggtagcggaacgctgatctcggtttaccccgaggagctcaccttcttgtttgagctggagaagccgtgctattgcaatctcaaggtggtgaacaacagcgagcaccatgtcgcattcaaggtcaaaacaacatcaccgaggaagtattttgtccggccgaacgcgagcatcgtccagccatgggattcttgcacaataacgattacgctgcaggcacagaaagagttcccaccagatatgcaatgcaaggataagttcttgattcagagcacgaaggtgcctgccagtaccgacatggatgagatcccccctgatacgttcaacaaggaaactgataaggtaattgaggaaatgaagctcaaggttgtttacacattacctagtggaggttcagatgactctagtgtgtcatctctaggaagccggagcttcaaaggggcatctgacgatttgacgatgctgaagaatgcaagcattgaagagatccagacaattcagcggttgaaggaagaaagagataacatgcttcagcaaaatcagcaaatgcaacgtgaattggatgtgcttcggaggcgtaggagccgcaagggcgatgcaggtttctccttgacgtttgctgcgtttgctgggctaataggtgttctggtgggtctcctgatgagcctcatcttctcttctccaccggctgatgcataa

SEQ ID NO: 1942 - protein, 237 aa, Sorghum bicolor
  misc_feature: Ceres ANNOT ID no. 6017483
  misc_feature (11)..(119): Pfam Id: Motile_Sperm Pfam Desc: MSP (Major sperm protein) domain
  misc_feature (11)..(133): NCBI GI: 140062643 NCBI Desc: major sperm protein [medicago truncatula]
  misc_feature (5)..(133): NCBI GI: 115459632 NCBI Desc: os04g0534400 [oryza sativa (japonica cultivar-group)]
  misc_feature (5)..(133): NCBI GI: 116310461 NCBI Desc: osigba0159i10.10 [oryza sativa (indica cultivar-group)]
  misc_feature (7)..(226): NCBI GI: 6688926 NCBI Desc: vap27 [nicotiana plumbaginifolia]
  misc_feature (8)..(226): NCBI GI: 90738686 NCBI Desc: vap25 [solanum chacoense]
  misc_feature: The sequence is a functional homolog of SEQ ID NO. 356 in the 11/188,298 US application
MVVAMGGSGTLISVYPEELTFLFELEKPCYCNLKVVNNSEHHVAFKVKTTSPRKYFVRPNASIVQPWDSCTITITLQAQKEFPPDMQCKDKFLIQSTKVPASTDMDEIPPDTFNKETDKVIEEMKLKVVYTLPSGGSDDSSVSSLGSRSFKGASDDLTMLKNASIEEIQTIQRLKEERDNMLQQNQQMQRELDVLRRRRSRKGDAGFSLTFAAFAGLIGVLVGLLMSLIFSSPPADA

SEQ ID NO: 1943 - DNA, 642 bp, Sorghum bicolor
  misc_feature: Ceres ANNOT ID no. 6017484
  misc_feature: Encodes the peptide sequence at SEQ ID NO 1944
atggccgccgccgcctccgccaccgccatctccggcgtcgtgcttccccacgccttcctatcccaccggtcgccgccgccgcaggtcctagccgtggcctcctcattccgccggctctccctgtgcgcttcccctcgccggaccacccacataatcgcgcgcgctgacgccagtgccgaagccggagaaccggagactgaggagcctgtcacttcctcagctgaatccgaagaagaggtggccgagggggctgtcgctgtggcggaggccgaggaagaggaggcagaggaaccgccgccgccgagcaagccgaagattctgaataagcagtttattgaggaggctgagaaggtgaagacagtaccagatctgaggcctggcgatatcattgagcttaggatgcaacggcccaacaagaggagattgtcactctttaagggtataatcatcgcaaagcacaaagctggtgttcacaccacaatccgtgtcagaaggatcattgctggtgtaggagttgagattaccttcccagtgtactcacccaggatcaaggagatcacggtaatcaggcacaggaaagtgaggagagcaaagttgtactacctgaaagacaagcttccccgcttttcaaccttcaagtga

SEQ ID NO: 1944 - protein, 213 aa, Sorghum bicolor
  misc_feature: Ceres ANNOT ID no. 6017484
  misc_feature (105)..(206): Pfam Id: Ribosomal_L19 Pfam Desc: Ribosomal protein L19
  misc_feature (14)..(213): NCBI GI: 21592584 NCBI Desc: contains similarity to plastid ribosomal protein l19 [arabidopsis thaliana]
  misc_feature (65)..(213): NCBI GI: 7582403 NCBI Desc: plastid ribosomal protein l19 precursor [spinacia oleracea]
  misc_feature (66)..(213): NCBI GI: 39931795 NCBI Desc: 50s ribosomal protein l19
  misc_feature (66)..(213): NCBI GI: 33239924 NCBI Desc: ribosomal protein l19 [prochlorococcus marinus subsp. marinus str. ccmp1375]
  misc_feature (71)..(213): NCBI GI: 116073441 NCBI Desc: 50s ribosomal protein l19 [synechococcus sp. rs9916]
MAAAASATAISGVVLPHAFLSHRSPPPQVLAVASSFRRLSLCASPRRTTHIIARADASAEAGEPETEEPVTSSAESEEEVAEGAVAVAEAEEEEAEEPPPPSKPKILNKQFIEEAEKVKTVPDLRPGDIIELRMQRPNKRRLSLFKGIIIAKHKAGVHTTIRVRRIIAGVGVEITFPVYSPRIKEITVIRHRKVRRAKLYYLKDKLPRFSTFK

SEQ ID NO: 1945 - DNA, 1638 bp, Sorghum bicolor
  misc_feature: Ceres ANNOT ID no. 6017485
  misc_feature: Encodes the peptide sequence at SEQ ID NO 1946
atgacgaagccgccggcaccggcggttccgtcgcctgagccgccgccgccgccgcgcctcgccggtgggcgtgggccgcgcggcctccgatccctgcccgcgctctcctacaacacccaccgcgccctcgtcctggggctcaccttcctggcctacgcgctctaccacgcctcccgcaagccgcccagcatcgtcaagcgcgagctcgcccggtcctggccgcccttcgccgacccggcgctcctcggcgccaccgacgtcgctttcctcatctcctattccctcggcatgttcgtcgccggccacctcggcgactgcctcgacctccgccgcttccttgccttcggcatggtcaccagcggcgccgccgtggcgctcttcggcgccgggtacttcctcggcctgcattccctcgtgttctacgtcgtcgcccaggtgctcgcgggcctgctccagtccacgggctggccctccgtcgtcgccatcgtgggcaactggttctgcggccggaggcgcggcctcatcatgggcgtatggaacgcgcacacctcggtcgggaacatcaccggatcgcttgtcgccgcggccatgcttgggtacgggtggggatggtcgttcgtggtccccggtgggctcattgcgctcggtggcgtccttgtgcttttcttcctcgcgccatacccccagtacgtcggcttcggcccctcgccgattgaaccggtcacggatgagagcaccgacggggaggacatcagtgccgcaggtggcgatgggaaggacagacgggatgccgtcggaatttttaaggcactagccattcccggtgtggtcatcttcgcgctctgtctgttcttcgccaaactagttgcctacacgttcctgtactggctcccattctacttgagccagactgctattggaggccagtatatgtcagctgcatctgctggatatgtatcagttttgtttgatgtaggtggaatagttgggggagttctggccggcttcatatctgaccagctcaatgctagggcaaccactgctgcagttttcatgtacttggcgattccatctcttttcctctttcatgcatatggtagtacctcaaaagcgacaaacattggattgatgatgatcagtggcctgtttgttaatggaccttatgctctcataacaactgctgtttctgctgatttgggcactcacaaatcccttaaaggagattctcgtgcattggccacggtaacggcaattatagatgggacaggatctcttggtgctgcattaggaccattcataacgggcttcatttcaaggaaaggatgggattcagtattcataatgcttgcactttgtgcactggttgctgctgtgtcgttgtcaagtcatgtgaaaacagaaattcctcagatcatccagaagtggagaaatcgatcaaccaatacgcaggatggaaatgcagtaggccggcctcgtggtcatgggccaggatacatatatatgatccagttggtttgcgagtcactgtcacctgcatatataatttcagtgatcgatcgagcagcagtgccactggccagtgatcgagtgattatattcaagggatggctttgctgcatgcacctggttggtagctag

SEQ ID NO: 1946 - protein, 545 aa, Sorghum bicolor
  misc_feature: Ceres ANNOT ID no. 6017485
  misc_feature (48)..(431): Pfam Id: MFS_1 Pfam Desc: Major Facilitator Superfamily
  misc_feature (242)..(468): NCBI GI: 30684088 NCBI Desc: transporter-related [arabidopsis thaliana]
  misc_feature (242)..(468): NCBI GI: 7268507 NCBI Desc: glycerol-3-phosphate permease like protein [arabidopsis thaliana]
  misc_feature (66)..(468): NCBI GI: 115474855 NCBI Desc: os08g0156600 [oryza sativa (japonica cultivar-group)]
  misc_feature (69)..(468): NCBI GI: 38345584 NCBI Desc: osjnbb0012e24.2 [oryza sativa (japonica cultivar-group)]
  misc_feature (70)..(461): NCBI GI: 145357057 NCBI Desc: mfs family transporter: glycerol-3-phosphate [ostreococcus lucimarinus cce9901]
MTKPPAPAVPSPEPPPPPRLAGGRGPRGLRSLPALSYNTHRALVLGLTFLAYALYHASRKPPSIVKRELARSWPPFADPALLGATDVAFLISYSLGMFVAGHLGDCLDLRRFLAFGMVTSGAAVALFGAGYFLGLHSLVFYVVAQVLAGLLQSTGWPSVVAIVGNWFCGRRRGLIMGVWNAHTSVGNITGSLVAAAMLGYGWGWSFVVPGGLIALGGVLVLFFLAPYPQYVGFGPSPIEPVTDESTDGEDISAAGGDGKDRRDAVGIFKALAIPGVVIFALCLFFAKLVAYTFLYWLPFYLSQTAIGGQYMSAASAGYVSVLFDVGGIVGGVLAGFISDQLNARATTAAVFMYLAIPSLFLFHAYGSTSKATNIGLMMISGLFVNGPYALITTAVSADLGTHKSLKGDSRALATVTAIIDGTGSLGAALGPFITGFISRKGWDSVFIMLALCALVAAVSLSSHVKTEIPQIIQKWRNRSTNTQDGNAVGRPRGHGPGYIYMIQLVCESLSPAYIISVIDRAAVPLASDRVIIFKGWLCCMHLVGS

SEQ ID NO: 1947 - DNA, 918 bp, Sorghum bicolor
  misc_feature: Ceres ANNOT ID no. 6017490
  misc_feature: Encodes the peptide sequence at SEQ ID NO 1948
atgcgcagtccgcgaggcctcctcgccgcctccggctaccttgcgggccgccatgctccgtcgacctccgtatccaccactggccaccactccctattcgcccgcaccttccaaatcctagcccagtcggagcccgtccgcctccagaagctcccggcacccaactccgggatcttagagctgaggctggaccggccggaggtcaagaacgccattaattgggatttgatgaggaggctgcggagcgccatagagaagattcagaccgacacgacggcgaaggtcgtccttgttgcgagctccgtgccgggggctttctgtgcaggcgccgatctcaaggaaaggaggctaatgaaatcttctgacgttggggagtatgctagatccttgagatctacattttcgtcttttgaggcactccctattccaacaattgctgtcattgaaggagctgcccttggtggtgggctagaactggctttggcatgcgacctccgaatatgcggggaatatgcagaacttggactgccagaaacaggccttgctattatacctggagctggaggtacacaacgccttccaaggatcgtagggagatccagagcaaaggaactgatattcactggccgcaaatgtggcgcagctgaagctgtaatgatgggattagcaaactattgtgttccagcaggagaggcttaccagaaggctcttgacattgcctgtgagataactcagaagggtcccttggggataaggatggcaaagaaggctatcaatgaggggacagaggtggccgacatgtcctcagcgctggctatcgaaggggagtgctacgagcagctgctgcacacgcaggatcgccttgaggccctggctgcattcgccgagaagaggaagcctgtgtacacaggaaagtag

SEQ ID NO: 1948 - protein, 305 aa, Sorghum bicolor
  misc_feature: Ceres ANNOT ID no. 6017490
  misc_feature (59)..(228): Pfam Id: ECH Pfam Desc: Enoyl-CoA hydratase/isomerase family
  misc_feature (58)..(305): NCBI GI: 144924706 NCBI Desc: enoyl-coa hydratase/isomerase [medicago truncatula]
  misc_feature (76)..(305): NCBI GI: 20271005 NCBI Desc: enoyl-coa hydratase [arabidopsis lyrata subsp. petraea]
  misc_feature (51)..(305): NCBI GI: 50417177 NCBI Desc: zgc:101057 protein [danio rerio]
  misc_feature (44)..(305): NCBI GI: 29612662 NCBI Desc: au rna-binding enoyl-coenzyme a hydratase [mus musculus]
  misc_feature (44)..(305): NCBI GI: 20072952 NCBI Desc: auh protein [mus musculus]
MRSPRGLLAASGYLAGRHAPSTSVSTTGHHSLFARTFQILAQSEPVRLQKLPAPNSGILELRLDRPEVKNAINWDLMRRLRSAIEKIQTDTTAKVVLVASSVPGAFCAGADLKERRLMKSSDVGEYARSLRSTFSSFEALPIPTIAVIEGAALGGGLELALACDLRICGEYAELGLPETGLAIIPGAGGTQRLPRIVGRSRAKELIFTGRKCGAAEAVMMGLANYCVPAGEAYQKALDIACEITQKGPLGIRMAKKAINEGTEVADMSSALAIEGECYEQLLHTQDRLEALAAFAEKRKPVYTGK

SEQ ID NO: 1949 - DNA, 909 bp, Sorghum bicolor
  misc_feature: Ceres ANNOT ID no. 6017492
  misc_feature: Encodes the peptide sequence at SEQ ID NO 1950
atgctcggcctccggcgcctcctcgttgtctccggccgccacgcgccggaggtcacctccgcctgtgcggcgtcctcccacagcgccgtcttctttcgcgcgctccaaatcctcgcccagccggggcccgtccgcctccacaagctctcggctccggacaccgggatcgtggagctgaggctggagcggccggaggccaagaacgccatagggaaggagatgctccacgggctgcggagcgccatccaggaggtggtggccgacacggctgcaaacgtcgtcttggtggcgagctccgtgcccaaggttttctgcgcgggcgccgatctcaaggaaaggaggttgatgggccctactgaagttcgggactttgttaattccttaagatctacattttcatcctttgaggcactgtctattcctacaattgctgttgttgaaggggttgctttcggtggcgggttagaattggctctgtcatgtgatcttcgcatatgtggcgaggatgcaaaattcagtttgccagagactggccttgctattattccgggtgctggaggaactcagcgccttcctaggattgttggaaggtcaagagcaaaggaactaatattcactggccgtagatttgatgcagtggaagctgcaactatgggagtagtaaactactgtgttcctgctggcgaggcttatcaaaaggctcttgaacttgcacgggagataaaccagaaaggcccagtagcggtaaaaatggctaagaaggccatcaatcaaggggcagaggtagacatgccctcggcattggctgttgaagaagaatgctacgagcaagttctgcacactcaggatcgtcttgaaggtctagccgcatttgccgagaaaaggaagcctgtatataaagggaagtag

SEQ ID NO: 1950 - protein, 302 aa, Sorghum bicolor
  misc_feature: Ceres ANNOT ID no. 6017492
  misc_feature (57)..(226): Pfam Id: ECH Pfam Desc: Enoyl-CoA hydratase/isomerase family
  misc_feature (56)..(302): NCBI GI: 144924706 NCBI Desc: enoyl-coa hydratase/isomerase [medicago truncatula]
  misc_feature (74)..(302): NCBI GI: 20271005 NCBI Desc: enoyl-coa hydratase [arabidopsis lyrata subsp. petraea]
  misc_feature (49)..(302): NCBI GI: 50417177 NCBI Desc: zgc:101057 protein [danio rerio]
  misc_feature (44)..(302): NCBI GI: 24653139 NCBI Desc: cg8778-pa [drosophila melanogaster]
  misc_feature (44)..(302): NCBI GI: 125806609 NCBI Desc: ga21314-pa [drosophila pseudoobscura]
MLGLRRLLVVSGRHAPEVTSACAASSHSAVFFRALQILAQPGPVRLHKLSAPDTGIVELRLERPEAKNAIGKEMLHGLRSAIQEVVADTAANVVLVASSVPKVFCAGADLKERRLMGPTEVRDFVNSLRSTFSSFEALSIPTIAVVEGVAFGGGLELALSCDLRICGEDAKFSLPETGLAIIPGAGGTQRLPRIVGRSRAKELIFTGRRFDAVEAATMGVVNYCVPAGEAYQKALELAREINQKGPVAVKMAKKAINQGAEVDMPSALAVEEECYEQVLHTQDRLEGLAAFAEKRKPVYKGK

SEQ ID NO: 1951 - DNA, 690 bp, Sorghum bicolor
  misc_feature: Ceres ANNOT ID no. 6017493
  misc_feature: Encodes the peptide sequence at SEQ ID NO 1952
atggggaagcgctggatcccgctggaggccaacccggacgtcatgaaccagttcatatgggggctgggagtccccgagggggatgtgcagttctgcgacgtctacggcctggacgatgagctgctcgccatggtgccccagcccgttctcgccgtcctcttcctctaccccctcacctctctggacgaggaggagaaagaggaatcaagtgcttctgccacatcgaccacaaggggcaaggaattgagcaagaaggtatactttacgaagcagactgttggtaatgcttgtggaacagttggtgttattcatgcaataggaaatgcaaaatctcagatcaagctagttgaggggtcctattttgagaagttctataagcaaacagctgatatggatccaatccagcgtgctacctttcttgaggaagatgatgagatggaggatgcacattctgttgctgcatctgctggtgacactgatgctaatgttgatgttaatgaacattttgtatgtttctcctgtgttgatggtgaactttatgagcttgatggacgaaaatcacaacccacatcccatggcccttcatcacctgaaaccttgttgcaggatgctgcaaaagtcatcaaagctagaattgcagagaaccctaactcgatgaacttcaacgtcatggccctttcaaagaagtga

SEQ ID NO: 1952 - protein, 229 aa, Sorghum bicolor
  misc_feature: Ceres ANNOT ID no. 6017493
  misc_feature (4)..(215): Pfam Id: Peptidase_C12 Pfam Desc: Ubiquitin carboxyl-terminal hydrolase, family 1
  misc_feature (1)..(228): NCBI GI: 49388197 NCBI Desc: carboxyl-terminal proteinase-like [oryza sativa (japonica cultivar-group)]
  misc_feature (1)..(229): NCBI GI: 116310252 NCBI Desc: osigba0101c23.12 [oryza sativa (indica cultivar-group)]
  misc_feature (18)..(229): NCBI GI: 144924704 NCBI Desc: helix-turn-helix, arac type; peptidase c12, ubiquitin carboxyl-terminal hydrolase 1 [medicago truncatula]
  misc_feature (86)..(229): NCBI GI: 115461176 NCBI Desc: os04g0667500 [oryza sativa (japonica cultivar-group)]
  misc_feature (2)..(229): NCBI GI: 32488373 NCBI Desc: osjnba0043a12.3 [oryza sativa (japonica cultivar-group)]
MGKRWIPLEANPDVMNQFIWGLGVPEGDVQFCDVYGLDDELLAMVPQPVLAVLFLYPLTSLDEEEKEESSASATSTTRGKELSKKVYFTKQTVGNACGTVGVIHAIGNAKSQIKLVEGSYFEKFYKQTADMDPIQRATFLEEDDEMEDAHSVAASAGDTDANVDVNEHFVCFSCVDGELYELDGRKSQPTSHGPSSPETLLQDAAKVIKARIAENPNSMNFNVMALSKK

SEQ ID NO: 1953 - DNA, 753 bp, Sorghum bicolor
  misc_feature: Ceres ANNOT ID no. 6017499
  misc_feature: Encodes the peptide sequence at SEQ ID NO 1954
atggcggctgctccgtcggcgacggcggtgtccacggcggcgcttctagccccaatccgagctccaaccagcgcgtttctccggcgcacccagctcacccgtcaccgcgaccactccctaaaatgccgccgcgctggtcccatcgtccccgcggccgctgctgccgcggcgggcagcagcagctccccgtcgtctgccgttttccacggcgagtgctttgtggtgggcgacaacatcgacaccgaccagatcatccccgcggagcacctcactctggtgccctccaagcctgacgagtaccgcaagctcggctcctttgccttcgcggggctcccctccgcggcctacccgacgccgttcgtcgccccgggtgaggagtccacccgctacgccgtcgtcgtcggtggggccaacttcgggtgcggctcctcccgcgagcacgcgcccgtcgcgcttggggcggctggagcccgcgccgtcgtcgcggagggctacgcgcgcatcttcttccgcaactccgtggccactggagaggtgtaccctctggagctcacggacactggagcctggaaggagtgcaagacaggggatgtggtcaccgtggaccttagtaactccgtttttattaaccacacctctggcaaggagtacaagctgaaaccaattggtgatgctggtccggtgattgaggcgggagggatctttgcctatgctcggaagacaggaatgatcgcgtcaaaagctgctgcatga

SEQ ID NO: 1954 - protein, 250 aa, Sorghum bicolor
  misc_feature: Ceres ANNOT ID no. 6017499
  misc_feature (65)..(187): Pfam Id: Aconitase_C Pfam Desc: Aconitase C-terminal domain
  misc_feature (2)..(249): NCBI GI: 34398297 NCBI Desc: 3-isopropylmalate dehydratase small subunit [oryza sativa (japonica cultivar-group)]
  misc_feature (56)..(250): NCBI GI: 53801464 NCBI Desc: plastid 3-isopropylmalate dehydratase; isopropylmalate isomerase [helicosporidium sp. ex simulium jonesii]
  misc_feature (51)..(244): NCBI GI: 67772402 NCBI Desc: isopropylmalate dehydratase [gonium pectorale]
  misc_feature (70)..(247): NCBI GI: 113474825 NCBI Desc: 3-isopropylmalate dehydratase, small subunit [trichodesmium erythraeum ims101]
  misc_feature (67)..(245): NCBI GI: 78189854 NCBI Desc: 3-isopropylmalate dehydratase, small subunit [chlorobium chlorochromatii cad3]
MAAAPSATAVSTAALLAPIRAPTSAFLRRTQLTRHRDHSLKCRRAGPIVPAAAAAAAGSSSSPSSAVFHGECFVVGDNIDTDQIIPAEHLTLVPSKPDEYRKLGSFAFAGLPSAAYPTPFVAPGEESTRYAVVVGGANFGCGSSREHAPVALGAAGARAVVAEGYARIFFRNSVATGEVYPLELTDTGAWKECKTGDVVTVDLSNSVFINHTSGKEYKLKPIGDAGPVIEAGGIFAYARKTGMIASKAAA

SEQ ID NO: 1955 - DNA, 843 bp, Sorghum bicolor
  misc_feature: Ceres ANNOT ID no. 6017503
  misc_feature: Encodes the peptide sequence at SEQ ID NO 1956
atggtgcggccttacgcggtgaaggggcggaagaagaagcgcaagctcgaggaggcgtcggcctcgggcgctgccccgcccgccgaagaagcagaggagctgccaccgccagaggtgggcagcggcgaggaggatgaggcagcggcggggaaggaggagcacgcggcggcggacgggctcccaatcatacccaggacagttgatgggaagcggcgacccggcgccatcttcgtgctcgagagggcctgtctcgaggtcggcaaagtcggcaagactatgcaaatcttgaactcagatgatcatgcaaattatttgaggaagcagaatcgcaatcctgcagattataggcctgatatcattcatcaggctctactagcaatatttgatagccctctaactaaggctggaaggttacaggctgtttatgtaaggactgaaaagggagtattgtttgaaatcaaacctcatgtccgcatgccaagaacatttaaacgtttctgtggtttaatgtcacaattgttacaaaaactgagcattacggcagttgggaagcgtgagaagcttcttaatgttgttaaaaatcctgttacccgctatctacctgttggtgcacgtaagattggcctttcatttagtgctgagaagtcagtcaacttgtttgactatgttgccaaatccagtgacgatgaaccccttgtgtttgtggttggtgccatggcccatggaaagatcgacaaggaatacacagatgactacatacaaatttgcaactaccctctcagtgccgcctgctgtttaaatcggatatgcagtgctctggagcagaagtggaacatccaatga

SEQ ID NO: 1956 - protein, 280 aa, Sorghum bicolor
  misc_feature: Ceres ANNOT ID no. 6017503
  misc_feature (109)..(275): Pfam Id: Nep1 Pfam Desc: Nep1 ribosome biogenesis protein
  misc_feature (1)..(279): NCBI GI: 140069739 NCBI Desc: suppressor mra1 [medicago truncatula]
  misc_feature (76)..(279): NCBI GI: 55241966 NCBI Desc: ensangp00000016225 [anopheles gambiae str. pest]
  misc_feature (76)..(279): NCBI GI: 108882524 NCBI Desc: nucleolar essential protein 1 (nep1) [aedes aegypti]
  misc_feature (42)..(279): NCBI GI: 2276396 NCBI Desc: c2f [homo sapiens]
  misc_feature (42)..(279): NCBI GI: 119609102 NCBI Desc: emg1 nucleolar protein homolog (s. cerevisiae), isoform cra_c [homo sapiens]
MVRPYAVKGRKKKRKLEEASASGAAPPAEEAEELPPPEVGSGEEDEAAAGKEEHAAADGLPIIPRTVDGKRRPGAIFVLERACLEVGKVGKTMQILNSDDHANYLRKQNRNPADYRPDIIHQALLAIFDSPLTKAGRLQAVYVRTEKGVLFEIKPHVRMPRTFKRFCGLMSQLLQKLSITAVGKREKLLNVVKNPVTRYLPVGARKIGLSFSAEKSVNLFDYVAKSSDDEPLVFVVGAMAHGKIDKEYTDDYIQICNYPLSAACCLNRICSALEQKWNIQ

SEQ ID NO: 1957 - DNA, 1803 bp, Sorghum bicolor
  misc_feature: Ceres ANNOT ID no. 6017514
  misc_feature: Encodes the peptide sequence at SEQ ID NO 1958
atggcttccgccaaggagacctatcgcgccgagctccgcgccgccgcccgccagcttggagagcgctgcctctactccgccgctaaatgggccgccgagctgctcgtcggtgtagagccggatgcggccccggtcccgtcggccgtgatggacaccccttcctcctcgtccgcgacctccgcggggcggctattgcacctgcaccgtagtgggggttccagcttccgccaccgcccccgccccgctggcggcggcactagctcggaggccgggacccctctcggtggcgtgtcgtacgtcagcacgcccatccccgacgacgatgcgttcgattcgggcggcgacaagtacctgctggccaagacctatttcgactgtcgggagtaccgccgcgctgcgcatgtgctgcagaagcaggtcgggcgtaaggctgtgttcctgcgatgctacgcgctctacatggctggagagaagcggaaagaggcagagatgatagagcttgaaggatcgttgggcaagagtaatgctgttaatcaggaactaattgctttggagaaagagctctcaacacataaaagaactggatctattgattcgtttggactctacttgtatggcattgttctacgtgataaaggatgtgaaggtctagctagaacgatcttggtagaatctgtcaatagctatccttggaactggagtgcttggtcagagttacaatctttatgtaccagcagtgacattttaaacaagttaaatctgaagaatcactggatgaaagacttctttcttgctagtgcatatttggaactaaagatgcatgaagaagctcttaaaagatatgaacgcttgatgggggtcttccgctgcagtggttacattcaggctcaaattgcaacagttcagtacagtatgagggaccttgatgaagctgagatgattttcgaagatctgctcaggactgatccttttcgtgtggattctatggatatttactcaaatttactatatgcaaaagaaagcttgactgctttgagtttccttgcgcacagagtatttttgacagataaataccgcccagaatcttgctgcataattgcaaattactacagtctgaagggtcagcatgagaaatcagttttgtactttcaaagggcactaaagcttaatcgaaagtacctctcagcttggaccctgatggggcatgagtatgttgaactgaagaatactcctgctgcaattgatgcctacagaagagctgttgatattaatcctagagatttccgtgcttggtatggtcttggtcaaatctatgagatgatggggatgccgttttatgcacttcattacttccggaaatcgtcatacttgcaacccaatgatgctcgtctctggattgccatggctcagtgttacgaaagtgatccacttcaaatgattgaagaagccatcaagtgctatgagagagctgcagatagcaatgacactgaaggaatagcacttcaccaactagcaaaattgcatggaatgctggggcaatctgaggaagctgcgttctactacaagaaggatttagagagaatggaggttgaggaaaggcaaggccagaatgttgttgaagctctgctgttccttgctaagtataacaagagcataggcaagtttgaggaagcagaggactattgtacaaggcttttggattacactggcccagagaaggagactgctaaaaatctgttgcaagggataaaaaggttacagtcaggatttccatcaatgaatactgatcattttgcactgtaa

SEQ ID NO: 1958 - protein, 600 aa, Sorghum bicolor
  misc_feature: Ceres ANNOT ID no. 6017514
  misc_feature (1)..(182): Pfam Id: APC8 Pfam Desc: Anaphase promoting complex subunit 8 / Cdc23
  misc_feature (360)..(393): Pfam Id: TPR_1 Pfam Desc: Tetratricopeptide repeat
  misc_feature (394)..(427): Pfam Id: TPR_1 Pfam Desc: Tetratricopeptide repeat
  misc_feature (428)..(461): Pfam Id: TPR_1 Pfam Desc: Tetratricopeptide repeat
  misc_feature (360)..(393): Pfam Id: TPR_2 Pfam Desc: Tetratricopeptide repeat
  misc_feature (394)..(427): Pfam Id: TPR_2 Pfam Desc: Tetratricopeptide repeat
  misc_feature (428)..(461): Pfam Id: TPR_2 Pfam Desc: Tetratricopeptide repeat
  misc_feature (1)..(600): NCBI GI: 14140153 NCBI Desc: anaphase-promoting complex subunit 8-like protein [oryza sativa]
  misc_feature (71)..(600): NCBI GI: 23198162 NCBI Desc: cell division cycle protein 23-like protein [arabidopsis thaliana]
  misc_feature (179)..(583): NCBI GI: 28828076 NCBI Desc: similar to arabidopsis thaliana (mouse-ear cress). cell division cycle protein 23-like protein (at3g48150/t24c20_30) [dictyostelium discoideum]
  misc_feature (103)..(588): NCBI GI: 61359751 NCBI Desc: cdc23 [synthetic construct]
  misc_feature (103)..(588): NCBI GI: 6180017 NCBI Desc: anaphase-promoting complex subunit 8 [homo sapiens]
  misc_feature: Useful for making plants with altered Lignin content
  misc_feature: Useful for making plants with altered cell wall content and/or composition
  misc_feature: GREAT-hit functional homolog of the protein sequence given in SEQ ID NO 13206
  misc_feature: GREAT-hit functional homolog of the protein sequence given in SEQ ID NO 13207
  misc_feature: The sequence is a functional homolog of SEQ ID NO. 298 in the 11/188,298 US application
MASAKETYRAELRAAARQLGERCLYSAAKWAAELLVGVEPDAAPVPSAVMDTPSSSSATSAGRLLHLHRSGGSSFRHRPRPAGGGTSSEAGTPLGGVSYVSTPIPDDDAFDSGGDKYLLAKTYFDCREYRRAAHVLQKQVGRKAVFLRCYALYMAGEKRKEAEMIELEGSLGKSNAVNQELIALEKELSTHKRTGSIDSFGLYLYGIVLRDKGCEGLARTILVESVNSYPWNWSAWSELQSLCTSSDILNKLNLKNHWMKDFFLASAYLELKMHEEALKRYERLMGVFRCSGYIQAQIATVQYSMRDLDEAEMIFEDLLRTDPFRVDSMDIYSNLLYAKESLTALSFLAHRVFLTDKYRPESCCIIANYYSLKGQHEKSVLYFQRALKLNRKYLSAWTLMGHEYVELKNTPAAIDAYRRAVDINPRDFRAWYGLGQIYEMMGMPFYALHYFRKSSYLQPNDARLWIAMAQCYESDPLQMIEEAIKCYERAADSNDTEGIALHQLAKLHGMLGQSEEAAFYYKKDLERMEVEERQGQNVVEALLFLAKYNKSIGKFEEAEDYCTRLLDYTGPEKETAKNLLQGIKRLQSGFPSMNTDHFAL

SEQ ID NO: 1959 - DNA, 795 bp, Sorghum bicolor
  misc_feature: Ceres ANNOT ID no. 6017518
  misc_feature: Encodes the peptide sequence at SEQ ID NO 1960
atgagcttgcttgtgactgccagcttcgcacagtgttcatcgcccaccatggaagaagagcgagcactgtccccggtgtccgacgcctgcaccacctgcagcagctccggcgccggtactaccggccccaactcccctgtctcttcgtcgtcgcagtctttggatgacaccagcggcggcggctcgagcagccggaagcggccgcgccgggagctcaagcacccaacgtaccgcggcgtccgcatgcgcgcgtggggcaagtgggtgtccgagatccgggagccccgcaagaagtcccgcatctggctgggcaccttcgacacccccgagatggccgcgcgcgcgcacgacgtcgccgcgctcgccatcaagggccgcgccgcgcacctcaacttcccggagatgtcccacgagctgccccgcgcggcatcggcggcgcccgaggacgtgcgtgccgcggcggcgctcgcggccgcgatggacaggagggagagcgtggcgccgctgcccacgtctagcgattctagccacggcgcccgcaatgacgaaagtgaagagccggccgcatctagctcctccggcaacgacgccgacgacagtgtccagagcgatgagccggctgcgccgccgtctgagcattcgatgctggtggacgggcacatccttgatctcgcgctcttcgagctgccggacgttctactcgagttcggcttcgcgctgccgccaccgccgtcgtcgacgtcttgtggctacgatttgtcctgggacgagccgttgctgctctgggagcactga

SEQ ID NO: 1960 - protein, 264 aa, Sorghum bicolor
  misc_feature: Ceres ANNOT ID no. 6017518
  misc_feature (75)..(126): Pfam Id: AP2 Pfam Desc: AP2 domain
  misc_feature (17)..(264): NCBI GI: 116310705 NCBI Desc: osigba0134h18.5 [oryza sativa (indica cultivar-group)]
  misc_feature (31)..(206): NCBI GI: 60547461 NCBI Desc: hvcbf7 [hordeum vulgare subsp. vulgare]
  misc_feature (64)..(263): NCBI GI: 21908034 NCBI Desc: dre binding factor 2 [zea mays]
  misc_feature (64)..(263): NCBI GI: 25990951 NCBI Desc: dreb-like protein [zea mays]
  misc_feature (38)..(204): NCBI GI: 32455220 NCBI Desc: transcription factor [oryza sativa (japonica cultivar-group)]
  misc_feature: The plant flowers significantly late compared to wild-type.
  misc_feature: The plant is abnormally small.
  misc_feature: The sequence is a functional homolog of SEQ ID NO 1050 in the 10/666,642US patent application
  misc_feature: The sequence is a functional homolog of SEQ ID NO 1222 in the 10/374,780US patent application
  misc_feature: The sequence is a functional homolog of SEQ ID NO 1223 in the 10/374,780US patent application
  misc_feature: The sequence is a functional homolog of SEQ ID NO 1227 in the 10/374,780US patent application
  misc_feature: The sequence is a functional homolog of SEQ ID NO 1232 in the 10/374,780US patent application
  misc_feature: The sequence is a functional homolog of SEQ ID NO 1233 in the 10/374,780US patent application
  misc_feature: The sequence is a functional homolog of SEQ ID NO 1234 in the 10/374,780US patent application
  misc_feature: The sequence is a functional homolog of SEQ ID NO 1411 in the 10/412,699US patent application
  misc_feature: The sequence is a functional homolog of SEQ ID NO 1412 in the 10/412,699US patent application
  misc_feature: The sequence is a functional homolog of SEQ ID NO 164 in the 11/375,241US patent application
  misc_feature: The sequence is a functional homolog of SEQ ID NO 2233 in the 10/666,642US patent application
  misc_feature: The sequence is a functional homolog of SEQ ID NO 706 in the 11/435,388US patent application
  misc_feature: The sequence is a functional homolog of SEQ ID NO 712 in the 11/435,388US patent application
  misc_feature: The sequence is a functional homolog of SEQ ID NO 716 in the 11/435,388US patent application
  misc_feature: The sequence is a functional homolog of SEQ ID NO 718 in the 11/435,388US patent application
  misc_feature: The sequence is a functional homolog of SEQ ID NO 776 in the 11/435,388US patent application
  misc_feature: The sequence is a functional homolog of SEQ ID NO 778 in the 11/435,388US patent application
  misc_feature: The sequence is a functional homolog of SEQ ID NO 780 in the 11/435,388US patent application
  misc_feature: The sequence is a functional homolog of SEQ ID NO 96 in the 10/714,887US patent application
  misc_feature: The sequence is a functional homolog of SEQ ID NO 96 in the 11/435,388US patent application
  misc_feature: Useful for making plants with altered Lignin content
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 12893
  misc_feature: Functional homolog of the protein sequence given in SEQ ID NO 13073
  misc_feature: The sequence is a functional homolog of SEQ ID NO 1411 in the 20040045049 US patent application
  misc_feature: The sequence is a functional homolog of SEQ ID NO 1412 in the 20040045049 US patent application
  misc_feature: The sequence is a functional homolog of SEQ ID NO 96 in the 20060015972 US patent application
  misc_feature: The sequence is a functional homolog of SEQ ID NO 1227 in the 20060162006 US patent application
  misc_feature: The sequence is a functional homolog of SEQ ID NO 1232 in the 20060162006 US patent application
  misc_feature: The sequence is a functional homolog of SEQ ID NO 1233 in the 20060162006 US patent application
  misc_feature: The sequence is a functional homolog of SEQ ID NO 1234 in the 20060162006 US patent application
  misc_feature: The sequence is a functional homolog of SEQ ID NO 776 in the 20060272060 US patent application
  misc_feature: The sequence is a functional homolog of SEQ ID NO 778 in the 20060272060 US patent application
  misc_feature: The sequence is a functional homolog of SEQ ID NO 780 in the 20060272060 US patent application
  misc_feature: The sequence is a functional homolog of SEQ ID NO 1050 in the 20070033671 US patent application
  misc_feature: The sequence is a functional homolog of SEQ ID NO 159 in the 11/479,226 US patent application
  misc_feature: The sequence is a functional homolog of SEQ ID NO 2218 in the 10/374,780 US patent application
  misc_feature: The sequence is a functional homolog of SEQ ID NO 36 in the 10/412,699 US patent application
  misc_feature: The sequence is a functional homolog of SEQ ID NO 466 in the 11/435,388 US patent application
  misc_feature: The sequence is a functional homolog of SEQ ID NO 492 in the 10/225,066 US patent application
  misc_feature: The sequence is a functional homolog of SEQ ID NO 2602 in the 10/374,780 US patent application
  misc_feature: The sequence is a functional homolog of SEQ ID NO 656 in the 11/435,388 US patent application
  misc_feature: The sequence is a functional homolog of SEQ ID NO 68 in the 10/225,066 US patent application
  misc_feature: Useful for biocontainment applications
  misc_feature: Useful for making plants with modulated flowering time
  misc_feature: Functional homolog of the protein sequence given in SEQ ID NO 13724
  misc_feature: The sequence is a functional homolog of SEQ ID NO 16 in the 10/412,699 US patent application
  misc_feature: The sequence is a functional homolog of SEQ ID NO 164 in the 11/375,241 US patent application
  misc_feature: The sequence is a functional homolog of SEQ ID NO 2233 in the 10/666,642 US patent application
  misc_feature: The sequence is a functional homolog of SEQ ID NO 96 in the 10/714,887 US patent application
  misc_feature: The sequence is a functional homolog of SEQ ID NO 96 in the 11/435,388 US patent application
  misc_feature: Useful for making plants with altered lignin content
  misc_feature: Functional homolog of the protein sequence given in SEQ ID NO 13219
  misc_feature: Useful for making plants with altered lutein content
  misc_feature: Useful for making plants with modulated biomass
  misc_feature: Functional homolog of the protein sequence given in SEQ ID NO 13470
  misc_feature: The sequence is a functional homolog of SEQ ID NO. 274 in the 11/188,298 US application
MSLLVTASFAQCSSPTMEEERALSPVSDACTTCSSSGAGTTGPNSPVSSSSQSLDDTSGGGSSSRKRPRRELKHPTYRGVRMRAWGKWVSEIREPRKKSRIWLGTFDTPEMAARAHDVAALAIKGRAAHLNFPEMSHELPRAASAAPEDVRAAAALAAAMDRRESVAPLPTSSDSSHGARNDESEEPAASSSSGNDADDSVQSDEPAAPPSEHSMLVDGHILDLALFELPDVLLEFGFALPPPPSSTSCGYDLSWDEPLLLWEH

SEQ ID NO: 1961 - DNA, 705 bp, Sorghum bicolor
  misc_feature: Ceres ANNOT ID no. 6017519
  misc_feature: Encodes the peptide sequence at SEQ ID NO 1962
atggccatggacgactcgtcctccggctccgagcccgagcccacctcgtcgtcctccgtggaggctcccgcgtccccgaccgcgtcgtcctccgactccgcctccgccgcgggcagcgacagcaagaagcggcggcgcaccaaggacgggcaccacccgacgtaccgcggcgtgcgcatgcgggcctggggcaagtgggtgtcggagatccgggagccccgcaagaagtcgcgcatctggctcggcaccttcgccaccgccgagatggcggcgcgcgcccacgacgtggccgcgctgcgattcaagggccgcgccgcgcacctcaacttcccggagctcgcgggcgagctcccgcgcccggccaccgccgcgcccaaggacgtccaggccgccgccgcgctcgccgccgccgcggacttcccggcaacgcccgccaatgcagccggcgccgacgacgactgtggcccggacgccagcgccgcctccgacgacgtctccgcctccgcctcgccaccgccggcaacgacgctggacaaccccgacgacgcgctgttcgacctccccgacctcctcctcgacctcagacacggggcctcgtcgtgccagctgctctcgtgcgcgccgtcgtggtacgacgacgtgtgcttctccggcgccgccgccggtgcgttccgcctggaggagccgctgctgtgggagtactga

SEQ ID NO: 1962 - protein, 234 aa, Sorghum bicolor
  misc_feature: Ceres ANNOT ID no. 6017519
  misc_feature (53)..(104): Pfam Id: AP2 Pfam Desc: AP2 domain
  misc_feature (2)..(234): NCBI GI: 60547461 NCBI Desc: hvcbf7 [hordeum vulgare subsp. vulgare]
  misc_feature (3)..(234): NCBI GI: 32455220 NCBI Desc: transcription factor [oryza sativa (japonica cultivar-group)]
  misc_feature (3)..(234): NCBI GI: 116310707 NCBI Desc: osigba0134h18.7 [oryza sativa (indica cultivar-group)]
  misc_feature (18)..(233): NCBI GI: 21908034 NCBI Desc: dre binding factor 2 [zea mays]
  misc_feature (18)..(233): NCBI GI: 25990951 NCBI Desc: dreb-like protein [zea mays]
  misc_feature: The plant is abnormally small.
  misc_feature: The sequence is a functional homolog of SEQ ID NO 1222 in the 10/374,780US patent application
  misc_feature: The sequence is a functional homolog of SEQ ID NO 1226 in the 10/374,780US patent application
  misc_feature: The sequence is a functional homolog of SEQ ID NO 1234 in the 10/374,780US patent application
  misc_feature: The sequence is a functional homolog of SEQ ID NO 1291 in the 10/374,780US patent application
  misc_feature: The sequence is a functional homolog of SEQ ID NO 1411 in the 10/412,699US patent application
  misc_feature: The sequence is a functional homolog of SEQ ID NO 164 in the 11/375,241US patent application
  misc_feature: The sequence is a functional homolog of SEQ ID NO 2233 in the 10/666,642US patent application
  misc_feature: The sequence is a functional homolog of SEQ ID NO 24 in the 10/225,066US patent application
  misc_feature: The sequence is a functional homolog of SEQ ID NO 242 in the 10/225,066US patent application
  misc_feature: The sequence is a functional homolog of SEQ ID NO 2494 in the 10/374,780US patent application
  misc_feature: The sequence is a functional homolog of SEQ ID NO 2596 in the 10/374,780US patent application
  misc_feature: The sequence is a functional homolog of SEQ ID NO 290 in the 10/374,780US patent application
  misc_feature: The sequence is a functional homolog of SEQ ID NO 36 in the 11/375,241US patent application
  misc_feature: The sequence is a functional homolog of SEQ ID NO 440 in the 10/374,780US patent application
  misc_feature: The sequence is a functional homolog of SEQ ID NO 6 in the 10/225,066US patent application
  misc_feature: The sequence is a functional homolog of SEQ ID NO 644 in the 10/225,066US patent application
  misc_feature: The sequence is a functional homolog of SEQ ID NO 712 in the 11/435,388US patent application
  misc_feature: The sequence is a functional homolog of SEQ ID NO 776 in the 11/435,388US patent application
  misc_feature: The sequence is a functional homolog of SEQ ID NO 778 in the 11/435,388US patent application
  misc_feature: The sequence is a functional homolog of SEQ ID NO 780 in the 11/435,388US patent application
  misc_feature: The sequence is a functional homolog of SEQ ID NO 96 in the 10/714,887US patent application
  misc_feature: The sequence is a functional homolog of SEQ ID NO 96 in the 11/435,388US patent application
  misc_feature: Useful for making plants with altered Lignin content
  misc_feature: Useful for making plants with modulated biomass
  misc_feature: Useful for making plants with modulated growth and phenotype characteristics
  misc_feature: GREAT-hit functional homolog of the protein sequence given in SEQ ID NO 13073
  misc_feature: The sequence is a functional homolog of SEQ ID NO 1411 in the 20040045049 US patent application
  misc_feature: The sequence is a functional homolog of SEQ ID NO 24 in the 20050160493 US patent application
  misc_feature: The sequence is a functional homolog of SEQ ID NO 242 in the 20050160493 US patent application
  misc_feature: The sequence is a functional homolog of SEQ ID NO 6 in the 20050160493 US patent application
  misc_feature: The sequence is a functional homolog of SEQ ID NO 644 in the 20050160493 US patent application
  misc_feature: The sequence is a functional homolog of SEQ ID NO 96 in the 20060015972 US patent application
  misc_feature: The sequence is a functional homolog of SEQ ID NO 1226 in the 20060162006 US patent application
  misc_feature: The sequence is a functional homolog of SEQ ID NO 1234 in the 20060162006 US patent application
  misc_feature: The sequence is a functional homolog of SEQ ID NO 1291 in the 20060162006 US patent application
  misc_feature: The sequence is a functional homolog of SEQ ID NO 776 in the 20060272060 US patent application
  misc_feature: The sequence is a functional homolog of SEQ ID NO 778 in the 20060272060 US patent application
  misc_feature: The sequence is a functional homolog of SEQ ID NO 780 in the 20060272060 US patent application
  misc_feature: The sequence is a functional homolog of SEQ ID NO 16 in the 10/412,699 US patent application
  misc_feature: Useful for making plants with altered lignin content
  misc_feature: Functional homolog of the protein sequence given in SEQ ID NO 13219
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: The sequence is a functional homolog of SEQ ID NO. 274 in the 11/188,298 US application
MAMDDSSSGSEPEPTSSSSVEAPASPTASSSDSASAAGSDSKKRRRTKDGHHPTYRGVRMRAWGKWVSEIREPRKKSRIWLGTFATAEMAARAHDVAALRFKGRAAHLNFPELAGELPRPATAAPKDVQAAAALAAAADFPATPANAAGADDDCGPDASAASDDVSASASPPPATTLDNPDDALFDLPDLLLDLRHGASSCQLLSCAPSWYDDVCFSGAAAGAFRLEEPLLWEY

SEQ ID NO: 1963 - DNA, 795 bp, Sorghum bicolor
  misc_feature: Ceres ANNOT ID no. 6017532
  misc_feature: Encodes the peptide sequence at SEQ ID NO 1964
atggctaccaagatggtcctgtgtcgctttgtggccttggcggctctcgcctgcctcctccgccctggcgcgcccgtcgagctccaccgcaggctctccgcctggtccggcgacgccggcgcgacgtggtacggcgcacccaccggcgctgggagcgacggtggtgcgtgcgggtaccagaacgccgtcgaccagccgccgttctcgtccatgatcgccgccggcagcccgtccatcttccagaacggcgagggctgcggctcctgctatcaggtgaaatgcaccggtcacgcgtcgtgctccggcagcccggtgacggtggtcctgaccgacgagtgccccggcggcgcgtgcctggccgagcccgtgcacttcgacctgagcggcacggcgttcggagccctggcgaagcccggccaggccgaccagctccgcagcgccggactcctcaagatccagtacactcgggtgccgtgcaactggaacgggatggacatcgcgttcaaggtggacggcgggtcgaacgcgaactacttggcggtgctgatcgagtacgagtccggcgacggcgagctgaggtccgtggagctcatgcagcgcggcggcgcggcgtgggcgccgatgcagcggtcgtggggcgccgtgtggaggtacaactccggcgccgccctgcaggcgcccttctccgtccgcctcacctccggctccggcaggacggtcgtggccaccaacgtcatccccgcggggtggtcgcccggcgccacgtaccgctcggtcgtcaacttcaacaactaa

SEQ ID NO: 1964 - protein, 264 aa, Sorghum bicolor
  misc_feature: Ceres ANNOT ID no. 6017532
  misc_feature (166)..(247): Pfam Id: Pollen_allerg_1 Pfam Desc: Pollen allergen
  misc_feature (72)..(154): Pfam Id: DPBB_1 Pfam Desc: Rare lipoprotein A (RlpA)-like double-psi beta-barrel
  misc_feature (4)..(262): NCBI GI: 21666630 NCBI Desc: beta-expansin osexpb15 [oryza sativa]
  misc_feature (4)..(262): NCBI GI: 75144406 NCBI Desc: expansin-b15 precursor (osexpb15) (beta-expansin-15) (osaexpb1.16)
  misc_feature (4)..(262): NCBI GI: 116310398 NCBI Desc: osigba0143n19.1 [oryza sativa (indica cultivar-group)]
  misc_feature (4)..(262): NCBI GI: 75110761 NCBI Desc: expansin-b18 precursor (osexpb18) (beta-expansin-18) (osaexpb1.15)
  misc_feature (4)..(261): NCBI GI: 115459802 NCBI Desc: os04g0552000 [oryza sativa (japonica cultivar-group)]
  misc_feature: Useful for making plants with altered cell wall content and/or composition
  misc_feature: GREAT-hit functional homolog of the protein sequence encoded by LOCUS at2g45110
  misc_feature: Useful for making plants with altered carbohydrate content
  misc_feature: Functional homolog of the protein sequence given in SEQ ID NO 13767
  misc_feature: Useful for making plants with altered cell wall content and/or composition
  misc_feature: Functional homolog of the protein sequence given in SEQ ID NO 13768
MATKMVLCRFVALAALACLLRPGAPVELHRRLSAWSGDAGATWYGAPTGAGSDGGACGYQNAVDQPPFSSMIAAGSPSIFQNGEGCGSCYQVKCTGHASCSGSPVTVVLTDECPGGACLAEPVHFDLSGTAFGALAKPGQADQLRSAGLLKIQYTRVPCNWNGMDIAFKVDGGSNANYLAVLIEYESGDGELRSVELMQRGGAAWAPMQRSWGAVWRYNSGAALQAPFSVRLTSGSGRTVVATNVIPAGWSPGATYRSVVNFNN

SEQ ID NO: 1965 - DNA, 888 bp, Sorghum bicolor
  misc_feature: Ceres ANNOT ID no. 6017534
  misc_feature: Encodes the peptide sequence at SEQ ID NO 1966
atggcgaaatcttacaccttcctgttcggtgcactggtcgtcctcgcgcttctagtgagccccattgcttgctcccgcaagctcgccaagccgaacaaacacaagcccacccacaagccggctgccagggtcgtcgcgccccgcagcaactacacctccaccccctcggcgtccgacgcatacggctccggcggctggctgtctgccggcgcgacgtactacggcgccccaaacggcgacggcagtgacggcggtgcgtgcggataccagaccgccgtcgggcagcggcccttctcgtcgatgatcgccgccgggagcccgtctctgttcaagggaggcaagggctgcggcgcctgctacgaggttaaatgcgacagcaacgcggcgtgctccggccagccggccaccgtggtcatcaccgacgagtgccccggcggtgtctgccttgcggaggcggctcacttcgacatgagcggcacttccatgggcgccatggccaagcccggcatggccgacaggcttcgcgccgccggcatcctcaagatccagtacaagagggtgccgtgcaagtacagcggcgtgaacatcgccttcagggtggaccagggctccaacccattctacttggaggtgctggtggagttcgaggacggcgacggcgacctcagcgccgtggacctgatggaggccggttgcggcacctggacgccgatggtgcagaactggggcgcgctgtggcgctacaactccaacaccggcaaggcgctcaaggcgcccttctcgctccgcctcacctccgactccggcaaggtgctcgtcgccaacaacgtcatccccgccggctggaaccccggcgcaacgtaccgctccctggtcaactactcctaa

SEQ ID NO: 1966 - protein, 295 aa, Sorghum bicolor
  misc_feature: Ceres ANNOT ID no. 6017534
  misc_feature (196)..(279): Pfam Id: Pollen_allerg_1 Pfam Desc: Pollen allergen
  misc_feature (102)..(184): Pfam Id: DPBB_1 Pfam Desc: Rare lipoprotein A (RlpA)-like double-psi beta-barrel
  misc_feature (1)..(295): NCBI GI: 75123238 NCBI Desc: expansin-b11 precursor (osexpb11) (beta-expansin-11) (osaexpb1.20)
  misc_feature (1)..(295): NCBI GI: 16517013 NCBI Desc: beta-expansin osexpb11 [oryza sativa]
  misc_feature (1)..(294): NCBI GI: 14193767 NCBI Desc: beta-expansin 4 [zea mays]
  misc_feature (1)..(294): NCBI GI: 44894810 NCBI Desc: expansin expb9 [triticum aestivum]
  misc_feature (50)..(295): NCBI GI: 116310399 NCBI Desc: osigba0143n19.2 [oryza sativa (indica cultivar-group)]
  misc_feature: Useful for making plants with altered cell wall content and/or composition
  misc_feature: Functional homolog of the protein sequence encoded by LOCUS at2g45110
  misc_feature: Useful for making plants with altered carbohydrate content
  misc_feature: Functional homolog of the protein sequence given in SEQ ID NO 13769
  misc_feature: Useful for making plants with altered cell wall content and/or composition
  misc_feature: Functional homolog of the protein sequence given in SEQ ID NO 13768
MAKSYTFLFGALVVLALLVSPIACSRKLAKPNKHKPTHKPAARVVAPRSNYTSTPSASDAYGSGGWLSAGATYYGAPNGDGSDGGACGYQTAVGQRPFSSMIAAGSPSLFKGGKGCGACYEVKCDSNAACSGQPATVVITDECPGGVCLAEAAHFDMSGTSMGAMAKPGMADRLRAAGILKIQYKRVPCKYSGVNIAFRVDQGSNPFYLEVLVEFEDGDGDLSAVDLMEAGCGTWTPMVQNWGALWRYNSNTGKALKAPFSLRLTSDSGKVLVANNVIPAGWNPGATYRSLVNYS

SEQ ID NO: 1967 - DNA, 1845 bp, Sorghum bicolor
  misc_feature: Ceres ANNOT ID no. 6017535
  misc_feature: Encodes the peptide sequence at SEQ ID NO 1968
atggcgatggttatggagagccagcagccgctggcgccgccgatgccggtggtccgggcgccgcccctgcctcctcctcctccccctccgccgctgccgccacctccgcaggcgtacaagcaccgctgcagggtgtgcaagaaggggttcatgtgcgggcgcgcgctgggcggccacatgcgggcgcacggcgttaccgaagtcgacgggctcagcgccgacgacgacgacgacctcgacgatgacgcgggcccctttggcggcgcatgggactctacggaggcggcggcggcggcgacgacgacgacgaagcgcatgtactcgctccgcaccaacgcgggccggcacaagaattgcagggtgtgcgagaactgtggcaaggagttcacgtcgtggaaatcgttgctggatcacggcaggtgcagctacgatcggaagaaggacgacctcaatatcgccggcactgacatcgatggcgaagatgaggaggacctaacattggcagccggcggatggtcgaaagggaaacgtacacgccggacaaaggtgatcgttgtggacaatggtccacaaactgatgagccgctgccggtgccggccacctcaagggaggaggaggacctcgccaactgtctcgtcatgctcgcatcatcgcgtggtgacatgcagccacgagctgttgtcgatgtccaaaaacaacagcacgcatcgacgagcaaggacgagcgcgcctcggcaggcaaagatgagcagagatttcttgtgccaccgcaaccaatctctatgttaccacctaccgtaccacagttcaagttcctggcgccaccacaagtgatgccatcgccgcctgtcatatctcgtggattatttgagtgcaaggcatgtaagaaggtgttcacatctcaccaggctctcggcggccaccgtgccagccacaaaaaggtcaaaggatgtttcgcggccaagctagaagagagcagccgcaataacgattccccgcaacccagcgcagcgtcttccaatgacaacgtcaacaagcaggtcgtcgtcgaagccattcctgccatcgtcgacaccacggaatcatcgaatggtgtcgatggcaacgcggaagtcaacaacatgctgctaaatggtagaaccaccgcggttgtcgcggccacctctgcgccagaaatggctaatactgtcatgcaggtcgacgaggcgccctcatcctccaccaccgtctcacccttgaagaagaaggggaaggtgcacgagtgctccatctgccaccgcgtcttcatgtcggggcaagcgctcggcggccacaagcggtgccactggctcacgacgggggccgccggcggggacccgacggtggtcgccaagcttcagcccttcgctcctcatcaagatcatcacgtcatgcacgccgccatgtgccagcagctcacgctgggtcctccgacgatgtatggcacgtcggattcgtgtcttgacctcaacgtgcccatgaatcaatctgcagatccagccgccacgagacaagcagccgggatcaacgaaagcatgctgagcctgaatgcaccggcgtcgctgtacatgcactcatggactggacataccaacaacgacgcgagcaacatgcacaacgacacggcggcgacaagtggtcactgcgacttgccggaggccaccgccgccaccgaggatgaagcggacagtacgagtgccaagcgagccaagatcagtgacctcaaggacatgaacatggctggggagacctcgccgtggctgcaagttggcattgccctaccgtccgagacgaccaacgagagactgctcaagcctaaaggctag

SEQ ID NO: 1968 - protein, 614 aa, Sorghum bicolor
  misc_feature: Ceres ANNOT ID no. 6017535
  misc_feature (20)..(391): NCBI GI: 38345472 NCBI Desc: osjnba0010h02.10 [oryza sativa (japonica cultivar-group)]
  misc_feature (20)..(370): NCBI GI: 116310401 NCBI Desc: osigba0143n19.4 [oryza sativa (indica cultivar-group)]
  misc_feature (16)..(391): NCBI GI: 115459808 NCBI Desc: os04g0552400 [oryza sativa (japonica cultivar-group)]
  misc_feature (39)..(245): NCBI GI: 1786142 NCBI Desc: pethy;zpt4-1 [petunia x hybrida]
  misc_feature (39)..(265): NCBI GI: 63259083 NCBI Desc: cys2/his2 zinc-finger transcription factor [silene latifolia]
  misc_feature: The plant is abnormally small.
  misc_feature: The sequence is a functional homolog of SEQ ID NO 1010 in the 10/666,642US patent application
  misc_feature: The sequence is a functional homolog of SEQ ID NO 1011 in the 10/666,642US patent application
  misc_feature: The sequence is a functional homolog of SEQ ID NO 1012 in the 10/666,642US patent application
  misc_feature: The sequence is a functional homolog of SEQ ID NO 1092 in the 10/666,642US patent application
  misc_feature: The sequence is a functional homolog of SEQ ID NO 1093 in the 10/666,642US patent application
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1213 in the 10/412,699US patent application
  misc_feature: The sequence is a functional homolog of SEQ ID NO 1214 in the 10/412,699US patent application
  misc_feature: The sequence is a functional homolog of SEQ ID NO 1215 in the 10/412,699US patent application
  misc_feature: The sequence is a functional homolog of SEQ ID NO 1288 in the 10/666,642US patent application
  misc_feature: The sequence is a functional homolog of SEQ ID NO 1289 in the 10/666,642US patent application
  misc_feature: The sequence is a functional homolog of SEQ ID NO 1290 in the 10/666,642US patent application
  misc_feature: The sequence is a functional homolog of SEQ ID NO 1291 in the 10/666,642US patent application
  misc_feature: The sequence is a functional homolog of SEQ ID NO 134 in the 10/286,264US patent application
  misc_feature: The sequence is a functional homolog of SEQ ID NO 2 in the 10/374,780US patent application
  misc_feature: The sequence is a functional homolog of SEQ ID NO 228 in the 10/666,642US patent application
  misc_feature: The sequence is a functional homolog of SEQ ID NO 464 in the 11/435,388US patent application
  misc_feature: The sequence is a functional homolog of SEQ ID NO 622 in the 10/374,780US patent application
  misc_feature: The sequence is a functional homolog of SEQ ID NO 623 in the 10/374,780US patent application
  misc_feature: The sequence is a functional homolog of SEQ ID NO 624 in the 10/374,780US patent application
  misc_feature: The sequence is a functional homolog of SEQ ID NO 625 in the 10/374,780US patent application
  misc_feature: The sequence is a functional homolog of SEQ ID NO 831 in the 10/666,642US patent application
  misc_feature: The sequence is a functional homolog of SEQ ID NO 832 in the 10/666,642US patent application
  misc_feature: The sequence is a functional homolog of SEQ ID NO 833 in the 10/666,642US patent application
  misc_feature: The sequence is a functional homolog of SEQ ID NO 896 in the 10/412,699US patent application
  misc_feature: The sequence is a functional homolog of SEQ ID NO 904 in the 10/374,780US patent application
  misc_feature: The sequence is a functional homolog of SEQ ID NO 905 in the 10/374,780US patent application
  misc_feature: The sequence is a functional homolog of SEQ ID NO 906 in the 10/374,780US patent application
  misc_feature: The sequence is a functional homolog of SEQ ID NO 907 in the 10/374,780US patent application
  misc_feature: Useful for making plants with modulated biomass
  misc_feature: Useful for making plants with modulated growth and phenotype characteristics
  misc_feature: The sequence is a functional homolog of SEQ ID NO 134 in the 20030093837 US patent application
  misc_feature: The sequence is a functional homolog of SEQ ID NO 12 in the 20040045049 US patent application
  misc_feature: The sequence is a functional homolog of SEQ ID NO 1213 in the 20040045049 US patent application
  misc_feature: The sequence is a functional homolog of SEQ ID NO 1214 in the 20040045049 US patent application
  misc_feature: The sequence is a functional homolog of SEQ ID NO 1215 in the 20040045049 US patent application
  misc_feature: The sequence is a functional homolog of SEQ ID NO 622 in the 20060162006 US patent application
  misc_feature: The sequence is a functional homolog of SEQ ID NO 623 in the 20060162006 US patent application
  misc_feature: The sequence is a functional homolog of SEQ ID NO 624 in the 20060162006 US patent application
  misc_feature: The sequence is a functional homolog of SEQ ID NO 625 in the 20060162006 US patent application
  misc_feature: The sequence is a functional homolog of SEQ ID NO 907 in the 20060162006 US patent application
  misc_feature: The sequence is a functional homolog of SEQ ID NO 1010 in the 20070033671 US patent application
  misc_feature: The sequence is a functional homolog of SEQ ID NO 1012 in the 20070033671 US patent application
  misc_feature: The sequence is a functional homolog of SEQ ID NO 1092 in the 20070033671 US patent application
  misc_feature: The sequence is a functional homolog of SEQ ID NO 1093 in the 20070033671 US patent application
  misc_feature: The sequence is a functional homolog of SEQ ID NO 831 in the 20070033671 US patent application
  misc_feature: The sequence is a functional homolog of SEQ ID NO 832 in the 20070033671 US patent application
  misc_feature: The sequence is a functional homolog of SEQ ID NO 833 in the 20070033671 US patent application
  misc_feature: Functional homolog of the protein sequence given in SEQ ID NO 13580
  misc_feature: The sequence is a functional homolog of SEQ ID NO. 457 in the 11/188,298 US application
  misc_feature: The sequence is a functional homolog of SEQ ID NO. 351 in the 11/188,298 US application
MAMVMESQQPLAPPMPVVRAPPLPPPPPPPPLPPPPQAYKHRCRVCKKGFMCGRALGGHMRAHGVTEVDGLSADDDDDLDDDAGPFGGAWDSTEAAAAATTTTKRMYSLRTNAGRHKNCRVCENCGKEFTSWKSLLDHGRCSYDRKKDDLNIAGTDIDGEDEEDLTLAAGGWSKGKRTRRTKVIVVDNGPQTDEPLPVPATSREEEDLANCLVMLASSRGDMQPRAVVDVQKQQHASTSKDERASAGKDEQRFLVPPQPISMLPPTVPQFKFLAPPQVMPSPPVISRGLFECKACKKVFTSHQALGGHRASHKKVKGCFAAKLEESSRNNDSPQPSAASSNDNVNKQVVVEAIPAIVDTTESSNGVDGNAEVNNMLLNGRTTAVVAATSAPEMANTVMQVDEAPSSSTTVSPLKKKGKVHECSICHRVFMSGQALGGHKRCHWLTTGAAGGDPTVVAKLQPFAPHQDHHVMHAAMCQQLTLGPPTMYGTSDSCLDLNVPMNQSADPAATRQAAGINESMLSLNAPASLYMHSWTGHTNNDASNMHNDTAATSGHCDLPEATAATEDEADSTSAKRAKISDLKDMNMAGETSPWLQVGIALPSETTNERLLKPKG

SEQ ID NO: 1969 - DNA, 675 bp, Sorghum bicolor
  misc_feature: Ceres ANNOT ID no. 6017540
  misc_feature: Encodes the peptide sequence at SEQ ID NO 1970
atggaattctgcgcgcggcagcagcaggttttcaatctgcagccgccgccgccgactccgaccaccaaacgacagccggcaccgtcgtcggcgagagcagcttggcctcgctcccgacgccccgctgttggtctcctctgttggtcgtcacgccgccatagcctaacactgcaggtcaccgccgccacgaccacgaccacatccacgaacaccatctgcttcaagaacatcatccaggacacgaaattaccgagggcgggcaaatttttcgagttggagatgacggtccgtgactgcgacatcatcgacgtctccggggtcgtgaacaatgctgtatatgctggttatatcgaaacagctcgccaagctatgcttgcaagcctcggcgtctgcacgggctcgatcgtgcgcacaggccgtgccatggcgctctccgagttgaacgtcaggtacttcgcgccactcaagcgcggtgccaagttcgtcgtcatggtgagggttgtccaaatcaagggtgtgcggatgtttatggagcacttgatcgcaacgctgccagaccgcaagctcgtgctagaggccatggcaactgtcgtctgcctcaaccaagactaccgtccaactcgcatgttcccggagatggcgaacctgctgcacttcttctctcatcctaattag

SEQ ID NO: 1970 - protein, 224 aa, Sorghum bicolor
  misc_feature: Ceres ANNOT ID no. 6017540
  misc_feature (105)..(190): Pfam Id: 4HBT Pfam Desc: Thioesterase superfamily
  misc_feature (9)..(221): NCBI GI: 38345477 NCBI Desc: osjnba0010h02.15 [oryza sativa (japonica cultivar-group)]
  misc_feature (89)..(220): NCBI GI: 116310404 NCBI Desc: osigba0143n19.7 [oryza sativa (indica cultivar-group)]
  misc_feature (89)..(220): NCBI GI: 38345476 NCBI Desc: osjnba0010h02.14 [oryza sativa (japonica cultivar-group)]
  misc_feature (94)..(221): NCBI GI: 115459814 NCBI Desc: os04g0553300 [oryza sativa (japonica cultivar-group)]
  misc_feature (41)..(219): NCBI GI: 42563045 NCBI Desc: thioesterase-related [arabidopsis thaliana]
MEFCARQQQVFNLQPPPPTPTTKRQPAPSSARAAWPRSRRPAVGLLCWSSRRHSLTLQVTAATTTTTSTNTICFKNIIQDTKLPRAGKFFELEMTVRDCDIIDVSGVVNNAVYAGYIETARQAMLASLGVCTGSIVRTGRAMALSELNVRYFAPLKRGAKFVVMVRVVQIKGVRMFMEHLIATLPDRKLVLEAMATVVCLNQDYRPTRMFPEMANLLHFFSHPN

SEQ ID NO: 1971 - DNA, 1113 bp, Sorghum bicolor
  misc_feature: Ceres ANNOT ID no. 6017545
  misc_feature: Encodes the peptide sequence at SEQ ID NO 1972
atggatatgagcagcagctcacctgttatcaccgatccaatatcaataagcccaccactgttgggaggcttgacatcaaatctgatgccgttttcagtcatgtctggaggttgctccagtcctagtatgaccgccagtaggcgtaaaattgaggaggtccttgttaatggcctgctagatgcaatgaaatcctcgtcaccgcgcaagaagcacaatctcgcctttggacaggataattcactcgacgaagatcctgcttacagtgcatggctgtcaaaatgcccttctgcgttgacctccttcaagcagatagtagccaatgcacaaggcaggcggattgctgtgttcttggattacgacggtaccctgtcaccaatcgttgatgatcccgacaaagcattcatgtcccctgtgatgagagctgctgtcagaaatgttgcaaagtacttccctactgcaattgtcagtggaaggtcccgtaagaaggtgtctgaatttgtgcaactgaaggaactatactacgctgggagtcatgggatggacatagtgacatctgtagcagcacatgctactgaaaagtgcaaacaagccaatctcttccaacctgcttgtgaatttcttcctatgattgacgaggtttccaagtccctcttggaggtcacgagtggaattgaaggtgcaagggttgagaacaacaagttctgtgtatctgtacattaccgcaacgtagcagagaaggactggaaagtggttgcaggcctcgtaaaacaagtattggaggcctttcctcgtctcaaagtaaccaatgggcgaatggttttagaggttcgcccagtgatcgactgggacaagggaaaggccgtcgagtttctgcttcaatcactcggcttaaacgactctgaagatgtgattcctatctacatcggagatgatcgcacggacgaagacgccttcaaggtacttcgagagcgaaaatgtggatatggaatcctagtttcgcaggtgcccaaggacactactgaagccttctactcgctgagagacccatctgaagtgatggggttcctcaattccttggtgagatggaagaagcactcactgcgacgaaactga

SEQ ID NO: 1972 - protein, 370 aa, Sorghum bicolor
  misc_feature: Ceres ANNOT ID no. 6017545
  misc_feature (116)..(350): Pfam Id: Trehalose_PPase Pfam Desc: Trehalose-phosphatase
  misc_feature (1)..(367): NCBI GI: 45544517 NCBI Desc: trehalose-6-phosphate phosphatase [oryza sativa (japonica cultivar-group)]
  misc_feature (1)..(366): NCBI GI: 51458330 NCBI Desc: trehalose-phosphate phosphatase [nicotiana tabacum]
  misc_feature (1)..(364): NCBI GI: 30725608 NCBI Desc: at5g51460 [arabidopsis thaliana]
  misc_feature (1)..(364): NCBI GI: 9758188 NCBI Desc: trehalose-6-phosphate phosphatase [arabidopsis thaliana]
  misc_feature (6)..(370): NCBI GI: 144924741 NCBI Desc: trehalose-phosphatase [medicago truncatula]
  misc_feature: The plant flowers significantly late compared to wild-type.
  misc_feature: Useful for making plants with modulated drought sensitivity
  misc_feature: Useful for making plants with modulated flowering time
  misc_feature: Functional homolog of the protein sequence given in SEQ ID NO 13348
  misc_feature: The sequence is a functional homolog of SEQ ID NO 16 in US patent 7214858
  misc_feature: Useful for making plants with modulated drought sensitivity
  misc_feature: Useful for making plants with modulated flowering time
  misc_feature: Useful for making plants with modulated water use efficiency
  misc_feature: Functional homolog of the protein sequence given in SEQ ID NO 13348
  misc_feature: Useful for making plants with modulated low light sensitivity
  misc_feature: Functional homolog of the protein sequence given in SEQ ID NO 13725
MDMSSSSPVITDPISISPPLLGGLTSNLMPFSVMSGGCSSPSMTASRRKIEEVLVNGLLDAMKSSSPRKKHNLAFGQDNSLDEDPAYSAWLSKCPSALTSFKQIVANAQGRRIAVFLDYDGTLSPIVDDPDKAFMSPVMRAAVRNVAKYFPTAIVSGRSRKKVSEFVQLKELYYAGSHGMDIVTSVAAHATEKCKQANLFQPACEFLPMIDEVSKSLLEVTSGIEGARVENNKFCVSVHYRNVAEKDWKVVAGLVKQVLEAFPRLKVTNGRMVLEVRPVIDWDKGKAVEFLLQSLGLNDSEDVIPIYIGDDRTDEDAFKVLRERKCGYGILVSQVPKDTTEAFYSLRDPSEVMGFLNSLVRWKKHSLRRN

SEQ ID NO: 1973 - DNA, 594 bp, Sorghum bicolor
  misc_feature: Ceres ANNOT ID no. 6017553
  misc_feature: Encodes the peptide sequence at SEQ ID NO 1974
atggcaaccgcaaccaccacctcgccgccggcgccgtcaaagcccaccctcctaggtggtgtccggggcctagacgcggccgtgtctctccgcctgcacgccctcttcggcccggtgccgcgcctcctcctcaaggcgctcgaggtcgctggcgacggccgcatctggctgcctgtccccatctccctgctcctcctctccgcgtccccggccaacccgatcctggcaggccttgttgctggcctcgtgctggacctcatcctcgtcggcctcgtcaaggtcgtcgtccgccgcccgcgcccggactacaacgccaaggacatgtacgtcgccgtcgccgccgaccactggtctttccccagcggccactcctcccgcgccttcctcgtcgcctccttcctcgccgccgccggcttccgtccccgcgaggcgctcttcctctgggccaccgcgacgtcggcgtccagggtgctccttggccggcactacgtcctcgacgtcgtcgctggggcttgcctcggcgtgttcgaggcctggctcagcaacttgctcttgagattcatgtgcgctcaaagcacctttcttttatgctaa

SEQ ID NO: 1974 - protein, 197 aa, Sorghum bicolor
  misc_feature: Ceres ANNOT ID no. 6017553
  misc_feature (74)..(190): Pfam Id: PAP2 Pfam Desc: PAP2 superfamily
  misc_feature (9)..(181): NCBI GI: 12247468 NCBI Desc: pnfl-1 [ipomoea nil]
  misc_feature (36)..(191): NCBI GI: 55251221 NCBI Desc: novel protein [danio rerio]
  misc_feature (41)..(184): NCBI GI: 24583289 NCBI Desc: cg31717-pa [drosophila melanogaster]
  misc_feature (36)..(177): NCBI GI: 66773040 NCBI Desc: phosphatidic acid phosphatase type 2 domain containing 2 [homo sapiens]
  misc_feature (36)..(177): NCBI GI: 119579189 NCBI Desc: phosphatidic acid phosphatase type 2 domain containing 2 [homo sapiens]
MATATTTSPPAPSKPTLLGGVRGLDAAVSLRLHALFGPVPRLLLKALEVAGDGRIWLPVPISLLLLSASPANPILAGLVAGLVLDLILVGLVKVVVRRPRPDYNAKDMYVAVAADHWSFPSGHSSRAFLVASFLAAAGFRPREALFLWATATSASRVLLGRHYVLDVVAGACLGVFEAWLSNLLLRFMCAQSTFLLC

SEQ ID NO: 1975 - DNA, 360 bp, Sorghum bicolor
  misc_feature: Ceres ANNOT ID no. 6017555
  misc_feature: Encodes the peptide sequence at SEQ ID NO 1976
atggcgtccaaggctttcgtgctgttcctggccgtgaacctggttgtgctcggcgtagccagcgcctggaccccgtcgacaccgacgcccacgccgtcgtcgttcggcaagtgccccagggacgcgctgaagctgggcgtgtgcgctaacgtgctgggcctcatcaaggctaaggtggcagtgccgcccgcggagccttgctgcccgctgctggaggggctcgtcgacctggaggccgccgtctgcctctgcaccgccatcaagggcaacatcctcggcatcaacctcaatctgccaattgatctcagtcttatcctcaactactgtggcaagacagtgcccaccggcttcaagtgctga

SEQ ID NO: 1976 - protein, 119 aa, Sorghum bicolor
  misc_feature: Ceres ANNOT ID no. 6017555
  misc_feature (38)..(119): Pfam Id: Tryp_alpha_amyl Pfam Desc: Protease inhibitor/seed storage/LTP family
  misc_feature (1)..(119): NCBI GI: 39748094 NCBI Desc: lipid transfer protein-like protein [oryza sativa (japonica cultivar-group)]
  misc_feature (1)..(119): NCBI GI: 124484377 NCBI Desc: extensin like protein [ipomoea nil]
  misc_feature (5)..(119): NCBI GI: 110816009 NCBI Desc: hyprp2 [gossypium hirsutum]
  misc_feature (1)..(119): NCBI GI: 4240033 NCBI Desc: zmgr1a [zea mays]
  misc_feature (1)..(119): NCBI GI: 10798758 NCBI Desc: p-rich protein nteig-c29 [nicotiana tabacum]
  misc_feature: Useful for making plants with modulated biomass
  misc_feature: Useful for making plants with modulated flowering time
  misc_feature: Functional homolog of the protein sequence given in SEQ ID NO 13584
  misc_feature: Useful for making plants with modulated oxidative stress sensitivity
  misc_feature: Functional homolog of the protein sequence given in SEQ ID NO 13086
  misc_feature: Useful for making plants with modulated salt sensitivity
  misc_feature: Functional homolog of the protein sequence given in SEQ ID NO 13766
MASKAFVLFLAVNLVVLGVASAWTPSTPTPTPSSFGKCPRDALKLGVCANVLGLIKAKVAVPPAEPCCPLLEGLVDLEAAVCLCTAIKGNILGINLNLPIDLSLILNYCGKTVPTGFKC

SEQ ID NO: 1977 - DNA, 369 bp, Sorghum bicolor
  misc_feature: Ceres ANNOT ID no. 6017558
  misc_feature: Encodes the peptide sequence at SEQ ID NO 1978
atggcgtccaaggcgttcgcgctgttcctggccgtgaacctggttgtgctgggcgtagccagcgcctgtgcgcccaacagcccgacgacacccacgccatcgtcgtcgtcgaacggctcgtgccccagggatgcgttgaagctgggcgtgtgcgccaatgtgctgggcctgatcaaggctcaggtcggcgtgccgcccgcggagccatgctgcccgctgctggcggggctcgtcgacctggaggccgccgtctgtctctgcaccgccatcaaggccaacgtcctcggcatcaacctcaacgtgccactcgatctcagcctcatcctcaactactgcggcaagaccgtgcccaccggcttcatgtgctga

SEQ ID NO: 1978 - protein, 122 aa, Sorghum bicolor
  misc_feature: Ceres ANNOT ID no. 6017558
  misc_feature (41)..(122): Pfam Id: Tryp_alpha_amyl Pfam Desc: Protease inhibitor/seed storage/LTP family
  misc_feature (1)..(122): NCBI GI: 39748094 NCBI Desc: lipid transfer protein-like protein [oryza sativa (japonica cultivar-group)]
  misc_feature (1)..(122): NCBI GI: 124484377 NCBI Desc: extensin like protein [ipomoea nil]
  misc_feature (1)..(122): NCBI GI: 110816009 NCBI Desc: hyprp2 [gossypium hirsutum]
  misc_feature (1)..(122): NCBI GI: 10798758 NCBI Desc: p-rich protein nteig-c29 [nicotiana tabacum]
  misc_feature (1)..(122): NCBI GI: 27765002 NCBI Desc: at4g12520 [arabidopsis thaliana]
  misc_feature: Useful for making plants with modulated biomass
  misc_feature: Useful for making plants with modulated flowering time
  misc_feature: Functional homolog of the protein sequence given in SEQ ID NO 13584
  misc_feature: Useful for making plants with modulated oxidative stress sensitivity
  misc_feature: Functional homolog of the protein sequence given in SEQ ID NO 13086
  misc_feature: Useful for making plants with modulated salt sensitivity
  misc_feature: Functional homolog of the protein sequence given in SEQ ID NO 13766
MASKAFALFLAVNLVVLGVASACAPNSPTTPTPSSSSNGSCPRDALKLGVCANVLGLIKAQVGVPPAEPCCPLLAGLVDLEAAVCLCTAIKANVLGINLNVPLDLSLILNYCGKTVPTGFMC

SEQ ID NO: 1979 - DNA, 369 bp, Sorghum bicolor; identical to SEQ ID NO: 1977
  misc_feature: Ceres ANNOT ID no. 6017560
  misc_feature: Encodes the peptide sequence at SEQ ID NO 1980

SEQ ID NO: 1980 - protein, 122 aa, Sorghum bicolor; identical to SEQ ID NO: 1978
  misc_feature: Ceres ANNOT ID no. 6017560
  misc_feature (41)..(122): Pfam Id: Tryp_alpha_amyl Pfam Desc: Protease inhibitor/seed storage/LTP family
  misc_feature (1)..(122): NCBI GI: 39748094 NCBI Desc: lipid transfer protein-like protein [oryza sativa (japonica cultivar-group)]
  misc_feature (1)..(122): NCBI GI: 124484377 NCBI Desc: extensin like protein [ipomoea nil]
  misc_feature (1)..(122): NCBI GI: 110816009 NCBI Desc: hyprp2 [gossypium hirsutum]
  misc_feature (1)..(122): NCBI GI: 10798758 NCBI Desc: p-rich protein nteig-c29 [nicotiana tabacum]
  misc_feature (1)..(122): NCBI GI: 27765002 NCBI Desc: at4g12520 [arabidopsis thaliana]
  misc_feature: Useful for making plants with modulated biomass
  misc_feature: Useful for making plants with modulated flowering time
  misc_feature: Functional homolog of the protein sequence given in SEQ ID NO 13584
  misc_feature: Useful for making plants with modulated oxidative stress sensitivity
  misc_feature: Functional homolog of the protein sequence given in SEQ ID NO 13086
  misc_feature: Useful for making plants with modulated salt sensitivity
  misc_feature: Functional homolog of the protein sequence given in SEQ ID NO 13766

SEQ ID NO: 1981 - DNA, 369 bp, Sorghum bicolor; identical to SEQ ID NO: 1977
  misc_feature: Ceres ANNOT ID no. 6017562
  misc_feature: Encodes the peptide sequence at SEQ ID NO 1982

SEQ ID NO: 1982 - protein, 122 aa, Sorghum bicolor; identical to SEQ ID NO: 1978
  misc_feature: Ceres ANNOT ID no. 6017562
  misc_feature (41)..(122): Pfam Id: Tryp_alpha_amyl Pfam Desc: Protease inhibitor/seed storage/LTP family
  misc_feature (1)..(122): NCBI GI: 39748094 NCBI Desc: lipid transfer protein-like protein [oryza sativa (japonica cultivar-group)]
  misc_feature (1)..(122): NCBI GI: 124484377 NCBI Desc: extensin like protein [ipomoea nil]
  misc_feature (1)..(122): NCBI GI: 110816009 NCBI Desc: hyprp2 [gossypium hirsutum]
  misc_feature (1)..(122): NCBI GI: 10798758 NCBI Desc: p-rich protein nteig-c29 [nicotiana tabacum]
  misc_feature (1)..(122): NCBI GI: 27765002 NCBI Desc: at4g12520 [arabidopsis thaliana]
  misc_feature: Useful for making plants with modulated biomass
  misc_feature: Useful for making plants with modulated flowering time
  misc_feature: Functional homolog of the protein sequence given in SEQ ID NO 13584
  misc_feature: Useful for making plants with modulated oxidative stress sensitivity
  misc_feature: Functional homolog of the protein sequence given in SEQ ID NO 13086
  misc_feature: Useful for making plants with modulated salt sensitivity
  misc_feature: Functional homolog of the protein sequence given in SEQ ID NO 13766

SEQ ID NO: 1983 - DNA, 2148 bp, Sorghum bicolor
  misc_feature: Ceres ANNOT ID no. 6017571
  misc_feature: Encodes the peptide sequence at SEQ ID NO 1984
atgagggcggcgctgttcggtgcccagcggagcggggctgcggacctcgtcggaggcgggaggacgctgctctggccggaggaggggaaggcgaaggcgcagctggagccgagatccgtgccggactgcacgcggagccccagccccagcaactcaacatcgacgctgtcgtcgtacatgggcggtggcggcgctgcggactcgaccggcggcgtggcggtggtttcgggcagcagcgctgccgccgccgccgacgccgccaaatggggagcctccggcaagcacggcggcggcgggaaggaggactgggcaggcggctgtgcgctgccgccgattcctaccggcctcgacatgggggtcatcggcggcggcgacagctgggacgccatgctcggcagcgcggctgcggcgggacaggaccagacgttcttgaactggatcattggagccgccggcgacctggatcagtcagggccgccgctccccgtgcaccagcagccgctccttgacaatgtgggcttcgggttcccggcggcggaccccctgggtttctcgctcgatccccacctcggcggcgttgcctcggacatgtcgtcccctggtgcggtgtcgcacgctcccaacagcggcggcggtggtggcaacaaggcgtcctcggccttcggcctcttctcaccggagtctgcttcgctccagccgccgccgccgccggtgctgttccacgaaggtatcgacacaaagccccctcttcttggtgcgcagccgcccggccgcctccaccagtaccagcaccagccgacctccgccacaaccttcttcatgcccatcccctccttccccaatcacaatcagcagtcgccactcgtccaaccaccgcccaaacgtcatcaatccataggggatgacctctatctcgcccgaaatcggcttctgcctccgccggcggggcaaggtcacgcctttccaccactaaatggtcctgctctgttccagctccagccttcgccaccaccgccccacggggcgatgaagacgacggctgctgaggcggcgcagcagcagttgctggacgagcttgcggtggcggcaaaggccgccgaagccggcaattccattggcgcgcgagagatattggcgcggctcaatcaccagcttcccccgctcgggaagccgttcctccgctccgcctcctacctcaaggaggccctcctcctcgcgctcgccgaaggccaccatggcggctgccacctcacatcaccgctcgacgttgccctcaagctcgcggcgtacaagactttctctgatcactcgcccgtgctccagttcaccaacttcaccgcaacgcaggcacttctggacgaaattgccggcaacacatcatcctgcatccatgtcatcgattttgatcttgctgttggaggccagtgggcttctttcttgcaggagcttgcacaccgccgtggcgcaggtggtgcagctctgccgttcgtcaagctcactgcctttgtatcagctgcttcccaccatccactggaactgcgtcttgcgcgtgacaacattgcacagtttgctgcagaccttggaattccctttgagttcagtgctatcagtgctgatactatcaaccctacagagctcatttctgccactggtgatgaagttgtagctgttgtcctcccggctggttgctctgctcgtgcaccaccactgccagcgatccttcggttggtgaaacagctggctcctaagattgtgatagccatagaccatggcgctgatcgtgctgatcttcccttctcacagcacttcttgaattgctttcagtcttgcatgttcctccttgattcgcttgatgctgctggcattgatgctgattctgccggcaagattgagaagttccttattcagccaagaattgaggattcagtgcttgggcgggccaaggtggacaagccaattgcatggagaagtgcattcgcagctgctgggttcgcgcctattccgcccagcagtttggctgaggcgcaggctgactgcctcctgaagcgggtgcaggtccgcggtttccacgtggagaaatgtggggtcgggctcacactatactggcagcgaggcgagcttgtcactgtatcagcatggcggtgctga

SEQ ID NO: 1984 - protein, 715 aa, Sorghum bicolor
  misc_feature: Ceres ANNOT ID no. 6017571
  misc_feature (333)..(630): Pfam Id: GRAS Pfam Desc: GRAS family transcription factor
  misc_feature (1)..(715): NCBI GI: 50251746 NCBI Desc: scl1 protein [oryza sativa (japonica cultivar-group)]
  misc_feature (1)..(715): NCBI GI: 38345583 NCBI Desc: osjnbb0012e24.1 [oryza sativa (japonica cultivar-group)]
  misc_feature (182)..(715): NCBI GI: 50251747 NCBI Desc: scl1 protein [oryza sativa (japonica cultivar-group)]
  misc_feature (454)..(715): NCBI GI: 4056615 NCBI Desc: scl1 protein [oryza sativa]
  misc_feature (312)..(715): NCBI GI: 115483306 NCBI Desc: os10g0551200 [oryza sativa (japonica cultivar-group)]
  misc_feature: Useful for making plants with modulated salt sensitivity
  misc_feature: Functional homolog of the protein sequence encoded by LOCUS at4g00150
MRAALFGAQRSGAADLVGGGRTLLWPEEGKAKAQLEPRSVPDCTRSPSPSNSTSTLSSYMGGGGAADSTGGVAVVSGSSAAAAADAAKWGASGKHGGGGKEDWAGGCALPPIPTGLDMGVIGGGDSWDAMLGSAAAAGQDQTFLNWIIGAAGDLDQSGPPLPVHQQPLLDNVGFGFPAADPLGFSLDPHLGGVASDMSSPGAVSHAPNSGGGGGNKASSAFGLFSPESASLQPPPPPVLFHEGIDTKPPLLGAQPPGRLHQYQHQPTSATTFFMPIPSFPNHNQQSPLVQPPPKRHQSIGDDLYLARNRLLPPPAGQGHAFPPLNGPALFQLQPSPPPPHGAMKTTAAEAAQQQLLDELAVAAKAAEAGNSIGAREILARLNHQLPPLGKPFLRSASYLKEALLLALAEGHHGGCHLTSPLDVALKLAAYKTFSDHSPVLQFTNFTATQALLDEIAGNTSSCIHVIDFDLAVGGQWASFLQELAHRRGAGGAALPFVKLTAFVSAASHHPLELRLARDNIAQFAADLGIPFEFSAISADTINPTELISATGDEVVAVVLPAGCSARAPPLPAILRLVKQLAPKIVIAIDHGADRADLPFSQHFLNCFQSCMFLLDSLDAAGIDADSAGKIEKFLIQPRIEDSVLGRAKVDKPIAWRSAFAAAGFAPIPPSSLAEAQADCLLKRVQVRGFHVEKCGVGLTLYWQRGELVTVSAWRC

SEQ ID NO: 1985 - DNA, 2151 bp, Sorghum bicolor
  misc_feature: Ceres ANNOT ID no. 6017574
  misc_feature: Encodes the peptide sequence at SEQ ID NO 1986
atgagggcggcgctgttcggtgcccagcggaacggggctgcggacctcgtcggaggcgggaatacgctgttctggccggaggaggggaaggcgaaggtgctgctggagccgaggtccgtgctggactgcacacggagccccagccctaacaactcgacatcgacgctgtcgtcgtccctgggcggcggcggcggcgctgcggactcgaccggcggcgtggcggcggtttccgacagcagcgctgccgctaccgccgccgaagccaccaaatggggagcccccggcgagtacggcggcggcgggaaggaggactgggccggcggctgtgagctgccgccgattcctaccggcctcaacatggaggtcatcggcggcagcgacagctgggacgccatgctcggcagcgccgctgcggcggggcaggaccagacgttcttgaactggatcattggggccgccggcgacctggatcagtcagggccgccgctccccgtgcaccagcagccgctccttgacaatgtgggcttcgggttcccggcggcggaccccctgggtttctcgctcgatccccacctcggcggcgttgcctcggacatgtcgtcccctggtgcggtgtcgcacgctaccaacagcgctggcggtggcaacaaggcgtcctcggccttcggcctcttctcaccggagtctgcttcgctccagccgccgccgccaccggtgctgttccacgaaggtatcgacacaaagccccctcttcttggtgcgcagccgcccggcctcctccaccagtaccagcaccagccgacccccgccacaaccttcttcatgcccatcccctccttccccaaccacaatcagcagtcgccactcgttcaaccaccgcccaaacgtcatcaatccataggggatgacctctatctcgcccgaaatcggcttctgtctccgccggcggggcaaggtcacgcctttccaccactaaatggtcctgctccgttccagctccagccttcgccaccaccgccccacggggcgatgaagacgacggctgcggaggcagcgcagcagcagttgctggacgagcttgcggcggcggcaaaggccgctgaagccggcaattccattggcgcgcgagagatattggcgcggctcaatcaccagcttcccccgctcgggaagccgttcctccgctccgcctcctacctcaaggaggccctcctcctcgcgctcgccgaaggtcaccatggcggctgccacctcacatcaccgctcgacgttgccctcaagctcgcggcgtacaagactttctctgaccactcgcccgtgctccagttcaccaacttcaccgcaacgcaggcacttctcgacgaaattgccagcagcacatcgtcctgcatccatgtcatcgattttgatcttggcgttggaggccagtgggcttctttcttgcaggagcttgcacaccgccgtggagcaggtggtgcagctctgccgttcgtcaagctcactgcctttgtatcagctgcttcccaccatccactggaactgcgtcttgcgcgtgacaacattgcacagtttgctgcagaccttggaattccctttgggttcagtgctatcagtgctgatacgatcaaccctacagagctaatttctgccactggtgatgaagttgtagctgttgtcctcccggctggttgctctgctcgtgcaccaccactgccagcgatccttcggttggtgaaacagctggctcctaagatcgtgatagccatagaccatggcgctgatcgtgctgatcttcccttctcacagcacttcttgaattgctttcagtcttgcatgttcctccttgattcgcttgatgctgctggcattgatgctgattctgccggcaagattgagaagttcctgattcagccaagaattgaggattcagtgcttgggcggggcaaggtggacaagccaattgcatggagaagtgcatttgcaggtgctgggttcgcacctgttccgcccagcagtttggcggaggcacaggccgactgcctcctgaagcgggtgcaggtccgcggattccacgtggagaaatgtggcgtcgggctcacactatactggcagcgaggcgagcttgtcactgtatcagcatggcggtgctga

SEQ ID NO: 1986 - protein, 716 aa, Sorghum bicolor
  misc_feature: Ceres ANNOT ID no. 6017574
  misc_feature (330)..(631): Pfam Id: GRAS Pfam Desc: GRAS family transcription factor
  misc_feature (1)..(716): NCBI GI: 50251746 NCBI Desc: scl1 protein [oryza sativa (japonica cultivar-group)]
  misc_feature (1)..(716): NCBI GI: 38345583 NCBI Desc: osjnbb0012e24.1 [oryza sativa (japonica cultivar-group)]
  misc_feature (184)..(716): NCBI GI: 50251747 NCBI Desc: scl1 protein [oryza sativa (japonica cultivar-group)]
  misc_feature (455)..(716): NCBI GI: 4056615 NCBI Desc: scl1 protein [oryza sativa]
  misc_feature (313)..(716): NCBI GI: 115483306 NCBI Desc: os10g0551200 [oryza sativa (japonica cultivar-group)]
  misc_feature: Useful for making plants with altered alkaloid content
  misc_feature: Functional homolog of the protein sequence given in SEQ ID NO 13318
MRAALFGAQRNGAADLVGGGNTLFWPEEGKAKVLLEPRSVLDCTRSPSPNNSTSTLSSSLGGGGGAADSTGGVAAVSDSSAAATAAEATKWGAPGEYGGGGKEDWAGGCELPPIPTGLNMEVIGGSDSWDAMLGSAAAAGQDQTFLNWIIGAAGDLDQSGPPLPVHQQPLLDNVGFGFPAADPLGFSLDPHLGGVASDMSSPGAVSHATNSAGGGNKASSAFGLFSPESASLQPPPPPVLFHEGIDTKPPLLGAQPPGLLHQYQHQPTPATTFFMPIPSFPNHNQQSPLVQPPPKRHQSIGDDLYLARNRLLSPPAGQGHAFPPLNGPAPFQLQPSPPPPHGAMKTTAAEAAQQQLLDELAAAAKAAEAGNSIGAREILARLNHQLPPLGKPFLRSASYLKEALLLALAEGHHGGCHLTSPLDVALKLAAYKTFSDHSPVLQFTNFTATQALLDEIASSTSSCIHVIDFDLGVGGQWASFLQELAHRRGAGGAALPFVKLTAFVSAASHHPLELRLARDNIAQFAADLGIPFGFSAISADTINPTELISATGDEVVAVVLPAGCSARAPPLPAILRLVKQLAPKIVIAIDHGADRADLPFSQHFLNCFQSCMFLLDSLDAAGIDADSAGKIEKFLIQPRIEDSVLGRGKVDKPIAWRSAFAGAGFAPVPPSSLAEAQADCLLKRVQVRGFHVEKCGVGLTLYWQRGELVTVSAWRC

SEQ ID NO: 1987 - DNA, 1989 bp, Sorghum bicolor
  misc_feature: Ceres ANNOT ID no. 6017579
  misc_feature: Encodes the peptide sequence at SEQ ID NO 1988
atgacaaccaacgccctcgtccagcaatgcctcgcgctcctcctccgatccaaaagctccgcaaccccgctcgttcccaccaccgccgcccagctccacgcactcctcctcaagtccggtcacctcctccactgcgacagcattcatctcctcttaggctcgtactgcgcgtgtggccgtcccttcgacgcccacaacctgctcgttcaaatgccgcaaccgcccccggtttccgtctccaacaccctcctccgctcctacaccggtctcggcttcaaccgacaggccctcgctctctactcacagatgcgcgccttcgaccacctcaccttcaccttcgctgccaaggcctgtgcggacctccgccgcaggcgccatgggcgtgccgtgcatggccgcgccctcaccgcgggcttcggcggcgacggctacgtccagaacgcgctcgtttccatgtatatgcgctgcagagacgtggtctcggcggaggcggtgttcggcgcgctgcggagccggacaaccgtgtcgtggaacacggtcatcaccgggtgtgtcaaggacggccgcgcggagagggcgttggaggtgttcgagacaatggtcggtcgtggcgtgtgcattgaccgtgccacggtggtgtcagtgctgccagcttgtgcacaagccagggacttgcacatggggagagctgtgcaccggttggctgtggtgagaggcttgggtaactacgccgcggtgaagaacgctctgatagacatgtatgggaagtgcaggagcctggaggatgcaaaaagggtgttcgatgaagacagctatgataaggatgttgtttcatggacggcgatgattggtgcatacgtgctgaatgaccacgcgagcaaggccttcgctcttggttctgagatgctggtgaccagtgaagcacaacctaatgctgtgaccatggtgcatctgctctcagcttgcaccagcttgctgtcagggaagcatgccaagtgcacacatgcgttgtgcattagacttgggcttggatcagatactgtcgttgagactgcacttgttgactgttacgcaaaatgtggctatatggggatgatagacatggtggttgagaaaggatcacgacggactgaaacatggaatgcagcaatctctggttatactcacagagaacagggaaagaaagctctagcgctgtttaagcaaatgcttgcagaatcagtgcgtccagattctgcaacaatggcaagcgtcatcccagcttacgcagaatcggcggacctggtacaggcgaagaacatccactgctgcttactgattcgtggatgtcttgggagtacagatattgccactggtctgatcaatgtgtatgccaaggctggtgacttgggtgtcgcatgggagctcttccagtgtttgcctgaaaaggatgtggttgcctggactactgtcatcgccggatatggaatgcatgggcatgcccaaactgccatcctgctatattccaggatgatagagatgggggtgacgccgaacaccgttaccatggcctccttgatgtactcttgcagccacgccggcatggtagacgaaggccttcggctgttcaatgacatgcgtggcgtccatggcctgatgccaaatgcagagcactacttgtgcctggttgacatgcttgggcgtgctgggaggatcgaggaggcctaccgcctcatccaagacatgccattcgagccgagcacgtcggtgtggagcgctctgctgggtgcctgtgttctccatgagaatgttgagttcggggaggttgctgctaaacatttgtttgaacttgaaccggataacgtcgggaattatgtgctccttgggaaggtatatgctgccgctgacagatggagcgatgttcaggatctgtggagagtgatggagggaaggggtcttcacaaagatccaggatctagtgtagttgatgccaagtctgaagtgtgctga

SEQ ID NO: 1988 - protein, 662 aa, Sorghum bicolor
  misc_feature: Ceres ANNOT ID no. 6017579
  misc_feature (175)..(209): Pfam Id: PPR Pfam Desc: PPR repeat
  misc_feature (378)..(412): Pfam Id: PPR Pfam Desc: PPR repeat
  misc_feature (479)..(513): Pfam Id: PPR Pfam Desc: PPR repeat
  misc_feature (1)..(662): NCBI GI: 50251760 NCBI Desc: pentatricopeptide (ppr) repeat-containing protein-like [oryza sativa (japonica cultivar-group)]
  misc_feature (4)..(659): NCBI GI: 10177683 NCBI Desc: selenium-binding protein-like [arabidopsis thaliana]
  misc_feature (31)..(656): NCBI GI: 140042117 NCBI Desc: tetratricopeptide-like helical [medicago truncatula]
  misc_feature (127)..(660): NCBI GI: 56201494 NCBI Desc: pentatricopeptide repeat protein -like [oryza sativa (japonica cultivar-group)]
  misc_feature (127)..(660): NCBI GI: 115435158 NCBI Desc: os01g0205200 [oryza sativa (japonica cultivar-group)]
MTTNALVQQCLALLLRSKSSATPLVPTTAAQLHALLLKSGHLLHCDSIHLLLGSYCACGRPFDAHNLLVQMPQPPPVSVSNTLLRSYTGLGFNRQALALYSQMRAFDHLTFTFAAKACADLRRRRHGRAVHGRALTAGFGGDGYVQNALVSMYMRCRDVVSAEAVFGALRSRTTVSWNTVITGCVKDGRAERALEVFETMVGRGVCIDRATVVSVLPACAQARDLHMGRAVHRLAVVRGLGNYAAVKNALIDMYGKCRSLEDAKRVFDEDSYDKDVVSWTAMIGAYVLNDHASKAFALGSEMLVTSEAQPNAVTMVHLLSACTSLLSGKHAKCTHALCIRLGLGSDTVVETALVDCYAKCGYMGMIDMVVEKGSRRTETWNAAISGYTHREQGKKALALFKQMLAESVRPDSATMASVIPAYAESADLVQAKNIHCCLLIRGCLGSTDIATGLINVYAKAGDLGVAWELFQCLPEKDVVAWTTVIAGYGMHGHAQTAILLYSRMIEMGVTPNTVTMASLMYSCSHAGMVDEGLRLFNDMRGVHGLMPNAEHYLCLVDMLGRAGRIEEAYRLIQDMPFEPSTSVWSALLGACVLHENVEFGEVAAKHLFELEPDNVGNYVLLGKVYAAADRWSDVQDLWRVMEGRGLHKDPGSSVVDAKSEVC

SEQ ID NO: 1989 - DNA, 756 bp, Sorghum bicolor
  misc_feature: Ceres ANNOT ID no. 6017581
  misc_feature: Encodes the peptide sequence at SEQ ID NO 1990
  misc_feature: Up-regulated in root tissues in response to salicylic acid treatment
  misc_feature: Up-regulated in shoot tissues in response to salicylic acid treatment
atgcctcccagccccgccccactattctctcgcctgcgcttccgcctccggacgtgcgccgccgtctccatctccacccgtccatcctccgcggcgcccctgcgctaccgtcgcactcgcctctctatcccttttcctctgtccccaccttgcccgcgcatcctccgcgccgccgccgccgccgcggtctcgtcgtcgctggatctgcgcgcgatagccggcgggttcgcgctgttcagcatggctgctgcctcctccgccacatccgtccacgacttcaccgtcaaggatgctagcgggaaagatgtggaccttagcacctacaaggggaaggttctactcatagtcaatgttgcatctcagtgtggcttgaccaattccaactacacagagctgagccagttgtatgagaagtacaaggaccagggttttgagatccttgctttcccatgtaaccagtttggtgggcaggagcctggcactaatgaggagattgtccagtttgcttgcactcgcttcaaggctgaatatccaattttcgacaaggttgatgtcaatggtgacaatactgcacccatctacaagttcctgaagtccagcaaaggtagtctctttggggagaacataaaatggaacttctccaagtttttggttgacaaagaggggcgtgttgtggagcggtacgcaccgacaacttccccactgagcatcgagaaggacatcaagaagctactagggagtccttcaaccttgtaa

SEQ ID NO: 1990 - protein, 251 aa, Sorghum bicolor
  misc_feature: Ceres ANNOT ID no. 6017581
  misc_feature (90)..(198): Pfam Id: GSHPx Pfam Desc: Glutathione peroxidase
  misc_feature (82)..(245): Pfam Id: Redoxin Pfam Desc: Redoxin
  misc_feature (1)..(247): NCBI GI: 6179600 NCBI Desc: gpx12hv, glutathione peroxidase-like protein [hordeum vulgare subsp. vulgare]
  misc_feature (81)..(247): NCBI GI: 44663004 NCBI Desc: phospholipid-hydroperoxide glutathione peroxidase [setaria italica]
  misc_feature (82)..(247): NCBI GI: 27544804 NCBI Desc: phospholipid hydroperoxide glutathione peroxidase-like protein [hordeum vulgare]
  misc_feature (81)..(247): NCBI GI: 34334012 NCBI Desc: cytosolic glutathione peroxidase [triticum monococcum]
  misc_feature (81)..(247): NCBI GI: 21360380 NCBI Desc: glutathione peroxidase 1 [oryza sativa]
  misc_feature (61)..(247): SWISSPROT Homolog: EC 1.11.1.12 Phospholipid hydroperoxide glutathione peroxidase 1, chloroplast precursor
  misc_feature (83)..(246): SWISSPROT Homolog: EC 1.11.1.9 Glutathione peroxidase 1
  misc_feature (97)..(245): SWISSPROT Homolog: EC 1.11.1.15 Peroxiredoxin HYR1
  misc_feature: Useful for making plants with modulated nitrogen use efficiency
  misc_feature: Functional homolog of the protein sequence given in SEQ ID NO 13071
  misc_feature: Useful for making plants with modulated flowering time
  misc_feature: Functional homolog of the protein sequence given in SEQ ID NO 12921
  misc_feature: Useful for making plants with modulated nitrogen use efficiency
  misc_feature: Functional homolog of the protein sequence given in SEQ ID NO 13071
  misc_feature: Up-regulated in root tissues in response to salicylic acid treatment
  misc_feature: Up-regulated in shoot tissues in response to salicylic acid treatment
MPPSPAPLFSRLRFRLRTCAAVSISTRPSSAAPLRYRRTRLSIPFPLSPPCPRILRAAAAAAVSSSLDLRAIAGGFALFSMAAASSATSVHDFTVKDASGKDVDLSTYKGKVLLIVNVASQCGLTNSNYTELSQLYEKYKDQGFEILAFPCNQFGGQEPGTNEEIVQFACTRFKAEYPIFDKVDVNGDNTAPIYKFLKSSKGSLFGENIKWNFSKFLVDKEGRVVERYAPTTSPLSIEKDIKKLLGSPSTL

SEQ ID NO: 1991 - DNA, 591 bp, Sorghum bicolor
  misc_feature: Ceres ANNOT ID no. 6017602
  misc_feature: Encodes the peptide sequence at SEQ ID NO 1992
atggcggagcccaggcgcatgcggccgtcgacgttccggtgcgccgcggcgacggtgctggcgctgctggtggtggtcttcatcatcgtgatcctgtggctcttcctgcacccgtccaagctctacctctccgtggaccacgcgtccacgacggggttcaacttcacggccgccggcgggctcgccggcgcgttcgacctcaccctgcgcgccttcaaccccaacgagcgcgcgagcgtgtcgtaccgctgggtcgacgtcggcgtctggtacggaggcacgtacctcgcgggcgcgcacgcgccggggttctaccagccgcccgaggacgagacccgcgtcgacgtggtcgcgcgggcggcgccggccgacgggacgacgacgctgccgcgggacgtggaggaaggcatgaagaaggagcgcacggcggggaagctgacggtggacgtgcacgtcgtcgccaaggtgcggttccggtacggcgtggtggggacccggaagtacaccgtccgcggcagctgccccgccgtgcccatcgacttcgcgtcgccgacctcgttcgaccgggtgaactgccacgtgcacatatga

SEQ ID NO: 1992 - protein, 196 aa, Sorghum bicolor
  misc_feature: Ceres ANNOT ID no. 6017602
  misc_feature (33)..(174): Pfam Id: Hin1 Pfam Desc: Harpin-induced protein 1 (Hin1)
  misc_feature (19)..(192): NCBI GI: 97974197 NCBI Desc: hairpin-induced family protein [ipomoea nil]
  misc_feature (12)..(194): NCBI GI: 90399146 NCBI Desc: h0913c04.11 [oryza sativa (indica cultivar-group)]
  misc_feature (12)..(194): NCBI GI: 32488714 NCBI Desc: osjnba0088h09.15 [oryza sativa (japonica cultivar-group)]
  misc_feature (12)..(194): NCBI GI: 115461434 NCBI Desc: os04g0685300 [oryza sativa (japonica cultivar-group)]
  misc_feature (12)..(194): NCBI GI: 2801538 NCBI Desc: harpin induced gene 1 homolog [oryza sativa]
  misc_feature: Useful for making plants with altered protein content
  misc_feature: Functional homolog of the protein sequence given in SEQ ID NO 13450
MAEPRRMRPSTFRCAAATVLALLVVVFIIVILWLFLHPSKLYLSVDHASTTGFNFTAAGGLAGAFDLTLRAFNPNERASVSYRWVDVGVWYGGTYLAGAHAPGFYQPPEDETRVDVVARAAPADGTTTLPRDVEEGMKKERTAGKLTVDVHVVAKVRFRYGVVGTRKYTVRGSCPAVPIDFASPTSFDRVNCHVHI

SEQ ID NO: 1993 - DNA, 249 bp, Sorghum bicolor
  misc_feature: Ceres ANNOT ID no. 6017607
  misc_feature: Encodes the peptide sequence at SEQ ID NO 1994
atggtgcatttcatggatttacgggctttcatcctacgtacacatgtcttgaagctttatagacaggcattgcgtattactcacagagcccctgtacatgctcgagatgagttgaggcagaccgcaagggacgagtttgagaaatatcgccattgtgatgataaacaaaagattaggtttttgatcagtgaagggaagcagagactaaaaggtcttgatgaactgcttgacatgacagggaacagctaa

SEQ ID NO: 1994 - protein, 82 aa, Sorghum bicolor
  misc_feature: Ceres ANNOT ID no. 6017607
  misc_feature (11)..(74): Pfam Id: Complex1_LYR Pfam Desc: Complex 1 protein (LYR family)
  misc_feature (1)..(82): NCBI GI: 115450863 NCBI Desc: os03g0159800 [oryza sativa (japonica cultivar-group)]
  misc_feature (5)..(81): NCBI GI: 116117231 NCBI Desc: ensangp00000008809 [anopheles gambiae str. pest]
  misc_feature (5)..(82): NCBI GI: 41616992 NCBI Desc: tpa: hdc05859 [drosophila melanogaster]
MVHFMDLRAFILRTHVLKLYRQALRITHRAPVHARDELRQTARDEFEKYRHCDDKQKIRFLISEGKQRLKGLDELLDMTGNS

SEQ ID NO: 1995 - DNA, 1344 bp, Sorghum bicolor
  misc_feature: Ceres ANNOT ID no. 6017610
  misc_feature: Encodes the peptide sequence at SEQ ID NO 1996
atgaaggacttggcggggctggggcacctgttcgtggtgacgttcctgttccacttcgcatccttcatggtgatcccggcggtcaccgacgtcaccatggaggccgtctgccccggccgcgacgagtgctccgtcgccatctacctcaccggcttccagaacgcggtcaccgggctgggggcgctcgtcgtcacccccatcgtcggcaacctgtcggacaggtacggccggaaggcgctcatgacgctgccggtgacggtggccgtcgcgccgctgtttatactggcttgcaaccgctcggaggtgtacttctacgtgtactacgtggccaagatcatcgccgggatcttctgcgagggcaccatgcactgtctctgccttgcctacgtggctgaccacgtgggccccaggcgtcgcgcggcagcgttcggtctcctctccggtgtgtcggcagcggggttcgtgtcggggaccttgaccgcgcgcttcctcccaactgcatccaccttccaggtcgccgccgccgtggccgtggcgtcagcgctctacctcagggccttcctccccgacgcaggcggcgtctcctgcgctgacgaagcctgcgatccgctcctccaggattcgtcctgcacctcgtccgcatcatcctccgatgaagagctctcgcctcggctgccgccgcataagagcgggctgccgtctctatccgacatggtcgcgcttctcactagcagtttggccttgtcaggggcagcagtcgtcactttcttttacagtctaggtgaacatgggcttaatactgcattgctgtactacctgaaggcacaatttggttacagcaaagatgaatttgctaatctgcttctaattgccggtgctgccggaatgctatcacagctcactgtaatgcctatcttggctccgattctgggtgaagaggtgctgcttattgttgggctgctaggtggatgtactcatgttttcttgtatggcattgcatggtcatactgggtaccttattttgctgcagcatttgtaattttgagtgcttttgttcacccatctataaggaccaatgtatcaaaaaatgttggatcaaatgagcagggaattgctcaaggatgtatatctgggattagttcttttggaagtatactaggtcccctcatatttactcctttaactgcatggtttctttctgaaacagggcccttcgacttcaaaggtttcagtattttgtgtgctggcttttgcaccctcattgcgtttattatcagtttgaggatgcgtggagctcaatctagtacgtgcaagaagaccacggttcagcatgagcaagcataa

SEQ ID NO: 1996 - protein, 447 aa, Sorghum bicolor
  misc_feature: Ceres ANNOT ID no. 6017610
  misc_feature (10)..(388): Pfam Id: MFS_1 Pfam Desc: Major Facilitator Superfamily
  misc_feature (238)..(447): NCBI GI: 50252129 NCBI Desc: tetracycline transporter protein-like [oryza sativa (japonica cultivar-group)]
  misc_feature (4)..(444): NCBI GI: 33589702 NCBI Desc: at2g16980 [arabidopsis thaliana]
  misc_feature (3)..(426): NCBI GI: 92871443 NCBI Desc: major facilitator superfamily mfs_1 [medicago truncatula]
  misc_feature (9)..(442): NCBI GI: 115484211 NCBI Desc: os11g0151500 [oryza sativa (japonica cultivar-group)]
  misc_feature (3)..(426): NCBI GI: 92871444 NCBI Desc: major facilitator superfamily mfs_1 [medicago truncatula]
  misc_feature: Useful for making plants with modulated biomass
  misc_feature: Useful for making plants with modulated cold sensitivity
  misc_feature: Useful for making plants with modulated drought sensitivity
  misc_feature: Useful for making plants with modulated heat sensitivity
  misc_feature: Useful for making plants with modulated salt sensitivity
  misc_feature: Functional homolog of the protein sequence given in SEQ ID NO 13434
  misc_feature: Functional homolog of the protein sequence given in SEQ ID NO 13472
  misc_feature: Functional homolog of the protein sequence given in SEQ ID NO 13474
  misc_feature: Useful for making plants with modulated cold sensitivity
  misc_feature: Useful for making plants with modulated salt sensitivity
  misc_feature: Functional homolog of the protein sequence given in SEQ ID NO 13474
MKDLAGLGHLFVVTFLFHFASFMVIPAVTDVTMEAVCPGRDECSVAIYLTGFQNAVTGLGALVVTPIVGNLSDRYGRKALMTLPVTVAVAPLFILACNRSEVYFYVYYVAKIIAGIFCEGTMHCLCLAYVADHVGPRRRAAAFGLLSGVSAAGFVSGTLTARFLPTASTFQVAAAVAVASALYLRAFLPDAGGVSCADEACDPLLQDSSCTSSASSSDEELSPRLPPHKSGLPSLSDMVALLTSSLALSGAAVVTFFYSLGEHGLNTALLYYLKAQFGYSKDEFANLLLIAGAAGMLSQLTVMPILAPILGEEVLLIVGLLGGCTHVFLYGIAWSYWVPYFAAAFVILSAFVHPSIRTNVSKNVGSNEQGIAQGCISGISSFGSILGPLIFTPLTAWFLSETGPFDFKGFSILCAGFCTLIAFIISLRMRGAQSSTCKKTTVQHEQA

SEQ ID NO: 1997 - DNA, 1038 bp, Sorghum bicolor
  misc_feature: Ceres ANNOT ID no. 6017611
  misc_feature: Encodes the peptide sequence at SEQ ID NO 1998
atggccaggcacgccaagacggactccgacgtgacgagcctggcggcgtccacgccgccgcggtccccgcgtggccgcccggcctactacgtgctcagccccgccgcctcccacccggacgtccacgtcggcggcgtcgcggggaccaccccggccgagtcgccgctccactaccacttccaccaccaccaccgtggctcgagcggcggcgtcggcgacggcggagccggcgccgggggcggcggcatgcaccactcccgggagtcctccacggggcggctcctcttctccgaccagctccgctccggcggcgacgtcgccgccgtggtgagcgtcccctggcgccggctcgggcacggcggcagcggcgcgggcagcgtcggggacgacgacggcggcgcgtccctgacgcgcggcgggttcgcggactcgccgtggcggtgctacgcgctcggcgcgttcgcgttcgtcgccgtgttcgccttcttcctgctcgtgctctggggcgccagcaggtcgtacaagcctcatgtcgtcgtcaagagcgtggtgttcgagtcgtaccacatccagggcggcacggaccggacgggcgtcccgacgaagatgatgtcggtgaacgcgacggtgcggctgcgcttccgcaaccggggcaccttcttcagcctgcacgtcacggccacgccgttcctcctcttctacggcgacctcaccgtcgcctccggagacatggcggagttctaccagccgcggaagagcgggcggatggtgacggtgtccgtggtggggaagcaggtgccgctctacggcgcgggcgcgggcctgcacagcaagcccaacaacggccgcctcggcgccgcggtggtgcccgtcgagctcgacctcgtgctgcgcgcgcgcgcccacatcctcggcctcctcgtcaagtccaagttctaccgccgcgtgcactgccgcctccacatccacgaggcgcacctcggcaggcccgcacgcggcgtcgccgccggatgccagtaccacgacggcctccgatga

SEQ ID NO: 1998 - protein, 345 aa, Sorghum bicolor
  misc_feature: Ceres ANNOT ID no. 6017611
  misc_feature (168)..(318): Pfam Id: Hin1 Pfam Desc: Harpin-induced protein 1 (Hin1)
  misc_feature (81)..(340): NCBI GI: 38345517 NCBI Desc: osjnba0039k24.20 [oryza sativa (japonica cultivar-group)]
  misc_feature (81)..(340): NCBI GI: 115461492 NCBI Desc: os04g0689500 [oryza sativa (japonica cultivar-group)]
  misc_feature (81)..(340): NCBI GI: 5777621 NCBI Desc: caa30379.1 protein [oryza sativa]
  misc_feature (1)..(330): NCBI GI: 116309975 NCBI Desc: osigba0160i14.1 [oryza sativa (indica cultivar-group)]
  misc_feature (1)..(330): NCBI GI: 32488073 NCBI Desc: osjnba0084a10.1 [oryza sativa (japonica cultivar-group)]
  misc_feature: Useful for making plants with altered cell wall content and/or composition
  misc_feature: Functional homolog of the protein sequence encoded by LOCUS at1g45688
MARHAKTDSDVTSLAASTPPRSPRGRPAYYVLSPAASHPDVHVGGVAGTTPAESPLHYHFHHHHRGSSGGVGDGGAGAGGGGMHHSRESSTGRLLFSDQLRSGGDVAAVVSVPWRRLGHGGSGAGSVGDDDGGASLTRGGFADSPWRCYALGAFAFVAVFAFFLLVLWGASRSYKPHVVVKSVVFESYHIQGGTDRTGVPTKMMSVNATVRLRFRNRGTFFSLHVTATPFLLFYGDLTVASGDMAEFYQPRKSGRMVTVSVVGKQVPLYGAGAGLHSKPNNGRLGAAVVPVELDLVLRARAHILGLLVKSKFYRRVHCRLHIHEAHLGRPARGVAAGCQYHDGLR

SEQ ID NO: 1999 - DNA, 1029 bp, Sorghum bicolor
  misc_feature: Ceres ANNOT ID no. 6017613
  misc_feature: Encodes the peptide sequence at SEQ ID NO 2000
atggctctctcctccctcttcatcaccctccccgtccccaaggtcccttcctccaactcccgccgcttgctcaccgcccgggcgtcctccgccgccgctcccgccgcctctgcttccttcgacctgcgccgctactggacctctctgatcgccgatgtggagtccgaactcgacgccgcgatgcccatgcagcctccggagagcatccactccgccatgcgctacgcggtgctcccgggcgccggcaaggagggcgccgccaagcgggcgccccccgtgctgtgcgtcgccgcgtgcgagctcctcgggggcccgcgcgcggccgcgctcccggccgccgcggcgctggagatgctccacgcggcgtcgctcgtgcacgacgacctgccctgcttcgacgcagccccgacgcggcgcgggcgcccgtccacgcacgcggcgtacggcaccgacatggccgtcctcgcgggggacgctctcttcccgctcgcctacacccacgtcatctcccacaccccgtccccggacccggtcccgcacgccgtcctcctgcgcgtcctcgcggagctcgcgcgcgccgtcggatccaccggcatggcggccggccagttcctcgatctggccggcgccaccgcccttggcgaggccgaggtcatgcaggtcctgacgaagaagttcggcgagatggccgagtgctccgccgcctgcggcgccatgctcggtggggcagggcccgacgaggaggccgcgctgcggcgctacggccgcaccatcggcgtcctgtacgagctcgtcgacgacgtccggagcgcgtcgggcaacggaaagatgaggaggaacgccagcgtcctgcgctccctggggatggaccgcgcgctgggcattgtggaggagctcaaggctcaggccaagacagaggctgacaggttcggggacaagtatggcgatcgggtgctgcccttgtacagcttcgtggactacgcggtggagagagggtttgagctccagggtgcagcggcaacttcatag

SEQ ID NO: 2000 - protein, 342 aa, Sorghum bicolor
  misc_feature: Ceres ANNOT ID no. 6017613
  misc_feature (69)..(329): Pfam Id: polyprenyl_synt Pfam Desc: Polyprenyl synthetase
  misc_feature (3)..(335): NCBI GI: 735880 NCBI Desc: geranylgeranyl pyrophosphate synthase-related protein
  misc_feature (3)..(335): NCBI GI: 11692820 NCBI Desc: at4g38460 [arabidopsis thaliana]
  misc_feature (17)..(331): NCBI GI: 86277807 NCBI Desc: geranylgeranyl diphosphate synthase [taxus wallichiana]
  misc_feature (17)..(331): NCBI GI: 4322331 NCBI Desc: geranylgeranyl diphosphate synthase [taxus canadensis]
  misc_feature (17)..(331): NCBI GI: 44972242 NCBI Desc: geranylgeranyl diphosphate synthase; tmggps [taxus x media]
MALSSLFITLPVPKVPSSNSRRLLTARASSAAAPAASASFDLRRYWTSLIADVESELDAAMPMQPPESIHSAMRYAVLPGAGKEGAAKRAPPVLCVAACELLGGPRAAALPAAAALEMLHAASLVHDDLPCFDAAPTRRGRPSTHAAYGTDMAVLAGDALFPLAYTHVISHTPSPDPVPHAVLLRVLAELARAVGSTGMAAGQFLDLAGATALGEAEVMQVLTKKFGEMAECSAACGAMLGGAGPDEEAALRRYGRTIGVLYELVDDVRSASGNGKMRRNASVLRSLGMDRALGIVEELKAQAKTEADRFGDKYGDRVLPLYSFVDYAVERGFELQGAAATS

SEQ ID NO: 2001 - DNA, 372 bp, Sorghum bicolor
  misc_feature: Ceres ANNOT ID no. 6017633
  misc_feature: Encodes the peptide sequence at SEQ ID NO 2002
atgaagggcaaggccgacacctccaagaaggatgagggcaggctccgggccggcggcggcgccggaaagcgcaagaaggccgctgcgagcggcaagcccaagtctgaattcaggcaggagtaccaggcacagcaccctggcaacaagagcgttgcggccgtgagcaaggcagcaggggaaaagtggcgtgctatgtcagagcaagagaagcaaccatatgtggaccaagctgggcagaagaagcaggactatgagaagactaaggcgaactttgagaagaaggagagcacaagctcaaagaaggctaagactgatgatgacgatggctcaaagtctgaggttgacgatgaggatgacgaggacgatgagtaa

SEQ ID NO: 2002 - protein, 123 aa, Sorghum bicolor
  misc_feature: Ceres ANNOT ID no. 6017633
  misc_feature (33)..(92): Pfam Id: HMG_box Pfam Desc: HMG (high mobility group) box
  misc_feature (1)..(123): NCBI GI: 17017394 NCBI Desc: hmg-like nucleosome/chromatin assembly factor d [zea mays]
  misc_feature (1)..(123): NCBI GI: 1845195 NCBI Desc: hmgc1 [zea mays]
  misc_feature (1)..(123): NCBI GI: 1845197 NCBI Desc: hmgc2 [zea mays]
  misc_feature (1)..(123): NCBI GI: 18700443 NCBI Desc: high mobility group box protein 2 [oryza sativa (japonica cultivar-group)]
  misc_feature (3)..(122): NCBI GI: 38345400 NCBI Desc: osjnba0017b10.6 [oryza sativa (japonica cultivar-group)]
  misc_feature: Useful for making plants with altered alkaloid content
  misc_feature: Functional homolog of the protein sequence given in SEQ ID NO 12910
MKGKADTSKKDEGRLRAGGGAGKRKKAAASGKPKSEFRQEYQAQHPGNKSVAAVSKAAGEKWRAMSEQEKQPYVDQAGQKKQDYEKTKANFEKKESTSSKKAKTDDDDGSKSEVDDEDDEDDE

SEQ ID NO: 2003 - DNA, 1281 bp, Sorghum bicolor
  misc_feature: Ceres ANNOT ID no. 6017635
  misc_feature: Encodes the peptide sequence at SEQ ID NO 2004
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
atgggattcggaatggggaataataacggggcgagctcctcgtcgtcgcggctggacccggcgccgctgctgccgcaccacggcagcgggagccgcgaggtcggcctgtcgtcgcagcccaagacgttcgccaacgtcttcatcgcggtggtgggcgccggcgtgctgggactgccgtacaccttctcgcacaccgggtgggcggcggggacgctgctgctcttctccgtcgccgcgctcaccttctactgcatgatgctgctcgtcgcgtgccgccgccgcctcgccgacgagcaccctaagatcgcctcgttcggggacctcggggacgccgtgttcggcgcgcacggccggttcgccgtcgacgtcatgctggtgctcagccaagtcagcttctgcgtcggctacctcatcttcatctctaacaccatggcgcacctctacccgattaccgcgccgtcctcctcggccctcctctcccccaaggcgctcgtcatctgggcgatgctgccgttccagctcgggctcaattccatcaagacgctcacgctgctcgcgccactcagcatcttcgccgacgtcgtcgacctcggcgccatgggcgtggtgcttggccaggacgttgccgcctgggtcgctaagcccgtgcccgtggccgccttcggcgggcctgccgcgcttctctacggtctcggcgtctccgtgtacgcgttcgagggcgtcggcatggtgctgccgctggaggccgaggcggcgaacaagaagaagttcggcgtcacgctggggctgtccatggcgttcatcgccgtcatgtacgggctgttcggcgtgatggggtacgtcgcgttcggcgacgccacgcgggacatcatcaccacaaacctcggcgccgggtggctgtcggccgccgtgcagctggggctctgcatcaacctcttcttcacgatgccggtgatgatgaaccccgtgtacgaggtcgccgagcgcctgctccacgggaagcgctactgctggtggctgaggtggctgctcgtcatcgtcgtcggactcgccgccatgtacgtgcccaacttcacggacttcctggcgctcgtcgggagcagcgtctgcgtcctcctcggcttcgtgctgccggcctcgttccacctcaaggtgttcggcggcgagatggaatggcccggagtggtatccgatgtcctgctggtcgtgatcggcctctcgctcgccgtgttcgggacgtacacgtcgctgctgcaaatcttccactcgtcaagcgcttga

SEQ ID NO: 2004 - protein, 426 aa, Sorghum bicolor
  misc_feature: Ceres ANNOT ID no. 6017635
  misc_feature (35)..(418): Pfam Id: Aa_trans Pfam Desc: Transmembrane amino acid transporter protein
  misc_feature (5)..(424): NCBI GI: 38345408 NCBI Desc: osjnba0017b10.14 [oryza sativa (japonica cultivar-group)]
  misc_feature (36)..(421): NCBI GI: 30688867 NCBI Desc: amino acid transporter family protein [arabidopsis thaliana]
  misc_feature (11)..(425): NCBI GI: 10177114 NCBI Desc: amino acid transporter protein-like [arabidopsis thaliana]
  misc_feature (85)..(425): NCBI GI: 40823279 NCBI Desc: at5g65990 [arabidopsis thaliana]
  misc_feature (217)..(424): NCBI GI: 115459950 NCBI Desc: os04g0565500 [oryza sativa (japonica cultivar-group)]
  misc_feature: Useful for making plants with modulated nitrogen use efficiency
  misc_feature: Useful for making plants with modulated nitrogen use efficiency
  misc_feature: Functional homolog of the protein sequence given in SEQ ID NO 13145
  misc_feature: Useful for making plants with modulated nitrogen use efficiency
  misc_feature: Functional homolog of the protein sequence given in SEQ ID NO 13145
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: The sequence is a functional homolog of SEQ ID NO. 438 in the 11/188,298 US application
  misc_feature: The sequence is a functional homolog of SEQ ID NO. 313 in the 11/188,298 US application
MGFGMGNNNGASSSSSRLDPAPLLPHHGSGSREVGLSSQPKTFANVFIAVVGAGVLGLPYTFSHTGWAAGTLLLFSVAALTFYCMMLLVACRRRLADEHPKIASFGDLGDAVFGAHGRFAVDVMLVLSQVSFCVGYLIFISNTMAHLYPITAPSSSALLSPKALVIWAMLPFQLGLNSIKTLTLLAPLSIFADVVDLGAMGVVLGQDVAAWVAKPVPVAAFGGPAALLYGLGVSVYAFEGVGMVLPLEAEAANKKKFGVTLGLSMAFIAVMYGLFGVMGYVAFGDATRDIITTNLGAGWLSAAVQLGLCINLFFTMPVMMNPVYEVAERLLHGKRYCWWLRWLLVIVVGLAAMYVPNFTDFLALVGSSVCVLLGFVLPASFHLKVFGGEMEWPGVVSDVLLVVIGLSLAVFGTYTSLLQIFHSSSA

SEQ ID NO: 2005 - DNA, 963 bp, Sorghum bicolor
  misc_feature: Ceres ANNOT ID no. 6017641
  misc_feature: Encodes the peptide sequence at SEQ ID NO 2006
atgggtggcgccgccggcggtgggaggaacggggcggcgacgaggcggtacaacaggtccaaggtgcccaggctcaggtggaccagcgagctccatcgcaacttcgtccgagccgtcgattgcctcggtggccaggacaaagctactcctaagctaattcttcagctcatgggtgtcagagggcttaccattgctcatgtcaagagccaccttcagatgtacagaagttcaggacatgacattagaaagagagagatgcaaccacggctacgacatctgaagcactcattcaccattgatgagggaggccccaaggaattcatctgcccgcctatgaaaagggcagaggcagcagggccagaagctgcagccacggccacggccacgcacgagagcatgcaggggaacagtgacatgggggctcctggcacccggcgctgcggcgatgattacacgcgagcgattcccatgggcagcagcaggaggataaccgagggcctcggcggatggcagcagtggcagagggatgccgccgctcgtgctgccacagccgcttccaccctgcgagagctgggattttgggtgcgaggaaccgaggagcccttcaaggtacggcagaccggcaggcccatagcaaaccgtcacagtcctgtggcgaggcagctatcttccaaggagatcaagggcgaaaacggacgcttcttgtgtggcactgcggctgcgactagagacgaagctgcggccaggagacgttcaccgtcgtcgcgaccgccagcctcctccattgacccaaaagctgtggccgctgtctcctggtggcccagcgaagaaggcggctgcgtcctcccgccgctgtcgtcgtcgaccagcttgagtgcatgctcagggccgtcaggcagctgcatattcgccaggcagagaagagttaacttggacctttccctgtccatatgcggatcatag

SEQ ID NO: 2006 - protein, 320 aa, Sorghum bicolor
  misc_feature: Ceres ANNOT ID no. 6017641
  misc_feature (24)..(75): Pfam Id: Myb_DNA-binding Pfam Desc: Myb-like DNA-binding domain
  misc_feature (10)..(80): NCBI GI: 115483751 NCBI Desc: os11g0106100 [oryza sativa (japonica cultivar-group)]
  misc_feature (9)..(91): NCBI GI: 92871144 NCBI Desc: homeodomain-related [medicago truncatula]
  misc_feature (3)..(77): NCBI GI: 7527727 NCBI Desc: t5e21.10 [arabidopsis thaliana]
  misc_feature (3)..(77): NCBI GI: 79344640 NCBI Desc: dna binding / transcription factor [arabidopsis thaliana]
  misc_feature (12)..(76): NCBI GI: 140057815 NCBI Desc: homeodomain-related [medicago truncatula]
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1857 in the 10/374,780US patent application
  misc_feature: The sequence is a functional homolog of SEQ ID NO 933 in the 10/666,642US patent application
  misc_feature: Useful for making plants with modulated growth and phenotype characteristics
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 933 in the 20070033671 US patent application
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
MGGAAGGGRNGAATRRYNRSKVPRLRWTSELHRNFVRAVDCLGGQDKATPKLILQLMGVRGLTIAHVKSHLQMYRSSGHDIRKREMQPRLRHLKHSFTIDEGGPKEFICPPMKRAEAAGPEAAATATATHESMQGNSDMGAPGTRRCGDDYTRAIPMGSSRRITEGLGGWQQWQRDAAARAATAASTLRELGFWVRGTEEPFKVRQTGRPIANRHSPVARQLSSKEIKGENGRFLCGTAAATRDEAAARRRSPSSRPPASSIDPKAVAAVSWWPSEEGGCVLPPLSSSTSLSACSGPSGSCIFARQRRVNLDLSLSICGS

SEQ ID NO: 2007 - DNA, 2121 bp, Sorghum bicolor
  misc_feature: Ceres ANNOT ID no. 6017646
  misc_feature: Encodes the peptide sequence at SEQ ID NO 2008
  misc_feature: Up-regulated in shoot tissues in response to salicylic acid treatment
atggaagcgcagaccgacgccgcccccggcggcggcgacgatctcgcgaccatgcgcgagcagtgccggacactggaggagtccatctccacccgccgggaggcgcagctcgaactcatcggctctctgcagcacctcgtccccgacctggtcccctccctcgaccaatccctccgcctcatcgccgccttcaacggccgccccttcgtccctacgctgtaccccaacgccagcatccacgtgcagaaccccagcctcaggccccagcaccgccgcgccctccccgacccggcccgctccacccgccggaagacctcgccgggctcctccccagcttccgccgccgcggggggcgcgggaaccggcggtggcatcgacgccgtgcgtaccatggttgccgtctgcctcctcgagctcgtcccctttgccgagatcgatgccgctgcgctcgcgcgccgcctgcagtccgaaacgtcgtccgccagcgaggccgagcgtgctgctctggccgacctcgctgcggagcttgggggctccgcgcccgctgcggttgctcttgcgctccgtcgcatcgcggaagacagcggcggattgcagatcgaggaggccttcattgggggcaagcagatgactatggtctgggccatcgaccggagcaagcttctcaaagagctaccagaatccgcctctgtgatccaaatgcaacctccgccaactccacaggtggctcccaccgatactgatactaacagcgccatcataccaaggcctccgccactgcagcagccggatatgtggggtcacccaatgccaccgatgttcccacgccccaggggcatgccaatgccgagaatgccgccagggttgatgccgctgcagcgaccattcatggcaccaggggcagttatcccaatgggtggtggtcctgggccgagttccgcacagctgaagctgaggacagaggaggatgatcttaaggaccttgaactgctgctaaacaagaagacatatagagagaagcagaatacaaagactggagaggagctgctggatcttattcaccggcctacagctaaggagactgctgtcgctgcaaagtttaaaacaaagggtggctcccagctgaaggaatactgtaccaacttaactaaagaagattgccgacgccaaacaggttcttttgtggcctgtgataaggtccattttcgtcgtattatagctccacatactgatacaaacctaggagattgctctttcctagacacatgccgtcacacaaagacttgcaagtatgtccactacgagcttgatcaaacaccagatgtacctcaaatgatggctggtgctgtcgcaccacctaggcaaataaagccacagagagctgaatattgttcagaaatagagcttggagaatcgcaatggataaactgtgacattcggaacttcaggatggacatcttaggacagtttggagtaattatggctgaccccccttgggatattcatatggagctaccatatggcacaatggctgatgatgaaatgaggacgcttaatgttccagctttgcaaactgatggtttgatttttttatgggtcactggtcgtgccatggaacttgggcgtgaatgtctggagttgtggggttacaagcgtgttgaagaaattatctgggtgaagaccaatcaacttcaacgtatcattcgaactggccgcactggccattggttgaatcacagcaaagaacattgtcttgttggaataaaaggaaaccctttagtgaacaggaatatagataccgatgttattgttgctgaagtccgtgaaacaagcagaaaacctgatgagatgtacgcaatgctagaacgaattagcccaaggacaaggaagttggaactgtttgcaagaatgcataatacacaagctggatggctttcactgggtaaccaattacaaggggtaaggcttgttgatgaagggttgagagcaaggtacaaggctgcttaccccgatgttgaggtccagccactgtctcctcccaggacaagcgcaccaatggatgttgaccaaagtagttcacagaaggctgctgcgccagatggtggcgagaggcccgcctga

SEQ ID NO: 2008 - protein, 706 aa, Sorghum bicolor
  misc_feature: Ceres ANNOT ID no. 6017646
  misc_feature (490)..(650): Pfam Id: MT-A70 Pfam Desc: MT-A70
  misc_feature (1)..(706): NCBI GI: 75122224 NCBI Desc: probable n6-adenosine-methyltransferase mt-a70-like
  misc_feature (401)..(616): NCBI GI: 3600038 NCBI Desc: similar to saccharomyces cerevisiae transcription regulator spo8 (sw:p41833) [arabidopsis thaliana]
  misc_feature (311)..(671): NCBI GI: 30353931 NCBI Desc: methyltransferase like 3 [homo sapiens]
  misc_feature (311)..(671): NCBI GI: 119586783 NCBI Desc: methyltransferase like 3 [homo sapiens]
  misc_feature (385)..(684): NCBI GI: 21355141 NCBI Desc: cg5933-pa [drosophila melanogaster]
  misc_feature (311)..(671): SWISSPROT Homolog: EC 2.1.1.62 N6-adenosine-methyltransferase 70 kDa subunit
  misc_feature: Up-regulated in shoot tissues in response to salicylic acid treatment
MEAQTDAAPGGGDDLATMREQCRTLEESISTRREAQLELIGSLQHLVPDLVPSLDQSLRLIAAFNGRPFVPTLYPNASIHVQNPSLRPQHRRALPDPARSTRRKTSPGSSPASAAAGGAGTGGGIDAVRTMVAVCLLELVPFAEIDAAALARRLQSETSSASEAERAALADLAAELGGSAPAAVALALRRIAEDSGGLQIEEAFIGGKQMTMVWAIDRSKLLKELPESASVIQMQPPPTPQVAPTDTDTNSAIIPRPPPLQQPDMWGHPMPPMFPRPRGMPMPRMPPGLMPLQRPFMAPGAVIPMGGGPGPSSAQLKLRTEEDDLKDLELLLNKKTYREKQNTKTGEELLDLIHRPTAKETAVAAKFKTKGGSQLKEYCTNLTKEDCRRQTGSFVACDKVHFRRIIAPHTDTNLGDCSFLDTCRHTKTCKYVHYELDQTPDVPQMMAGAVAPPRQIKPQRAEYCSEIELGESQWINCDIRNFRMDILGQFGVIMADPPWDIHMELPYGTMADDEMRTLNVPALQTDGLIFLWVTGRAMELGRECLELWGYKRVEEIIWVKTNQLQRIIRTGRTGHWLNHSKEHCLVGIKGNPLVNRNIDTDVIVAEVRETSRKPDEMYAMLERISPRTRKLELFARMHNTQAGWLSLGNQLQGVRLVDEGLRARYKAAYPDVEVQPLSPPRTSAPMDVDQSSSQKAAAPDGGERPA

SEQ ID NO: 2009 - DNA, 333 bp, Sorghum bicolor
  misc_feature: Ceres ANNOT ID no. 6017647
  misc_feature: Encodes the peptide sequence at SEQ ID NO 2010
atggaattctgcccggtgtgtgggatgctgctgcagatcgatccgggcaccgcaagccaccgcctgcgcctcttctgctccgtctgcccctacgtctgccccatccagaacaagattgtgaagaaggcgaggttggtcaagaaggaggtggagcccatcttcagcacggcggacgagatgaagtcggcccctaagaccgcagttacatgccaaagatgcaatcatggagaagcatacttcaagcagatgcagattcgatcagctgatgaaccgatgacaacaatatacaggtgttgcaaagaggaatgccagcatgaatggagagaggactga

SEQ ID NO: 2010 - protein, 110 aa, Sorghum bicolor
  misc_feature: Ceres ANNOT ID no. 6017647
  misc_feature (68)..(108): Pfam Id: TFIIS_C Pfam Desc: Transcription factor S-II (TFIIS)
  misc_feature (1)..(54): Pfam Id: RNA_POL_M_15KD Pfam Desc: RNA polymerases M/15 Kd subunit
  misc_feature (3)..(109): NCBI GI: 55245496 NCBI Desc: ensangp00000018390 [anopheles gambiae str. pest]
  misc_feature (3)..(109): NCBI GI: 21956651 NCBI Desc: polr3k [sphoeroides nephelus]
  misc_feature (3)..(109): NCBI GI: 38511445 NCBI Desc: mgc68582 protein [xenopus laevis]
  misc_feature (3)..(109): NCBI GI: 14336676 NCBI Desc: rna polymerase iii subunit cii [homo sapiens]
  misc_feature (3)..(109): NCBI GI: 123999444 NCBI Desc: polymerase (rna) iii (dna directed) polypeptide k, 12.3 kda [synthetic construct]
MEFCPVCGMLLQIDPGTASHRLRLFCSVCPYVCPIQNKIVKKARLVKKEVEPIFSTADEMKSAPKTAVTCQRCNHGEAYFKQMQIRSADEPMTTIYRCCKEECQHEWRED

SEQ ID NO: 2011 - DNA, 1491 bp, Sorghum bicolor
  misc_feature: Ceres ANNOT ID no. 6017720
  misc_feature: Encodes the peptide sequence at SEQ ID NO 2012
atggcatctccgtctccattattggcgctgttcgtggttgtgctgcttgctggtagtgccagctccactgttgatggtgcagatgcgcaaaggtacatagtcgtagctactagttcgctgaagccatcagaagtctgctcaggccataaaggttcttctattacaattagtaacagatatgttgtcctagctagtcttataaggaaatcttgtgagaaggtgatagtgcggcagtatcctgatccagttaccccgtccaagaacggttccacgctagcactgagccaccgtcacggcccgtgctctccggtcatctccaaagagaagccttcgcatgaggaaacgctccgccgagaccaactccgtgccgcctacatccaggcaaaggtttcttctcgatacaataatgtcgccaaagagctccagcagtcggcggtgactatcccgactagctccggctactccctgggcaccacagagtacgtgatcaccgtcaccatcggcacgcccgccgtgacccaggtcatgagcatcgacacaggcagcgacgtctcgtgggtccagtgcgcgccgtgcgccgcgcagtcgtgctcctcgcagaaggacaagctgttcgatccggccatgtccgccacgtactccgccttctcctgcggctctgcccagtgcgcgcagctcggcgacgagggcaatggctgcctgaaatcgcagtgccagtacatcgtcaagtacggcgacggctccaacacggcggggacgtacggctccgacactctgagcctcacctcgtccgacgccgtcaagagcttccagttcgggtgcagccaccgcgcggccggcttcgtgggagagctggacggcctcatggggctcggtggcgacacggagtccctcgtgtcgcagacggcggcgacctacggcaaagcgttctcctactgcctcccgccgccgtcgagctccggcggcgggttcctcaccctcggcgcagcaggtggcgcgtcgtcgtcgcgctactcacacacgcccatggtgagattcagcgttcctaccttctacggcgtgttcctccagggcatcaccgtggccgggaccatgctcaacgtgccggcctcggtcttctccggcgcatccgtcgtcgactccggcaccgtcatcacgcagctgccgcccacggcgtaccaggcgctacggacggcgttcaagaaagagatgaaggcgtacccgtcggcggctccggtgggcagcctggacacctgcttcgacttcagcggcttcaacacgatcacggtgcccacggtgacactgactttctcccgtggcgccgccatggacctcgacatctccggcatcctctacgctggctgcctcgcgttcacggccacggcccatgatggcgacaccggaatcttggggaacgtgcagcagcgtacgttcgagatgctattcgatgttggaggcagaaccattggattccgctctggtgcatgctaa

SEQ ID NO: 2012 - protein, 496 aa, Sorghum bicolor
  misc_feature: Ceres ANNOT ID no. 6017720
  misc_feature (160)..(494): Pfam Id: Asp Pfam Desc: Eukaryotic aspartyl protease
  misc_feature (83)..(496): NCBI GI: 53792202 NCBI Desc: nucleoid dna-binding protein cnd41-like [oryza sativa (japonica cultivar-group)]
  misc_feature (83)..(496): NCBI GI: 115438424 NCBI Desc: os01g0608300 [oryza sativa (japonica cultivar-group)]
  misc_feature (6)..(496): NCBI GI: 115466080 NCBI Desc: os06g0121800 [oryza sativa (japonica cultivar-group)]
  misc_feature (90)..(496): NCBI GI: 8979711 NCBI Desc: nucleoid dna-binding protein cnd41-like protein [arabidopsis thaliana]
  misc_feature (81)..(496): NCBI GI: 2541876 NCBI Desc: cnd41, chloroplast nucleoid dna binding protein [nicotiana tabacum]
MASPSPLLALFVVVLLAGSASSTVDGADAQRYIVVATSSLKPSEVCSGHKGSSITISNRYVVLASLIRKSCEKVIVRQYPDPVTPSKNGSTLALSHRHGPCSPVISKEKPSHEETLRRDQLRAAYIQAKVSSRYNNVAKELQQSAVTIPTSSGYSLGTTEYVITVTIGTPAVTQVMSIDTGSDVSWVQCAPCAAQSCSSQKDKLFDPAMSATYSAFSCGSAQCAQLGDEGNGCLKSQCQYIVKYGDGSNTAGTYGSDTLSLTSSDAVKSFQFGCSHRAAGFVGELDGLMGLGGDTESLVSQTAATYGKAFSYCLPPPSSSGGGFLTLGAAGGASSSRYSHTPMVRFSVPTFYGVFLQGITVAGTMLNVPASVFSGASVVDSGTVITQLPPTAYQALRTAFKKEMKAYPSAAPVGSLDTCFDFSGFNTITVPTVTLTFSRGAAMDLDISGILYAGCLAFTATAHDGDTGILGNVQQRTFEMLFDVGGRTIGFRSGAC

SEQ ID NO: 2013 - DNA, 1518 bp, Sorghum bicolor
  misc_feature: Ceres ANNOT ID no. 6017769
  misc_feature: Encodes the peptide sequence at SEQ ID NO 2014
atggcctcgcaacgtttgctgcttgtgcggctgctcgtgctctgccttgtatgcggcgcttgtgcagcggcgaagcggcgatacctctccgtcagcatggaccaagtgctgaggtccaaggctcacctcgactgccctccctggaacaagaagtcaggttggttttacttacacggtggtgtgggacacatgttgggtgtgacaacgacttccggcaacaagctcacgatcccagcagtctgcgggcttccacgttctccatcgaaatgttgcggcgcatttgagcgccacgtcctcaaccacgacatgaaccgtctgagcaaactcctccagaggtcctccgtctcatcagcagctgccgcaccagctccgtcgcctctccctcgaggaattccgttttttcctccggtggcgccgccagctgaggcgccggccgtgacgatcccggacagcaccgggacgtccctcgacacgctggagttcgtggtcaccgtcggcttcggctcgccggcccagaattacacgctgagcatcgacaccggcagcgacgtgtcgtggatccagtgcctaccgtgctccgggcactgctacaagcagcacgaccctgtcttcgacccgaccaagtccgccacctactccgccgtcccctgcggccacccgcagtgcgcggccgccggcgggaagtgcagcaacagtggcacttgcctctacaaggtcacgtacggcgatggctcgtccaccgctggtgtcctgtcccacgagacgctgtcgctctcctccacacgggatctccccgggttcgcgttcggatgcggccagacaaacctcggtgagttcggcggcgttgatgggctggtcggcctcggccgcggcgcgctgtcgctgccctcgcaagccgccgcgacgttcggcgccaccttctcctactgcctgccgtcgtacgacaccacgcatgggtacctcaccatgggctccaccactccggcggcctccaacgacgacgacgacgtgcagtacacggcgatgatacagaaggaagattacccgtccttgtacttcgtcgaggtcgtctccatcgacatcggcggctacatcctgccggtgccaccgacggtgttcacgagagacggcacgctcttcgactccggcaccatcctcacctacctcccaccggaggcgtacgcttcgctccgggaccggttcaagttcaccatgacgcagtacaagccggcgccggcgtacgaccccttcgacacgtgctacgacttcacgggccataatgcaatcttcatgccggctgtggctttcaagttcagcgacggcgccgtgttcgacctcagccccgtcgcgatcttgatataccccgatgacacggcgcccgccaccggctgcctcgcgttcgtgccgagaccttccacgatgccgttcaacatcatcggcaacacgcagcagcggggcaccgaggtgatctacgacgttgccgcggagaagatcggatttggccagttcacttgctga

SEQ ID NO: 2014 - protein, 505 aa, Sorghum bicolor
  misc_feature: Ceres ANNOT ID no. 6017769
  misc_feature (160)..(503): Pfam Id: Asp Pfam Desc: Eukaryotic aspartyl protease
  misc_feature (146)..(505): NCBI GI: 86438622 NCBI Desc: chloroplast nucleoid binding protein [brachypodium sylvaticum]
  misc_feature (142)..(505): NCBI GI: 53792202 NCBI Desc: nucleoid dna-binding protein cnd41-like [oryza sativa (japonica cultivar-group)]
  misc_feature (142)..(505): NCBI GI: 115438424 NCBI Desc: os01g0608300 [oryza sativa (japonica cultivar-group)]
  misc_feature (141)..(505): NCBI GI: 8979711 NCBI Desc: nucleoid dna-binding protein cnd41-like protein [arabidopsis thaliana]
  misc_feature (148)..(505): NCBI GI: 24430421 NCBI Desc: 41 kd chloroplast nucleoid dna binding protein (cnd41) [nicotiana sylvestris]
MASQRLLLVRLLVLCLVCGACAAAKRRYLSVSMDQVLRSKAHLDCPPWNKKSGWFYLHGGVGHMLGVTTTSGNKLTIPAVCGLPRSPSKCCGAFERHVLNHDMNRLSKLLQRSSVSSAAAAPAPSPLPRGIPFFPPVAPPAEAPAVTIPDSTGTSLDTLEFVVTVGFGSPAQNYTLSIDTGSDVSWIQCLPCSGHCYKQHDPVFDPTKSATYSAVPCGHPQCAAAGGKCSNSGTCLYKVTYGDGSSTAGVLSHETLSLSSTRDLPGFAFGCGQTNLGEFGGVDGLVGLGRGALSLPSQAAATFGATFSYCLPSYDTTHGYLTMGSTTPAASNDDDDVQYTAMIQKEDYPSLYFVEVVSIDIGGYILPVPPTVFTRDGTLFDSGTILTYLPPEAYASLRDRFKFTMTQYKPAPAYDPFDTCYDFTGHNAIFMPAVAFKFSDGAVFDLSPVAILIYPDDTAPATGCLAFVPRPSTMPFNIIGNTQQRGTEVIYDVAAEKIGFGQFTC

SEQ ID NO: 2015 - DNA, 4404 bp, Sorghum bicolor
  misc_feature: Ceres ANNOT ID no. 6018299
  misc_feature: Encodes the peptide sequence at SEQ ID NO 2016
atggcctcgccctcgcctggcacggacgacgacatcggcgacaagcacctgttcgacggcgtccgcttcttgctggtcggattcaacagcgatgacgcgtcccagtaccggtcggagatggtgcggcgcggcggcgccgacgcggggccgtcgggcaacgggtgcacacacgtggtcgtgtggaacctcatctacgatgacccgacgtgcgtggccgcgcgggcgcaagggaagaaggtcgtcaacgggctgtgggtggaggacagcttggattgcggggtgcttgctgatgctgatagggttatgtattggccgatgagagatttgaagggaataccgggtgctccatcattgcttatatgcttgacgggttaccaaaaaagctatcgggaagatatgatgaaaatggtttcattgatgggagcccgattctcaaaacctttgatagcaaatgcggtcactcaccttatttgttataaattcgaaggtgacaagtatgaggttgcaaaaaaggtgaacatcaaacttgttaatcaccggtggttggaagattgcttaaaggcatggaaaattctcccagtcagtgattatagcaaaagtggtaacagagaggtggtggcaggaaggaatttgaacactcctaaccatatcataaatacagaggatgcaaacaacaagacacatgatattagaggtcaaagcagtgccaactctatggttgcagtttctgctaagattgatgtctttgcacccattcaaagtccttctgttcatatcatgaatatagaagatgcagacagcaagacacatcatattacaggccaagacagtcctgactctggtttattggcaagttctgctaaagctgatatacttgcacccattcagtcttccggtgaaaagaaagatatagtaaggaacacagatagtccgaatctgcaggaagttaaagaaaaatatgctggtgcaaggacacaggaccttgcaagtggtgttctaggtcctccaagcacaagcaaaatgactgtttttagaaatcaccatgtagataccttaaatgggaccctgggtattctaaaagtccatacagatcatgtttctggaaaatattctgctagccatgatcaaaccgatgtagctgaagtcttattgaccagccctttgataggaaatcagtctgtggatgagcttgattcatcaaaagatgacaaatggcaacatcaggagaaggatggaccctcaggtattcatatcgcagcacctggtcagttaaatgttgattccaagctcaacaatcatgagtccaatccaaaacctggcagtgattccatgtctaacaacatcaagaacacaagtaatgataaaaaggcctatcggaagtcatttttacaggaagggcattcagttaaccatatggcatcacctcagagagctgaagaaagcacactgagaggttaccccaatatttcttcattagaaacagcacaccaaaaggttgttgaacatgctgatgttcagagcattcaaggcaatcaaaacactaagaatgaggatggagtagatggtacatatgctgagaaaaggaagagcttagtctccccagcttgcttaaatttgcaaaaggaagatcttgtgtcagaaactggtcctttagattctccatttgtgagtagactgagtggtgcatctgaaacagcaaatgtttcatctgaaaggataaatctagttgaaactaatgctattaatttgggaaatcaacactctagcttttctacaagcaaacaaacaagatctaggaagacttctctcaagcatggtggtcccatcggtggaatcaagcttcctgactattcttcaagtgataagaatgtaaaatctttacggaaagcaagaatgtcattcaaagcaacgacagaaagtaaatgcaccatgagttcttcagccactgttcaagatggtaaaacaagtgcaggttttcagtttcagaataaggatggggaaagtacacaaattagtggtaatgcagtaaatcaagattgcttgaatgagataggaaatgcctgcacaaaggatcaggcacatgaaaaatctgtaaacagttcaaataattcacaagttgtaccctattatggaaatgctggcaacaggatagccgatccagtcaaagtgaatggtaatgaagtggcagtggcatcaagttctgaacttaagaaggtggtgtctgatgccactgtgaaagaaagcacgcaacaatttcaaaacacttctaggaatgtccaggctgaaacgagttattcaaagaaagcaccaactactataagaaggaatgctggtgtcaagaggcatctgagtgctaatattgagtctgaaggatcagttatcaacagtgataagaaagttgttcctgaatcctcgcctgccaaagtgatgattcatcatgagcatgctggcccagtctctaaaaatggcaacagcgcagcatgtgcagctgaactcaaaataaatcctccaaagaaagcacctatttgtagagtgacagatactgttgcaaagaggacacgaagtgcttgcaccaagatagatggtacatgggtaggttctagtttgcagttcagtaaagtgatgccccaagaaaatattgagataaaccccacaaaaaatcttgacactgcaaatgctaatgaacaacaaagaaattcacctaagaaaataccaaacactagagtaaggaatagagctgtgaagaggtcattgaaatctgacaccaatatgagcaatgatacattaatggtcaaagctgagacagtggctgctggttcattgtttgatgattggtttccctcaggcaatgttgaagatgaagactggcctaaaaaaattcctggtcatgcaagtgttaatgactgtgaaacactttctcccaagaccgtatcaaatgccagaattaggaatgcagctgccaagaggaaaataaaaactgtagaagacaagtctggtggcaagtttggcaaagttggtagtgccatcacatctgaaacaaaagctttttcatcaaagagaactgaaggtatttcatgcaatatcaacaaagtaattgctgatccagaatctgagaagtccaataaggatgtgaggagagaggtatctggactgttttgccaagattcttgcacgatagacaagcaaggaccatacaattctaagttgagaagcagcaaaagaaataaagctctgacttcagctcatgaaaaggagaacagactaggctgtagtgatctcaactctaaaccagatagaactggcagtttgtgttccatatctgatgcagaatcaatgaagaaaagcacacttgtgctcagtaagcaccaaagggaaaaaataagtgaatctggaaccttgatcacgagtgaacctgcattatttattttaagtggaaatcgtcagcagagaagggattatcgctcaatacttagacgcttgaagggacgagtttgtagggattcacatcattggtcgtatcaagcaacacatttcattgctccagaccctctgaggagaaccgagaagttctttgcagcagctgcagcaggcaggtggatactcaagagagagtacttgacctcgtgcattgaggctggcaagttcctggatgaagaaccatttgaatggtttggtacaggctttaatgatggacaaacaatcagctttgacgctcctagaaaatggcgaaatataaggcagcagatgggtcatggtgccttctacagaatgcagatcgttgtctatggacagctcatatcaccaactctggacacagtaaagcgtgcagtaaaagctggtgacggcgtcattttagcaacattgccgccatacactcgattcctagactccggagttgactttgccgtagtatcagagaccataccaagagcagacgcatgggttcagcagttcatcagtcacggcattccctgtgtcagcgcggattatctggtcgagtacgtctgcaagcctggccaacccctcgaccggcatgttctcttcaagacgaaccacctggccaacaagtctcttgagaaactcatgaagaaccagcaagagatggccatggtgaggtcaaaaccatcggaagacgacgaggacgatccggaggaggacctgagttgctcggtgtgtggccagaaggaccggggagacgtgatgctgatctgcggcgacgaggacggcgagactggctgcgggatcggcatgcacatcgactgctgcgaccctccgctggacgctgtccccgacgacgactggctgtgccccaagtgcgccgtaccgaaatccaaaacgaagcgtactactacatgtggtactaaacgcaagggcagaggagtttccagttccaggcgaaggtga

SEQ ID NO: 2016 - protein, 1467 aa, Sorghum bicolor
  misc_feature: Ceres ANNOT ID no. 6018299
  misc_feature (114)..(186): Pfam Id: BRCT Pfam Desc: BRCA1 C Terminus (BRCT) domain
  misc_feature (1130)..(1210): Pfam Id: BRCT Pfam Desc: BRCA1 C Terminus (BRCT) domain
  misc_feature (1388)..(1442): Pfam Id: PHD Pfam Desc: PHD-finger
  misc_feature (868)..(1365): NCBI GI: 115474221 NCBI Desc: os07g0689900 [oryza sativa (japonica cultivar-group)]
  misc_feature (1141)..(1347): NCBI GI: 28881882 NCBI Desc: cut5-related protein [xenopus laevis]
  misc_feature (1119)..(1380): NCBI GI: 5902138 NCBI Desc: topoisomerase (dna) ii binding protein 1 [homo sapiens]
  misc_feature (1119)..(1380): NCBI GI: 133778287 NCBI Desc: topoisomerase (dna) ii binding protein 1 [homo sapiens]
  misc_feature (1119)..(1380): NCBI GI: 62901464 NCBI Desc: dna topoisomerase ii binding protein 1 (dna topoisomerase iibeta-binding protein 1) (topbp1)
MASPSPGTDDDIGDKHLFDGVRFLLVGFNSDDASQYRSEMVRRGGADAGPSGNGCTHVVVWNLIYDDPTCVAARAQGKKVVNGLWVEDSLDCGVLADADRVMYWPMRDLKGIPGAPSLLICLTGYQKSYREDMMKMVSLMGARFSKPLIANAVTHLICYKFEGDKYEVAKKVNIKLVNHRWLEDCLKAWKILPVSDYSKSGNREVVAGRNLNTPNHIINTEDANNKTHDIRGQSSANSMVAVSAKIDVFAPIQSPSVHIMNIEDADSKTHHITGQDSPDSGLLASSAKADILAPIQSSGEKKDIVRNTDSPNLQEVKEKYAGARTQDLASGVLGPPSTSKMTVFRNHHVDTLNGTLGILKVHTDHVSGKYSASHDQTDVAEVLLTSPLIGNQSVDELDSSKDDKWQHQEKDGPSGIHIAAPGQLNVDSKLNNHESNPKPGSDSMSNNIKNTSNDKKAYRKSFLQEGHSVNHMASPQRAEESTLRGYPNISSLETAHQKVVEHADVQSIQGNQNTKNEDGVDGTYAEKRKSLVSPACLNLQKEDLVSETGPLDSPFVSRLSGASETANVSSERINLVETNAINLGNQHSSFSTSKQTRSRKTSLKHGGPIGGIKLPDYSSSDKNVKSLRKARMSFKATTESKCTMSSSATVQDGKTSAGFQFQNKDGESTQISGNAVNQDCLNEIGNACTKDQAHEKSVNSSNNSQVVPYYGNAGNRIADPVKVNGNEVAVASSSELKKVVSDATVKESTQQFQNTSRNVQAETSYSKKAPTTIRRNAGVKRHLSANIESEGSVINSDKKVVPESSPAKVMIHHEHAGPVSKNGNSAACAAELKINPPKKAPICRVTDTVAKRTRSACTKIDGTWVGSSLQFSKVMPQENIEINPTKNLDTANANEQQRNSPKKIPNTRVRNRAVKRSLKSDTNMSNDTLMVKAETVAAGSLFDDWFPSGNVEDEDWPKKIPGHASVNDCETLSPKTVSNARIRNAAAKRKIKTVEDKSGGKFGKVGSAITSETKAFSSKRTEGISCNINKVIADPESEKSNKDVRREVSGLFCQDSCTIDKQGPYNSKLRSSKRNKALTSAHEKENRLGCSDLNSKPDRTGSLCSISDAESMKKSTLVLSKHQREKISESGTLITSEPALFILSGNRQQRRDYRSILRRLKGRVCRDSHHWSYQATHFIAPDPLRRTEKFFAAAAAGRWILKREYLTSCIEAGKFLDEEPFEWFGTGFNDGQTISFDAPRKWRNIRQQMGHGAFYRMQIVVYGQLISPTLDTVKRAVKAGDGVILATLPPYTRFLDSGVDFAVVSETIPRADAWVQQFISHGIPCVSADYLVEYVCKPGQPLDRHVLFKTNHLANKSLEKLMKNQQEMAMVRSKPSEDDEDDPEEDLSCSVCGQKDRGDVMLICGDEDGETGCGIGMHIDCCDPPLDAVPDDDWLCPKCAVPKSKTKRTTTCGTKRKGRGVSSSRRR

SEQ ID NO: 2017 - DNA, 1707 bp, Sorghum bicolor
  misc_feature: Ceres ANNOT ID no. 6018303
  misc_feature: Encodes the peptide sequence at SEQ ID NO 2018
atggcggcggagcgggacatcgacgacctgccgcggaacgacgccaactacacggcgctcacgccgctctggttcctcgagcgcgccgcgctgacccacccggccagggcctccgtcgtgcacgggcccgtgcgctacacctgggccgacacctacacccgctgccgccgcctcgcctccgccctcgcgcgccgatccgtcggccacggaagcacggtagctgtaatagccccaaatatcccagcgatttatgaagctcattttggagtgcccatggctggggcagtggtcaattgcgtcaacattcgattaaatgctgccactgtagcatttctcttagagcactcctcagcagaagttgtcatggttgaccaagaatttttcaccctggcagaggattctttgaggattatcgctgatcaaaagaaaggtgctttcaaacagccacttctgatagttattggtgacccaacttgcgatccaacgaccctccaagatgctttgagaaaaggagccatcgagtatgaggcattcttggaaagtggagatcctgaatttgcttggaaaccaccacaggatgaatggaagagtatcgcactaggttatacttctgggacaacttctaacccaaagggtgtggtattgcatcacaggggagcttacctaatgtcactgagtggtgctttgatatggggaatgaacgaaggcgctgtctacttgtggactttgccaatgttccattgcaatggctggtgctatacatggacacttgctgctctttgtgggacaagtatatgtcttcgtcaggtttcagcgaaggccatcttctcagcaatagccaaccagggcgtgactcacttctgcggggcaccggtcgtcctgaacaccatcgtcaacgcccctccggccgacacgattctccccctgcctcgtgtcgtcgacgtcatgactgctggcgctgctccgccaccctctgtgctggcggcaatgtcgaagcttgggttccgcatcactcacacctacggcctatcggagacctatggaccatccacggtgtgcgcctggaagccggaatgggacagcctgccagccgacgagcgcgcccgcctccacgcgcgccagggcgtccggtacgtcggcctggagggccttgacgtcgtggacccgcagacgatggcgcccgtcccggccgacggcaccacgatgggggagatcgtgatgcgcgggaacggcgtcatgaaggggtacctgaagaaccccagggcgaacgcggaggcgttcgagaacgggtggttccactcgggcgacctgggcgtgcggcacggcgacgggtacgtcgaggtgagggaccgcgccaaggacatcatcatctccggcggggagaacatcagcagcctggaggtggagaaggcggtgtacctgcacccggcggtgctggaggcgtcggtcgtggcccgcgccgacgagcagtggggggagtcgccgtgcgcgttcgtgacgctcaaggacgccgccgtggatcgctccgacgaggcggcgctggcgcgagacatcatggcgttctgccgcgagaggctgcccggctactgggtgcccaagtccgtggtgttcgggccgctgcccaagacggccaccggcaagatcaagaagcatgagctcagggccaaggccaaggaactgggtcccgtccggaagagcaggatgtga

SEQ ID NO: 2018 - protein, 568 aa, Sorghum bicolor
  misc_feature: Ceres ANNOT ID no. 6018303
  misc_feature (47)..(483): Pfam Id: AMP-binding Pfam Desc: AMP-binding enzyme
  misc_feature (1)..(568): NCBI GI: 115452557 NCBI Desc: os03g0305000 [oryza sativa (japonica cultivar-group)]
  misc_feature (1)..(568): NCBI GI: 20799723 NCBI Desc: adenosine monophosphate binding protein 7 ampbp7 [arabidopsis thaliana]
  misc_feature (1)..(568): NCBI GI: 7670021 NCBI Desc: amp-binding protein [arabidopsis thaliana]
  misc_feature (10)..(560): NCBI GI: 82946441 NCBI Desc: acyl-coa synthetase (amp-forming)/amp-acid ligase ii [magnetospirillum magneticum amb-1]
  misc_feature (10)..(560): NCBI GI: 67157301 NCBI Desc: amp-dependent synthetase and ligase [azotobacter vinelandii avop]
MAAERDIDDLPRNDANYTALTPLWFLERAALTHPARASVVHGPVRYTWADTYTRCRRLASALARRSVGHGSTVAVIAPNIPAIYEAHFGVPMAGAVVNCVNIRLNAATVAFLLEHSSAEVVMVDQEFFTLAEDSLRIIADQKKGAFKQPLLIVIGDPTCDPTTLQDALRKGAIEYEAFLESGDPEFAWKPPQDEWKSIALGYTSGTTSNPKGVVLHHRGAYLMSLSGALIWGMNEGAVYLWTLPMFHCNGWCYTWTLAALCGTSICLRQVSAKAIFSAIANQGVTHFCGAPVVLNTIVNAPPADTILPLPRVVDVMTAGAAPPPSVLAAMSKLGFRITHTYGLSETYGPSTVCAWKPEWDSLPADERARLHARQGVRYVGLEGLDVVDPQTMAPVPADGTTMGEIVMRGNGVMKGYLKNPRANAEAFENGWFHSGDLGVRHGDGYVEVRDRAKDIIISGGENISSLEVEKAVYLHPAVLEASVVARADEQWGESPCAFVTLKDAAVDRSDEAALARDIMAFCRERLPGYWVPKSVVFGPLPKTATGKIKKHELRAKAKELGPVRKSRM

SEQ ID NO: 2019 - DNA, 1404 bp, Sorghum bicolor
  misc_feature: Ceres ANNOT ID no. 6018311
  misc_feature: Encodes the peptide sequence at SEQ ID NO 2020
atggcttcccgcctcttaaccagatcagcggcggcgcgcctcgtctcccgcctccaccgcaagacgctacgcactgctcaccgccccctctcccacgccgccgccttggcgtccctcctggggcccactgatggcctcccccacgccgccgactccacgctcctccgcgttccggtgcggtggttctcctctccgtccacggaggcgttggcggaggctccgatgaccgctgacggcctgacggtagattcgatcgccgacaaggggtggaccatccttcccgaagccgacagcgactggcgcagccacgccgccgccgtcgcgcagtccgtcaagctcatcaagaagcgcctcaagtggggatggatacttgagagaacgaagcaattggctgtggtgttggagaggccagacctctgggaagatccagtttttgctgggagggttagccgtgagcagggtgagctcatgggcaagattaagtcagtgaaccagtttgagcaggaattgattgaacacattgagatgctacggcttgcacgtgaagaaaacgataatgaacttgagatggaaagcatgagggctttagccgatatgagaagaagtgcaaaggagaaagaacttaatgcgttactttctggagacaatgactcttgtccttgcttcattgaggttcaggcaggggctggtggcaccgagagtatggactgggctgcaatggtcatgaacatgtataggtcatgggcccagcgacgaggatatacagtcactgtggtagaagagatgcctggtgaagtagcaggaatcaagagggccactatcaaagttgatggtgaatatgcatttggatatgccaaagctgaagtaggagttcatagattggtgcgaatttctccatttgacagtggaaagcgacggcacacttcctttgcagctgttgctgtaatacctattcttggggatgctgctagccgataccagatcaaagattctgatcttaggatagaacgtttccgttctggtggccctggtggtcagcatgccaacactacagagagtgccattcgaattgtgcacatcccaactggtataagtgcaacatgtcaaaatgaaagatcacagcacatgaacaaggcatcagcaatggcagtgctccaatctcgtcttgatcagcttgagattgctcgccaagcacagatgaatgcagagcacacacaatcactcaatgaaatcagctggggcaaccaaataagatcttatgttctccatccataccgtatggtcaaagatctccggacgaactatgaagtatctgaccccgattcagtcctagaaggagacatagatgatttcatcttgaattatttgtcttcatcactggatgaagctgatgtaagtacctga

SEQ ID NO: 2020 - protein, 467 aa, Sorghum bicolor
  misc_feature: Ceres ANNOT ID no. 6018311
  misc_feature (319)..(432): Pfam Id: RF-1 Pfam Desc: Peptidyl-tRNA hydrolase domain
  misc_feature (178)..(288): Pfam Id: PCRF Pfam Desc: PCRF domain
  misc_feature (106)..(466): NCBI GI: 69934478 NCBI Desc: peptide chain release factor 2 [paracoccus denitrificans pd1222]
  misc_feature (106)..(466): NCBI GI: 119384552 NCBI Desc: peptide chain release factor 2 [paracoccus denitrificans pd1222]
  misc_feature (107)..(460): NCBI GI: 83951928 NCBI Desc: peptide chain release factor 2 [roseovarius nubinhibens ism]
  misc_feature (101)..(460): NCBI GI: 56551094 NCBI Desc: protein chain release factor b [zymomonas mobilis subsp. mobilis zm4]
  misc_feature (107)..(452): NCBI GI: 85374178 NCBI Desc: protein chain release factor b [erythrobacter litoralis htcc2594]
MASRLLTRSAAARLVSRLHRKTLRTAHRPLSHAAALASLLGPTDGLPHAADSTLLRVPVRWFSSPSTEALAEAPMTADGLTVDSIADKGWTILPEADSDWRSHAAAVAQSVKLIKKRLKWGWILERTKQLAVVLERPDLWEDPVFAGRVSREQGELMGKIKSVNQFEQELIEHIEMLRLAREENDNELEMESMRALADMRRSAKEKELNALLSGDNDSCPCFIEVQAGAGGTESMDWAAMVMNMYRSWAQRRGYTVTVVEEMPGEVAGIKRATIKVDGEYAFGYAKAEVGVHRLVRISPFDSGKRRHTSFAAVAVIPILGDAASRYQIKDSDLRIERFRSGGPGGQHANTTESAIRIVHIPTGISATCQNERSQHMNKASAMAVLQSRLDQLEIARQAQMNAEHTQSLNEISWGNQIRSYVLHPYRMVKDLRTNYEVSDPDSVLEGDIDDFILNYLSSSLDEADVST

SEQ ID NO: 2021 - DNA, 1341 bp, Sorghum bicolor
  misc_feature: Ceres ANNOT ID no. 6018312
  misc_feature: Encodes the peptide sequence at SEQ ID NO 2022
atgacgacggagcaacccgtcacggccgaccgacgagctcggcagcatcgtctgctcccccttctggtcctccccgtcttcttcctcgtcgcgccgtgcgctctcttcttcttcagatcgtccgacttggccctcatcccccgcatccgcatcgagttcgaccgcccacctaaaaatgagccgccgccagcagagccagtgccactgacgtcgccaccaccaccaccgcctccggctccgggtgcgaacgatgacgaggagcaacgacggctaccgcctccgcgccagctgacggacccaccgtactcgctcggcccgaccgccgactacgacgcgcgcagggcccagtggctccgcgacaacccgcggttcccggccttcgtcgcgccggggaggccccgggtgctcgtggtcaccgggtcgtcgccgcgccggtgcagcgacccggacggcgagcacttgctgctccgggcgttcaagaacaaggcggactactgccgcgtccacggcttcgacatcttctacagcaccgcggtgctcgacgccgagctgccggggttctggtccaagctgccgctgctgcggacgctgatgctggcgcacccggaggcggagctcctgtggtgggtggactccgacgtgatcttcaccgacatgctcttcgagccgccgtgggacaagtacgccggccacaacctcgtgctcccgggctcggaggagaaggtgtacaccgccaagagctggatcggcatcaacgccggcagcttcatcatccgcaactgccagtggtcgctggacctgctcgacgcgcttgcccggatggggccgcgcggccccgtgcgcgagatgtacggcagggtcatcgccgggacgctctccgaccggcagccgtacgaggcctgcgaccagtcggcgctcgtctacctgctcgtgacggagcggcgcaggtggggcgacaagacgttcctcgagagctcctactgcctcagcggcttctgggtctacatcgtggacaagctcgaggagatgcggcggcgggattcgacgacgaccccgccggagcccggccacgaacggtggccgctgacgacgcacttcatggggtgcaagccgtgcggcggggacgactccacctacgacgccgcctggtgccggcgctcgatggagcgtgctctcaacttcggcgacgaccagatactcaacctttacgggttcgagcacaagacgctcaacaccaccgccgtgcggcgcgtccggaacgacactggcgggccgctggacgcggccgacgaggagctcggacggctcttgcatcccacgttcagggctgccaacttgtga

SEQ ID NO: 2022 - protein, 446 aa, Sorghum bicolor
  misc_feature: Ceres ANNOT ID no. 6018312
  misc_feature (131)..(379): Pfam Id: Glyco_transf_34 Pfam Desc: galactosyl transferase GMA12/MNN10 family
  misc_feature (97)..(443): NCBI GI: 115452505 NCBI Desc: os03g0300000 [oryza sativa (japonica cultivar-group)]
  misc_feature (95)..(446): NCBI GI: 7362752 NCBI Desc: alpha galactosyltransferase-like protein [arabidopsis thaliana]
  misc_feature (85)..(446): NCBI GI: 55956970 NCBI Desc: beta-6-xylosyltransferase [vitis vinifera]
  misc_feature (94)..(446): NCBI GI: 55956974 NCBI Desc: beta-6-xylosyltransferase [gossypium raimondii]
  misc_feature (86)..(446): NCBI GI: 55956972 NCBI Desc: beta-6-xylosyltransferase [pinus taeda]
  misc_feature (95)..(446): SWISSPROT Homolog: EC 2.4.2.39 Xyloglucan 6-xylosyltransferase
  misc_feature: Useful for making plants with altered cell wall content and/or composition
  misc_feature: Functional homolog of the protein sequence encoded by LOCUS at3g62720
  misc_feature: Functional homolog of the protein sequence encoded by LOCUS at4g02500
  misc_feature: Useful for making plants with altered carbohydrate content
  misc_feature: Functional homolog of the protein sequence given in SEQ ID NO 13770
  misc_feature: Useful for making plants with altered cell wall content and/or composition
  misc_feature: Functional homolog of the protein sequence given in SEQ ID NO 13771
MTTEQPVTADRRARQHRLLPLLVLPVFFLVAPCALFFFRSSDLALIPRIRIEFDRPPKNEPPPAEPVPLTSPPPPPPPAPGANDDEEQRRLPPPRQLTDPPYSLGPTADYDARRAQWLRDNPRFPAFVAPGRPRVLVVTGSSPRRCSDPDGEHLLLRAFKNKADYCRVHGFDIFYSTAVLDAELPGFWSKLPLLRTLMLAHPEAELLWWVDSDVIFTDMLFEPPWDKYAGHNLVLPGSEEKVYTAKSWIGINAGSFIIRNCQWSLDLLDALARMGPRGPVREMYGRVIAGTLSDRQPYEACDQSALVYLLVTERRRWGDKTFLESSYCLSGFWVYIVDKLEEMRRRDSTTTPPEPGHERWPLTTHFMGCKPCGGDDSTYDAAWCRRSMERALNFGDDQILNLYGFEHKTLNTTAVRRVRNDTGGPLDAADEELGRLLHPTFRAANL

SEQ ID NO: 2023 - DNA, 393 bp, Sorghum bicolor
  misc_feature: Ceres ANNOT ID no. 6018316
  misc_feature: Encodes the peptide sequence at SEQ ID NO 2024
atggccacctcggtctccgccgtggccgccctagccgttttctcggctccaagaagcctccttcagcgcccggcccagctgccgtcccgccagaacgtcgtgtcgttcttcgtcgggccggcgcgggcgcaccgccggttggtggccgtggcggccagctcgccggccacgccgccggatcttgccaacaaggtgtccgagagcatcaagcaggccaaggagacgtgcgcggatgacccggtgagcgccgagtgcgtggcggcgtgggacgaggtggaggagctcagcgcggccgccagccacgcgcgcgaccggcagaagggcgtcgacccgctcgaggagtactgcaaggacaaccccgagaccgacgagtgccgcacgtacgaggactga

SEQ ID NO: 2024 - protein, 130 aa, Sorghum bicolor
  misc_feature: Ceres ANNOT ID no. 6018316
  misc_feature (61)..(130): Pfam Id: CP12 Pfam Desc: CP12 domain
  misc_feature (8)..(130): NCBI GI: 1617213 NCBI Desc: cp12 [spinacia oleracea]
  misc_feature (5)..(130): NCBI GI: 1617206 NCBI Desc: cp12 [pisum sativum]
  misc_feature (3)..(130): NCBI GI: 23505751 NCBI Desc: at2g47400/t8i13.24 [arabidopsis thaliana]
  misc_feature (38)..(130): NCBI GI: 82697169 NCBI Desc: chloroplast protein 12 precursor [cynara scolymus]
  misc_feature (1)..(130): NCBI GI: 21555170 NCBI Desc: cp12 protein precursor-like protein [arabidopsis thaliana]
MATSVSAVAALAVFSAPRSLLQRPAQLPSRQNVVSFFVGPARAHRRLVAVAASSPATPPDLANKVSESIKQAKETCADDPVSAECVAAWDEVEELSAAASHARDRQKGVDPLEEYCKDNPETDECRTYED

SEQ ID NO: 2025 - DNA, 675 bp, Sorghum bicolor
  misc_feature: Ceres ANNOT ID no. 6018317
  misc_feature: Encodes the peptide sequence at SEQ ID NO 2026
atggacggcggcggggtcgacacgggcacgacggcggcgtggatggagaagcaccggcagatgtacgagcgggccacccggcacccgttcaccgtctccatccgcgacggtaccgtcgacatgtctgccttcaagcgctggctgagccaggactatctgtttgtaagggaatttgttgcatttatagcaagtgtgttgcttaaatgctgcaagcaagaagacagctcggacatggaaattatcctgggtggagtagcttctatcagcgatgagatctcttggttcaagaatgaagctaccagatggggtgtcaatctagcaagtgtttctcccttaaaagccaatttagagtaccacaggtttctccagagctttactgagccagaggttagctatgttgttgctgtaacaaccttctggataattgaaaccgtgtaccaggacagtttcggtttctgtatacaagatggtaataggacgcccccggagtttttaggcccctcccagagatggggcagcgctgggttcagacagtactgccagtctctgcagagcatcgtggatcgctgcttggctaatgcgccagctgatgctgtcaagagtgctgaagaggccttcatccgggtactcgagctggaaattggtttctgggaaatgagctcttctcagtcctaa

SEQ ID NO: 2026 - protein, 224 aa, Sorghum bicolor
  misc_feature: Ceres ANNOT ID no. 6018317
  misc_feature (15)..(223): Pfam Id: TENA_THI-4 Pfam Desc: TENA/THI-4/PQQC family
  misc_feature (9)..(220): NCBI GI: 15228931 NCBI Desc: tena/thi-4 family protein [arabidopsis thaliana]
  misc_feature (9)..(220): NCBI GI: 85544579 NCBI Desc: chain b, x-ray structure of gene product from arabidopsis thaliana at3g16990
  misc_feature (9)..(220): NCBI GI: 140041503 NCBI Desc: tena/thi-4 protein [medicago truncatula]
  misc_feature (9)..(220): NCBI GI: 62287132 NCBI Desc: seed maturation protein pm36
  misc_feature (78)..(220): NCBI GI: 13605533 NCBI Desc: at3g16990/k14a17_11 [arabidopsis thaliana]
MDGGGVDTGTTAAWMEKHRQMYERATRHPFTVSIRDGTVDMSAFKRWLSQDYLFVREFVAFIASVLLKCCKQEDSSDMEIILGGVASISDEISWFKNEATRWGVNLASVSPLKANLEYHRFLQSFTEPEVSYVVAVTTFWIIETVYQDSFGFCIQDGNRTPPEFLGPSQRWGSAGFRQYCQSLQSIVDRCLANAPADAVKSAEEAFIRVLELEIGFWEMSSSQS

SEQ ID NO: 2027 - DNA, 1815 bp, Sorghum bicolor
  misc_feature: Ceres ANNOT ID no. 6018321
  misc_feature: Encodes the peptide sequence at SEQ ID NO 2028
atggaggcccagaacgtggaggttgctgccctggtgcagaagatcgcggccctccacgccgacatcgccaagctgccgtcgctgagcccgtcccccgtcgtcgacgctctgttcaccaacctcgtcatggcctgcgtcccgccgagccccgtcgacgtgaccaagctcagcccggacgcccagaggatgcgggaggagctcatccgcctctgctccgacgccgagggccacctcgaggcgcactacgccgacatgctcggcggcttcgacaacccgctcgaccacctcggtcgcttcccgtacttcagcaactacatcaacctgagcaagctcgagtacgaccttctggtccgctacatcccagggctcgcgccttcccgcgtcgccttcgtcgggtcaggtcccttgccgttcagctcgctcgtgctcgccgcacgccacctgcccaacacactgttcgacaactacgaccggtgcggcgccgccaacgaccgtgcgcggaagctggtccgtgcggacaaggacctgaacgcgcgcatgtccttccacacggtggacgtcgccaacctgaccgacgagctcggcaagtacgacgtcgtcttccttgcggcgctcgtcggcatggcggccgaggacaaggccaaggtggtggcgcaccttggcaggcacatggccgacggggcggctctcgtcgtgcggagcgcgcacggggctcgcgggtttctgtaccccatcgttgatcccgaggacatccgtcgcggcgggttcgacgttctgacggtgtaccacccggacggcgaggtgatcaactctgtcatcatcgcgcgcaagatcgacgcccacgcaaagacggaggtttctgccctggtgcagaagataaccggcctgcacgccgccatcaccaagctgccatcgctgagcccgtcccccgacgtcgacgcgctgttcaccgagctcgtcatggcctgcgtcccaccgagccccgtcgacgtgaccaagctcggcccggacgcgcagaggatgcgagaggagctcatccgcctctgctccgacgccgagggacacctcgaggcgcactacgccgacatgctcgccggcttcgacaacccgctcgaccacctcggccgcttcccttacttcagcaactacgtcaacctgagcaagctggagtacgacctcctggtccgctatgtcccgggcctggcgccttcccgcgtcgccttcgtcgggtcaggccccctgccgttcagctcgctcgtgctcgccgcgcgccacctgccgaacgcgctgttcgacaactacgaccggtgcggcgccgccaacgaccgtgcccggaagctggtccgcgcggacgagggcctgcggaagcgaatgtccttccacaccgccgacgtcgccagcctcacggacggcctcggcaagtacgacgtggtgttcctggccgccctcgtcggcatggcggccgaggacaaggccaaggtggtggcgcaccttggcaggcacatggcggacggggcggcgctcgtcgtgcggagcgcgcacggggctcgcgggttcctgtacccgatcgtcgaccctgaggacatccggcgcggcgggttcgacgtgctcgccgtgtaccacccggacgacgaggtcatcaactccgtcatcatcgcgcggaagacggacgcccacgccaagggacctcagaatgggcacgcgcatgcgcgcggcgcggtgccgatagtgagcccgccgtgcaagtgctgcaagatggaggcgaacgcgctgcagaagagggaggagatggcgacgacggagctgtccatctga

SEQ ID NO: 2028 - protein, 604 aa, Sorghum bicolor
  misc_feature: Ceres ANNOT ID no. 6018321
  misc_feature (3)..(283): Pfam Id: NAS Pfam Desc: Nicotianamine synthase protein
  misc_feature (284)..(561): Pfam Id: NAS Pfam Desc: Nicotianamine synthase protein
  misc_feature (1)..(599): NCBI GI: 20387262 NCBI Desc: zmnas2 [zea mays]
  misc_feature (285)..(604): NCBI GI: 19911064 NCBI Desc: zmnas1 [zea mays]
  misc_feature (285)..(604): NCBI GI: 68846417 NCBI Desc: nicotianamine synthase 2 (s-adenosyl-l-methionine:s-adenosyl-l-methionine:s-adenosyl- methion ine 3-amino-3-carboxypropyltransferase 2) (osnas2)
  misc_feature (285)..(604): NCBI GI: 11176991 NCBI Desc: nicotianamine synthase 2 [oryza sativa (indica cultivar-group)]
  misc_feature (285)..(604): NCBI GI: 68846451 NCBI Desc: nicotianamine synthase 1 (s-adenosyl-l-methionine:s-adenosyl-l-methionine:s-adenosyl- methion ine 3-amino-3-carboxypropyltransferase 1) (osnas1)
  misc_feature (285)..(604): SWISSPROT Homolog: EC 2.5.1.43 Nicotianamine synthase 2
MEAQNVEVAALVQKIAALHADIAKLPSLSPSPVVDALFTNLVMACVPPSPVDVTKLSPDAQRMREELIRLCSDAEGHLEAHYADMLGGFDNPLDHLGRFPYFSNYINLSKLEYDLLVRYIPGLAPSRVAFVGSGPLPFSSLVLAARHLPNTLFDNYDRCGAANDRARKLVRADKDLNARMSFHTVDVANLTDELGKYDVVFLAALVGMAAEDKAKVVAHLGRHMADGAALVVRSAHGARGFLYPIVDPEDIRRGGFDVLTVYHPDGEVINSVIIARKIDAHAKTEVSALVQKITGLHAAITKLPSLSPSPDVDALFTELVMACVPPSPVDVTKLGPDAQRMREELIRLCSDAEGHLEAHYADMLAGFDNPLDHLGRFPYFSNYVNLSKLEYDLLVRYVPGLAPSRVAFVGSGPLPFSSLVLAARHLPNALFDNYDRCGAANDRARKLVRADEGLRKRMSFHTADVASLTDGLGKYDVVFLAALVGMAAEDKAKVVAHLGRHMADGAALVVRSAHGARGFLYPIVDPEDIRRGGFDVLAVYHPDDEVINSVIIARKTDAHAKGPQNGHAHARGAVPIVSPPCKCCKMEANALQKREEMATTELSI

SEQ ID NO: 2029 - DNA, 1914 bp, Sorghum bicolor
  misc_feature: Ceres ANNOT ID no. 6018323
  misc_feature: Encodes the peptide sequence at SEQ ID NO 2030
atggagaggcagaggagccccttctcctgctcctggtcgtaccactgccacctgctgagcccaaagagcctcttcctcgcttccttcgcctccttatccctcctcttctcttttctcttggccttccgccatggccgctcgctccaccttccctttgcgctcgccgcagccccggcgccggttctcgtgggcggtgggggttactggggcgacccagcggcggtggaggttgaagaggcggttctcgggctcaggagaggggaatcggccgcggagggagcccgcaccgctgttcccggagacttgtcggtgcgcggcgtgggctcggtaacgcaggcgcaggaagctgttactccaggagggaatggcagagcaccctcgaatggtgaggttttcaaagagcaaaagatcgtggaagctggaaaccactcttttggttttggaggcttggattcggctgtggaggaggtgaaggaagctgctcctgaaggtggaggtggcgagaggttgtcagaagattcgatttcagagagaccagtcatagcagaaggcaagaatcttagcaaagaagttcttggttcgccaactgcatcagcagagaaatcggagggaacggggtctgcgcgagctgtcaatttctccatacaagcttcaggtcccttaaaggggtcgaaaggcgaattcttgcaagatggacatgttgacggtagggctatttcctctgtgcatggagcttatgcttctgaacaaggggaacgatgggaaagctcagatcgttcaacagtgaagtacaaaccaggagcagctccagtgaatccaactaaacaagaacctaatccgaatccagaaatggctgcgagcaaaattggtttggcgcaaagcaatgctgcaaactgtgatgtttctgatgggagttgggtgtttgacgagagctatccagtctacgcgagcaatgtgtgcccatttatagatgaaggattcagctgtgaagctaatgggagagtggaccaaagctatatgaagctcaggtggcaacctaagcattgcagcattccaaggtttgatgctaggaaaatgcttgagatgctgcgaggaaagcgactagtgtttgttggagattccattaacaggaaccaatgggaatccatgatgtgcttgctgagtacggaaatctcagatcctgcaaggattcatgaaactcgtggccgcaagattaagagagagaaacgatattacaacttcgtgttcttggactataattgcagtgtagagtatcatgccacacatttcttggtgcatgaagccaaggcaagaatgggccagaagggcacaatgacgctatggatcgataccatagatcggagctcatcaagatggaaaggtgctgatgtgcttgtgttcaactctgctcattggtggtcacgtcacaaaacaaatgatggagtgaatttctatcaagaaggagatcatgttcacccatatcttgatgcctccacagctttccaaagagcactaacgacatgggcattgtgggttgaccgctacatcaatccacagcgaactcgagtgttcttccgaagcacatcgccgtcacatttcagcggaggagagtggaattcagggggacactgcagagagagcacactaggccctaatgacagccgtctatggccaatgcctgagataaacgtgatgctggaacaagtctctaagcaaatgaagaatcctgtgacaattctgaacatcactgatctatccaggctaagaatggatggtcacccatctgtttatcgacggaagggagtagatttaacagcatcgagtgcccaggactgcagccactggtgccttcctggagtcccagacacatggaatgagctgctgttctaccatctagtgtcctcacgagaatag

SEQ ID NO: 2030 - protein, 637 aa, Sorghum bicolor
  misc_feature: Ceres ANNOT ID no. 6018323
  misc_feature (1)..(555): NCBI GI: 115452595 NCBI Desc: os03g0307700 [oryza sativa (japonica cultivar-group)]
  misc_feature (87)..(633): NCBI GI: 51091192 NCBI Desc: lustrin a-like [oryza sativa (japonica cultivar-group)]
  misc_feature (87)..(633): NCBI GI: 115467002 NCBI Desc: os06g0207500 [oryza sativa (japonica cultivar-group)]
  misc_feature (158)..(618): NCBI GI: 115448981 NCBI Desc: os02g0773600 [oryza sativa (japonica cultivar-group)]
  misc_feature (245)..(635): NCBI GI: 116310768 NCBI Desc: osigba0101p20.4 [oryza sativa (indica cultivar-group)]
  misc_feature: Useful for making plants with altered cell wall content and/or composition
  misc_feature: Functional homolog of the protein sequence given in SEQ ID NO 13772
MERQRSPFSCSWSYHCHLLSPKSLFLASFASLSLLFSFLLAFRHGRSLHLPFALAAAPAPVLVGGGGYWGDPAAVEVEEAVLGLRRGESAAEGARTAVPGDLSVRGVGSVTQAQEAVTPGGNGRAPSNGEVFKEQKIVEAGNHSFGFGGLDSAVEEVKEAAPEGGGGERLSEDSISERPVIAEGKNLSKEVLGSPTASAEKSEGTGSARAVNFSIQASGPLKGSKGEFLQDGHVDGRAISSVHGAYASEQGERWESSDRSTVKYKPGAAPVNPTKQEPNPNPEMAASKIGLAQSNAANCDVSDGSWVFDESYPVYASNVCPFIDEGFSCEANGRVDQSYMKLRWQPKHCSIPRFDARKMLEMLRGKRLVFVGDSINRNQWESMMCLLSTEISDPARIHETRGRKIKREKRYYNFVFLDYNCSVEYHATHFLVHEAKARMGQKGTMTLWIDTIDRSSSRWKGADVLVFNSAHWWSRHKTNDGVNFYQEGDHVHPYLDASTAFQRALTTWALWVDRYINPQRTRVFFRSTSPSHFSGGEWNSGGHCRESTLGPNDSRLWPMPEINVMLEQVSKQMKNPVTILNITDLSRLRMDGHPSVYRRKGVDLTASSAQDCSHWCLPGVPDTWNELLFYHLVSSRE

SEQ ID NO: 2031 - DNA, 2700 bp, Sorghum bicolor
  misc_feature: Ceres ANNOT ID no. 6018325
  misc_feature: Encodes the peptide sequence at SEQ ID NO 2032
atggcttcgtcgtcgaaggcctccgactcctcctcccaacgatccaagcggtcggatcaggggatgatgggcagggacgccgctgccgcctctgctgtctcgatccacgcgaacctgacgcagctgatacgccaaatcaaatcggggcgcctcgcgtacatcaaggagaaattggaggcgaacaggaagacgctgcagaggcactcctgtgcgctgttcgacgtggcagcggcggcggaggtggcgtcgaggggcacctatggcggcaacgcgctgtcgcagcgcgcggcggagggacagtccaggctcgctgggtcagacctggcaaacgggataggggagagggacgtggtgtacatgcaggaggagaacctggcggccgggacgctcgcgctctccagctcgggcgctgccgcgcagcggacagtcgtgcggttcgtgaagctgccgttggttgagaggatccctccgtacaccacttggattttcctggacaaaaaccaaagaatggccgacgatcagtcagttgttggtaggagaagaatttactatgatccagttggaaatgaggctctgatctgcagtgacagtgatgaagaaatcccagaaccagaggaagagaaacactttttcacagagggagaagatcaattgatatggagagctactcaagagcatgggttaaaccgagaggttattaatgtcctctgccagtttattgatgcaactccatcagaaattgaggaaagatctgaagttctatttgagaaaaatgagaagcactctgcatcttcagacaagatagaaagccaactttctctggacaaaactatggatgctgttctggattcttttgataatctcttctgccgcagatgcttggtttttgattgccgcctccatggttgctcacagaatttggtattcccatgtgagaagcaaccctacagctttgagcctgctgaaaacaagaagccatgtggtcatcagtgctaccttcgatttccccagtggagagaaggatttcaagagatgcatgatgatggtcttggtggctgtgcaacatatactatggaatcaggaaccgcctcacacaaagttgatgttaatattatgtctgaatcagaagattcaaaccgagagaaaggcaacattagatccatgacactatttggaaccagtggatcaaaaataatttcttctgttagcgctgaggaaagcactactccgccttcagcagatacctctgaaacagagaatgtaccctctgatttgcctcccagtagtttaaggaaacacaagatttcaaaacatggacctaggtacagggagcgttctcctggcaaaaggcagaaggtttttacttctgacatttcttttgcaagcaatatactgaataaactttccattccggagattcgtgacacaagaccagagtctagagaatccgggggtgataaactacgaattcttgacgagtccactaagaagacttcaagcaaagatatctatggagaaaacccaactactactactgaaaatgtgggaagagaaagtaataaagtatcttcaacaaataatttgtcggagcacactctttcttgttggagtgccttagagcgagatctatacttgaagggcatagagatatttggaaagaacagctgtctcattgccagaaatttactatctggtctgaagacctgcatggaagtggccaactacatgtacaacaatggtgcagcgatggcgaagagacctctcttgaataaatccatctcgggcgactttgcagaaactgaacaagactacatggagcaagacatggttgccagaacaagaatctatcgtcggaggggccgcaatcggaagctgaaatatacttggaagtctgcagggcatccaactgttagaaaaagaattggtgatgggaagcaatggtacacacaatataacccatgtgtgtgccagcaaatgtgtggtaaagattgcccctgtgtggaaaatggaacttgctgcgaaaagtactgtgggtgttcgaagagctgcaaaaacaagtttagaggctgtcattgtgcaaaaagtcaatgcagaagcagacagtgcccctgttttgcagccaatcgtgaatgtgatccagatgtttgtaggaattgctgggtgagctgtggggatggttcactaggtgagccacctgcaagaggtgatggctatcagtgtggaaatatgaagctccttttgaaacaacagcaaaggattttgttaggaaggtctgatgttgcaggttggggtgcattcattaagaatcctgtaaataaaaatgattatcttggagaatatactggtgaattgatctctcacaaggaagcagacaaacgcggcaaaatttatgaccgggcaaactcatcatttctatttgatttaaatgaccagtatgtattggatgcttatcgcaagggggacaaattgaagttcgcaaatcactcatctaaccccaactgctatgcaaaggtgatgttggtggctggcgaccatcgggttggtatctatgcgaaggagcatattgaggctagcgacgaactcttttatgattatcgttatgggcctgaccaggctccagcttgggctaggagacccgaaggatcaaagaaggacgaagcatccgtctctcatcatcgagcacacaaagttgctcgatag

SEQ ID NO: 2032 - protein, 899 aa, Sorghum bicolor
  misc_feature: Ceres ANNOT ID no. 6018325
  misc_feature (745)..(872): Pfam Id: SET Pfam Desc: SET domain
  misc_feature (685)..(725): Pfam Id: CXC Pfam Desc: Tesmin/TSO1-like CXC domain
  misc_feature (1)..(899): NCBI GI: 20152911 NCBI Desc: enhancer of zeste-like protein 3 [zea mays]
  misc_feature (1)..(899): NCBI GI: 20152909 NCBI Desc: enhancer of zeste-like protein 2 [zea mays]
  misc_feature (2)..(899): NCBI GI: 22535907 NCBI Desc: set domain-containing protein [oryza sativa]
  misc_feature (2)..(899): NCBI GI: 29565495 NCBI Desc: enhancer of zeste protein [oryza sativa (indica cultivar-group)]
  misc_feature (2)..(898): NCBI GI: 115338495 NCBI Desc: enhancer of zeste 1 [triticum monococcum]
  misc_feature: Useful for biocontainment applications
  misc_feature: Useful for making plants with modulated endosperm cell number
  misc_feature: Useful for making plants with modulated endosperm cell size
  misc_feature: Useful for making plants with modulated seed size
  misc_feature: Functional homolog of the protein sequence given in SEQ ID NO 13516
MASSSKASDSSSQRSKRSDQGMMGRDAAAASAVSIHANLTQLIRQIKSGRLAYIKEKLEANRKTLQRHSCALFDVAAAAEVASRGTYGGNALSQRAAEGQSRLAGSDLANGIGERDVVYMQEENLAAGTLALSSSGAAAQRTVVRFVKLPLVERIPPYTTWIFLDKNQRMADDQSVVGRRRIYYDPVGNEALICSDSDEEIPEPEEEKHFFTEGEDQLIWRATQEHGLNREVINVLCQFIDATPSEIEERSEVLFEKNEKHSASSDKIESQLSLDKTMDAVLDSFDNLFCRRCLVFDCRLHGCSQNLVFPCEKQPYSFEPAENKKPCGHQCYLRFPQWREGFQEMHDDGLGGCATYTMESGTASHKVDVNIMSESEDSNREKGNIRSMTLFGTSGSKIISSVSAEESTTPPSADTSETENVPSDLPPSSLRKHKISKHGPRYRERSPGKRQKVFTSDISFASNILNKLSIPEIRDTRPESRESGGDKLRILDESTKKTSSKDIYGENPTTTTENVGRESNKVSSTNNLSEHTLSCWSALERDLYLKGIEIFGKNSCLIARNLLSGLKTCMEVANYMYNNGAAMAKRPLLNKSISGDFAETEQDYMEQDMVARTRIYRRRGRNRKLKYTWKSAGHPTVRKRIGDGKQWYTQYNPCVCQQMCGKDCPCVENGTCCEKYCGCSKSCKNKFRGCHCAKSQCRSRQCPCFAANRECDPDVCRNCWVSCGDGSLGEPPARGDGYQCGNMKLLLKQQQRILLGRSDVAGWGAFIKNPVNKNDYLGEYTGELISHKEADKRGKIYDRANSSFLFDLNDQYVLDAYRKGDKLKFANHSSNPNCYAKVMLVAGDHRVGIYAKEHIEASDELFYDYRYGPDQAPAWARRPEGSKKDEASVSHHRAHKVAR

SEQ ID NO: 2033 - DNA, 942 bp, Sorghum bicolor
  misc_feature: Ceres ANNOT ID no. 6018326
  misc_feature: Encodes the peptide sequence at SEQ ID NO 2034
atggcggccacggctaagtacaatcggagcaacccggcggtgaagcggatcctgcaggaggtcaaggagatgcagtccaatccctcacccgacttcatggcccttcccctcgaggaggacatcttcgagtggcaatttgctatccttggcccgagagacagcgagtttgagggtggaatctatcatggcaggatccagctaccctcggattatccattcaagccaccgtccttcatgctacttacgccaagtggacgctttgagattcagaagaagatttgtttgagcatatccaattaccaccctgagcactggcagccttcatggagtgtccgcacagcgttggtagccttgattgcattcatgccaacgaaccctggtggggcattgggctcactggattacaaaaaggaagatagacgagcacttgctataaaatcacgtgaagcgccgccaaaatttggctcctcagaacgtcagaaactaattgatgagatccatgagcaaatgctcagtaaggctcctcctgtcccccaagcgctaccaaatgtgccaaacgaggagtctaaccaattacccacacctaacgcttctggtgagcatgcagacaaggtagatgaaggtgacaacacatctgggtctatgtcaggctcgttgagtggccttcctgtgcctgaatctgaatcgggggttgcagaaaacactggtgaagcctcagctgttgaggttgccaaccatcatgtgcctgaagcgagccatagagagaacattccaacagttccttcgtctctgcagaatcctgctgttgcgatccagaagccaaagcatgacaggctgttgaccttggctgcatttgggctgactcttgctattatggcacttgtgataaagaagttcttaaaaatcaatggcttgggcggtttcattgagggcaagttctga

SEQ ID NO: 2034 - protein, 313 aa, Sorghum bicolor
  misc_feature: Ceres ANNOT ID no. 6018326
  misc_feature (16)..(149): Pfam Id: UQ_con Pfam Desc: Ubiquitin-conjugating enzyme
  misc_feature (6)..(311): NCBI GI: 92875005 NCBI Desc: ubiquitin-conjugating enzyme, e2 [medicago truncatula]
  misc_feature (3)..(278): NCBI GI: 66354472 NCBI Desc: ubiquitinating enzyme [arabidopsis thaliana]
  misc_feature (5)..(298): NCBI GI: 47550809 NCBI Desc: zgc:63554 [danio rerio]
  misc_feature (6)..(303): NCBI GI: 7363050 NCBI Desc: non-canonical ubiquitin conjugating enzyme 1 (ncube1) [mus musculus]
  misc_feature (68)..(223): NCBI GI: 121489743 NCBI Desc: ubiquitin conjugating enzyme precursor [phillyrea latifolia]
  misc_feature: The sequence is a functional homolog of SEQ ID NO. 431 in the 11/188,298 US application
MAATAKYNRSNPAVKRILQEVKEMQSNPSPDFMALPLEEDIFEWQFAILGPRDSEFEGGIYHGRIQLPSDYPFKPPSFMLLTPSGRFEIQKKICLSISNYHPEHWQPSWSVRTALVALIAFMPTNPGGALGSLDYKKEDRRALAIKSREAPPKFGSSERQKLIDEIHEQMLSKAPPVPQALPNVPNEESNQLPTPNASGEHADKVDEGDNTSGSMSGSLSGLPVPESESGVAENTGEASAVEVANHHVPEASHRENIPTVPSSLQNPAVAIQKPKHDRLLTLAAFGLTLAIMALVIKKFLKINGLGGFIEGKF

SEQ ID NO: 2035 - DNA, 1848 bp, Sorghum bicolor
  misc_feature: Ceres ANNOT ID no. 6018334
  misc_feature: Encodes the peptide sequence at SEQ ID NO 2036
  misc_feature: Up-regulated in shoot tissues in response to salicylic acid treatment
atggcgatgcggctcctgtccccctccacgccgcccccactcttcccgagccccggcccgaaggcacccgcctccgtctccgcatcgtcttcctcgtacttgtctgtccgcttgcgccgcgcgcgcgcggcgtctgcagcgtctggcgcggccgcgtcgggcgggtccgaccgggacggcggacgcttcgagggggaggcgatgagcggggcattcgacaggggcctcgcggagatcgcgaggaaggtgccgctcttcgagcccgcagcggacggggagctcgccgccgcggccggcgagcggccgttgcctatcaatctcgagctctggctctaccgcgtcaaagtgcacaccaggaagttcgagttccctgaagcagagaagcttctcgacaagtgtatctcattctggcctgaagacggacgtccgtatgtggcactggggaagttgttcagcaagcagtcaaggtatgacaaagctagagcggtgtacgaaaggggatgccaagcaacgcaaggcgaaaacccatacatttggcagtgctgggcagtcctagaaagcaagggtggaaatattcgaagggcacgcgagctatttgatgctgctactgtggctgatgcaaagcacattgctgcttggcacgggtgggcaattttagaaataaagcaaggaaatataaaaaaagcacggaacctacttgggaaagccctgaaatattgtggaggaaatgagtatatttaccaaactcttgctttgcttgaagctaaagcagagcgctttgaacaagcaaggactttgttcgaacaagccactcaatccaatccgaaaagttgtgcaagctggctagcttgggctcaggtagaaatgcgtgcaggaaacaataccatggccagaaatctctttgagaaagctgtccaggctagtcctaaaaaccgtttttcatggcatgtatgggcactatttgaggcaaatgaaggtaatattgacagtgcaaggaagttgcttaagattggacatgctgtaaatcctaaggaccctgtaatcctccagtcacttgcactgctggaatacaacttttcatctgcgaatgttgctcgtgtgttattcagaaaagcatctcaaattgatccaaggcatcagccagtttggatagcttggggatggatggaatggaaagaaggaaatgcaagaacagcaagggccctctatcaaagagctttgtcagttaattcaacaaatgaatgtgctgctcgttgccttcaggcttggggggtcctagaacagcgtgctggtaactacacggcagccagaagattgttgaggtcttcgttgaatataaactctcaaagtgaggtgacatggatgacatgggcagcacttgaggaggaacagggagatccagttcgagctgaagaaattcggaacctttactttcagcagcgcactgaagttgtggatgatgcctcctgggtcatgggcttcctcgacatcatcgaccctgccctagacagcgtgaagaagctgctaaacctagatcagccttctgggccaacgaggcaagatgatgttaaaagcactgccaggagttctgcagctagggagtcttcagaaacctctgcggctgtaggttcagatacccctggccttacgagcaatgatgctggtaacaacgggagggaagcaactaggactccaacaaatgatttcgatttggatcgtttcatcaaaaagaggctggccctcgacccggcggagctggatgccgtgctcgagggctctgacccgaggggtgttgtttctcagaggaggaaacagcggctgcccaggaagccactccctgtcccgtaa

SEQ ID NO: 2036 - protein, 615 aa, Sorghum bicolor
  misc_feature: Ceres ANNOT ID no. 6018334
  misc_feature (179)..(529): NCBI GI: 144924840 NCBI Desc: protein prenyltransferase [medicago truncatula]
  misc_feature (181)..(529): NCBI GI: 140041491 NCBI Desc: protein prenyltransferase [medicago truncatula]
  misc_feature (95)..(522): NCBI GI: 145346887 NCBI Desc: tpr-repeat containing protein [ostreococcus lucimarinus cce9901]
  misc_feature (23)..(605): NCBI GI: 11990205 NCBI Desc: mbb1 protein [chlamydomonas reinhardtii]
  misc_feature (105)..(332): NCBI GI: 32307536 NCBI Desc: psba maturation factor mbb1 [bigelowiella natans]
  misc_feature: Up-regulated in shoot tissues in response to salicylic acid treatment
MAMRLLSPSTPPPLFPSPGPKAPASVSASSSSYLSVRLRRARAASAASGAAASGGSDRDGGRFEGEAMSGAFDRGLAEIARKVPLFEPAADGELAAAAGERPLPINLELWLYRVKVHTRKFEFPEAEKLLDKCISFWPEDGRPYVALGKLFSKQSRYDKARAVYERGCQATQGENPYIWQCWAVLESKGGNIRRARELFDAATVADAKHIAAWHGWAILEIKQGNIKKARNLLGKALKYCGGNEYIYQTLALLEAKAERFEQARTLFEQATQSNPKSCASWLAWAQVEMRAGNNTMARNLFEKAVQASPKNRFSWHVWALFEANEGNIDSARKLLKIGHAVNPKDPVILQSLALLEYNFSSANVARVLFRKASQIDPRHQPVWIAWGWMEWKEGNARTARALYQRALSVNSTNECAARCLQAWGVLEQRAGNYTAARRLLRSSLNINSQSEVTWMTWAALEEEQGDPVRAEEIRNLYFQQRTEVVDDASWVMGFLDIIDPALDSVKKLLNLDQPSGPTRQDDVKSTARSSAARESSETSAAVGSDTPGLTSNDAGNNGREATRTPTNDFDLDRFIKKRLALDPAELDAVLEGSDPRGVVSQRRKQRLPRKPLPVP

SEQ ID NO: 2037 - DNA, 1107 bp, Sorghum bicolor
  misc_feature: Ceres ANNOT ID no. 6018336
  misc_feature: Encodes the peptide sequence at SEQ ID NO 2038
atgaggaggttactcgtcatcctgttcgcagcggctgccctcgcggtagccaccagcgcgcacgagcaccatggcgaggcgcccacctgcgctggaggcagcgggcacgtgctcgcggagttccgccccggggaggtgaccgtggacgggcacagcgacgactgggacagcgtggaggcctcagagttcgcgctgctgccggcgctcgatccagacgaagataaggcctactccggcggcaaggtcgctgtaaaggctgtgcatgatggtgtcaacgtcttcttcttgcttcaggtttatggggattacgcttacactaaaggggaaagtaacaaatgcccttctgttgctctcatgttccaagttggagagaaagccacattttacaatatgggaggatgcaaagatatgccaggttcatgcacaagtaaaagttgtagaggtcatgaggttgacattatgcacttctcaattggaaatgctattcctggacgactttatggtggcaatcacatagacaatgcagctgggaatggaaacgacagatttggtcaccttgttgatgtctatgcatggaatccacattgccgataccttgatggactgggccctaaagagaacaatttagatgctcaaaatgattggcatggggcttggtggcacagttcactgaccgtccattcaggctttgttgatgatgataatccttatggaaaacaggatgagaagggcacatattattttgagttttcaagacccttaagaacaatggatcaatttcagcaggatgcacagttcacaataggacatcccagcaatatggctgtagccttttggtacccaactgatggcaaagcatggagcaagtccgatcattactcagccagttgcaactggttggttttggatatacaacgttcatctgaagctgcatattaccgtccagctcctaatcgctcttgggatgctgcaactgcctttgctttacttctttcagtggtagccatttgcctgtccatctttgtgggctaccgattttctaggaacaggagcactgcccagtttacaccacttgaacagatccagtttgctgaagaacgccattga

SEQ ID NO: 2038 - protein, 368 aa, Sorghum bicolor
  misc_feature: Ceres ANNOT ID no. 6018336
  misc_feature: The plant produces a reduced number of seeds.
  misc_feature: Useful for biocontainment applications
  misc_feature: GREAT-hit functional homolog of the protein sequence given in SEQ ID NO 13538
  misc_feature: Useful for biocontainment applications
  misc_feature: Functional homolog of the protein sequence given in SEQ ID NO 13538
MRRLLVILFAAAALAVATSAHEHHGEAPTCAGGSGHVLAEFRPGEVTVDGHSDDWDSVEASEFALLPALDPDEDKAYSGGKVAVKAVHDGVNVFFLLQVYGDYAYTKGESNKCPSVALMFQVGEKATFYNMGGCKDMPGSCTSKSCRGHEVDIMHFSIGNAIPGRLYGGNHIDNAAGNGNDRFGHLVDVYAWNPHCRYLDGLGPKENNLDAQNDWHGAWWHSSLTVHSGFVDDDNPYGKQDEKGTYYFEFSRPLRTMDQFQQDAQFTIGHPSNMAVAFWYPTDGKAWSKSDHYSASCNWLVLDIQRSSEAAYYRPAPNRSWDAATAFALLLSVVAICLSIFVGYRFSRNRSTAQFTPLEQIQFAEERH

SEQ ID NO: 2039 - DNA, 1608 bp, Sorghum bicolor
  misc_feature: Ceres ANNOT ID no. 6018368
  misc_feature: Encodes the peptide sequence at SEQ ID NO 2040
atggcactggacctcgccgtcgggggctcggcggctcgcagggccgagacccaaaccctagcgcccgtgctgctcatgggcccgccgcctccaccgccgatcccaccgacgacgggggtgtacctcccggggcccccgcccccgggggcgctcctgtcgcgcccgatccccatggcgctcccgcgcgaggtcatcgtctacatggacgagtgtcggagccgctccctcctcaagttcatttccgacgcggggattgtgccttcgctagaggacgaacggaggagggagcgggtagtacgcgagctcggcaagatagtgatggagtgggcaaagagggtggcctacgagcagggcaaacagcactggatcacatcagccacggtgttgacctttggctcctatgccttaggggcatatggacctgaatctgatattgatgtcctctgtattggtccttatattgcaacactgcaacaccatttttttgttgtcctgcgacaaatgcttgaagggaggccagaagtatcagaattgcagtcaattgaaggagctaaggttccattgatgcgttttaaattcaatgggattttagttgactttccttatgttcaactcccatttatcaatgctgcagaggctatgcatgcatttgatccccatgtgctagagaatgtggatgggccaagctggagatgtctatctggagttcgtgctaatagacaaatcattcaattagttcctaatatgaagaaatttcaatatctgttgcggtgcctcaaactatgggcgagaaaaagaggacttcattgccatctacttggcttctttgctggaatccatttggcgattcttgctgcatatgtttgccgcagacatccgaatgctagtataaatactttgttgtctttgttcttcgatatttttgctcactggccttggcctcttccagtgagtttgctggatccgccagttctttgtcggggtcctgatgggtgctctctcatgcccataatgttgccctgcaatccaccagaattttgctcctctagtacaacagaaagtactttcagcaaaatcaaagaagagcttcggcgtggttatgctttgacaaaggataccagaagtactgattttgactggagttggctctttgcatcttttccgtatggtgcaagatacaaatgctttctccgcatagttctctctgctccattggacgaagaattgcgtgactgggttggatgggtgaaatcacgattccgcaaccttcttcttaagctggagagtcttggcgtttactgtgacccagattcctcggaacaagttgatcacaccatcactgagccaaatgttgtattcttctggggtctcgtcttcacaaggaatattcaaatctgtacaagttctctcaaagaagatttcatgaaaagcgtctgcaataacatctatggaaaggaaaaatgtgcccattcagacatcacaatggccattgttgggcctccccagctgcctaagagtatctttgatctctcagtttactcagaaaagctgccacaacatatgatggggcaccaactaatgaagcagaggtacaatgcagtgagttag

SEQ ID NO: 2040 - protein, 535 aa, Sorghum bicolor
  misc_feature: Ceres ANNOT ID no. 6018368
  misc_feature (47)..(387): Pfam Id: PAP_central Pfam Desc: Poly(A) polymerase central domain
  misc_feature (388)..(518): Pfam Id: PAP_RNA-bind Pfam Desc: Poly(A) polymerase predicted RNA binding domain
  misc_feature (196)..(534): NCBI GI: 115452655 NCBI Desc: os03g0313300 [oryza sativa (japonica cultivar-group)]
  misc_feature (55)..(525): NCBI GI: 24059888 NCBI Desc: poly(a) polymerase-like protein [oryza sativa (japonica cultivar-group)]
  misc_feature (311)..(487): NCBI GI: 115474207 NCBI Desc: os07g0688500 [oryza sativa (japonica cultivar-group)]
  misc_feature (69)..(506): NCBI GI: 62320636 NCBI Desc: poly(a) polymerase [arabidopsis thaliana]
  misc_feature (84)..(506): NCBI GI: 32527644 NCBI Desc: poly(a) polymerase [arabidopsis thaliana]
MALDLAVGGSAARRAETQTLAPVLLMGPPPPPPIPPTTGVYLPGPPPPGALLSRPIPMALPREVIVYMDECRSRSLLKFISDAGIVPSLEDERRRERVVRELGKIVMEWAKRVAYEQGKQHWITSATVLTFGSYALGAYGPESDIDVLCIGPYIATLQHHFFVVLRQMLEGRPEVSELQSIEGAKVPLMRFKFNGILVDFPYVQLPFINAAEAMHAFDPHVLENVDGPSWRCLSGVRANRQIIQLVPNMKKFQYLLRCLKLWARKRGLHCHLLGFFAGIHLAILAAYVCRRHPNASINTLLSLFFDIFAHWPWPLPVSLLDPPVLCRGPDGCSLMPIMLPCNPPEFCSSSTTESTFSKIKEELRRGYALTKDTRSTDFDWSWLFASFPYGARYKCFLRIVLSAPLDEELRDWVGWVKSRFRNLLLKLESLGVYCDPDSSEQVDHTITEPNVVFFWGLVFTRNIQICTSSLKEDFMKSVCNNIYGKEKCAHSDITMAIVGPPQLPKSIFDLSVYSEKLPQHMMGHQLMKQRYNAVS

SEQ ID NO: 2041 - DNA, 1656 bp, Sorghum bicolor
  misc_feature: Ceres ANNOT ID no. 6018372
  misc_feature: Encodes the peptide sequence at SEQ ID NO 2042
atggggacggagcggaagcggaaggtgagcctcttcgacgtggtcgacgagacctccgtctccgccaagctgggccgcgccgcctccaacggcgccgccgccaccgcggcggggggcaacccgtctgtcaaccggtggaacgggcggccctacacggcacggtacttcgagatcctcgagaagcgccgcacgctccccgtgtggcagcagaaggaggagttcctccgctctctccgcgacaaccagaccctcatcctcgtcggtgaaacgggaagcgggaagacaactcagatcccccaatttgttcttgaggcggaaggcttgagtaaccgttccatggttgcttgcactcagcctcggagggttgcagcaatgtcagtctccaggcgtgtggcggaggagatggatgttactattggggaagaagtgggttacagcattcggtttgaggattgcagcagccacaaaactgttctcaaatatttgacagatggtatgcttttgagagaagcaatggcagacccacttttagagaagtacaaggtgattgttcttgatgaggctcatgagaggactttggcaacagatgttctgtttgggcttctacaggaggttctaaaaaatagaccagatttgaagcttgttgttatgagcgctacccttgaagcagagaaattccagggttacttcagtggtgcacccttgatgaaggtgcctgggagacttcatccagttgagatattttatacccaagaaccagagagggactatctagaggctgctatcaggacagttgtgcaaatacatatgtgtgaacctgctggtgatatccttgtattccttactggagaagaggagattgaggatgcatgtcggaaaatcaataaggaaattaataatatgggagatcaggttggcacagttaaagtcgtgcctttatactctacactgcctccagccatgcagcagaagatttttgaacctgctcctgccccattgaaggaaggaggtcctcctggaaggaaaattgttgtctccacaaacattgctgaaacatccttaactatagatggcatagtttatgtgatagacccagggttttccaaacagaaagtttacaacccaagaataagggtggaatccctcctggtgtcaccaatttctaaggcaagtgctcatcagagagctggtcgtgctggacgaacgcaacctgggaagtgctttaggctatacacagagaagagtttcaatgaggatttgcaaccacagacatacccagaaattcttcggtcgaacctggcaaatacagttctgaccttgaagaaacttggaattgatgatttagtacattttgactttatggatcctccagcgccagaaactctaatgagggccttagaagttttgaactatttgggtgcactagatgatgaaggtaatctaacacagttaggtgagatgatgagtgagtttcccctggatccacaaatgtcgaagatgcttgtcatcagtccaaagtacaactgttcgaacgagatcttatcaatatctgccatgctgtcaggtatgttaacaaattgcagttctaaaaattatcttgtctatatgtttatctggactactttgcttgtcagttctgttcaagcggagtgctag

SEQ ID NO: 2042 - protein, 551 aa, Sorghum bicolor
  misc_feature: Ceres ANNOT ID no. 6018372
  misc_feature (464)..(536): Pfam Id: HA2 Pfam Desc: Helicase associated domain (HA2)
  misc_feature (302)..(403): Pfam Id: Helicase_C Pfam Desc: Helicase conserved C-terminal domain
  misc_feature (49)..(226): Pfam Id: DEAD Pfam Desc: DEAD/DEAH box helicase
  misc_feature (1)..(527): NCBI GI: 92885144 NCBI Desc: helicase, c-terminal [medicago truncatula]
  misc_feature (19)..(521): NCBI GI: 116131715 NCBI Desc: ensangp00000021966 [anopheles gambiae str. pest]
  misc_feature (100)..(527): NCBI GI: 140047044 NCBI Desc: helicase, c-terminal [medicago truncatula]
  misc_feature (27)..(521): NCBI GI: 108879962 NCBI Desc: atp-dependent rna helicase [aedes aegypti]
  misc_feature (42)..(521): NCBI GI: 89284961 NCBI Desc: helicase associated domain (ha2) [tetrahymena thermophila sb210]
MGTERKRKVSLFDVVDETSVSAKLGRAASNGAAATAAGGNPSVNRWNGRPYTARYFEILEKRRTLPVWQQKEEFLRSLRDNQTLILVGETGSGKTTQIPQFVLEAEGLSNRSMVACTQPRRVAAMSVSRRVAEEMDVTIGEEVGYSIRFEDCSSHKTVLKYLTDGMLLREAMADPLLEKYKVIVLDEAHERTLATDVLFGLLQEVLKNRPDLKLVVMSATLEAEKFQGYFSGAPLMKVPGRLHPVEIFYTQEPERDYLEAAIRTVVQIHMCEPAGDILVFLTGEEEIEDACRKINKEINNMGDQVGTVKVVPLYSTLPPAMQQKIFEPAPAPLKEGGPPGRKIVVSTNIAETSLTIDGIVYVIDPGFSKQKVYNPRIRVESLLVSPISKASAHQRAGRAGRTQPGKCFRLYTEKSFNEDLQPQTYPEILRSNLANTVLTLKKLGIDDLVHFDFMDPPAPETLMRALEVLNYLGALDDEGNLTQLGEMMSEFPLDPQMSKMLVISPKYNCSNEILSISAMLSGMLTNCSSKNYLVYMFIWTTLLVSSVQAEC

SEQ ID NO: 2043 - DNA, 1953 bp, Sorghum bicolor
  misc_feature: Ceres ANNOT ID no. 6018374
  misc_feature: Encodes the peptide sequence at SEQ ID NO 2044
atgctcacggtgtcccttctggacgcgcaactctcccgctgccgctccgcgcgccacctccttgaaatccacgcgcagttcctcgcgtcgggcctcctcgctgacgcctacgccgccagccgcctcctcctcttcaccacctccgcgaccgccgcgcgcctcctgccgcaaccgctccaccactccctccaactcttccggctcgtgcgcagccccaatgccttcacctgcaacactctcatcagggcggctctgcgccagggcttgccccacctctgcttcccgctctacgcctccatgccagcggcgcccgacacctacacgcacccgctcctcgccgccgcctgcgccgccagaggggacgcgagggaaggccggcaggtccactcccacgccgtcaagcacgggttcggcgacaacctgtacctcaggaacgcgctgatgcacatgtactctgcgtgcggctgcgtcgcgggcgcgcgcagggtgttcgacgcgggacccgtgtgggacgccgtttcctggaacacgatcctcgccacgtacgtgcgggacggggatgtcgaacaggctgtcggggtgtttgcgaggatgccagagaggagcgctgcggcggtgagctcgatggtggcgttgttcgcgaggacagggatggtagaggaggcgaggggggtgtttgacggagcagagcatagggatgcattcacgtggacagctatgatctcttgcttcgagcggaatgatctgttcgtggaagcgctggctgtgttttcagatatgcgtgaagaggggtggcctgtggacgaggcagtgatggtcagtgtggtcgctgcttgtgctaagtcagaggtgattcagaacggagaggtgtgccatggactggttgtcagagctggccttggttcgcgggtgaatgtccagaatgcgctgatccacatgtactcaagttgtctggatgttgttgcagcacgacgattgtttgatagcagtgagagtttagaccacttctcctggaattcgatgatttctggctatctgaagaatggccgcgtcgaagatgcaaaagcattattcaatgtgatgcctgacaaggacaacgtttcctggagtgcaatgatagctggttgtgtgcaaaataaccagtcatccgaggcgctcactgtttttgacaacatgagagcccatgaaatcaaaccggatgaagttacgcttgttagcgtcatctctgcatgtactaatttgtgtgctttggagcaagggaagttagtgcatgagtacattaggcaataccaatataacatcactatcgtacttgggactagcctcattgacatgtacatgaaatgtggatgcatggaggctgcactagaagtcttcgacatggtggaagaaaaaggaacaccttgctggaatgctgtcattgtgggactggccatgaatggccttgttacaagatcccttgacatgttctctgagatggaaacctctggcattgctgtccccagtgagataactttcactggagttctgagtgcttgcaggcatggtggcttagttgaggagggccgtcaattcttcaagttgatgcagaacaagtaccagattataccaaacatcagacattatggatgtatggttgatctccttgggcgtgctgggtatgtcagagaggccgaggatctgatccagagcatgcccatgtcacctgatgttccagcatggggtgcattacttggtgcctgttggaagcacagcgatagtgaggtcggggaaagggttggcaagaagcttgtcaagctggatcctcatcatgatgggttccaaactatgttatctaacatatatgcttcagaggggatgtggcagtgtgtaaaggacctaaggggttccatgaagcaacatgtagcaaaagttgcaggctgtagtgtggttgaatcatcacattcttcatga

SEQ ID NO: 2044 - protein, 650 aa, Sorghum bicolor
  misc_feature: Ceres ANNOT ID no. 6018374
  misc_feature (235)..(269): Pfam Id: PPR Pfam Desc: PPR repeat
  misc_feature (367)..(401): Pfam Id: PPR Pfam Desc: PPR repeat
  misc_feature (468)..(502): Pfam Id: PPR Pfam Desc: PPR repeat
  misc_feature (73)..(632): NCBI GI: 140069228 NCBI Desc: tetratricopeptide-like helical [medicago truncatula]
  misc_feature (2)..(642): NCBI GI: 21328171 NCBI Desc: pentatricopeptide (ppr) repeat-containing-like protein [oryza sativa (japonica cultivar-group)]
  misc_feature (216)..(645): NCBI GI: 10178110 NCBI Desc: selenium-binding protein-like [arabidopsis thaliana]
  misc_feature (183)..(645): NCBI GI: 12322531 NCBI Desc: ppr-repeat protein [arabidopsis thaliana]
  misc_feature (188)..(632): NCBI GI: 15239636 NCBI Desc: pentatricopeptide (ppr) repeat-containing protein [arabidopsis thaliana]
MLTVSLLDAQLSRCRSARHLLEIHAQFLASGLLADAYAASRLLLFTTSATAARLLPQPLHHSLQLFRLVRSPNAFTCNTLIRAALRQGLPHLCFPLYASMPAAPDTYTHPLLAAACAARGDAREGRQVHSHAVKHGFGDNLYLRNALMHMYSACGCVAGARRVFDAGPVWDAVSWNTILATYVRDGDVEQAVGVFARMPERSAAAVSSMVALFARTGMVEEARGVFDGAEHRDAFTWTAMISCFERNDLFVEALAVFSDMREEGWPVDEAVMVSVVAACAKSEVIQNGEVCHGLVVRAGLGSRVNVQNALIHMYSSCLDVVAARRLFDSSESLDHFSWNSMISGYLKNGRVEDAKALFNVMPDKDNVSWSAMIAGCVQNNQSSEALTVFDNMRAHEIKPDEVTLVSVISACTNLCALEQGKLVHEYIRQYQYNITIVLGTSLIDMYMKCGCMEAALEVFDMVEEKGTPCWNAVIVGLAMNGLVTRSLDMFSEMETSGIAVPSEITFTGVLSACRHGGLVEEGRQFFKLMQNKYQIIPNIRHYGCMVDLLGRAGYVREAEDLIQSMPMSPDVPAWGALLGACWKHSDSEVGERVGKKLVKLDPHHDGFQTMLSNIYASEGMWQCVKDLRGSMKQHVAKVAGCSVVESSHSS

SEQ ID NO: 2045 - DNA, 1881 bp, Sorghum bicolor
  misc_feature: Ceres ANNOT ID no. 6018379
  misc_feature: Encodes the peptide sequence at SEQ ID NO 2046
atggcggccgccgccatctctcacctccgccgcggcgcgcagcgccacgcccacgcggtgctatgcatctcgctgtcgcgccgccgcttctcctcctccgccgtggccgcggcctccccgctcgccgcggccgcgcgccgcctcctctccacgacggcagactccgccgggtccacgtcgggggagcactacaagccgccgcccttcgaccccttccgcgccgccaccctatcgccctcggctctgccgctagagtcgcccccgatcgaggatgagcccccgagcagcccaccgccacaggatgaggcggctgcgtccgaggcggcgcacgagcaggcgacgctggcgtgccaggaggtggaattggagggcctcaaggcgggggtggaggcggtgaagagcagggaggagtccccggaggagaaggaagcgtggtggctgctcagccgcgcggtcgtcaactactgtggcagcgccgtcgggacggtggccgcgaacgatccgtccaccagccagatgctcaattatgaccaggtgttcattagggactttgtgccgtcggctatcgcgttcctcctcaagggtgagagcgatattgtgaagaacttcctgctccacacgttgcagctccagagttgggagaagaccgtggattgctatagtcctggtcaagggttgatgcctgctagtttcaaagttagatccgtgcctttagatggaaatagtgaagcatttgaggaggttcttgacccagattttggagagtcagccattggacgtgtagcacctgttgactctggtctttggtggataatcctgttaagggcatatggaaaaattactggagactatgctctacaagaaagggttgatgtgcagacaggcatcaggctaatactgaatttgtgcttgtctgatggatttgacatgtttcctacattgcttgtaactgatggatcatgtatgattgatcggcggatgggaatccatggtcatcctcttgagatccaggctctgttctattctgctttacgctgtgcccgagaaatgattggtgtaactgatggatccaagaacttgatccgtgctattaacaacaggctcagtgctctgtcatttcacataagagagtattattgggttgatatgaagaagataaatgagatttatcgctataagactgaggagtactcccatgatgctattaacaaattcaacatctacccagagcaaattccgtcttggcttgcagactggattcctgtgaaaggcggttaccttataggcaatctgcagccagctcacatggatttcaggtttttctccttagggaatctgtgggcgattgtctcatctcttgctactcaaaggcaagcagagggtattctgaaccttattgaagccaaatgggatgatatagtagccaacatgcctctcaaaatatgctaccctgcactagagtatgaggaatggcgtatcatcaccggcagtgatcccaaaaacacgccctggtcgtatcataacggtggatcttggcctacattgttatggcagttcaccttagcctgtatcaagatgggtaggcgtgacttggcacggagggcagttgaggtggcagaaaagaggctctcagatgacaagtggccagagtattatgacaccaggacaggaaggttcattggaaaacaatcgcgactgtatcaaacttggaccattgccggatatcttagctctaagatgttattggactgtccagagatggcatccatactagtatgcgacgaagactttgagctgctggaagggtgtgcttgcagcttgaataagaatgctcgcaccaaatgctcacgtcgtgcggccaagtcgcaggttcttgtgtag

SEQ ID NO: 2046 - protein, 626 aa, Sorghum bicolor
  misc_feature: Ceres ANNOT ID no. 6018379
  misc_feature (132)..(604): Pfam Id: Invertase_neut Pfam Desc: Plant neutral invertase
  misc_feature (17)..(625): NCBI GI: 27948558 NCBI Desc: invertase [oryza sativa (indica cultivar-group)]
  misc_feature (123)..(625): NCBI GI: 4200165 NCBI Desc: neutral invertase [daucus carota]
  misc_feature (141)..(626): NCBI GI: 92899277 NCBI Desc: plant neutral invertase; glycoside transferase, six-hairpin [medicago truncatula]
  misc_feature (68)..(626): NCBI GI: 21322510 NCBI Desc: neutral invertase [beta vulgaris]
  misc_feature (133)..(618): NCBI GI: 2832717 NCBI Desc: alkaline/neutral invertase [lolium temulentum]
  misc_feature: Useful for making plants with altered carbohydrate content
  misc_feature: Functional homolog of the protein sequence given in SEQ ID NO 13652
  misc_feature: Useful for making plants with modulated oxidative stress sensitivity
  misc_feature: Functional homolog of the protein sequence given in SEQ ID NO 13231
MAAAAISHLRRGAQRHAHAVLCISLSRRRFSSSAVAAASPLAAAARRLLSTTADSAGSTSGEHYKPPPFDPFRAATLSPSALPLESPPIEDEPPSSPPPQDEAAASEAAHEQATLACQEVELEGLKAGVEAVKSREESPEEKEAWWLLSRAVVNYCGSAVGTVAANDPSTSQMLNYDQVFIRDFVPSAIAFLLKGESDIVKNFLLHTLQLQSWEKTVDCYSPGQGLMPASFKVRSVPLDGNSEAFEEVLDPDFGESAIGRVAPVDSGLWWIILLRAYGKITGDYALQERVDVQTGIRLILNLCLSDGFDMFPTLLVTDGSCMIDRRMGIHGHPLEIQALFYSALRCAREMIGVTDGSKNLIRAINNRLSALSFHIREYYWVDMKKINEIYRYKTEEYSHDAINKFNIYPEQIPSWLADWIPVKGGYLIGNLQPAHMDFRFFSLGNLWAIVSSLATQRQAEGILNLIEAKWDDIVANMPLKICYPALEYEEWRIITGSDPKNTPWSYHNGGSWPTLLWQFTLACIKMGRRDLARRAVEVAEKRLSDDKWPEYYDTRTGRFIGKQSRLYQTWTIAGYLSSKMLLDCPEMASILVCDEDFELLEGCACSLNKNARTKCSRRAAKSQVLV

SEQ ID NO: 2047 - DNA, 1203 bp, Sorghum bicolor
  misc_feature: Ceres ANNOT ID no. 6018382
  misc_feature: Encodes the peptide sequence at SEQ ID NO 2048
atggcgtccctggcgcagcacgtcgcgggcctcccgtgcccccctctatccggcgcgtcgcgccgtcgccccgcggcgcagaggcggcctccgtcggcgctggtttgcgggacctacgcgctgaccaaggacgagcgggagcgggagcggatgcgccagctgttcgaagacgccgccgaccgctgccgcaccgcgcccatggacggcgtcgccttctcccccgacgacctcgacaccgccgtcgagtccaccgacatagacaccgagatcggctcgctcattaaaggaacagtatttatgactacctcaaatggtgcatatatcgacatccaatcgaagtctactgcttttttgcccttagatgaggcatgccttcttgatatcgataatgttgaagaggcaggcattcgccctgggttagtagaagaattcatgataattgatgagaaccctggtgacgaaactttgattctgagtttgcaagcaattcagcaagaacttgcatgggaaaggtgccggcaactacaggctgaagatgtcgtcgtcacgggtaaagtaattggtggaaacaaaggaggtgtagtagctcttgtggaagggcttaagggattcgttccattttcgcaagtgtcatcgaaaactaccgctgaagagctgcttgacaaagaattgcctctaaagtatgtagaggtcgatgaggaacaaggcaggcttgtcctcagtaatcgcaaggcaatggcagatagtcaggcccagcttggtattggctcagttgtcttgggaaccgttgagagcctaaaaccttatggtgccttcattgacatcggtggaatcaatggccttctccatgtcagccagattagtcatgaccgtgttgcagatatctcaacagttctgcaaccaggagataccctcaaggttatgatactgagccatgatcgtgaaagaggccgagtcagcctttctacaaagaagctcgagccaacacctggtgacatgatccgcaatcccaagcttgtctttgagaaggctgatgaaatggctcaggtattcaggcagcgaatagcccaagccgaggcaatggctcgtgctgacatgttgagattccagccagagagtggattgaccctcagttcagagggcatcttaggaccattgtcgtcggacgcaccttcagaggattctgaacccacagatgaatag

SEQ ID NO: 2048 - protein, 400 aa, Sorghum bicolor
  misc_feature: Ceres ANNOT ID no. 6018382
  misc_feature (87)..(161): Pfam Id: S1 Pfam Desc: S1 RNA binding domain
  misc_feature (175)..(243): Pfam Id: S1 Pfam Desc: S1 RNA binding domain
  misc_feature (252)..(324): Pfam Id: S1 Pfam Desc: S1 RNA binding domain
  misc_feature (24)..(400): NCBI GI: 115452675 NCBI Desc: os03g0315800 [oryza sativa (japonica cultivar-group)]
  misc_feature (1)..(393): NCBI GI: 18060 NCBI Desc: ribosomal protein s1 [spinacia oleracea]
  misc_feature (70)..(392): NCBI GI: 22299589 NCBI Desc: 30s ribosomal protein s1 [thermosynechococcus elongatus bp-1]
  misc_feature (56)..(359): NCBI GI: 88807804 NCBI Desc: 30s ribosomal protein s1 [synechococcus sp. wh 7805]
  misc_feature (56)..(359): NCBI GI: 86167219 NCBI Desc: rna binding s1 [synechococcus sp. rs9917]
MASLAQHVAGLPCPPLSGASRRRPAAQRRPPSALVCGTYALTKDERERERMRQLFEDAADRCRTAPMDGVAFSPDDLDTAVESTDIDTEIGSLIKGTVFMTTSNGAYIDIQSKSTAFLPLDEACLLDIDNVEEAGIRPGLVEEFMIIDENPGDETLILSLQAIQQELAWERCRQLQAEDVVVTGKVIGGNKGGVVALVEGLKGFVPFSQVSSKTTAEELLDKELPLKYVEVDEEQGRLVLSNRKAMADSQAQLGIGSVVLGTVESLKPYGAFIDIGGINGLLHVSQISHDRVADISTVLQPGDTLKVMILSHDRERGRVSLSTKKLEPTPGDMIRNPKLVFEKADEMAQVFRQRIAQAEAMARADMLRFQPESGLTLSSEGILGPLSSDAPSEDSEPTDE

SEQ ID NO: 2049 - DNA, 972 bp, Sorghum bicolor
  misc_feature: Ceres ANNOT ID no. 6018386
  misc_feature: Encodes the peptide sequence at SEQ ID NO 2050
atggcgccaacggttgagatcagccacctctccttcacctacccgggcatcgacggccgcccgccacccggcgcgccgccgctcatcgaggacgtctgcttctccctcgacgccggccaacgatgcctcctcctcggctccaacggcgcaggcaagacgacgatactgaagatactaggcgggaagcacatggtggatccgagcatggtgcgggtcctgggaaggtccgccttccacgacacggcactcacctcctccggcgacctctgctatctcggcggtgagtggagacgcgacgtggcctttgctggctaccaggtgaatattcagatggatatatcggcagagaagatgatttttggtgttgctggtgttgatcccaagaggagagatgagcttatcaagattttagacatcgaccttgcctggcgcatgcacaaggcatcagatggtcagaggagacgtgtccagatttgcatgggacttcttaaggcattcaaggttctcctcctcgatgagatcacagttgaccttgatgttctggcaagatcaaatctgttaacatatcttaaaaaggaatgtgaggaaagaggtgcaacaatcatctatgccacacatatttttgatggtcttgatgattggccaacacacattgtttacattgctcatgggaagctgcaattagcactgcctttggaaaaggtgaaagaaatgagccagttatctctcatgagaactgtggagagctggttgaggaaagaaagagatgaggacaggaggaggagaaaggagcgaaaggagaaaggcctcccagaattcgacatggttgccgagggtagtcgggttataggtgatccagcaaagagcgcagccagagttgtaaacaacgggtgggcagcaggacggctcacctcgacgatcgcaggagaggagaattttgttttcagctcgaacagcgttcttaggcaatga

SEQ ID NO: 2050 - protein, 323 aa, Sorghum bicolor
  misc_feature: Ceres ANNOT ID no. 6018386
  misc_feature (39)..(224): Pfam Id: ABC_tran Pfam Desc: ABC transporter
  misc_feature (4)..(322): NCBI GI: 30984550 NCBI Desc: at5g02270 [arabidopsis thaliana]
  misc_feature (3)..(307): NCBI GI: 145341349 NCBI Desc: abc(atp-binding) family transporter [ostreococcus lucimarinus cce9901]
  misc_feature (27)..(264): NCBI GI: 75338543 NCBI Desc: non-intrinsic abc protein 2 (gcn-related protein 1)
  misc_feature (27)..(262): NCBI GI: 21592901 NCBI Desc: nbd-like protein [arabidopsis thaliana]
  misc_feature (27)..(263): NCBI GI: 18379174 NCBI Desc: abc transporter family protein [arabidopsis thaliana]
  misc_feature: Useful for biocontainment applications
  misc_feature: Functional homolog of the protein sequence given in SEQ ID NO 13106
MAPTVEISHLSFTYPGIDGRPPPGAPPLIEDVCFSLDAGQRCLLLGSNGAGKTTILKILGGKHMVDPSMVRVLGRSAFHDTALTSSGDLCYLGGEWRRDVAFAGYQVNIQMDISAEKMIFGVAGVDPKRRDELIKILDIDLAWRMHKASDGQRRRVQICMGLLKAFKVLLLDEITVDLDVLARSNLLTYLKKECEERGATIIYATHIFDGLDDWPTHIVYIAHGKLQLALPLEKVKEMSQLSLMRTVESWLRKERDEDRRRRKERKEKGLPEFDMVAEGSRVIGDPAKSAARVVNNGWAAGRLTSTIAGEENFVFSSNSVLRQ

SEQ ID NO: 2051 - DNA, 1884 bp, Sorghum bicolor
  misc_feature: Ceres ANNOT ID no. 6018388
  misc_feature: Encodes the peptide sequence at SEQ ID NO 2052
atgtcagggctcgccgcgtcggcgtccgcagctccgtcgctgccctcctggtcctcgttggcgacctcgcgcttcaccccggttgcaatagctgctccaagtttcagaacgcaagcttgtggattgaggtgctggattgctgcaaagctgaaactccggaaggcattgaaaaggcatcatggatggcaacttcaaagaaatctagatgctcgagggaatgataaagttccagattacttggagcctgcatctcagactgaaaagagaagtcattggaacatgcatcttgcttatgattctggaggtgaaatggccaatacaagctcagatactttagatagttcaactgttcacgaaatatcagtgcctcagggacatatcccctctgaaatcagttttgctgttcaaaaggaagagtatgctgtgtccagaagacactccaacaatgaaccatctctttgcattgctgtaattggagctaccggcgagctggcaagaactaaagtttttccagcactgtttgctctgtattatagtggttttcttcctcggaatgttggtatatttgggtattctaggaagaaattaacagatgagagcttaagatctataattgaagccaatttgacctgccgggtggatcaccatgaaaattgtgatggcaagttaagtgagttcctcaaaaggacgtattatgtagatgccggacatgacaacaaagaagggatggttagattaaattctaggatggcacagatagagaacattggtgctgcaaacagaatattctaccttgctgttccacaagaggcactccttgatgtagcattgccactggctgacggtgcccaaactaagcaaggctggaatagaataattatcgagaaaccatttggctttactggtttgtcctcacagcaggtaacacaatctatgctgtcaagatttgacgagaagcaaatttacagaattgaccaccttctggggaaggatttgattgaaaaccttactgtcttgaggttttctaatttggtgtttgaacctttgtggagtcgaacttacattcgaaatgtgcaggtcattttttctgaagaaacatcaaatgaaatacaagggaggtactttggaaattatgggataatccgtgacatagttcacagtcacattcttcaaacaatagctctatttgctatggaaccacctgtaagtcttgatggagaggatatccgagatgaaaaggtgaaggttctcagatcaattcggaaagtggaccttgaggatgttgttcttggtcaacttaaagatacgtctggtaaagttgacagatacacaaaatccatgacaccaacctattttgccgctgctatgtacattgacaatgcacgctgggatggggtaccatttttgatcaggacaggcatggggcttatgacgaatagagctgaaattcgaattcagtttcgccatgtccctggtaatatctaccgtgaacgttttggccatgacatagatcttgacacaaacgagctggtcctacgcgatcaacctgaagaagcaatcctgttgaaagtcaacaataaggtcccagggcttgggctccagctggatgcttcagaactgaacctgctttaccgggataggtacaacaccgaggtggtaccagattcatatgaacatcttcttctggacgtgctagatggagatagtcatttattcatgcgcagcgatgagctggctgctgcatggaacgtcctgactccgataatccatgagattgatcagaacagagtagctcctgagctctacgaggctggggacagagggcctatcaatgcttactatctcgctgctaaacatggggtgcgatgggacgatgactggtga

SEQ ID NO: 2052 - protein, 627 aa, Sorghum bicolor
  misc_feature: Ceres ANNOT ID no. 6018388
  misc_feature (337)..(626): Pfam Id: G6PD_C Pfam Desc: Glucose-6-phosphate dehydrogenase, C-terminal domain
  misc_feature (156)..(335): Pfam Id: G6PD_N Pfam Desc: Glucose-6-phosphate dehydrogenase, NAD binding domain
  misc_feature (148)..(625): NCBI GI: 1197385 NCBI Desc: glucose-6-phosphate dehydrogenase [solanum tuberosum]
  misc_feature (148)..(625): NCBI GI: 3021532 NCBI Desc: glucose-6-phosphate dehydrogenase [nicotiana tabacum]
  misc_feature (150)..(625): NCBI GI: 2276344 NCBI Desc: glucose-6-phosphate dehydrogenase [spinacia oleracea]
  misc_feature (132)..(625): NCBI GI: 21592340 NCBI Desc: glucose-6-phosphate dehydrogenase [arabidopsis thaliana]
  misc_feature (110)..(625): NCBI GI: 9955555 NCBI Desc: glucose-6-phosphate 1-dehydrogenase [arabidopsis thaliana]
  misc_feature (152)..(626): SWISSPROT Homolog: EC 1.1.1.49 Glucose-6-phosphate 1-dehydrogenase 4, chloroplast precursor
MSGLAASASAAPSLPSWSSLATSRFTPVAIAAPSFRTQACGLRCWIAAKLKLRKALKRHHGWQLQRNLDARGNDKVPDYLEPASQTEKRSHWNMHLAYDSGGEMANTSSDTLDSSTVHEISVPQGHIPSEISFAVQKEEYAVSRRHSNNEPSLCIAVIGATGELARTKVFPALFALYYSGFLPRNVGIFGYSRKKLTDESLRSIIEANLTCRVDHHENCDGKLSEFLKRTYYVDAGHDNKEGMVRLNSRMAQIENIGAANRIFYLAVPQEALLDVALPLADGAQTKQGWNRIIIEKPFGFTGLSSQQVTQSMLSRFDEKQIYRIDHLLGKDLIENLTVLRFSNLVFEPLWSRTYIRNVQVIFSEETSNEIQGRYFGNYGIIRDIVHSHILQTIALFAMEPPVSLDGEDIRDEKVKVLRSIRKVDLEDVVLGQLKDTSGKVDRYTKSMTPTYFAAAMYIDNARWDGVPFLIRTGMGLMTNRAEIRIQFRHVPGNIYRERFGHDIDLDTNELVLRDQPEEAILLKVNNKVPGLGLQLDASELNLLYRDRYNTEVVPDSYEHLLLDVLDGDSHLFMRSDELAAAWNVLTPIIHEIDQNRVAPELYEAGDRGPINAYYLAAKHGVRWDDDW

SEQ ID NO: 2053 - DNA, 906 bp, Sorghum bicolor
  misc_feature: Ceres ANNOT ID no. 6018398
  misc_feature: Encodes the peptide sequence at SEQ ID NO 2054
atgggcaacgccagcggccgcgaggaggacgccgtggctgttgacggcgatggcgccgacgtggaggacggcggaggggactcgtcggtccgctcgtcggagctcagcttcccgccgtacggcagcggaggagccaaccacgtgcgtcgcgcgtgctcggtgggcgtcgtaggtggcggcggcggcgctggatcgccacccgggagccccggccactcgctctcgccgcggatgttcgtgccccagacccctgtacctccactgcaaagagctgctgatgtaaccccagtgttcaaccagatattgatgaatgaacaagaagaagaatacgatgggccccctcaaaaggaaattcctgctttaattgtctggacccttggaggaaagaatgtatatgttgaaggatcatgggataactggaaatcaagaaaagccatgcaaaaatctggaaaagattattctcttttgctggtactcccatcaggagtttaccgatacagatttgttgtagatggagaaaggagatgtcttcctgatcttccctgtgaaactgatgcaatgggcaatgcggttaaccttcttgatgttaatgattttgtacctgaaagtgttgagagcgtggcagaatttgaggcgccgccttctccggactctagctacagtttccaggcacctgaggagaaggactttgccaaggagcctcctgctcttccgtctcaactccatctcggtgttcttaactcacagaactcggaagaaagctgcgcgcggccgcagcacatagtcctcaatcatctcttcatagagaagggctggggcgcccaccctctggtggctctcggcctaacccacaggttcgagtccaaatatgtaactgtcgtcctgtacaaacccatcgaacgatag

SEQ ID NO: 2054 - protein, 301 aa, Sorghum bicolor
  misc_feature: Ceres ANNOT ID no. 6018398
  misc_feature (213)..(299): Pfam Id: AMPKBI Pfam Desc: 5'-AMP-activated protein kinase, beta subunit, complex-interactingregion
  misc_feature (1)..(301): NCBI GI: 50509154 NCBI Desc: akin beta1-like protein [oryza sativa (japonica cultivar-group)]
  misc_feature (1)..(301): NCBI GI: 5702015 NCBI Desc: gal83 protein [solanum tuberosum]
  misc_feature (1)..(301): NCBI GI: 77745436 NCBI Desc: gal83-like protein [solanum tuberosum]
  misc_feature (9)..(301): NCBI GI: 42540596 NCBI Desc: gal83 [nicotiana attenuata]
  misc_feature (63)..(301): NCBI GI: 66710734 NCBI Desc: snf1-related protein kinase regulatory beta subunit 1 [pisum sativum]
  misc_feature: The sequence is a functional homolog of SEQ ID NO. 473 in the 11/188,298 US application
MGNASGREEDAVAVDGDGADVEDGGGDSSVRSSELSFPPYGSGGANHVRRACSVGVVGGGGGAGSPPGSPGHSLSPRMFVPQTPVPPLQRAADVTPVFNQILMNEQEEEYDGPPQKEIPALIVWTLGGKNVYVEGSWDNWKSRKAMQKSGKDYSLLLVLPSGVYRYRFVVDGERRCLPDLPCETDAMGNAVNLLDVNDFVPESVESVAEFEAPPSPDSSYSFQAPEEKDFAKEPPALPSQLHLGVLNSQNSEESCARPQHIVLNHLFIEKGWGAHPLVALGLTHRFESKYVTVVLYKPIER

SEQ ID NO: 2055 - DNA, 636 bp, Sorghum bicolor
  misc_feature: Ceres ANNOT ID no. 6018409
  misc_feature: Encodes the peptide sequence at SEQ ID NO 2056
atggacgccgtctcactctcctgcgcgggcacggcgccgcggagcgcgctcctatcccactccttcgccgacgcggccatcgcgcgcgcgctccacttctccctctccgatcacgccccggccgacccgacgcccgtggcggcggcggcgatgctgatgcacggcgccgtggcagcagggacgacggactgtcccccgacggtcgcagcgccgtcgccgtcgtcgtccgcgcggtgccggctgggccccgcgggcgggcacgcggggaagcggcgccggccgcggccgtccaagcgcgtgcccaccacgtacatcagcaccgacgccgccaccttccgcgccatggtgcagcgcgtcaccggcgccgacgaggccgacctgcaggcgctgcagcagcagcagcagcaggacggcgtcctcggtctcggcgtcctcctgccgcacctcggcgtcgagcagttcctccaggcggcgggacacgcgccgcacgtcgctgctgctgcaccgtacgcgacggcaacgccctccgcggcggcggcggagcagcagcagccgctgttcccgacgctggactcgtggaacgtcatgtacgggaagaagaacgaggtggtctcagccctgactgctggcccatga

SEQ ID NO: 2056 - protein, 211 aa, Sorghum bicolor
  misc_feature: Ceres ANNOT ID no. 6018409
  misc_feature (98)..(128): Pfam Id: VQ Pfam Desc: VQ motif
  misc_feature (49)..(124): NCBI GI: 115483987 NCBI Desc: os11g0131100 [oryza sativa (japonica cultivar-group)]
  misc_feature (65)..(169): NCBI GI: 115487138 NCBI Desc: os12g0127800 [oryza sativa (japonica cultivar-group)]
  misc_feature (13)..(121): NCBI GI: 115435962 NCBI Desc: os01g0278000 [oryza sativa (japonica cultivar-group)]
  misc_feature (24)..(121): NCBI GI: 87241016 NCBI Desc: vq [medicago truncatula]
MDAVSLSCAGTAPRSALLSHSFADAAIARALHFSLSDHAPADPTPVAAAAMLMHGAVAAGTTDCPPTVAAPSPSSSARCRLGPAGGHAGKRRRPRPSKRVPTTYISTDAATFRAMVQRVTGADEADLQALQQQQQQDGVLGLGVLLPHLGVEQFLQAAGHAPHVAAAAPYATATPSAAAAEQQQPLFPTLDSWNVMYGKKNEVVSALTAGP

SEQ ID NO: 2057 - DNA, 678 bp, Sorghum bicolor
  misc_feature: Ceres ANNOT ID no. 6018417
  misc_feature: Encodes the peptide sequence at SEQ ID NO 2058
atgtctccggcgccgacttcgcatcactcgcagatcaattcgaggaaggagaagcggatgaggaaggtggacaccttcgcgccgcacaacgacggccaccaatggaggaagtacggcgagaagaagatcaacaacaccaacttccccaggtattactacagatgcacgtacaaggacaacatgaactgcccggccacgaagcaggtgcagcagaaggaccacagcgacccgccattgtacgcggtcacctactacaacgagcactcgtgcaacagcgccttcctcccgctctccccctccgagttccagctgcagacctcgtccgggaaggccgtctccatctgcttcgactcctcgtccggggcggcggcgccgcaagaaccgccggccacggcagcggccaccaatgccagcggcggcggcggctcgccgtcttccagcgcggcggcggtggcggcggcgcggagaggcacgccgccggagatcagtaacccgcccgtgctgcggcggtccgagacgtacccgtggggcgcaggcgccgccggtgtcgtggagcagaagccggcgtcctgcagcaccgagtgccacgacgccttctcgggtgccgccggcgccgtgccggaggaggtggtagatgcaggcagatttgggtctatcaggttcttccattttttgtaa

SEQ ID NO: 2058 - protein, 225 aa, Sorghum bicolor
  misc_feature: Ceres ANNOT ID no. 6018417
  misc_feature (29)..(92): Pfam Id: WRKY Pfam Desc: WRKY DNA -binding domain
  misc_feature (2)..(225): NCBI GI: 115483857 NCBI Desc: os11g0116900 [oryza sativa (japonica cultivar-group)]
  misc_feature (10)..(181): NCBI GI: 125491399 NCBI Desc: wrky transcription factor [triticum aestivum]
  misc_feature (2)..(93): NCBI GI: 46394346 NCBI Desc: tpa: wrky transcription factor 46 [oryza sativa (indica cultivar-group)]
  misc_feature (1)..(121): NCBI GI: 56201706 NCBI Desc: wrky transcription factor 18-like protein [oryza sativa (japonica cultivar-group)]
  misc_feature (3)..(171): NCBI GI: 46394290 NCBI Desc: tpa: wrky transcription factor 18 [oryza sativa (japonica cultivar-group)]
  misc_feature: The sequence is a functional homolog of SEQ ID NO 1197 in the 10/666,642US patent application
  misc_feature: The sequence is a functional homolog of SEQ ID NO 1198 in the 10/666,642US patent application
  misc_feature: Useful for making plants with modulated growth and phenotype characteristics
  misc_feature: The sequence is a functional homolog of SEQ ID NO 1197 in the 20070033671 US patent application
MSPAPTSHHSQINSRKEKRMRKVDTFAPHNDGHQWRKYGEKKINNTNFPRYYYRCTYKDNMNCPATKQVQQKDHSDPPLYAVTYYNEHSCNSAFLPLSPSEFQLQTSSGKAVSICFDSSSGAAAPQEPPATAAATNASGGGGSPSSSAAAVAAARRGTPPEISNPPVLRRSETYPWGAGAAGVVEQKPASCSTECHDAFSGAAGAVPEEVVDAGRFGSIRFFHFL

SEQ ID NO: 2059 - DNA, 552 bp, Sorghum bicolor
  misc_feature: Ceres ANNOT ID no. 6018419
  misc_feature: Encodes the peptide sequence at SEQ ID NO 2060
atggcgacggcttttatggagcaagcactcgagcaggcaaagtttgcgctggataacctcgaggtccctgttgggtgtgtgattgtggaggacgggaaagtgatctcctctggcagcaacaagacgaatgccacccgaaatgctaccagacatgctgagatggaagctattgatgtcctgctccgggagtggcaaagcatgggtcttgatcagacacaggttgcggagaaatttgcaggatgcgacctttatgtcacgtgtgagccatgtataatgtgtgcgacagcattgtcgataattggaataagagaagtttactttggttgtgccaatgacaaatttggaggatgtggatcaatcatgtcattgcacaagggtgatacttcttcgtcagatgatttatcagggagccaagcctctaaaccaaaaggtttcaaatgcactggagggatcatggctgaagaagcggtagctctttttaggtgtttctacgaacaaggaaacccaaatgccccaaggcctcacagaccagttcgaacgcctcaacaatga

SEQ ID NO: 2060 - protein, 183 aa, Sorghum bicolor
  misc_feature: Ceres ANNOT ID no. 6018419
  misc_feature (1)..(109): Pfam Id: dCMP_cyt_deam_1 Pfam Desc: Cytidine and deoxycytidylate deaminase zinc-binding region
  misc_feature (5)..(178): NCBI GI: 79361008 NCBI Desc: emb2191; hydrolase/ zinc ion binding [arabidopsis thaliana]
  misc_feature (5)..(178): NCBI GI: 124360458 NCBI Desc: cmp/dcmp deaminase, zinc-binding [medicago truncatula]
  misc_feature (26)..(170): NCBI GI: 8778532 NCBI Desc: f21d18.9 [arabidopsis thaliana]
  misc_feature (5)..(173): NCBI GI: 59858211 NCBI Desc: deaminase domain containing 1 [bos taurus]
  misc_feature (5)..(173): NCBI GI: 31652308 NCBI Desc: otthump00000017329 [homo sapiens]
MATAFMEQALEQAKFALDNLEVPVGCVIVEDGKVISSGSNKTNATRNATRHAEMEAIDVLLREWQSMGLDQTQVAEKFAGCDLYVTCEPCIMCATALSIIGIREVYFGCANDKFGGCGSIMSLHKGDTSSSDDLSGSQASKPKGFKCTGGIMAEEAVALFRCFYEQGNPNAPRPHRPVRTPQQ

SEQ ID NO: 2061 - DNA, 735 bp, Sorghum bicolor
  misc_feature: Ceres ANNOT ID no. 6018423
  misc_feature: Encodes the peptide sequence at SEQ ID NO 2062
atgggagccgaggcaatgtcgtcccacggcagcagggtcggcggcggcggcggggccctgtcgcggcagggctcggtgtgcagcctcacgttcagcgaggtggagggacagctgcacggcgtcaacctggacgacctcctccgctcgggcaggaagacggcggacgaggtgtggcgggacatccagggcgccgccgccgccgcggcggcctgcccgcgggcccagatgacgctggaggacttcctgtcccgcggcggcggcccgcccgccgacgccgccgcagacacggacacgggctccggcgcccgcggctgggcgcagcagctgtaccagccggccccggccccggccccgctggagctgggccgccaccaccccgccgtcgggcgtcccgtgccgcggccgctcggcgcgggcgcggggccggtgctggacgcgctgtaccacgacggccaggacgcggtggccggggcgaagcgtgtcgccggcgagggcggcgtggcggagaggagcaacgagcggcgcaagaagcggatgatcaagaaccgggagtcggcggcgaggtctcgcgcgcggaagcaggcgtacacgaacgagctggagaacaagatctcgcagctggaggaggagaacgagcggctccggaggcacaaggcaccggagccggtagtgcagtatgtgccgcaacaggagctgaagaatcggctccggcgggctaactcggccaacttctaa

SEQ ID NO: 2062 - protein, 244 aa, Sorghum bicolor
  misc_feature: Ceres ANNOT ID no. 6018423
  misc_feature (170)..(232): Pfam Id: bZIP_1 Pfam Desc: bZIP transcription factor
  misc_feature (170)..(223): Pfam Id: bZIP_2 Pfam Desc: Basic region leucine zipper
  misc_feature (1)..(219): NCBI GI: 115474165 NCBI Desc: os07g0686100 [oryza sativa (japonica cultivar-group)]
  misc_feature (75)..(244): NCBI GI: 3273764 NCBI Desc: dc3 promoter-binding factor-3 [helianthus annuus]
  misc_feature (87)..(244): NCBI GI: 59896064 NCBI Desc: bzip transcription factor [malus x domestica]
  misc_feature (157)..(244): NCBI GI: 92875948 NCBI Desc: camp response element binding (creb) protein [medicago truncatula]
  misc_feature (157)..(242): NCBI GI: 87162867 NCBI Desc: camp response element binding (creb) protein [medicago truncatula]
  misc_feature: The sequence is a functional homolog of SEQ ID NO 114 in the 10/374,780US patent application
  misc_feature: The sequence is a functional homolog of SEQ ID NO 1537 in the 10/412,699US patent application
  misc_feature: The sequence is a functional homolog of SEQ ID NO 1538 in the 10/412,699US patent application
  misc_feature: The sequence is a functional homolog of SEQ ID NO 1539 in the 10/412,699US patent application
  misc_feature: The sequence is a functional homolog of SEQ ID NO 1540 in the 10/412,699US patent application
  misc_feature: The sequence is a functional homolog of SEQ ID NO 1541 in the 10/412,699US patent application
  misc_feature: The sequence is a functional homolog of SEQ ID NO 1542 in the 10/412,699US patent application
  misc_feature: The sequence is a functional homolog of SEQ ID NO 1761 in the 10/374,780US patent application
  misc_feature: The sequence is a functional homolog of SEQ ID NO 2542 in the 10/374,780US patent application
  misc_feature: The sequence is a functional homolog of SEQ ID NO 268 in the 10/225,066US patent application
  misc_feature: The sequence is a functional homolog of SEQ ID NO 36 in the 10/225,066US patent application
  misc_feature: The sequence is a functional homolog of SEQ ID NO 750 in the 10/412,699US patent application
  misc_feature: Useful for making plants with modulated growth and phenotype characteristics
  misc_feature: The sequence is a functional homolog of SEQ ID NO 1537 in the 20040045049 US patent application
  misc_feature: The sequence is a functional homolog of SEQ ID NO 1538 in the 20040045049 US patent application
  misc_feature: The sequence is a functional homolog of SEQ ID NO 1539 in the 20040045049 US patent application
  misc_feature: The sequence is a functional homolog of SEQ ID NO 1540 in the 20040045049 US patent application
  misc_feature: The sequence is a functional homolog of SEQ ID NO 1542 in the 20040045049 US patent application
  misc_feature: The sequence is a functional homolog of SEQ ID NO 750 in the 20040045049 US patent application
  misc_feature: The sequence is a functional homolog of SEQ ID NO 36 in the 20050160493 US patent application
  misc_feature: The sequence is a functional homolog of SEQ ID NO 1761 in the 20060162006 US patent application
  misc_feature: The sequence is a functional homolog of SEQ ID NO. 337 in the 11/188,298 US application
  misc_feature: The sequence is a functional homolog of SEQ ID NO. 512 in the 11/188,298 US application
MGAEAMSSHGSRVGGGGGALSRQGSVCSLTFSEVEGQLHGVNLDDLLRSGRKTADEVWRDIQGAAAAAAACPRAQMTLEDFLSRGGGPPADAAADTDTGSGARGWAQQLYQPAPAPAPLELGRHHPAVGRPVPRPLGAGAGPVLDALYHDGQDAVAGAKRVAGEGGVAERSNERRKKRMIKNRESAARSRARKQAYTNELENKISQLEEENERLRRHKAPEPVVQYVPQQELKNRLRRANSANF

SEQ ID NO: 2063 - DNA, 951 bp, Sorghum bicolor
  misc_feature: Ceres ANNOT ID no. 6018427
  misc_feature: Encodes the peptide sequence at SEQ ID NO 2064
  misc_feature: Up-regulated in root tissues in response to salicylic acid treatment
  misc_feature: Up-regulated in shoot tissues in response to salicylic acid treatment
atgtcaactaccaatctgaggcggcgactccatcatggagacgttgatggaaggaaaaacgagcatgttgacatatccagtgctgattccctcaatgaacctctattagggaagtccagtggtgacaattttggatcagcggtgtatgatcctagaagacaggacctgtgggatgatgatagaaagaaagaacaactacactggtcatttcttttctcaaacttgattgcacaatgggcgcaatggttagcaagcattattgtaagctctggatctatctttggtagattattccccttctcttcagagaaccaaatcaatccagtatatcttagccctctacaggaacaaaggctgaataatttaagacgcagattgcaaatcccttttgatggctcccgtattgaacatcaagacgccttgaggcaactctggcgtttagcttatcccactcgtgagattccacccctcaaatcagaattatggaaggagatgggttggcaaggcaatgatccatctactgatttcaggggtggtggactcatatcgttggagaacctcatctttttcgccaggaactaccctaattcatttcagatgcttctgagcaaagtgcaagggcagagatcagattgggagtacccttttgcagttgctggtatcaacatttcattcatgctggtccagatgttggatctaaaatcaagtattccatcttcaaagtacggaattcgtttccttgaattgcttgaacgggatgagaatgtgtttgaccacttgtactgtgtggcctttcggctgcttgatgctcagtggcttgtgaaacgtgcctcctatatggaattcaatgaggtcttgaaatcaacaagaactcaactggagcgcgaactggttctagatgatgtgctggaggtgaaggacctgccgtcatacactatgttggatgagtaa

SEQ ID NO: 2064 - protein, 316 aa, Sorghum bicolor
  misc_feature: Ceres ANNOT ID no. 6018427
  misc_feature (135)..(296): Pfam Id: ELMO_CED12 Pfam Desc: ELMO/CED-12 family
  misc_feature (1)..(314): NCBI GI: 92893033 NCBI Desc: engulfment and cell motility, elm [medicago truncatula]
  misc_feature (84)..(314): NCBI GI: 15218859 NCBI Desc: phagocytosis and cell motility protein elmo1-related [arabidopsis thaliana]
  misc_feature (103)..(316): NCBI GI: 17981659 NCBI Desc: at2g44770/f16b22.26 [arabidopsis thaliana]
  misc_feature (94)..(314): NCBI GI: 90265048 NCBI Desc: h0102c09.5 [oryza sativa (indica cultivar-group)]
  misc_feature (94)..(314): NCBI GI: 38344760 NCBI Desc: osjnba0068l06.3 [oryza sativa (japonica cultivar-group)]
  misc_feature: Up-regulated in root tissues in response to salicylic acid treatment
  misc_feature: Up-regulated in shoot tissues in response to salicylic acid treatment
MSTTNLRRRLHHGDVDGRKNEHVDISSADSLNEPLLGKSSGDNFGSAVYDPRRQDLWDDDRKKEQLHWSFLFSNLIAQWAQWLASIIVSSGSIFGRLFPFSSENQINPVYLSPLQEQRLNNLRRRLQIPFDGSRIEHQDALRQLWRLAYPTREIPPLKSELWKEMGWQGNDPSTDFRGGGLISLENLIFFARNYPNSFQMLLSKVQGQRSDWEYPFAVAGINISFMLVQMLDLKSSIPSSKYGIRFLELLERDENVFDHLYCVAFRLLDAQWLVKRASYMEFNEVLKSTRTQLERELVLDDVLEVKDLPSYTMLDE

SEQ ID NO: 2065 - DNA, 1956 bp, Sorghum bicolor
  misc_feature: Ceres ANNOT ID no. 6018429
  misc_feature: Encodes the peptide sequence at SEQ ID NO 2066
atggcggccgcgtcgaggaaggaggaggagaggaacgagcggatcgtgcgggggctcctcaagctgccgcccaaccgcagatgcgtcaactgcaacgggctcgggccgcagtacgtgtgcaccagcttctggaccttcgtctgcgtctcctgcagcggcatccaccgagagttcacgcaccgtgtgaaatccgtctccatgtcaacgttcagcacgcaagaggtcgaggctctccagaagggtgggaaccagcgtgccaaggaatcattcttgaaggactttgatacccagaaaatgaggctacctgatagcagcaacattggcagtcttagggaattcataaaagctgtctatgtggagagacggtatgctggtggtagattttctgaaaggcctccaagagataaacagaaccaaaaggcccatgaggaagagcatagaaggccaagttcttaccattcattttcacagagcccaccttatggttgccagtatgaagagaggcgtaatggcaagcaatctgcatttctaagtaggaagcctggttcagatagggggcatgaggggaagatttctggatattcttacagttcacatagcttgcatgagagaatgtttcaggatggatttactggtgagagttgtggaccgaggacttctaactgctcagggtcaagcacgggtgatacagctaaatctgcaccacaatcacctaattttcctgatagtatatgtttcagcccccccgtgctacaagatcaatcaaatatacagagttcttgtggactcactagttcacagagaactgtatcagcaggaaacatagattctatctctcttaaatcaggcaagtcaagcttatctgatttgatttttgaggatgataatgttcacagaactgaaacagccaaaaattccgctgctccaagtttcatggcctttcctgatgatattagtgctccaaatcaagatatctttgattccaaagctactcaggaacatcatgtaactaccactgatcaatctgttgatctattttcgaacatgcttactgaaactccatctgctgataaagtgataccagcagctccatcaatggacaatgctgggtgggctacattcgatacacctccagaacaaaagcaacctgcactcactgggctttcttatgttgctaccacaagcattgataaacaggctccgaatcgtgatttgttttcatttgaatcaaatgctgagctaacatggtttcagagctctaaggatgatacttcagttaccagtcagaatcagtctactgctacatctcttgatacaggcagttctcagccttggagtactttcgatgcctccagtgctagcacccagtacactgtcaagggagatctatcattaatgacttctacattgcaagagcctaaaagaccaatagacagaaattgttctcagctttggcattcatttgatgatgctaatgaggtcgtttgtgctaaaccacgaattgaagaccacagcaatgtagtaagcatttccctttcaaccagcaatccatttatgtgctctgtagtttcagaggaatcttatgatgatgattcccagaaagtattcatggacgaattgtcacctaatacatcgattgctgcttccgcagattcatctctgggtgggccctctaataagcagatgccattaaatccatttgatcttccatttgacactcagttggggactcctgatctgttcatggacgtaagttcattgcaagagcccttgcctagtccagatctgccagctttccttgatggtttacctgaaagatggttccccagcagttcttgtgcttatgatccatcagcgtcacatggtggactaccgtgccttgtcgagcagggaccgaacttttctttgcggaatataccagtgggcactgtatcaactggaaatccttttgtatag

SEQ ID NO: 2066 - protein, 651 aa, Sorghum bicolor
  misc_feature: Ceres ANNOT ID no. 6018429
  misc_feature (13)..(131): Pfam Id: ArfGap Pfam Desc: Putative GTPase activating protein for Arf
  misc_feature (2)..(525): NCBI GI: 115452747 NCBI Desc: os03g0323500 [oryza sativa (japonica cultivar-group)]
  misc_feature (5)..(650): NCBI GI: 10441354 NCBI Desc: arf gap-like zinc finger-containing protein ziga4 [arabidopsis thaliana]
  misc_feature (4)..(257): NCBI GI: 49387911 NCBI Desc: ziga2 protein-like [oryza sativa (japonica cultivar-group)]
  misc_feature (4)..(257): NCBI GI: 49387912 NCBI Desc: human rev interacting-like protein-like [oryza sativa (japonica cultivar-group)]
  misc_feature (46)..(137): NCBI GI: 9802557 NCBI Desc: f22o13.16 [arabidopsis thaliana]
  misc_feature: The sequence is a functional homolog of SEQ ID NO. 425 in the 11/188,298 US application
MAAASRKEEERNERIVRGLLKLPPNRRCVNCNGLGPQYVCTSFWTFVCVSCSGIHREFTHRVKSVSMSTFSTQEVEALQKGGNQRAKESFLKDFDTQKMRLPDSSNIGSLREFIKAVYVERRYAGGRFSERPPRDKQNQKAHEEEHRRPSSYHSFSQSPPYGCQYEERRNGKQSAFLSRKPGSDRGHEGKISGYSYSSHSLHERMFQDGFTGESCGPRTSNCSGSSTGDTAKSAPQSPNFPDSICFSPPVLQDQSNIQSSCGLTSSQRTVSAGNIDSISLKSGKSSLSDLIFEDDNVHRTETAKNSAAPSFMAFPDDISAPNQDIFDSKATQEHHVTTTDQSVDLFSNMLTETPSADKVIPAAPSMDNAGWATFDTPPEQKQPALTGLSYVATTSIDKQAPNRDLFSFESNAELTWFQSSKDDTSVTSQNQSTATSLDTGSSQPWSTFDASSASTQYTVKGDLSLMTSTLQEPKRPIDRNCSQLWHSFDDANEVVCAKPRIEDHSNVVSISLSTSNPFMCSVVSEESYDDDSQKVFMDELSPNTSIAASADSSLGGPSNKQMPLNPFDLPFDTQLGTPDLFMDVSSLQEPLPSPDLPAFLDGLPERWFPSSSCAYDPSASHGGLPCLVEQGPNFSLRNIPVGTVSTGNPFV

SEQ ID NO: 2067 - DNA, 969 bp, Sorghum bicolor
  misc_feature: Ceres ANNOT ID no. 6018431
  misc_feature: Encodes the peptide sequence at SEQ ID NO 2068
  misc_feature: Up-regulated in shoot tissues in response to methyl jasmonate treatment
atgggatctgttgcctccgccgccgtgccacctcctcctcaatcagcgccgccccaggtgggcgcgccgccttatgggcccgggctcgccgggatcctcccgccgaggccggagggggaggagaagaaggaggagaaggtggactacctcaacctcccctgccccgtgccattcgaggagatccagcgcgaggccctcatgtctttgaagcctgaactttttgaaggattgaggtttgacttcacaaaagggttgaatcaaaagttctctcttagccacagcgtttttatgggctccttagaagttcctgcccaggcagctgaaactattaaagttcctactgcgcattatgaatttggtgccaattttttagatccaaagttaatgctcattggaagggtgatgacagatggaaggcttaatgctcgtgtgaaatgtgatttgacagacaatctgacgctgaaagtaaatgcacagcttacccaagaggcacattactcacaaggaatgtttaactttgactacaagggaagtgactatcgagcacaattccaaattgggaacaatgcattctatggtgcaaattatattcagagtgttactccgaacctatcaatgggaactgaaatgttctggcttggtcaccaaaggaagtctggaattggttttgcctctcgctataacacggacaaaatggtgggcactctgcaagtcgcaagcactggaatagttgccttaagttatgtccagaagatttccgagaaggtttccctcgcgtctgatttcatgtataaccatatgtcacgagatgtaacttgccgtctaagaggcaaaattgactcaaatggtgttgttgccgcatacttggaggagaggttgaacatgggtgtcaacttccttctatctgctgagattgaccattgtaagaagaactacaagtttggttttggaatgaccgtaggagagtaa

SEQ ID NO: 2068 - protein, 322 aa, Sorghum bicolor
  misc_feature: Ceres ANNOT ID no. 6018431
  misc_feature (54)..(315): Pfam Id: Porin_3 Pfam Desc: Eukaryotic porin
  misc_feature (29)..(322): NCBI GI: 92880528 NCBI Desc: porin, eukaryotic type [medicago truncatula]
  misc_feature (159)..(321): NCBI GI: 11994775 NCBI Desc: membrane import protein-like [arabidopsis thaliana]
  misc_feature (39)..(322): NCBI GI: 145345027 NCBI Desc: mpt family transporter: outer membrane translocase (import) tom40 [ostreococcus lucimarinus cce9901]
  misc_feature (3)..(204): NCBI GI: 90654201 NCBI Desc: mitochondrial import receptor-like protein [nicotiana tabacum]
  misc_feature (29)..(130): NCBI GI: 92898676 NCBI Desc: membrane import protein-like-related [medicago truncatula]
  misc_feature: Up-regulated in shoot tissues in response to methyl jasmonate treatment
MGSVASAAVPPPPQSAPPQVGAPPYGPGLAGILPPRPEGEEKKEEKVDYLNLPCPVPFEEIQREALMSLKPELFEGLRFDFTKGLNQKFSLSHSVFMGSLEVPAQAAETIKVPTAHYEFGANFLDPKLMLIGRVMTDGRLNARVKCDLTDNLTLKVNAQLTQEAHYSQGMFNFDYKGSDYRAQFQIGNNAFYGANYIQSVTPNLSMGTEMFWLGHQRKSGIGFASRYNTDKMVGTLQVASTGIVALSYVQKISEKVSLASDFMYNHMSRDVTCRLRGKIDSNGVVAAYLEERLNMGVNFLLSAEIDHCKKNYKFGFGMTVGE

SEQ ID NO: 2069 - DNA, 591 bp, Sorghum bicolor
  misc_feature: Ceres ANNOT ID no. 6018432
  misc_feature: Encodes the peptide sequence at SEQ ID NO 2070
atggctctgacggtgccaaccgcggcgctggtcgtcctcgccgtcgcggccacgctggccctgcagccgcgagcgagcgcgcagatatcagccccgccctcgggcgcccccgcggccgcgccgtcgtcgccgtcgctggactgcgcgggcgcgctgcggaacctgacgccgtgcctgacgtacgtggagcgccgcagcgcgctgacgcggccggacaagggctgctgcggggcgctcgcggccgtcgtgggcggcgacgacgccgcctgcctgtgcgcgctcctcgccgggtacggcgcgcgcggcgtccgcgtcgacaccgtgcgcgcgctcgcgctgcccaccatctgccgcgtcgacgcgccgccgcccaggctctgcgccgcgctcggcatgcccgtcgccgagccgccgggcggagccgccgccgcgccgatggactcagggtccgacgcgccgtcgaccacaccggcaacggcggccgcgaacggcggcccggcgacgcgctggcgagcttcgacacggccgtacctggtggctgctctctcgcacggctgtggtgccatcctcctctccacactgctgctgtaa

SEQ ID NO: 2070 - protein, 196 aa, Sorghum bicolor
  misc_feature: Ceres ANNOT ID no. 6018432
  misc_feature (48)..(127): Pfam Id: Tryp_alpha_amyl Pfam Desc: Protease inhibitor/seed storage/LTP family
  misc_feature (1)..(165): NCBI GI: 92888656 NCBI Desc: plant lipid transfer protein/par allergen [medicago truncatula]
  misc_feature (10)..(177): NCBI GI: 21617892 NCBI Desc: lipid-transfer protein-like protein [arabidopsis thaliana]
  misc_feature (10)..(165): NCBI GI: 79314090 NCBI Desc: lipid binding [arabidopsis thaliana]
  misc_feature (9)..(192): NCBI GI: 30680828 NCBI Desc: protease inhibitor/seed storage/lipid transfer protein (ltp) family protein [arabidopsis thaliana]
  misc_feature (13)..(174): NCBI GI: 50509338 NCBI Desc: protease inhibitor-like protein [oryza sativa (japonica cultivar-group)]
MALTVPTAALVVLAVAATLALQPRASAQISAPPSGAPAAAPSSPSLDCAGALRNLTPCLTYVERRSALTRPDKGCCGALAAVVGGDDAACLCALLAGYGARGVRVDTVRALALPTICRVDAPPPRLCAALGMPVAEPPGGAAAAPMDSGSDAPSTTPATAAANGGPATRWRASTRPYLVAALSHGCGAILLSTLLL

SEQ ID NO: 2071 - DNA, 1932 bp, Sorghum bicolor
  misc_feature: Ceres ANNOT ID no. 6018434
  misc_feature: Encodes the peptide sequence at SEQ ID NO 2072
  misc_feature: Up-regulated in root tissues in response to methyl jasmonate treatment
  misc_feature: Up-regulated in shoot tissues in response to salicylic acid treatment
atgatgggaggcgggctgatgatggatcagagcgtggtgttccctggcgtccacaacttcgtggatctccttcagcaaaacggtgacaagaaccttggcttcgggtcgctgatgccgcagacgtcctccggcgaccagtgcgtgatgggggagggtgatcttgtggacccgccgccggagagcttcccggacgctggggaggacgacagcgatgatgatgttgaggacatcgaggagctggagcgccgcatgtggcgcgaccgcatgaagctgaagcggctcagggagctgcagcagagccgcggcaaggattcgatagctggcggtgggggcctggctgacggctcgtccaagccaaggcagtcgcaggagcaggcccgacgcaagaagatgtctcgcgcgcaggacggcatcctcaagtacatgctcaagatgatggaagtgtgccgcgcacaggggtttgtgtatgggatcattccggagaagggcaagccggtgagcggcgcctccgacaacctccgtgcgtggtggaaggagaaggtccgcttcgaccgcaacggcccggccgccatcgccaagtatcaggccgacaacgcagtccctggtgccgagaacgagctcacctcgggcgctgccagccctcattccttgcaggagctgcaggacactacgctgggctcattgctctcagcactcatgcagcactgcgaccccccacagcggcgctacccgctggagaagggcgttcctccaccatggtggcctactggcgacgaagagtggtggccggaacttggcatccccaaggaccagggcccacccccatacaagaagcctcatgaccttaagaaggcctggaaggtgagcgtgctcaccgctgtcatcaagcacatgtcaccagacatagagaagatccgtcgccttgttcgccagtccaagtgcctccaggacaagatgactgccaaggagatctcaacctggctggcggtcgtcaagcaggaagaggagctgtacctgaagctgcaccccggcgcactcccaccagcatctactggtggcatcgccagtgccatatccttcaacaccagctcaagcgagtatgatgtggacatcattgatgagtgtaagggggatgaggccggcaaccagaagacaggagtcactgacccaaccgcgttcaaccttggtgctgctatcctaagtgacaagttccttgtgcagacgcccatgaaggaggagactgcggacgtcgagttcatccagaagaggaacgcccccgctgctgctgagccagagctaatgctaaacaaccgagtgtacacctgcaacaacgtccagtgcccacacagtgactacagctatggattccttgaccggaatacccgcaacagccaccagtacacctgtaagtacaatgaaccaatccctcagagcactgagaacaagccgccgccagcaccgccacagtcacaagccttccagccggccttcaaccaacccaatcagtcactgaacaatctggatttcagcctgcccatggacgggcagaggtccatcgctgagctgatgaacatgtacgacaacaacttcatgacaaacaagaacatgagcagtgacagcgtcaccatcatggagaggcctaatgcgatgccccagaggatccagatggatgagggtttctttggacagggcaatggagtcttcgacgatgtcaatagcatgatgcagcaacaacagcaggcaccagtgcagcagcagcagcagcagcagcagcagcagttcttcatccgtgatgacacgccatttgtgagccagatgggcgacatcaccagcacatcggagttcaggttcggttctggtttcaacatgtctagcaccgttgattacccaggcgcggcgcagaagaacgatgggaccaattggttctactga

SEQ ID NO: 2072 - protein, 643 aa, Sorghum bicolor
  misc_feature: Ceres ANNOT ID no. 6018434
  misc_feature (60)..(467): Pfam Id: EIN3 Pfam Desc: Ethylene insensitive 3
  misc_feature (1)..(642): NCBI GI: 115452753 NCBI Desc: os03g0324200 [oryza sativa (japonica cultivar-group)]
  misc_feature (1)..(477): NCBI GI: 115452755 NCBI Desc: os03g0324300 [oryza sativa (japonica cultivar-group)]
  misc_feature (4)..(643): NCBI GI: 121309570 NCBI Desc: ethylene signal transcription factor [musa acuminata]
  misc_feature (2)..(510): NCBI GI: 121309572 NCBI Desc: ethylene signal transcription factor [musa acuminata]
  misc_feature (2)..(643): NCBI GI: 121309574 NCBI Desc: ethylene signal transcription factor [musa acuminata]
  misc_feature: The sequence is a functional homolog of SEQ ID NO 1350 in the 11/479,226US patent application
  misc_feature: The sequence is a functional homolog of SEQ ID NO 1358 in the 11/479,226US patent application
  misc_feature: The sequence is a functional homolog of SEQ ID NO 1361 in the 11/479,226US patent application
  misc_feature: The sequence is a functional homolog of SEQ ID NO 2464 in the 10/374,780US patent application
  misc_feature: The sequence is a functional homolog of SEQ ID NO 632 in the 10/412,699US patent application
  misc_feature: The sequence is a functional homolog of SEQ ID NO 632 in the 10/666,642US patent application
  misc_feature: The sequence is a functional homolog of SEQ ID NO 818 in the 10/225,066US patent application
  misc_feature: Useful for making plants with modulated growth and phenotype characteristics
  misc_feature: Useful for making plants with modulated low light sensitivity
  misc_feature: Functional homolog of the protein sequence given in SEQ ID NO 13343
  misc_feature: The sequence is a functional homolog of SEQ ID NO 632 in the 20040045049 US patent application
  misc_feature: The sequence is a functional homolog of SEQ ID NO 1358 in the 20070022495 US patent application
  misc_feature: The sequence is a functional homolog of SEQ ID NO 1361 in the 20070022495 US patent application
  misc_feature: The sequence is a functional homolog of SEQ ID NO 632 in the 20070033671 US patent application
  misc_feature: The sequence is a functional homolog of SEQ ID NO 1350 in the 11/479,226 US patent application
  misc_feature: The sequence is a functional homolog of SEQ ID NO 2464 in the 10/374,780 US patent application
  misc_feature: The sequence is a functional homolog of SEQ ID NO 632 in the 10/412,699 US patent application
  misc_feature: The sequence is a functional homolog of SEQ ID NO 818 in the 10/225,066 US patent application
  misc_feature: The sequence is a functional homolog of SEQ ID NO 204 in the 10/225,068 US patent application
  misc_feature: The sequence is a functional homolog of SEQ ID NO 2468 in the 10/374,780 US patent application
  misc_feature: Useful for making plants with modulated low light sensitivity
  misc_feature: Functional homolog of the protein sequence given in SEQ ID NO 13343
  misc_feature: The sequence is a functional homolog of SEQ ID NO 632 in the 10/666,642 US patent application
  misc_feature: Up-regulated in root tissues in response to methyl jasmonate treatment
  misc_feature: Up-regulated in shoot tissues in response to salicylic acid treatment
MMGGGLMMDQSVVFPGVHNFVDLLQQNGDKNLGFGSLMPQTSSGDQCVMGEGDLVDPPPESFPDAGEDDSDDDVEDIEELERRMWRDRMKLKRLRELQQSRGKDSIAGGGGLADGSSKPRQSQEQARRKKMSRAQDGILKYMLKMMEVCRAQGFVYGIIPEKGKPVSGASDNLRAWWKEKVRFDRNGPAAIAKYQADNAVPGAENELTSGAASPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLHPGALPPASTGGIASAISFNTSSSEYDVDIIDECKGDEAGNQKTGVTDPTAFNLGAAILSDKFLVQTPMKEETADVEFIQKRNAPAAAEPELMLNNRVYTCNNVQCPHSDYSYGFLDRNTRNSHQYTCKYNEPIPQSTENKPPPAPPQSQAFQPAFNQPNQSLNNLDFSLPMDGQRSIAELMNMYDNNFMTNKNMSSDSVTIMERPNAMPQRIQMDEGFFGQGNGVFDDVNSMMQQQQQAPVQQQQQQQQQQFFIRDDTPFVSQMGDITSTSEFRFGSGFNMSSTVDYPGAAQKNDGTNWFY

SEQ ID NO: 2073 - DNA, 1557 bp, Sorghum bicolor
  misc_feature: Ceres ANNOT ID no. 6018441
  misc_feature: Encodes the peptide sequence at SEQ ID NO 2074
atgtccctccgggcggcattggcggacgtggacatggaatgcgtcgcgacggggcctgaggagatatggcgtcgccggcccaagaccaagatcgtctgcaccctaggtccggcctcgcgctccgtcgagatgtgcgcgcgcctgctgcgcgccggcatgtgcgtcgcgcgcttcaacttctcgcacggctcccacgagtaccaccaggagaccctggacaacctccgaaaggccatggacctcaccggcctcatctgcgccgtcatgctcgacactaagggaccagagatccgcacaggttttttgaaagatggcaagcctgtaaagctgacacgggggcacgaaatcaccatcaccactgattattccatcaagggtgatgagaatatgatttccatgagctacaacaagattgctgtagacctggagcctgggagcacaatactatgcgctgatggcaccatcacattcactgtgctttcctgtgatcctgtgcaaggcctggttcgttgccgttgtgagaactcagctctccttggggagagaaagaatgtcaatcttcctggggtgatcgtggatctcccaaccttaacagaaaaggacaaagtggatatccttcagtggggtgtcccaaacaacattgacatgattgcgctatccttcgtacgcaaaggatcagatcttaagatggtcagaggtgtgctcggtgagcatgccaagtcaatactacttatgtccaaggttgagaatcaagaaggtgttgccaattttgatgagatacttgcaaactcagatgctttcatggttgccagaggggatttgggaatggagatacccatcgagaagatattctatgctcagaaggtgatgatcttcaaatgtaatgtgcaaggcaagcctgttgttactgcaacccagatgctggagtcaatgattaaatctccccgccctacaagagcagaagcaactgatgtcgccaatgctgtcctggatggcactgattgtgtgatgcttagcggtgagactgcagctggggcatatccagagctagcagtgcaaacaatgtcaaggatttgcctacaagcagagtcacatacagattatggagcagttttcaagttaatcagtagtgctgccccaatccctatgagtccactggagagcttggcgtcatcagcagttcgaaccgccaacatctctaatgcatcactcatcttggtcctcacaaggggaggcacaaccgcgaggcttgtggcaaagtacaggccagcaattccagtgataacctctgtggtcccagaaatgaagacggacgataattttaactggacttgcagtgatgagcgccctgccaggcacagcatgattgtgaggggcctgatcccgatgcttagcgctgctacagcgaaggcatctgatactgagtcgactgaggaagccattagctttgccatagatcatgcgaagaagctcaagatctgcaagtcaggggattcagtcgtcgccttgcatcgtattggtgcatcatctgtcatcaagatcttgacagtcgattag

SEQ ID NO: 2074 - protein, 518 aa, Sorghum bicolor
  misc_feature: Ceres ANNOT ID no. 6018441
  misc_feature (26)..(372): Pfam Id: PK Pfam Desc: Pyruvate kinase, barrel domain
  misc_feature (386)..(516): Pfam Id: PK_C Pfam Desc: Pyruvate kinase, alpha/beta domain
  misc_feature (25)..(517): NCBI GI: 59668642 NCBI Desc: pyruvate kinase [glycine max]
  misc_feature (25)..(517): NCBI GI: 444023 NCBI Desc: pyruvate kinase [nicotiana tabacum]
  misc_feature (25)..(517): NCBI GI: 92868232 NCBI Desc: pyruvate kinase [medicago truncatula]
  misc_feature (7)..(517): NCBI GI: 2497538 NCBI Desc: pyruvate kinase, cytosolic isozyme (pk)
  misc_feature (7)..(517): NCBI GI: 22296818 NCBI Desc: pyruvate kinase [glycine max]
  misc_feature (25)..(517): SWISSPROT Homolog: EC 2.7.1.40 Pyruvate kinase, cytosolic isozyme
MSLRAALADVDMECVATGPEEIWRRRPKTKIVCTLGPASRSVEMCARLLRAGMCVARFNFSHGSHEYHQETLDNLRKAMDLTGLICAVMLDTKGPEIRTGFLKDGKPVKLTRGHEITITTDYSIKGDENMISMSYNKIAVDLEPGSTILCADGTITFTVLSCDPVQGLVRCRCENSALLGERKNVNLPGVIVDLPTLTEKDKVDILQWGVPNNIDMIALSFVRKGSDLKMVRGVLGEHAKSILLMSKVENQEGVANFDEILANSDAFMVARGDLGMEIPIEKIFYAQKVMIFKCNVQGKPVVTATQMLESMIKSPRPTRAEATDVANAVLDGTDCVMLSGETAAGAYPELAVQTMSRICLQAESHTDYGAVFKLISSAAPIPMSPLESLASSAVRTANISNASLILVLTRGGTTARLVAKYRPAIPVITSVVPEMKTDDNFNWTCSDERPARHSMIVRGLIPMLSAATAKASDTESTEEAISFAIDHAKKLKICKSGDSVVALHRIGASSVIKILTVD

SEQ ID NO: 2075 - DNA, 1062 bp, Sorghum bicolor
  misc_feature: Ceres ANNOT ID no. 6018443
  misc_feature: Encodes the peptide sequence at SEQ ID NO 2076
atgtatcatcatcaacaacagcttcagagccacagccatttcctgtcttctaggcagacattccctccagaaaggcacatgattctgcaaggagggagcattccagcagagtcagggcttgtgctttcgactgatgctaaacctaggttaaaatggacgcctgaactacatgagcgttttgtggaggcagtaaatcaacttggtgggcctgataaagctacaccaaagacaatcatgagactcatgggtgtccccggactaacactataccaccttaagagtcatcttcagaaatacaggctaagcaaaaacattcatgcccaagctaatggtggaaatgcaaaaaatgtggttggctgcgccatggcaatggagaaaccacctgaaggaaatggatcaccggctagccacttaaatcttggaacccagacaaacaaatctgtgcacataggtgaagcccttcagatgcaaattgaagtacagcgccgactgcatgagcaacttgaggtacaaagacatttgcaactccgcattgaagcacaagggaagtacctacaatctgtgctagaaaaggcacaggagacactttcaaagcagaatgcagggtcagtcggtgtagaaaccgcgaagatgcaactgtcagaattagtctcaaaggtatcaacagaatgcctccagcattcatttacaggctttgaagagattgaaggttcccaaattctacaagggcacaccatccaacttggcgacgggtcagttgacagctgcttaactgcttgtgatggctcacagaaagatcaagatatcctatcaatcagcctttctgctcacagaggaaaggagataggaggcatggcctttgatatgcaagcgaaagaaagaagagaggatttgtttcttgacaagctaagcatgatgcctccaagccacttagacaggcatgagagagacagttttagtatgacacgcaaggcagcaaaattggatctgaatatcaatgacaccactgacgggccacagaactgcaagaaaattgacttgaatgggttcaactggacctaa

SEQ ID NO: 2076 - protein, 353 aa, Sorghum bicolor
  misc_feature: Ceres ANNOT ID no. 6018443
  misc_feature (49)..(100): Pfam Id: Myb_DNA-binding Pfam Desc: Myb-like DNA-binding domain
  misc_feature (1)..(353): NCBI GI: 34394528 NCBI Desc: transfactor-like protein [oryza sativa (japonica cultivar-group)]
  misc_feature (1)..(353): NCBI GI: 115474151 NCBI Desc: os07g0685300 [oryza sativa (japonica cultivar-group)]
  misc_feature (1)..(270): NCBI GI: 6223653 NCBI Desc: transfactor-like [arabidopsis thaliana]
  misc_feature (1)..(305): NCBI GI: 9758906 NCBI Desc: transfactor-like protein [arabidopsis thaliana]
  misc_feature (1)..(305): NCBI GI: 14596181 NCBI Desc: transfactor-like protein [arabidopsis thaliana]
  misc_feature: The plant flowers significantly late compared to wild-type.
  misc_feature: The sequence is a functional homolog of SEQ ID NO 1233 in the 10/666,642US patent application
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1857 in the 10/374,780US patent application
  misc_feature: The sequence is a functional homolog of SEQ ID NO 190 in the 10/225,066US patent application
  misc_feature: The sequence is a functional homolog of SEQ ID NO 1990 in the 11/479,226US patent application
  misc_feature: The sequence is a functional homolog of SEQ ID NO 1992 in the 11/479,226US patent application
  misc_feature: The sequence is a functional homolog of SEQ ID NO 1999 in the 11/479,226US patent application
  misc_feature: The sequence is a functional homolog of SEQ ID NO 2000 in the 11/479,226US patent application
  misc_feature: The sequence is a functional homolog of SEQ ID NO 2866 in the 10/374,780US patent application
  misc_feature: The sequence is a functional homolog of SEQ ID NO 935 in the 10/666,642US patent application
  misc_feature: Useful for making plants with modulated flowering time
  misc_feature: Useful for making plants with modulated growth and phenotype characteristics
  misc_feature: The sequence is a functional homolog of SEQ ID NO 190 in the 20050160493 US patent application
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 1990 in the 20070022495 US patent application
  misc_feature: The sequence is a functional homolog of SEQ ID NO 1992 in the 20070022495 US patent application
  misc_feature: The sequence is a functional homolog of SEQ ID NO 1999 in the 20070022495 US patent application
  misc_feature: The sequence is a functional homolog of SEQ ID NO 2000 in the 20070022495 US patent application
  misc_feature: The sequence is a functional homolog of SEQ ID NO 1233 in the 20070033671 US patent application
  misc_feature: The sequence is a functional homolog of SEQ ID NO 935 in the 20070033671 US patent application
  misc_feature: GREAT-hit functional homolog of the protein sequence given in SEQ ID NO 13579
  misc_feature: Useful for making plants with modulated flowering time
  misc_feature: Functional homolog of the protein sequence given in SEQ ID NO 13579
  misc_feature: The sequence is a functional homolog of SEQ ID NO 1589 in the 11/479,226 US patent application
  misc_feature: The sequence is a functional homolog of SEQ ID NO 762 in the 10/412,699 US patent application
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
  misc_feature: The sequence is a functional homolog of SEQ ID NO 190 in the 10/225,066 US patent application
  misc_feature: The sequence is a functional homolog of SEQ ID NO 2866 in the 10/374,780 US patent application
  misc_feature: Useful for making plants with altered lignin content
  misc_feature: Useful for making plants with altered terpenoid content
  misc_feature: Functional homolog of the protein sequence given in SEQ ID NO 12902
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
MYHHQQQLQSHSHFLSSRQTFPPERHMILQGGSIPAESGLVLSTDAKPRLKWTPELHERFVEAVNQLGGPDKATPKTIMRLMGVPGLTLYHLKSHLQKYRLSKNIHAQANGGNAKNVVGCAMAMEKPPEGNGSPASHLNLGTQTNKSVHIGEALQMQIEVQRRLHEQLEVQRHLQLRIEAQGKYLQSVLEKAQETLSKQNAGSVGVETAKMQLSELVSKVSTECLQHSFTGFEEIEGSQILQGHTIQLGDGSVDSCLTACDGSQKDQDILSISLSAHRGKEIGGMAFDMQAKERREDLFLDKLSMMPPSHLDRHERDSFSMTRKAAKLDLNINDTTDGPQNCKKIDLNGFNWT

SEQ ID NO: 2077 - DNA, 1089 bp, Sorghum bicolor
  misc_feature: Ceres ANNOT ID no. 6018444
  misc_feature: Encodes the peptide sequence at SEQ ID NO 2078
atggaggggagcagcaatagcccggacaggcagtcgtcgggcggcagcccagaggagcgcggaagcggtggtagcggaggccggggcggcaccggggagccggtgcggtcgcggtggacgcccaagccggagcagatactgatcctcgagtccatcttcaacagcggcatggtcaacccgcccaaggatgaaaccgtccgcatccgcaagctgctcgagcgcttcggcgccgtcggggacgccaacgtcttctactggttccagaaccgccgctcccgctcgcgccgccgccagcgccagatgcaggccgccgccgccgcggccgccgctgcggcagcggccaacagcgctcccgcggctagcgccaccgccggcggccttccttctggcgctctacaatatcccttggccatgggcggcggcaccgcctgccagtatgagcagcaggcgagctcctcctcgtcgtcggggagcactactgggggctcgtctcttggccagttcgcgctcggagccggggtgcccggcaccggcggcggtgggtacttccaggcgtcgtgtggcgcttcgtcgccactggcgactgggctgatgggggacgtggacagcagcagtggcggcagcgacgatctcttcgccatctccaggcagatggggttcgcggcgacgagccccgtcgcctcggcctcggtggcgccgccgagcaccaccgcacaccagcaaccgtattactcatgccaatcgcctgcagcgacgatcacggtgttcatcaatggagtcccaatggaggttcccaggggtccaatagacttgcgagccatgttcggccaggacgtgatgctcgtccattccaccggggccctcctcccagtcaacgactatggaattctaacgcagagcttgcagatgggtgaaagctatttcttgtggagaattgggggtgacaaatgtgtgcttgtggttgagttttggaggagtgaaagggtgaggaggttccctttagctagctgtacccaaagggacgtgtcaagcgcgccggccggcctccgacgccggcaggcggcacctgccctccaccgccccatgtag

SEQ ID NO: 2078 - protein, 362 aa, Sorghum bicolor
  misc_feature: Ceres ANNOT ID no. 6018444
  misc_feature (35)..(96): Pfam Id: Homeobox Pfam Desc: Homeobox domain
  misc_feature (33)..(162): NCBI GI: 124360469 NCBI Desc: homeodomain-related [medicago truncatula]
  misc_feature (32)..(196): NCBI GI: 115474147 NCBI Desc: os07g0684900 [oryza sativa (japonica cultivar-group)]
  misc_feature (2)..(166): NCBI GI: 61217578 NCBI Desc: wuschel-related homeobox 11
  misc_feature (2)..(166): NCBI GI: 145338074 NCBI Desc: dna binding / transcription factor [arabidopsis thaliana]
  misc_feature (4)..(99): NCBI GI: 124361149 NCBI Desc: homeodomain-related [medicago truncatula]
  misc_feature: The plant is abnormally small.
  misc_feature: The plant produces a reduced number of seeds.
  misc_feature: Useful for biocontainment applications
  misc_feature: Useful for making plants with modulated biomass
  misc_feature: GREAT-hit functional homolog of the protein sequence given in SEQ ID NO 12941
  misc_feature: Useful for biocontainment applications
  misc_feature: Useful for making plants with modulated biomass
  misc_feature: Functional homolog of the protein sequence given in SEQ ID NO 12941
MEGSSNSPDRQSSGGSPEERGSGGSGGRGGTGEPVRSRWTPKPEQILILESIFNSGMVNPPKDETVRIRKLLERFGAVGDANVFYWFQNRRSRSRRRQRQMQAAAAAAAAAAAANSAPAASATAGGLPSGALQYPLAMGGGTACQYEQQASSSSSSGSTTGGSSLGQFALGAGVPGTGGGGYFQASCGASSPLATGLMGDVDSSSGGSDDLFAISRQMGFAATSPVASASVAPPSTTAHQQPYYSCQSPAATITVFINGVPMEVPRGPIDLRAMFGQDVMLVHSTGALLPVNDYGILTQSLQMGESYFLWRIGGDKCVLVVEFWRSERVRRFPLASCTQRDVSSAPAGLRRRQAAPALHRPM

SEQ ID NO: 2079 - DNA, 1389 bp, Sorghum bicolor
  misc_feature: Ceres ANNOT ID no. 6018448
  misc_feature: Encodes the peptide sequence at SEQ ID NO 2080
  misc_feature: Up-regulated in shoot tissues in response to salicylic acid treatment
atggatcctactgagcctcgttggcgtataaactcgagcttctctcctccaacgtcaaggagatgggactgccgttattcatcagatggattgccccacagagttcatgatgctcctcatgatcacccaccttatgtttcatccctatcgtcccatagcaaaggaagcagaagtgcatttggcagtgatcagtacctcaatcaccatcattccgtgtctgatggagcactttcttactttgggagtccagctgacagccttcaggctccacgctggacaccctctcttcaaagatttgatctcggtgaattctctacccctgcaggaggatcaagaccagaaacttctgactatcctcagtcaagtgagaggccactgactgcaacaagcagtttcagttctgcatccccattttcagaatcaagccagctagcatcatcatctagtaaacaaccagccccatatctacctcgcaaccatatgggcaggcggtctttcatgtctaaaccagtctacccacttgtcttccggaatcctgtgtcagaatcagaagcgtgcaggatgcttgaggttactaatgctgggcgagcgacaccaagtgatgacagtcaggcttctcctctgtggcgtcgcagcttggcgagtccagaactcaagttccataatgcactgaatgaacttgggaagatggaggcttcacctgaaccgaacacaagctcaagacgggaagggttcagatggagcaatgccagtagttatgattttggatatgatggagatgccattgacatttcagatcatatcagtattgagtcccagagatctcccacaagctcagtgaggttcctgaagtgtgggctgtgcgagagattcctgcgccagaaatcgccctggacctcgaaccggattgttcgaaacgccgacatgccagtagcagcggttcttccttgccgacatgccttccacgcggattgcttggaggaaagcactcccaagacagaagtccatgatccaccctgcccgctgtgcacgcgagccactgaagacgaagggcatgtgtcgttctcagaacctctgcatgttgccctccggtccgctcgcagcaggaacctttccttgggcagtggtgctggtgggagtagcagcagcgccaaccctccttgcagtgatcgtggcttgaagaggaaccattctgctatcgtgccgagacgcggcagtggtagctcattgttccgcaaccgcttcaagaagcagttccccttcaaagcgaggatcgggaaggagctttttggcggcagggttttcaacagggttggatcatcttcgtcttcaggtcagcagggtgaccatcgacagcaagctccaaagcatgaccgacccatgaagtag

SEQ ID NO: 2080 - protein, 462 aa, Sorghum bicolor
  misc_feature: Ceres ANNOT ID no. 6018448
  misc_feature (73)..(424): NCBI GI: 140071230 NCBI Desc: zinc finger, ring-type [medicago truncatula]
  misc_feature (221)..(348): NCBI GI: 73329438 NCBI Desc: at1g19680-like protein [arabidopsis lyrata]
  misc_feature (221)..(344): NCBI GI: 73329338 NCBI Desc: at1g19680 [arabidopsis thaliana]
  misc_feature (221)..(344): NCBI GI: 73329340 NCBI Desc: at1g19680 [arabidopsis thaliana]
  misc_feature (221)..(344): NCBI GI: 73329342 NCBI Desc: at1g19680 [arabidopsis thaliana]
  misc_feature: Up-regulated in shoot tissues in response to salicylic acid treatment
MDPTEPRWRINSSFSPPTSRRWDCRYSSDGLPHRVHDAPHDHPPYVSSLSSHSKGSRSAFGSDQYLNHHHSVSDGALSYFGSPADSLQAPRWTPSLQRFDLGEFSTPAGGSRPETSDYPQSSERPLTATSSFSSASPFSESSQLASSSSKQPAPYLPRNHMGRRSFMSKPVYPLVFRNPVSESEACRMLEVTNAGRATPSDDSQASPLWRRSLASPELKFHNALNELGKMEASPEPNTSSRREGFRWSNASSYDFGYDGDAIDISDHISIESQRSPTSSVRFLKCGLCERFLRQKSPWTSNRIVRNADMPVAAVLPCRHAFHADCLEESTPKTEVHDPPCPLCTRATEDEGHVSFSEPLHVALRSARSRNLSLGSGAGGSSSSANPPCSDRGLKRNHSAIVPRRGSGSSLFRNRFKKQFPFKARIGKELFGGRVFNRVGSSSSSGQQGDHRQQAPKHDRPMK

SEQ ID NO: 2081 - DNA, 1404 bp, Sorghum bicolor
  misc_feature: Ceres ANNOT ID no. 6018452
  misc_feature: Encodes the peptide sequence at SEQ ID NO 2082
atggcgtccttcccgccgccgccgcacacgctacctcctaccccgacagcaccctacccggcaacacctccgcctctgcaccaccaccaccaccagcagcagcaggggcccgctccaccgggggcggcgacgcttctggtgaggcatctcccagaggcgatcacgcaggagatgctatcccgcctcttctcccactacggcgccacatccgtccgcccctgttccggtggaaagttgaggaattgtgcatttgtagattttagggatgaggcggcagccaatcacgcacattcgcttttgaacaggttgaggtttctggggaaagtgttgactgtcgagcgagctaaccgtccaaatgcaaatgattctcacctgaagcatcaggaccaattagtgcatggggtgtcccaggtaccaagtattagttcccaaaatcagaaggatcacacatcgactgctgaaccaattgcccccaagcttggtgtggactatccattccctccgcaccttgagtatgcatatccaccaccagatggaaacatattgacaaatattgtcaatgccctgattgccgtccctcgattctataatcaggtcctgcatttaatgaacaagatgaaccttcctgctccatttcggatggcattgcctactccacccctaccatcgcaactgcctgttacccctcatccacagccactaccgcaatctgctaccaccggggagcttcatacggctgatttgtctagtgatgagtctgagttagaatcatctgatgaagatattgataaacggaaaagcaaacgtgcaaagcatgaagcaattgttggtccggcagttgataaaaatgttgctcatgaagcagtgggggtgaaacctgctgcattggtttctaatgagcttcaagtgatcaaaaagaaaaacccagtacttcagataaaaattgcccctaagcctatgcagaaggaaccacctgtcccaagtataactgaaaatgaaccggattcaactcatgaacaacttcaagagaaacattttgtcacaccccaggaaatgttgagagagaaattaccaccagaggagattttatcccttcctatgttcaagaattacactccaggaaatcctgccagtgttttgtacattaagaacttggcaaaggatgtcactcatgatgacttctattatgtctttggttctgtattcgaaagcatggacagtgcaaggctgggtctaagtataaagttaatgcaggaaggacggatgcgtggtcaagcctttgtcacatttcccacggttgaacttgctcaacgtgccctgaatctagcgcatggctacgtgttcaaaggaaaaccaatgatcatacatttcggaagaaatcctgctgctaacaaagcttcctaa

SEQ ID NO: 2082 - protein, 467 aa, Sorghum bicolor
  misc_feature: Ceres ANNOT ID no. 6018452
  misc_feature (45)..(112): Pfam Id: RRM_1 Pfam Desc: RNA recognition motif. (a.k.a. RRM, RBD, or RNP domain)
  misc_feature (380)..(455): Pfam Id: RRM_1 Pfam Desc: RNA recognition motif. (a.k.a. RRM, RBD, or RNP domain)
  misc_feature (17)..(439): NCBI GI: 3249110 NCBI Desc: t12m4.6 [arabidopsis thaliana]
  misc_feature (20)..(278): NCBI GI: 31981077 NCBI Desc: riken cdna 2810441o16 [mus musculus]
  misc_feature (38)..(292): NCBI GI: 14017895 NCBI Desc: kiaa1839 protein [homo sapiens]
  misc_feature (44)..(278): NCBI GI: 62858877 NCBI Desc: loc548771 [xenopus tropicalis]
  misc_feature (70)..(278): NCBI GI: 50511129 NCBI Desc: mkiaa1839 protein [mus musculus]
  misc_feature: The sequence is a functional homolog of SEQ ID NO. 339 in the 11/188,298 US application
MASFPPPPHTLPPTPTAPYPATPPPLHHHHHQQQQGPAPPGAATLLVRHLPEAITQEMLSRLFSHYGATSVRPCSGGKLRNCAFVDFRDEAAANHAHSLLNRLRFLGKVLTVERANRPNANDSHLKHQDQLVHGVSQVPSISSQNQKDHTSTAEPIAPKLGVDYPFPPHLEYAYPPPDGNILTNIVNALIAVPRFYNQVLHLMNKMNLPAPFRMALPTPPLPSQLPVTPHPQPLPQSATTGELHTADLSSDESELESSDEDIDKRKSKRAKHEAIVGPAVDKNVAHEAVGVKPAALVSNELQVIKKKNPVLQIKIAPKPMQKEPPVPSITENEPDSTHEQLQEKHFVTPQEMLREKLPPEEILSLPMFKNYTPGNPASVLYIKNLAKDVTHDDFYYVFGSVFESMDSARLGLSIKLMQEGRMRGQAFVTFPTVELAQRALNLAHGYVFKGKPMIIHFGRNPAANKAS

SEQ ID NO: 2083 - DNA, 1098 bp, Sorghum bicolor
  misc_feature: Ceres ANNOT ID no. 6018457
  misc_feature: Encodes the peptide sequence at SEQ ID NO 2084
atgttcggcttcgggcaccacggccaccaccacggcgagaacccgccggcgcaccctcctgcccacggcggcgtgcacccgcccaccttcaagatcttctgcaaggccgacgaggggtactgcctcaccgtccgcgacggcaacgtggtgctggccccctccaacccgcgcgacgagcaccagcactggtacaaggacatgcgcttcagcaaccagatcaaggacgaggaaggcaaccctgcgttcgccctcgtcaacaaggccactggcctcgccatcaagcactccctcggccagtcccacccggtgaagctggtgccgttcaacccggagtaccaggacgagtcggtgctgtggacggagagcggcgacgttggcaagggcttccgctgcatccgcatggtgaacaacatccggctcaacttcgacgccttccacggcgacaaggaccacggcggcgtgcacgacggcaccaccgtggtgctgtgggagtgggccaagggcgacaaccagagctggaagatcctcccctggggcgacgaggcctacgccggcggcagcggcggcgccgccgccaacgcgccgtacggccacggcgagccgacggtccgcatctactgcaaggcggacgacgggttcagcgtgaccgtccgcaacggcagcgtgtgcctggcgccgacgaacccgcgcgacgagtaccagcactgggtcaaggacatgcggcacagcaaccgcatcaaggacgaggaagggtacccggcgttcgcgctcgtgaacagggtcaccggcgaggccatcaagcactcgcagggcgagggccacccggtgaagctggtgccgtacaacccaaactaccaggacgagtcggtgctgtggaccgagagccgcgacgtcggccacgggttccgctgcatccgcatggtgaacaacatctacctcaacttcgacgccttccacggcgacaaggaccacggcggggtgcgcgacggcaccgccgtcgtgctctggaagtggtgcgagggcgacaaccagcgctggaagatcgtcccctggtattttattattataattagatggtatccaaacacggctaagtag

SEQ ID NO: 2084 - protein, 365 aa, Sorghum bicolor
  misc_feature: Ceres ANNOT ID no. 6018457
  misc_feature (1)..(351): NCBI GI: 1296955 NCBI Desc: osr40c1 [oryza sativa]
  misc_feature (1)..(351): NCBI GI: 34394517 NCBI Desc: r40g2 protein [oryza sativa (japonica cultivar-group)]
  misc_feature (1)..(351): NCBI GI: 1658313 NCBI Desc: osr40g2 [oryza sativa (indica cultivar-group)]
  misc_feature (200)..(350): NCBI GI: 115474135 NCBI Desc: os07g0683600 [oryza sativa (japonica cultivar-group)]
  misc_feature (200)..(352): NCBI GI: 1658315 NCBI Desc: osr40g3 [oryza sativa (indica cultivar-group)]
MFGFGHHGHHHGENPPAHPPAHGGVHPPTFKIFCKADEGYCLTVRDGNVVLAPSNPRDEHQHWYKDMRFSNQIKDEEGNPAFALVNKATGLAIKHSLGQSHPVKLVPFNPEYQDESVLWTESGDVGKGFRCIRMVNNIRLNFDAFHGDKDHGGVHDGTTVVLWEWAKGDNQSWKILPWGDEAYAGGSGGAAANAPYGHGEPTVRIYCKADDGFSVTVRNGSVCLAPTNPRDEYQHWVKDMRHSNRIKDEEGYPAFALVNRVTGEAIKHSQGEGHPVKLVPYNPNYQDESVLWTESRDVGHGFRCIRMVNNIYLNFDAFHGDKDHGGVRDGTAVVLWKWCEGDNQRWKIVPWYFIIIIRWYPNTAK

SEQ ID NO: 2085 - DNA, 1863 bp, Sorghum bicolor
  misc_feature: Ceres ANNOT ID no. 6018477
  misc_feature: Encodes the peptide sequence at SEQ ID NO 2086
atgagcatgtacgggagggacccgtggggcgggccgctggagatatgccacccggactcggccacggacgacgaccgcagccggaacctggacatcgaccggggcgcgatgtcgcggacgctcgacgagacgcagcagagctggctgctggcggggcccggggaccaggcccgcaagaagaagaagtacgtcgacatcggctgcctcgtcgtcagccgcaagctcttcgtctggacgctcggggtgctcctcgccgctgccgtcttcgcgggggtcgtcgccgggatcgccaaggccatccccaggcgccaccgcccgccgccgccacccgacgactacaccgtcgcgctgcacaaggcgctcatgttcttcaatgcccagagatctgggaagcttccgaagcacaacaatataccatggcgaggtaactcttgcatgaaggacggactttctgaccctgcagtcaggcgaagcctggtcggcgggtattatgatgctggcggcgctgtcaagttcaatttcccagctgccttctcaatgaccctcctcagctggagtgttattgagtacagtgctaagtacgatgctgttggggaacttggccatgtccgtgacattatcaagtgggggtcagactacttcttgaagacctttaattccacagccgatagcattgatcgtgtcattgcacaggtgggaagtgctgcaatgtcacctggttcgacgcagcccaatgatcaatattgttggatgagaccagaggacatcgactacccacggccagtggttgagtgccacgcttgttcagatcttgctgctgaaatggctgcagcattagctgcagcatctattgtattcaaggacaataaggcttactcacagaagcttgtacatggtgctaccactctcttccagtttgcaagggagcggcgtgggaggtatagtgcaggtggctcagatgctacaaagttctacaattcaaccagttactgggatgagtttgtgtggggtagttcatggatgtaccttgcaactggcaattcatcatacttgactctagccacacaccctaaacttgcaaagcatgctggcgctttctggggtggaccagattatggtgtgttcagctgggataataagctcactggtgcacaggttcttctaagccggttgaggcttttcttgagtcctggatatccatatgaagagatgttgagggcattccacaaccaaactagcattatcatgtgttcctaccttccaatctttaaatctttcaacagaacaagaggtggtttgattcagttaaatcacgggaagccacaaccccttcagtatgtggtcaatgctgcattccttgcttctgtgttcagtgattatcttgaggctgcggatactcctgggtggtactgtggcccccatttctactctattgaggttcttcgcagttttgcaaggactcagattgaatacatcttaggaaagaatcctttgaagatgagctatgtggttgggtttggaaaccattaccccaagcatgttcaccaccggggcgcctcaatccctaagaatggtgttcactatggttgcaaaggagggtggaagtggagggacaccaagaagccaaaccctaatatcatagtaggggccatggttgctggccctgatcgccatgacaggttcaaagatgcccgcaagaattataactacactgaagcaacactggtaggcaatgctggtctagtcgcagcattggtagctttgtctggtgaaggccacggggtggacaagaatgctatgttctctgcagtaccgcccatgttcccttcccctccgccgccaccggccccatggaaaccataa

SEQ ID NO: 2086 - protein, 620 aa, Sorghum bicolor
  misc_feature: Ceres ANNOT ID no. 6018477
  misc_feature (112)..(586): Pfam Id: Glyco_hydro_9 Pfam Desc: Glycosyl hydrolase family 9
  misc_feature (1)..(620): NCBI GI: 114149315 NCBI Desc: endoglucanase 9 (endo-1,4-beta glucanase 9) (osglu1)
  misc_feature (1)..(620): NCBI GI: 118421056 NCBI Desc: endo-beta-1,4-d-glucanase [oryza sativa]
  misc_feature (3)..(620): NCBI GI: 33324614 NCBI Desc: endo-1,4-beta-glucanase [gossypium hirsutum]
  misc_feature (3)..(620): NCBI GI: 32454474 NCBI Desc: endo-1,4-beta-glucanase [gossypium hirsutum]
  misc_feature (3)..(620): NCBI GI: 46318067 NCBI Desc: membrane-anchored endo-1,4-beta-glucanase [gossypium hirsutum]
  misc_feature (1)..(620): SWISSPROT Homolog: EC 3.2.1.4 Endoglucanase 9
  misc_feature: Useful for making plants with altered cell wall content and/or composition
  misc_feature: Functional homolog of the protein sequence encoded by LOCUS at4g24260
  misc_feature: GREAT-hit functional homolog of the protein sequence encoded by LOCUS at5g49720
  misc_feature: Useful for making plants with altered cell wall content and/or composition
  misc_feature: Functional homolog of the protein sequence given in SEQ ID NO 13773
  misc_feature: Useful for making plants with altered carbohydrate content
  misc_feature: Functional homolog of the protein sequence given in SEQ ID NO 13774
MSMYGRDPWGGPLEICHPDSATDDDRSRNLDIDRGAMSRTLDETQQSWLLAGPGDQARKKKKYVDIGCLVVSRKLFVWTLGVLLAAAVFAGVVAGIAKAIPRRHRPPPPPDDYTVALHKALMFFNAQRSGKLPKHNNIPWRGNSCMKDGLSDPAVRRSLVGGYYDAGGAVKFNFPAAFSMTLLSWSVIEYSAKYDAVGELGHVRDIIKWGSDYFLKTFNSTADSIDRVIAQVGSAAMSPGSTQPNDQYCWMRPEDIDYPRPVVECHACSDLAAEMAAALAAASIVFKDNKAYSQKLVHGATTLFQFARERRGRYSAGGSDATKFYNSTSYWDEFVWGSSWMYLATGNSSYLTLATHPKLAKHAGAFWGGPDYGVFSWDNKLTGAQVLLSRLRLFLSPGYPYEEMLRAFHNQTSIIMCSYLPIFKSFNRTRGGLIQLNHGKPQPLQYVVNAAFLASVFSDYLEAADTPGWYCGPHFYSIEVLRSFARTQIEYILGKNPLKMSYVVGFGNHYPKHVHHRGASIPKNGVHYGCKGGWKWRDTKKPNPNIIVGAMVAGPDRHDRFKDARKNYNYTEATLVGNAGLVAALVALSGEGHGVDKNAMFSAVPPMFPSPPPPPAPWKP

SEQ ID NO: 2087 - DNA, 1560 bp, Sorghum bicolor
  misc_feature: Ceres ANNOT ID no. 6018479
  misc_feature: Encodes the peptide sequence at SEQ ID NO 2088
atggcgaagccgaggaaaccccgcaccttggctccagatccgtccgtcgccgccgctcggcttccgtggcacccaccggcaccgccggtccccactgccgttctgatctcgctggccgcgctcctcgtccgcgtgctggtctccgtgggcccctactccggtcagggtgcggcgcccaagttcggcgactacgaggcgcagcggcactggatggagctcaccctccacctcacgccctccgactggtaccgcaacacctccgacaatgaccttgcctactggggtctggactacccgcccctctccgcctaccagagcctcctccacggccgcatcatcaatgcctcactccccgaggccgtcgcgctccgctcctcccgtggctacgaatctatggaatcgaagttgctgatgcggtggacggtgctgtcgtcggatctgttggtgttcttccctgctgctttgtggttcgtgtgggcttacatgaaagttggaatcggtattagtggggaggagagaagggaggggtggatgtggctgctagccatggtcctgatcagtccttgcttggtattgatcgaccatggccattttcagtataactgcattagccttggacttacgcttggagcaactgctggtgtgctgtcgaggaatgagcttgttgctgcagctctcttcactcttgcaatcaatcacaaacagatgagcctgtactttgcaccagctttttttagccatcttctggggaagtgcctcaaacgaaaacatcctattgtcgaagtaacaaaacttgctttcgtggtcttgggaacttttgctcttgtctggtggccatttttgcattcttatgaggctgccctacaggtgatctctcgattagctccatttgagagaggcatatatgaggattatgttgcaaatttctggtgtagtacttcagttattatcaagtggaagaaattgtttgcgataaagcctctgaaacttatgagtctctctgctaccatactggctttcttgccttcattcgttcagcaagtcaagtctccaagtaatcttggcttcctttattctctgatgaacagctctttctctttctatttattctcgtaccaagttcatgagaaatcaattttgcttcctcttttacctgctagtcttttagcactggaagaacctcggatgtatggatggtttgtgtactttgcccttttctcaatgtaccctcttatctgccgtgatcaacttcttctacagtatatagctgttcttggcctattctttcttatacactattcacctggtggaagctatggaaagagatcaaacatgtcatgcagggcaaaattagttcttagcttgccatttttatgctcacttctacttcacattacctacctgcaaatagagcctcccaataggtatcccttcctctttgatgcactgataatgttcgtctgtttttcacaatttgtcatcttagctctgtacaccaattataagcaatggatgttggacacacattctagatcaataggtgtgaagaaggatctgtga

SEQ ID NO: 2088 - protein, 519 aa, Sorghum bicolor
  misc_feature: Ceres ANNOT ID no. 6018479
  misc_feature (38)..(502): Pfam Id: Alg6_Alg8 Pfam Desc: ALG6, ALG8 glycosyltransferase family
  misc_feature (1)..(473): NCBI GI: 115470723 NCBI Desc: os07g0164500 [oryza sativa (japonica cultivar-group)]
  misc_feature (30)..(444): NCBI GI: 60467513 NCBI Desc: glycosyltransferase [dictyostelium discoideum]
  misc_feature (41)..(504): NCBI GI: 19921070 NCBI Desc: cg5091-pa [drosophila melanogaster]
  misc_feature (33)..(430): NCBI GI: 50418385 NCBI Desc: alg6-prov protein [xenopus laevis]
  misc_feature (35)..(450): NCBI GI: 38026892 NCBI Desc: dolichyl-p-glc:man9glcnac2-pp-dolichylglucosyltransferase [homo sapiens]
MAKPRKPRTLAPDPSVAAARLPWHPPAPPVPTAVLISLAALLVRVLVSVGPYSGQGAAPKFGDYEAQRHWMELTLHLTPSDWYRNTSDNDLAYWGLDYPPLSAYQSLLHGRIINASLPEAVALRSSRGYESMESKLLMRWTVLSSDLLVFFPAALWFVWAYMKVGIGISGEERREGWMWLLAMVLISPCLVLIDHGHFQYNCISLGLTLGATAGVLSRNELVAAALFTLAINHKQMSLYFAPAFFSHLLGKCLKRKHPIVEVTKLAFVVLGTFALVWWPFLHSYEAALQVISRLAPFERGIYEDYVANFWCSTSVIIKWKKLFAIKPLKLMSLSATILAFLPSFVQQVKSPSNLGFLYSLMNSSFSFYLFSYQVHEKSILLPLLPASLLALEEPRMYGWFVYFALFSMYPLICRDQLLLQYIAVLGLFFLIHYSPGGSYGKRSNMSCRAKLVLSLPFLCSLLLHITYLQIEPPNRYPFLFDALIMFVCFSQFVILALYTNYKQWMLDTHSRSIGVKKDL

SEQ ID NO: 2089 - DNA, 1299 bp, Sorghum bicolor
  misc_feature: Ceres ANNOT ID no. 6018481
  misc_feature: Encodes the peptide sequence at SEQ ID NO 2090
atgtcatcctctttgcctattctgccaaatcctttgaaagggagcttcccaaagccttgtaacccccagcatattcctatgtcgaggcagctgcctgatgactctatgcccttgcgtaatgacatacatcagtctgctagtttgcacccaagagctggtgttatcggggcaccatattcaggctactctgctagtccacttgattctgtgtctaaccatgatagccagtcaatggttgcaccctatatttctcagtcatccagttttgagtctttccagtctctatctgatactaccccaggaacacacactgaggcagcctggttcacatcttctatggatgtttcaccactctacacagataatattgctgctcctgatgataatcaaatccagagtatacgtcctgctatgacatctgatgagactgctaaacaaaatgattggtgggcagatataatgaatgatgattggaaagttattctagacgcaacagctactgattcacactcaaaagccatgattcaaacttccaactcagctacatcactacctgcagtaaaccagtcagcttcatctcatagtatggagatttgcccagttgctagtcctcccaatagcagcaatgcttcagttgctaaacaacggatgagatggaccccagaactccatgaatgttttgtagatgctgtaaatcagcttggcggtagcgaaaaagctactcccaagggcgtgctaaagcttatgaaagttgatggtttgactatatatcatgtcaaaagccacctgcagaagtaccgcacagctcgctataaaccagacctgtctgaaggtgcatcggaaaaaaggacagccactgaagagctagtcctggacctgaaaacgagcatggatcttactgaagcgctgcgccttcagatggaagtccagaagcgtcttcatgaacagcttgagattcagagaaaattgcagttgcggattgaagagcaaggaaagtatctgcagatgatgtttgaaaagcagagtcaatcaagcacggataaagtccaggatccatcctcaagggatacagtggcaaaaccatcatctaccctgagccaatcttcaaacaaggatagtggtgcaaccatggatccaaatggaacaggagacagcacgaagactgcaaaactgggagaacgatcgtctggatcaggtgtcaaccagaaacttgtagagatcgaatctgatactgaaggaggtacagacgatggatgtaagatctcccaagagaagcggcacaaactgcaagatagttaa

SEQ ID NO: 2090 - protein, 432 aa, Sorghum bicolor
  misc_feature: Ceres ANNOT ID no. 6018481
  misc_feature (216)..(267): Pfam Id: Myb_DNA-binding Pfam Desc: Myb-like DNA-binding domain
  misc_feature (152)..(394): NCBI GI: 4519671 NCBI Desc: transfactor [nicotiana tabacum]
  misc_feature (1)..(405): NCBI GI: 145338102 NCBI Desc: transcription factor [arabidopsis thaliana]
  misc_feature (1)..(432): NCBI GI: 6942190 NCBI Desc: cdpk substrate protein 1; csp1 [mesembryanthemum crystallinum]
  misc_feature (27)..(399): NCBI GI: 140049104 NCBI Desc: homeodomain-related [medicago truncatula]
  misc_feature (139)..(394): NCBI GI: 30692105 NCBI Desc: myb family transcription factor [arabidopsis thaliana]
  misc_feature: The sequence is a functional homolog of SEQ ID NO 1233 in the 10/666,642US patent application
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1781 in the 11/479,226US patent application
  misc_feature: The sequence is a functional homolog of SEQ ID NO 1857 in the 10/374,780US patent application
  misc_feature: The sequence is a functional homolog of SEQ ID NO 1990 in the 11/479,226US patent application
  misc_feature: The sequence is a functional homolog of SEQ ID NO 1999 in the 11/479,226US patent application
  misc_feature: The sequence is a functional homolog of SEQ ID NO 2000 in the 11/479,226US patent application
  misc_feature: The sequence is a functional homolog of SEQ ID NO 270 in the 10/374,780US patent application
  misc_feature: The sequence is a functional homolog of SEQ ID NO 384 in the 10/374,780US patent application
  misc_feature: The sequence is a functional homolog of SEQ ID NO 4 in the 10/225,066US patent application
  misc_feature: The sequence is a functional homolog of SEQ ID NO 426 in the 10/225,066US patent application
  misc_feature: The sequence is a functional homolog of SEQ ID NO 440 in the 10/666,642US patent application
  misc_feature: The sequence is a functional homolog of SEQ ID NO 933 in the 10/666,642US patent application
  misc_feature: Useful for making plants with altered Lignin content
  misc_feature: Useful for making plants with modulated growth and phenotype characteristics
  misc_feature: Functional homolog of the protein sequence given in SEQ ID NO 13011
  misc_feature: The sequence is a functional homolog of SEQ ID NO 4 in the 20050160493 US patent application
  misc_feature: The sequence is a functional homolog of SEQ ID NO 426 in the 20050160493 US patent application
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 1990 in the 20070022495 US patent application
  misc_feature: The sequence is a functional homolog of SEQ ID NO 1999 in the 20070022495 US patent application
  misc_feature: The sequence is a functional homolog of SEQ ID NO 2000 in the 20070022495 US patent application
  misc_feature: The sequence is a functional homolog of SEQ ID NO 1233 in the 20070033671 US patent application
  misc_feature: The sequence is a functional homolog of SEQ ID NO 440 in the 20070033671 US patent application
  misc_feature: The sequence is a functional homolog of SEQ ID NO 933 in the 20070033671 US patent application
  misc_feature: The sequence is a functional homolog of SEQ ID NO 1857 in the 10/374,780 US patent application
  misc_feature: Useful for making plants with altered lignin content
  misc_feature: Useful for making plants with altered terpenoid content
  misc_feature: Functional homolog of the protein sequence given in SEQ ID NO 12902
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
MSSSLPILPNPLKGSFPKPCNPQHIPMSRQLPDDSMPLRNDIHQSASLHPRAGVIGAPYSGYSASPLDSVSNHDSQSMVAPYISQSSSFESFQSLSDTTPGTHTEAAWFTSSMDVSPLYTDNIAAPDDNQIQSIRPAMTSDETAKQNDWWADIMNDDWKVILDATATDSHSKAMIQTSNSATSLPAVNQSASSHSMEICPVASPPNSSNASVAKQRMRWTPELHECFVDAVNQLGGSEKATPKGVLKLMKVDGLTIYHVKSHLQKYRTARYKPDLSEGASEKRTATEELVLDLKTSMDLTEALRLQMEVQKRLHEQLEIQRKLQLRIEEQGKYLQMMFEKQSQSSTDKVQDPSSRDTVAKPSSTLSQSSNKDSGATMDPNGTGDSTKTAKLGERSSGSGVNQKLVEIESDTEGGTDDGCKISQEKRHKLQDS

SEQ ID NO: 2091 - DNA, 1887 bp, Sorghum bicolor
  misc_feature: Ceres ANNOT ID no. 6018482
  misc_feature: Encodes the peptide sequence at SEQ ID NO 2092
atgaaggcgacggcgccgccggcaaagcggcggaggggcccgcggctggcggtgctggcgctcgtgttctgttcgctgctcgtgccgatcgccttcctcttcaaccgcttccccgccgtgtatgtgacggatgagcgccctcagcaggagatcgacttgccttcttctcgcaaagcgtttgaaagtggtggctctgtaaatgaagatgtgtccaagaagactcccgggagcagtagtgtgtcgcaccgtaatattgatagtgacccttccatagatagctctaagccaaaagctatagttctcccgcctccaaaaattgaacaagtagtcctcccccctccaaaagttgaacccaaaccagaagtgaagccagtaccagttccagttcatcaaaacccaaaaattaaccctgagaagattaaaaggcctcccagagttcaaagtgctgatgaggtggaaaaggctaaggcttgtcaacttgagtttgggagttactgtctctggtccatagagcacaaagaagttatgatagataccattgtgaaaaggctgaaagatcagctatttgtagcccgatcttactacccaagcattgcgaagcttaaaggaaaggagacattgactcgtgaactgaagcaaaatattcaagagcatgagagggttcttagtgaatccatcgtggatgctgatctaccatcctttataaaaatgaagatagagaggatggaccaatcaatagcaagagccaaatcatgcactgtggattgtaacaatgttgacagaaagcttcgtcaaattcttcatatgacagaggatgaagctcattttcatatgaagcagagtgcatacctatacaaccttggtgttcacaccatgcctaaaagtcatcattgtcttaatatgaggttgacagtagagtactttaaatccatgccattggatccaaatgactcttctgcccataagtttaacattccagacaataggcactatgttatattgtcaaaaaatgtccttgctgcttctgttgtcatcaactcaactgttagtagctctgaggatactgaaaatgtagtctttcatgtactaactgatgctcaaaatttttatgccatgaagcactggtttgcaagaaactcctacagggaatcagctgtcaatgtcataaattatgaacaaattattttcgagaattttcctgagtttggaacccaacagttatatttgcctgaggaatttcgtgttttcatcagtagcctggagcggcctactgagaagagtagaatggagtatttatcagtgttcagtcactcacatttctttcttgctgaaatattcaaagatttaaagaaggtaattgtgttggatgatgatgtggttgttcaacgtgatatttctttcttgtggaatcttgatatgggagataaggtcaatggtgctgtcagattttgtggtttgaaacttggccaactgaagaaccttctgggtaggacaatgtacgatcaacagtcatgtgcatggatgtctggggttaatgtgattgatttggacaaatggagagatcataatgttacagagaattacctgcaactcctgagaaagtttgggaacaatgatgacgaggcctctttgcgagcttccgctttgcctataagtttgttgtcgtttcagcatcttctatatccacttgatgagagattgactttatctggacttggatatgactatggaattaaagaagaagttgctcagagttctgcttcattgcattacaatggaaatatgaaaccttggcttgaattgggtataccagattataggaagtactggaagaggtttcttacacgagatgagagattcatggatgagtgcaatgtaagtccatag

SEQ ID NO: 2092 - protein, 628 aa, Sorghum bicolor
  misc_feature: Ceres ANNOT ID no. 6018482
  misc_feature (298)..(602): Pfam Id: Glyco_transf_8 Pfam Desc: Glycosyl transferase family 8
  misc_feature (7)..(627): NCBI GI: 124360299 NCBI Desc: glycosyl transferase, family 8 [medicago truncatula]
  misc_feature (169)..(628): NCBI GI: 86439693 NCBI Desc: glycosyl transferase-like protein [triticum aestivum]
  misc_feature (171)..(628): NCBI GI: 124360882 NCBI Desc: glycosyl transferase, family 8 [medicago truncatula]
  misc_feature (152)..(627): NCBI GI: 52077221 NCBI Desc: glycosyl transferase family 8 protein-like [oryza sativa (japonica cultivar-group)]
  misc_feature (169)..(628): NCBI GI: 86438644 NCBI Desc: glycosyl transferase-like protein [brachypodium sylvaticum]
  misc_feature: Useful for making plants with altered cell wall content and/or composition
  misc_feature: Functional homolog of the protein sequence encoded by LOCUS at2g38650
  misc_feature: Useful for making plants with altered carbohydrate content
  misc_feature: Functional homolog of the protein sequence given in SEQ ID NO 13776
  misc_feature: Useful for making plants with altered cell wall content and/or composition
  misc_feature: Functional homolog of the protein sequence given in SEQ ID NO 13608
MKATAPPAKRRRGPRLAVLALVFCSLLVPIAFLFNRFPAVYVTDERPQQEIDLPSSRKAFESGGSVNEDVSKKTPGSSSVSHRNIDSDPSIDSSKPKAIVLPPPKIEQVVLPPPKVEPKPEVKPVPVPVHQNPKINPEKIKRPPRVQSADEVEKAKACQLEFGSYCLWSIEHKEVMIDTIVKRLKDQLFVARSYYPSIAKLKGKETLTRELKQNIQEHERVLSESIVDADLPSFIKMKIERMDQSIARAKSCTVDCNNVDRKLRQILHMTEDEAHFHMKQSAYLYNLGVHTMPKSHHCLNMRLTVEYFKSMPLDPNDSSAHKFNIPDNRHYVILSKNVLAASVVINSTVSSSEDTENVVFHVLTDAQNFYAMKHWFARNSYRESAVNVINYEQIIFENFPEFGTQQLYLPEEFRVFISSLERPTEKSRMEYLSVFSHSHFFLAEIFKDLKKVIVLDDDVVVQRDISFLWNLDMGDKVNGAVRFCGLKLGQLKNLLGRTMYDQQSCAWMSGVNVIDLDKWRDHNVTENYLQLLRKFGNNDDEASLRASALPISLLSFQHLLYPLDERLTLSGLGYDYGIKEEVAQSSASLHYNGNMKPWLELGIPDYRKYWKRFLTRDERFMDECNVSP

SEQ ID NO: 2093 - DNA, 2214 bp, Sorghum bicolor
  misc_feature: Ceres ANNOT ID no. 6018494
  misc_feature: Encodes the peptide sequence at SEQ ID NO 2094
atgcggccttgttcccgcatactcgcggcgggccaccttctccgcggctcccggttcgatccctcccagactacctccgccgctgccggatttcggcggctgaacggagccaacaggccgtgcgtgccgaaacctctctttagcactctcctcggaggcttcggatcgaactgtggcgtacagcgcgggaaaggggtccccttcggcagcctcggcagcttcctgccggactctgcctacccgctgcacggcgcgcggcttcaacgagatacgagaggtaatgcattctccacatccgccaatgccgtgacagttaagaagccggttgatgacaaggtccagaaagatgcatcaaaaaaggatgttgatgaggagattgctgattctcagatattgaaaaaccttgggaagtacttattgttgaacgacagccctgacttccgctttagggttgccttgtcattgggcctattagttggtgcaaaggttataaatgttcaagtgcctttcttgtttaagctagctatcgactggcttgcagcccttggtggtgctgaagcttcactggcatcattcactgaaactaatgccaccctattggctctctttgcaagcccagcagctgttctgataggatatggaatcgcacgatcaggagtatcagcctgtacagaactacgaaacgctgtattttctaaagtgactttgagagccatccgttcagtatccagaaaggtattttctcacttgcatgagcttgatcttcgttatcatctaagccggcaaaccggtgctataaatcgcgtaattgatcgaggaagccgtgcaataaattacattctcacagtcatggtgtttaatgttgtgcccacaatactagagattggtatggtgtcaagcatacttgcctacaagtttggttcaacttttgcttggattacttcagcttcagttgctacttatattgctttcactttggctgtcacacagtggcggactaagttcaggatggccatgaataaagctgataatgcttctagtacggtggcagttgactctcttctgaattatgagactgtgaaatacttcaacaacgaacaatttgaagttgagaagtatgacaaatatttaaggaaatatgaggatgctgcattgaagacccaaagtagtcttgcctacctgaactttggccaaaacgttatctttagctcggctttatctgcagcaatggttttgagctcatatggaatcatgagtggtgctctgagtgtgggtgatttggtcatggttaatggacttctattccagctttcattgcctctgaacttccttgggagtgtgtatcgagaatctagacaaagcctcattgacatgaagtcgctgtttcagttgcttgaggaaaaacctggaataaaggatgagcctcatgcacaacctttgcagttcaagggagggtgcattgaattcgagaatgttcattttgggtatgtaccagaaaggaagattcttgatggtgccactttcactgtaccttcaggaaagagtgtggcaattgttggatctagtggaagcgggaaatcaactattcttagacttctgttcagattctttgattcgacttcaggatctatacgaattgatgggcaagatatccgaggagtgacactggaaagccttcgaaaatgtctaggtgttgtacctcaggacacagtactttttaatgacacaattaagcataatatacagtatgggcggttatcagccaaagatgaggaggtctatgatgctgcccgacgtgctgctattcacgatacaattatgaacttcccagacaagtacgacacagtagtaggagaacgaggcttgaagctaagtggcggggagaaacaacgtgtgtcaatagcccgtgtattcttgaaggagccctccattctattatgtgatgaagcaactagtgctcttgacagcactactgaagcatcaattttgaattctctgaaatccttatctgttgatcgaacatcaatctttattgctcatcgactcacaactgcaatgcagtgtgatcagataattgttttggagaatgggaaggtagtagaagaaggaccacatgattttcttctgtcaaaggggggccgatacgcagaattgtggtatcagcagaacagcagtgacgccagtgattctgctgcagttagcctagaggtttga

SEQ ID NO: 2094 - protein, 737 aa, Sorghum bicolor
  misc_feature: Ceres ANNOT ID no. 6018494
  misc_feature (513)..(697): Pfam Id: ABC_tran Pfam Desc: ABC transporter
  misc_feature (151)..(441): Pfam Id: ABC_membrane Pfam Desc: ABC transporter transmembrane region
  misc_feature (87)..(736): NCBI GI: 9187883 NCBI Desc: mitochondrial half-abc transporter [arabidopsis thaliana]
  misc_feature (87)..(725): NCBI GI: 31711744 NCBI Desc: at4g28630 [arabidopsis thaliana]
  misc_feature (87)..(725): NCBI GI: 7269718 NCBI Desc: abc transporter-like protein [arabidopsis thaliana]
  misc_feature (127)..(724): NCBI GI: 7269717 NCBI Desc: abc transporter-like protein [arabidopsis thaliana]
  misc_feature (120)..(724): NCBI GI: 60653207 NCBI Desc: atp-binding cassette sub-family b member 7 [synthetic construct]
MRPCSRILAAGHLLRGSRFDPSQTTSAAAGFRRLNGANRPCVPKPLFSTLLGGFGSNCGVQRGKGVPFGSLGSFLPDSAYPLHGARLQRDTRGNAFSTSANAVTVKKPVDDKVQKDASKKDVDEEIADSQILKNLGKYLLLNDSPDFRFRVALSLGLLVGAKVINVQVPFLFKLAIDWLAALGGAEASLASFTETNATLLALFASPAAVLIGYGIARSGVSACTELRNAVFSKVTLRAIRSVSRKVFSHLHELDLRYHLSRQTGAINRVIDRGSRAINYILTVMVFNVVPTILEIGMVSSILAYKFGSTFAWITSASVATYIAFTLAVTQWRTKFRMAMNKADNASSTVAVDSLLNYETVKYFNNEQFEVEKYDKYLRKYEDAALKTQSSLAYLNFGQNVIFSSALSAAMVLSSYGIMSGALSVGDLVMVNGLLFQLSLPLNFLGSVYRESRQSLIDMKSLFQLLEEKPGIKDEPHAQPLQFKGGCIEFENVHFGYVPERKILDGATFTVPSGKSVAIVGSSGSGKSTILRLLFRFFDSTSGSIRIDGQDIRGVTLESLRKCLGVVPQDTVLFNDTIKHNIQYGRLSAKDEEVYDAARRAAIHDTIMNFPDKYDTVVGERGLKLSGGEKQRVSIARVFLKEPSILLCDEATSALDSTTEASILNSLKSLSVDRTSIFIAHRLTTAMQCDQIIVLENGKVVEEGPHDFLLSKGGRYAELWYQQNSSDASDSAAVSLEV

SEQ ID NO: 2095 - DNA, 777 bp, Sorghum bicolor
  misc_feature: Ceres ANNOT ID no. 6018499
  misc_feature: Encodes the peptide sequence at SEQ ID NO 2096
atgaagatcattccggtcccctgcctggaggataactatgcctacctaatcgtggatgagagcaccaagaaggcggcggccgttgaccctgtggaaccggagaaggttatcaaggcggccggcgaggtcggcgcctacgtcgactgcgttctcaccacccatcaccactgggatcatgctggtggcaatgagaagatgagactgcaggtgccagggataaagatctttggaggatcactggacaatgtgaaaggatgcactgatcaggtggagaatggaacgaagttgtcacttgggaaggacattgagatactatgcctacacacgccttgccacactaaaggtcatattagctactatgttactagtaaggagggggaagatccagcggtcttcactggagataccttgttcattgctggctgtggcaagttttttgagggtactgcagagcaaatgtatcagtctcttattgttacactgggttctctgccaaagtcaactcgagtttactgtgggcatgagtacactgtgaagaacctaaaattcatactgacagtcgagccagagaatgagaagacaaaacagaagctggaatgggctgaaaagcagcgccaagcgaatcagccaacagtgccctcgactataggagatgagtttgagataaatacattcatgcgtgttgatctaccagagatacaggcgaaattcggtgccaactctccagttgaagcactgagagaggtcaggaagaccaaggataactggaaaggttga

SEQ ID NO: 2096 - protein, 258 aa, Sorghum bicolor
  misc_feature: Ceres ANNOT ID no. 6018499
  misc_feature (11)..(174): Pfam Id: Lactamase_B Pfam Desc: Metallo-beta-lactamase superfamily
  misc_feature (1)..(258): NCBI GI: 78191468 NCBI Desc: hydroxyacylglutathione hydrolase cytoplasmic-like [solanum tuberosum]
  misc_feature (1)..(258): NCBI GI: 6630545 NCBI Desc: hydroxyacylglutathione hydrolase cytoplasmic (glyoxalase ii) (glx ii) [arabidopsis thaliana]
  misc_feature (1)..(258): NCBI GI: 2570342 NCBI Desc: glyoxalase ii cytoplasmic isozyme [arabidopsis thaliana]
  misc_feature (1)..(257): NCBI GI: 37681823 NCBI Desc: hydroxyacyl glutathione hydrolase [danio rerio]
  misc_feature (1)..(171): NCBI GI: 71534880 NCBI Desc: hydroxyacylglutathione hydrolase [medicago sativa]
  misc_feature (1)..(258): SWISSPROT Homolog: EC 3.1.2.6 Hydroxyacylglutathione hydrolase cytoplasmic
  misc_feature: The plant is abnormally small.
  misc_feature: Useful for making plants with modulated biomass
  misc_feature: GREAT-hit functional homolog of the protein sequence given in SEQ ID NO 12939
  misc_feature: Useful for making plants with modulated biomass
  misc_feature: Functional homolog of the protein sequence given in SEQ ID NO 12939
MKIIPVPCLEDNYAYLIVDESTKKAAAVDPVEPEKVIKAAGEVGAYVDCVLTTHHHWDHAGGNEKMRLQVPGIKIFGGSLDNVKGCTDQVENGTKLSLGKDIEILCLHTPCHTKGHISYYVTSKEGEDPAVFTGDTLFIAGCGKFFEGTAEQMYQSLIVTLGSLPKSTRVYCGHEYTVKNLKFILTVEPENEKTKQKLEWAEKQRQANQPTVPSTIGDEFEINTFMRVDLPEIQAKFGANSPVEALREVRKTKDNWKG

SEQ ID NO: 2097 - DNA, 3498 bp, Sorghum bicolor
  misc_feature: Ceres ANNOT ID no. 6018507
  misc_feature: Encodes the peptide sequence at SEQ ID NO 2098
atggctccggcggacggcggcggcgagcaggcgcacaaggcgcaccgccaacacaagtctggcgccaaggcgcggaagaagaagggcaagggcaagggcgacggcggcgatgacgccgggggccagcagaagaaccctaaggcttttgcatttcagtcagcagcgaaggccaagcgtctgcaagctcgatcagctgagattgaacaacggcgtctccatgtcccaattatggaccgttccattggtgaacctcctccttttgttgttgtagttcaaggacctccacaggttgggaagtcactattgataaaatgtctggtaaaacactacaccaaacaaaacttaccagaagttcgtggtcccatcactgttgtatcaggcaaaagcaggagggtacagttcgtggagtgtccaaatgatatcaatggaatgattgatgctgctaaaatagctgatctcgctttattgctcattgatggaagctatggatttgaaatggatacatttgagtttcttaatatcatgcaagtccatggattccccaaggtgatgggagtgctcacacatcttgataaatttaaagatgtgaagaaactcaggaaaactaagcagcgccttaaacatcgattctgggccgagataaaggagggagcaaaattattctacttgtctggtttgattcatggaaaatacaccaaaagagaagtccataatcttgcaagattcatctctgtaatcaaacctatcccattgagttggcgtatggctcatccttatttgttagttgatagatttgaggatgtcacccctacagaaagtgtgcgcttgaacagaaagtgtgacagaacaataacattgtacggttacctccgtggctgtaatatgaaaagagggaccaaggtgcatatcacaggggcaggtgatttcagcttgtctggggtgacgggtttggctgatccttgccctttgccatcatctgcaaagaagagaggattgcgtgacaaggaaaaactgttctatgcgccaatgtctggtcttggggatttactttatgacaaggatgcagtttatattaatatcaatgatcatcttgttcagttttcaaagagtgatgaaaatgatgcacccgaaaagcaagggaaaggtaaagatgtcggcgtggccctggtaaaaacacttcaaaacacgagatactcccttgatgaaaagttggaacaaagttttataaatttctttggtgggcgtcctgctgctcaatccaaagacagtgatgctgaaggcaatgtcatctctgcaagccaggatgatcagggtgacacaaacttgcagcaagtagatgacggtaacaatagcaatgcagtcaccatggagagaaatgaacattctgaaggctctagtgatagcgaagaggataatgatgatattcagctgagggatcgtgatgttgaattgagggaagaagtagaaatttgcaatggaagagtgaggcgaaaagctgtgtctgctaattttctagatgacgttgatgatgagggtactgatgaagatggcgatgatgaggaggattctggtgatgaccagttgtctggggattctgtatcagcagatgatagtggagaagctagtgattcagaggatgaaattgagaacacttcaaaatggaaagaatccctacttgcaagaacacagtcccgacggagtgctaatttgatgcaacttgtctatggactaccttcaacaaagctaggcggtggtgcgctagaagaaaatgatgatggtgaagccaatagctcagatgacgaatttttcataccaaaaggacaaaagcaagcaaagaatgaatcaccaagctttgaggatattgatgctgaggattgctccaagtttttcaaagcagagctaagagattggtctaatgaagatctcatcaaaagcatccgtgatcgttttgtgactggaaattggtcaaaagctgctttaagaggacaggatgcagatgaaaatggagaggatggtgaggaaatatatggtgattttgaagatcttgaaactggtgaggtacatatgagccaggcagttgaagatgcagaaaggaaagatgatccagaagttgaagaaagaagacttaagaagcttgcactaagagcaaaatttgataagaaatccagacaggaacagtctaacggagggggctattttgacaaactaaaggaggaaatggaacttcgcaagcaaatgaatatgtccgagctcaatgaccttgacgaagagactcgagtagacattgaaggattcaggactggtacttatgtcaggttagaagtacatggtgtgccatttgagcttgttgagcattttaatccttgccaccccattcttgttgggggtattggccttggtgaggagaacacgggattcatgcaggctagtttgaagcgccataggtggcacaggaaagttctgaagacaaaggatccaatcatagtttcaattggatggaggcgattccaaacaacccctgtgtatgcaatagaggatcggaatggtcgacaccgcatgctgaagtatacgcctgagcatatgcattgctttgctatgttttggggaccacttgctccaccaaagagtggtgtattagcagtccagaatctttctaacaatcaggtgccatttaggataactgcaacaggatgggttcaagaattcaacaatactgccagaattgtgaagaagatcaagctcacaggcacaccatgcaagatatttaagaagactgcactaatcaaagggatgttcacatctgatttagaggttgctaggtttgaaggtgctgccattcggactgtaagtggaatccgaggacaggttaaaaaggcagcaaagattgagccaggagacatgttgaagagaaaaggggaaaatacagaaggaatcgcaagatgcacatttgaggacagaattcttatgagtgacattgttttcctgcgtgcctgggttaatgttgaagttcccacgtactgtaaccctgtgaccactgctctgcaacctagagagcagacctggcaaggcatgagaacaactgctgagttgcggagggaacacaatatccctaccccacacaacaaggactcagtttacaagcctattgagcggaaaccacggaagttcaatcctgttgagatccctgcaaagctgcaacagttacttccttttaaatctaagcctaaggatacacctaagcagaagaaagtatcagttgaaaacagggtgccagtaatcatgcaacctagtgagaagaagacacatgcagctatacaacagctaaggctgataaaacaagagaaggcaaagaagaagaaaaataaggaacaacagaagaaaaaagcatatgaggcagagaaagccaagaccgagctacttacgaagaaacgacagagggaagagaggcgtgagagatatcgggaagaagataagcaaaagaagcgtgcacgcagatga

SEQ ID NO: 2098 - protein, 1165 aa, Sorghum bicolor
  misc_feature: Ceres ANNOT ID no. 6018507
  misc_feature (235)..(321): Pfam Id: AARP2CN Pfam Desc: AARP2CN (NUC121) domain
  misc_feature (1)..(1165): NCBI GI: 115452841 NCBI Desc: os03g0333100 [oryza sativa (japonica cultivar-group)]
  misc_feature (128)..(1165): NCBI GI: 140049672 NCBI Desc: aarp2cn [medicago truncatula]
  misc_feature (4)..(473): NCBI GI: 54641184 NCBI Desc: ga20548-pa [drosophila pseudoobscura]
  misc_feature (5)..(1162): NCBI GI: 108880923 NCBI Desc: ribosome biogenesis protein [aedes aegypti]
  misc_feature (4)..(1152): NCBI GI: 21355337 NCBI Desc: cg7728-pa [drosophila melanogaster]
MAPADGGGEQAHKAHRQHKSGAKARKKKGKGKGDGGDDAGGQQKNPKAFAFQSAAKAKRLQARSAEIEQRRLHVPIMDRSIGEPPPFVVVVQGPPQVGKSLLIKCLVKHYTKQNLPEVRGPITVVSGKSRRVQFVECPNDINGMIDAAKIADLALLLIDGSYGFEMDTFEFLNIMQVHGFPKVMGVLTHLDKFKDVKKLRKTKQRLKHRFWAEIKEGAKLFYLSGLIHGKYTKREVHNLARFISVIKPIPLSWRMAHPYLLVDRFEDVTPTESVRLNRKCDRTITLYGYLRGCNMKRGTKVHITGAGDFSLSGVTGLADPCPLPSSAKKRGLRDKEKLFYAPMSGLGDLLYDKDAVYININDHLVQFSKSDENDAPEKQGKGKDVGVALVKTLQNTRYSLDEKLEQSFINFFGGRPAAQSKDSDAEGNVISASQDDQGDTNLQQVDDGNNSNAVTMERNEHSEGSSDSEEDNDDIQLRDRDVELREEVEICNGRVRRKAVSANFLDDVDDEGTDEDGDDEEDSGDDQLSGDSVSADDSGEASDSEDEIENTSKWKESLLARTQSRRSANLMQLVYGLPSTKLGGGALEENDDGEANSSDDEFFIPKGQKQAKNESPSFEDIDAEDCSKFFKAELRDWSNEDLIKSIRDRFVTGNWSKAALRGQDADENGEDGEEIYGDFEDLETGEVHMSQAVEDAERKDDPEVEERRLKKLALRAKFDKKSRQEQSNGGGYFDKLKEEMELRKQMNMSELNDLDEETRVDIEGFRTGTYVRLEVHGVPFELVEHFNPCHPILVGGIGLGEENTGFMQASLKRHRWHRKVLKTKDPIIVSIGWRRFQTTPVYAIEDRNGRHRMLKYTPEHMHCFAMFWGPLAPPKSGVLAVQNLSNNQVPFRITATGWVQEFNNTARIVKKIKLTGTPCKIFKKTALIKGMFTSDLEVARFEGAAIRTVSGIRGQVKKAAKIEPGDMLKRKGENTEGIARCTFEDRILMSDIVFLRAWVNVEVPTYCNPVTTALQPREQTWQGMRTTAELRREHNIPTPHNKDSVYKPIERKPRKFNPVEIPAKLQQLLPFKSKPKDTPKQKKVSVENRVPVIMQPSEKKTHAAIQQLRLIKQEKAKKKKNKEQQKKKAYEAEKAKTELLTKKRQREERRERYREEDKQKKRARR

SEQ ID NO: 2099 - DNA, 819 bp, Sorghum bicolor
  misc_feature: Ceres ANNOT ID no. 6018510
  misc_feature: Encodes the peptide sequence at SEQ ID NO 2100
atggcggacgacgagcaggcggagaggaaggaggaggtccccgagcttgctccttttgatccaaccaagaaaaagaagaagaagaaggtggtgatacaagagccatcagatgaggtggataacttggcagagaagactgagagtttgactgtagctgagtctagtgagccaagctttgcgggcatgaaaaagaagaagaagaaacatgtggaacttgatccttctcttactgagactggagatggtgatgaagctggagacgatcaagttagagaggatgaagaaggagaagggattgtcctcagtggtgctgctgccaccagatacccttgggaaggaactgacagagattataagtatgaagagctgcttggcagagtattcaatattctgcgtgagaacaacccagatcttgctggtgatagaagaagaactgttatgaggccccctcaagtcctcagggaaggaacaaagaagacagtttttgtgaactttatggacttgtgcaaaacaatgcataggcaaccagaacatgtgatgatgttcttgcttgctgagatgggaacaagtggatccctggatgggcaacagaggttggttatcaaaggaagatttgcgccaaaaaatttcgaagcaatacttaggagatatatcaatgaatatgtcatatgcaatggttgcaagagtccggataccattctttctaaagagaacaggctgttcttcctccgatgcgagcagtgtggttcgtcgaggtctgttgctcccatcaaggctggattcgttgcccaagttggccgtcgtaaggctggatcttaa

SEQ ID NO: 2100 - protein, 272 aa, Sorghum bicolor
  misc_feature: Ceres ANNOT ID no. 6018510
  misc_feature (126)..(253): Pfam Id: eIF-5_eIF-2B Pfam Desc: Domain found in IF2B/IF5
  misc_feature (1)..(272): NCBI GI: 3122234 NCBI Desc: eukaryotic translation initiation factor 2 beta subunit (eif-2-beta) (p38)
  misc_feature (1)..(272): NCBI GI: 82621136 NCBI Desc: eukaryotic translation initiation factor 2 beta subunit-like [solanum tuberosum]
  misc_feature (1)..(272): NCBI GI: 17865761 NCBI Desc: eukaryotic translation initiation factor 2 beta subunit (eif-2-beta)
  misc_feature (1)..(272): NCBI GI: 1732361 NCBI Desc: translation initiation factor 2 beta [malus x domestica]
  misc_feature (1)..(272): NCBI GI: 140054224 NCBI Desc: translation initiation factor if5 [medicago truncatula]
MADDEQAERKEEVPELAPFDPTKKKKKKKVVIQEPSDEVDNLAEKTESLTVAESSEPSFAGMKKKKKKHVELDPSLTETGDGDEAGDDQVREDEEGEGIVLSGAAATRYPWEGTDRDYKYEELLGRVFNILRENNPDLAGDRRRTVMRPPQVLREGTKKTVFVNFMDLCKTMHRQPEHVMMFLLAEMGTSGSLDGQQRLVIKGRFAPKNFEAILRRYINEYVICNGCKSPDTILSKENRLFFLRCEQCGSSRSVAPIKAGFVAQVGRRKAGS

SEQ ID NO: 2101 - DNA, 3936 bp, Sorghum bicolor
  misc_feature: Ceres ANNOT ID no. 6018516
  misc_feature: Encodes the peptide sequence at SEQ ID NO 2102
atgactactggtgatcccttgctcctgtcatcatccggaactgcagattcaccttcaaagcatcaggctcctgctcggccttcggtaggctcattaggctgcctctgcgcaactgattcattctcttcatcactgtacgaggattgtgaaacggcttctgtcacacccacggatgaaagagaggctcaaccaagacatttacgggtggagtctgatgtgagcagggtggcagagcgcttccagtctgctgattcacacttcttccatcgtctctcggtggaatgctctcaggaggagagacagcggaaggtttcttggggtggtgcaatggagatgcagcattctccatcatccctagagatcggaatggtatcttcttcccatgagaagccaaatcgctcccagagaatcaggaacaagagctcacagtttgaagatccatttttatccgagcatgagccaaggctaatttacattaatgatcctaacaggacaaatgatcgatatgaatttacagggaatgagatcaggacaagcaagtatactttgattacgttcctgcctaagaacctcttcatacagtttcatcggctggcatatgtatacttcctggttatagctgctcttaaccagctccctcctttagctgtatttggaagaactgcttctcttttcccactactctttgtgttgtttgtgactgctataaaagatggatatgaagactggcggcgtcacagatctgacagaaatgaaaataaccgagaggcactcgtacttcaacatggtgattttcggtcaaaaaagtggaaaaaaatttgtgcaggggaggttgtcaaaattcatgccaacgagaccatgccgtgtgacatggttctcctgggtacgagcgatccaaatggtatagcttatatccaaactatgaatttagatggtgagtcaaacctgaaaacaaggtatgctcgccaggaaactacttccatgatatatgacgatgcatattcaggcttgatcaaatgtgagcagcccaacagaaatatctatgagtttacagctaccatggagttgaacagtcagagggttccgcttggacaatcaaacattgtattacgtggatgccaactcaaaaacactgaatggattattggggttgttgtctatgctggtcaggagacaaaagctatgttgaacagcacgatatctccttcaaagagcagcaacctagagagttatatgaacagggaaaccctttggctatcagctttcctcttgatcacatgcacagttgtggctgctgggatgggggtttggctgtttaaaaattccaaaaacctggatgccctgccatactacagaagaaagtacttcacctttgggcgtgaaaatcgaaaagatttcaagttttatggcattgctttagagatatttttctccttcctcagttctgtgataatctttcagataatgataccgatatctctgtacatcacaatggagctagtcagggtggggcaatcatacttcatgattggagatacaaggatgtatgacagtagttcaggttcaagatttcagtgtcgatccttgaatatcaatgaggacctaggacaaatccgatacatattttctgacaaaacaggcactttgacacaaaacaagatggaatttcagcaagctagcatctacgggaagaactatggcagttccttgcaagtcaccagtgacttttcacatgaaataagcactacagagccattgagacaaaatggcaggaagcctaaagtcaatgttgatttggcactcacggcgcttctgaatcaaccattgattggggaggaaagacttgctgctcatgattttttccttactctggctgcctgcaacacagtaattccagttagcacagagagttctcacgatttgacaaatgaagtggacgagacaagtgcaattgattaccagggtgaatcacctgatgagcaagctttagtaactgcagcctctgcctacgggtataccctcgtggaaagaacaactggacatattgttatagatgttctaggcgagaggttaaggctggatgttcttggtctccatgaattcgatagtgtgagaaaaagaatgtccgttgttgtaaggtttccagacaacaatgtaaaggttcttgtgaaaggtgctgacacatcaatgctaagcattttgaaagtagaaattggtgatggactttatgattcgctgcatgttaaaattagagaaactacagaaaatcatttgtcagcttattcatcagagggtttacgaaccttagtcatcggttcaaaaaacctgacagatgcagaattcagtgaatggcaggaaaggtatgaagaagctagtacctccatgcacgagagatcagcaaagctccgtcaggcagcaggtctggtagaatgcaatctgacccttcttggtgcaactgcaattgaagataaattgcaggatggtgttcctgaggccattgagtctctgagacaggctggaatcaaggtgtgggttctaacaggagataagcaagaaactgctatatcgattggtttgtcatgtcgactcttgactcaaaccatgcattcgatcatcataaatggttcctcagaggttgagtgcaggcgtcttctagctgaggctaaagccaaatttggaataaagtcggctgattttgggcgggattcgcaaggtacagaagatttgtacgatggtgatatttctaaactgaggccctcaaatggccacctgtctgaaagtgcagtacaaaactttgaactaactggagttattgctggtgacaagtcagagtacaatgagaaagagacaaattttgatggcaccgagttagcactgataattgatggaagctcccttgtgtatattctagagaaagatcttgaatcagagttatttgacttggcaacttcatgtaaagtcgtcatctgttgtcgtgttgctcctctgcaaaaggctggcattgttgatttgattaaaagcagaacgagtgacatgaccctggcaattggtgatggggcaaatgatgtttcaatgatacagatggcagacgttggtgttggcatatgcggtcaagaaggtcgtcaggcggtgatggcttcagactttgctatgggtcaattccgctttctgaagagattacttcttgtacatgggcactggaattatcagcgtatcgcatacatgatcctgtacaacttctaccggaatgctgtcttcgtgctaatgcttttctggtatatcctatatacggcttattctgcaactctggcattaacagattggagcagtgttttctattcccttatatacacatcagttccaacggtagtagttggcattctcgacaagaacttaagtcataatacccttctctgttatccaagactatatgaggcagggcttcgaaatgagggctacaacttgacactcttctggatcacaatgctcgatacattgtggcaaagccttgtccttttctatgttcctttcttcacatacaatatcagtacaatggacatatggagtatgggaagtttgtggacaattgctgtggttataattgtcaatattcatctagccatggacattcaacgttgggtgcttataacccatcttgctgtatggggttctatagctgctacgtttttatgcatggtgttaattgactctataccaattttccctaactatgggacaatttacaacatggctgcttcaaggacttactggcttagtgtttgtcttataatagtccttgggttgcttcctcggttcctttgtaaagtagtatatcagaccttttggccatctgatattcagatagcaagagaagctgagctttttaaaaagctgccccagcagttgggttcaaggcctgcaagtgacatcagctaa

SEQ ID NO: 2102 - protein, 1311 aa, Sorghum bicolor
  misc_feature: Ceres ANNOT ID no. 6018516
  misc_feature (538)..(1039): Pfam Id: Hydrolase Pfam Desc: haloacid dehalogenase-like hydrolase
  misc_feature (463)..(1311): NCBI GI: 115452859 NCBI Desc: os03g0334700 [oryza sativa (japonica cultivar-group)]
  misc_feature (134)..(914): NCBI GI: 10178032 NCBI Desc: atpase [arabidopsis thaliana]
  misc_feature (134)..(914): NCBI GI: 110737394 NCBI Desc: atpase [arabidopsis thaliana]
  misc_feature (141)..(568): NCBI GI: 115435956 NCBI Desc: os01g0277600 [oryza sativa (japonica cultivar-group)]
  misc_feature (140)..(566): NCBI GI: 124297480 NCBI Desc: atpase, class v, type 10d [homo sapiens]
  misc_feature (134)..(914): SWISSPROT Homolog: EC 3.6.3.1 Phospholipid-transporting ATPase 1
MTTGDPLLLSSSGTADSPSKHQAPARPSVGSLGCLCATDSFSSSLYEDCETASVTPTDEREAQPRHLRVESDVSRVAERFQSADSHFFHRLSVECSQEERQRKVSWGGAMEMQHSPSSLEIGMVSSSHEKPNRSQRIRNKSSQFEDPFLSEHEPRLIYINDPNRTNDRYEFTGNEIRTSKYTLITFLPKNLFIQFHRLAYVYFLVIAALNQLPPLAVFGRTASLFPLLFVLFVTAIKDGYEDWRRHRSDRNENNREALVLQHGDFRSKKWKKICAGEVVKIHANETMPCDMVLLGTSDPNGIAYIQTMNLDGESNLKTRYARQETTSMIYDDAYSGLIKCEQPNRNIYEFTATMELNSQRVPLGQSNIVLRGCQLKNTEWIIGVVVYAGQETKAMLNSTISPSKSSNLESYMNRETLWLSAFLLITCTVVAAGMGVWLFKNSKNLDALPYYRRKYFTFGRENRKDFKFYGIALEIFFSFLSSVIIFQIMIPISLYITMELVRVGQSYFMIGDTRMYDSSSGSRFQCRSLNINEDLGQIRYIFSDKTGTLTQNKMEFQQASIYGKNYGSSLQVTSDFSHEISTTEPLRQNGRKPKVNVDLALTALLNQPLIGEERLAAHDFFLTLAACNTVIPVSTESSHDLTNEVDETSAIDYQGESPDEQALVTAASAYGYTLVERTTGHIVIDVLGERLRLDVLGLHEFDSVRKRMSVVVRFPDNNVKVLVKGADTSMLSILKVEIGDGLYDSLHVKIRETTENHLSAYSSEGLRTLVIGSKNLTDAEFSEWQERYEEASTSMHERSAKLRQAAGLVECNLTLLGATAIEDKLQDGVPEAIESLRQAGIKVWVLTGDKQETAISIGLSCRLLTQTMHSIIINGSSEVECRRLLAEAKAKFGIKSADFGRDSQGTEDLYDGDISKLRPSNGHLSESAVQNFELTGVIAGDKSEYNEKETNFDGTELALIIDGSSLVYILEKDLESELFDLATSCKVVICCRVAPLQKAGIVDLIKSRTSDMTLAIGDGANDVSMIQMADVGVGICGQEGRQAVMASDFAMGQFRFLKRLLLVHGHWNYQRIAYMILYNFYRNAVFVLMLFWYILYTAYSATLALTDWSSVFYSLIYTSVPTVVVGILDKNLSHNTLLCYPRLYEAGLRNEGYNLTLFWITMLDTLWQSLVLFYVPFFTYNISTMDIWSMGSLWTIAVVIIVNIHLAMDIQRWVLITHLAVWGSIAATFLCMVLIDSIPIFPNYGTIYNMAASRTYWLSVCLIIVLGLLPRFLCKVVYQTFWPSDIQIAREAELFKKLPQQLGSRPASDIS

SEQ ID NO: 2103 - DNA, 1491 bp, Sorghum bicolor
  misc_feature: Ceres ANNOT ID no. 6018519
  misc_feature: Encodes the peptide sequence at SEQ ID NO 2104
atgcggcgagccacactcccgctcgcgcttgggctctccatcgtcgccctcttcgcggccaggggcgccgatgcctcaatccacgagtacgccgccggcggcttcgcgccgcgggccaactccttcttcttccacggcgggagcgaggggctctacgcgtccgacccctcatccaactcctccgcgtccttcatcagatttgacaccgttgtttttcgtcgcaccctggagtcagcatctaggcatgaggagatgcagcaaaagacaggattggtggaggctataattgttgagatacaggacagggacaaaattggaggtttatacctgcactctgatgcaatatgctgcacgcctgagcttgataaggagaaatcttgtagagtaggtgaggtgatcatacgtccaaatcctgagaaccctgactggcctaagaggatccagacattctttgatggtaaaaatgaagaaaccactatggtaactcaatttgtatcgataaacaaaacagggatgtattacctctattttatgttctgtgatcctcaacttaagggattgaagattacaggaagaactgtttggagaaatccacagggttatctccctggtaaaatggctccaatgatgacattttatggtttcatgtcacttgcatatcttgcccttggacttctatggttcattcagttcgtgcgatgctggaaggacattttgcagctgcattaccatataacagttgttattgctcttggcatgtgtgaaatggctttctggtattttgagtatgctaactttaattcaactggaaccagacctatgggcattaccttgtgggcagttacatttacagctgtgaagaagactgtttctcggcttcttctattagtagtgtcgatgggctacggtgttgttctacccacattgggtggcataacatcaagagttgctgctcttggtttcatctattttgttgcttcagaagctcttgaacttgttgaaaatctgggaaatatcaatgacttctctggaaagacaaggctattcctagtgttgcctgttgccgtacttgatgctacctttatcatctggatattctcatccctctccagaactttggagaagctgcagctgcggagaagcatggcaaaacttgaattgtatcgaaagtttacaaattctctggctgtgtcagtgcttatctcaatcgcttggattggctatgagctatatttcaatgcaactgacccgttgagtgaactttggcaacgggcttggatcatcccctccttttggaatgttctttcctatgcgctcctcgccatcatatgcatcctttggtctccatctcgcaatccaacagggtttgcatattcagaggatgcaggtgagggagctgatgaggaagggctctctctagtaggcagtgcagtgaaaggaactggagatatggtaaacatgcatatctttcctgaggataaacgtgcatga

SEQ ID NO: 2104 - protein, 496 aa, Sorghum bicolor
  misc_feature: Ceres ANNOT ID no. 6018519
  misc_feature (167)..(454): Pfam Id: Lung_7-TM_R Pfam Desc: Lung seven transmembrane receptor
  misc_feature (9)..(411): NCBI GI: 4508069
  misc_feature (6)..(474): NCBI GI: 51091402 NCBI Desc: membrane protein ptm1-like [oryza sativa (japonica cultivar-group)]
  misc_feature (25)..(484): NCBI GI: 124360430 NCBI Desc: lung seven transmembrane receptor [medicago truncatula]
  misc_feature (12)..(377): NCBI GI: 140067186 NCBI Desc: lung seven transmembrane receptor [medicago truncatula]
  misc_feature (112)..(293): NCBI GI: 50261853 NCBI Desc: at1g10980 [arabidopsis lyrata subsp. petraea]
MRRATLPLALGLSIVALFAARGADASIHEYAAGGFAPRANSFFFHGGSEGLYASDPSSNSSASFIRFDTVVFRRTLESASRHEEMQQKTGLVEAIIVEIQDRDKIGGLYLHSDAICCTPELDKEKSCRVGEVIIRPNPENPDWPKRIQTFFDGKNEETTMVTQFVSINKTGMYYLYFMFCDPQLKGLKITGRTVWRNPQGYLPGKMAPMMTFYGFMSLAYLALGLLWFIQFVRCWKDILQLHYHITVVIALGMCEMAFWYFEYANFNSTGTRPMGITLWAVTFTAVKKTVSRLLLLVVSMGYGVVLPTLGGITSRVAALGFIYFVASEALELVENLGNINDFSGKTRLFLVLPVAVLDATFIIWIFSSLSRTLEKLQLRRSMAKLELYRKFTNSLAVSVLISIAWIGYELYFNATDPLSELWQRAWIIPSFWNVLSYALLAIICILWSPSRNPTGFAYSEDAGEGADEEGLSLVGSAVKGTGDMVNMHIFPEDKRA

SEQ ID NO: 2105 - DNA, 996 bp, Sorghum bicolor
  misc_feature: Ceres ANNOT ID no. 6018522
  misc_feature: Encodes the peptide sequence at SEQ ID NO 2106
atggcgtcgtcgggcagcgacgtgccggcggcgagggcggccgtggcggtgaacgatctgatccaggcgcgcgacggcgcggcgaggctcagggccttcctgctgcagctggacgaccagcgcgcggcgtgggcgcagctgcagatcgacggcgtcctgaccaagctgtcgagcgcgatgtcggcgttggatgtaagcgatgccgccgggtcggacgacgatcacagcgtccatctgacaaaaagatcactgctaacctggaagatggccacgtatggcggaaatatgggcagaaagagattcaagactcaccctatccaagttatatatatagtggtatggccgaacgaaaggccatcaaacagagatcacggaaccggaacgtgtttgctttgcaggagctactacaggtgcacgcacaagacagaccagggctgcagcgccaggaggcaggtccagcgctgcgagacggacacgtccaagtacgtcgttacctactacggcgagcacacgtgccgggacccctcgacgatcccgctcatcgaccacgccgccggcgcccttgccgagctcgaccgtgccaacaacctcatcagcttcggccccagcggcaccagcaacgacgcaaacgcagcagccgcggccagcaacgccggcgcctcttcgtcgcagtacctgcaggctatgggcgggagcgctgctgctgatcagctgtccacgtcgtggtgcaccagcgacgacgtgttcagctcgtcggccggctcgttcatgcaggtggaccagctgatcggcgccgtcgtgggcggctccgccggggtcgtgacgtcagcggcggcgccggaccgtggcgtcgtgcttggtggcgtggcgagcggcggcagaggcaccgccagcttcccgacgtctccgaacagcctcggcttcgtggtgggatcgcttgggagcatcggcggcggcggcgaggacgacgacgatatgtttagactggatccttag

SEQ ID NO: 2106 - protein, 331 aa, Sorghum bicolor
  misc_feature: Ceres ANNOT ID no. 6018522
  misc_feature (133)..(174): Pfam Id: WRKY Pfam Desc: WRKY DNA -binding domain
  misc_feature (133)..(331): NCBI GI: 108708014 NCBI Desc: wrky dna binding domain containing protein [oryza sativa (japonica cultivar-group)]
  misc_feature (133)..(331): NCBI GI: 115452865 NCBI Desc: os03g0335200 [oryza sativa (japonica cultivar-group)]
  misc_feature (6)..(295): NCBI GI: 83320247 NCBI Desc: wrky transcription factor 45 [oryza sativa]
  misc_feature (6)..(295): NCBI GI: 46394344 NCBI Desc: tpa: wrky transcription factor 45 [oryza sativa (indica cultivar-group)]
  misc_feature (133)..(272): NCBI GI: 126508732 NCBI Desc: wrky45 transcription factor [triticum aestivum]
MASSGSDVPAARAAVAVNDLIQARDGAARLRAFLLQLDDQRAAWAQLQIDGVLTKLSSAMSALDVSDAAGSDDDHSVHLTKRSLLTWKMATYGGNMGRKRFKTHPIQVIYIVVWPNERPSNRDHGTGTCLLCRSYYRCTHKTDQGCSARRQVQRCETDTSKYVVTYYGEHTCRDPSTIPLIDHAAGALAELDRANNLISFGPSGTSNDANAAAAASNAGASSSQYLQAMGGSAAADQLSTSWCTSDDVFSSSAGSFMQVDQLIGAVVGGSAGVVTSAAAPDRGVVLGGVASGGRGTASFPTSPNSLGFVVGSLGSIGGGGEDDDDMFRLDP

SEQ ID NO: 2107 - DNA, 1890 bp, Sorghum bicolor
  misc_feature: Ceres ANNOT ID no. 6018527
  misc_feature: Encodes the peptide sequence at SEQ ID NO 2108
  misc_feature: Up-regulated in shoot tissues in response to methyl jasmonate treatment
  misc_feature: Up-regulated in shoot tissues in response to salicylic acid treatment
atgatgagggggcaggcgtggctggcgctgctgctcgtggtggcgctggccttggcggacgcggcggcggggaggttcgtggtggagaagaacagcatccaggtgacgtcccccgacgagctcaagggcaagtacgagtgcgccatcggcaacttcggggtgccgcagtacgggggcaccctgcacggatgggtcgagtaccccaagtccaaccggaaggcgtgccagagcttcgaccagttcgacatctcgttcaagcccaagcaggctgggggacgacccaccttcgtcctcgtcgaccgcggagaatgcttcttcacaaccaaggcatggaatgcacaaaacgctggagctgctgcagttcttgtcgtggatgacaagtcagaacctctaatcacaatggacaacccagaagaaggcaaagagcacctagaaaacatcactattccctcagtgcttataacaaagaaattgggggaaagccttaagaaatctgtggaaaatggtgatatgcttagcgttcttctggactggagagaatcccttccccatcccgatgagcgtgtagagtatgagttctggacaaacagtaatgatgaatgtggtcctaaatgcgatatgcaaatggactttgtgaggagctttagaggaactgcacaaattcttgagaaaaagggttacactcagtttactcctcattatatcacatggtattgtccagaagcttttgtcagtagcaagcaatgcaaatcacagtgcatcaatcatgggagatattgtgcaccagaccctgagcaggattttagccaagggtatgatggaagagatgttgtggttcaaaatctgcatcaaatttgtgtattcaagattgctaatgagactggaaagccatggctgtggtgggattatgtgcatgattttgcacttaggtgcccaatgaaggataagaaatacaaccatgactgtgccagcgatgttatcaagtcacttggattggaaatggagaagataaacaagtgtattggcgaccctgaagccgatgtggaaaatgaaattttaaaggcggaacaagatgcccaaattggtcatggtaataggggagatgtcacaatactaccaacccttgtcatcaacaacaggcaatacagaggtacgctggacaaagttgctgtcatgaaagcgatctgttcaggattcgaggagacaactgagcctgctgtttgtttgagcgaagaggttcaaacaaatgagtgtttggagaacaatgggggttgctggctggacacagctaataatgttactgcatgcaaggataccttccgtgggcgtgtttgtgagtgccctattgtgagaggtgtaaaatttgttggtgatggatatacccattgtgaagcttctggtattggtaggtgtgagatcaataatggagggtgctggcaggaaactaaagatgggaagacaatctctgcctgctcaaacgaagtatctgaaggttgtaaatgtccagtgggtttcaagggtgatggagaaaaaagttgtgaagacattgatgaatgcaaagacaaactttactgtcagtgcaagggttgcagctgcaagaatacatggggaagctatgagtgcagctgtggtgatgacaatatgctatacatgagggagcatgacacttgcatcagcaaaaagggtactaccagtactgttggctggagcttcctctgggttattttctttggacttgtttttgccggggttggagcatacgctgtgtacaaatacaggctgaggagttacatggattcggagatccgtgccatcatggctcagtacatgcctctggataaccaagaaggggcaaaccagcatcaggtcgtgcacgcgaatgatatttga

SEQ ID NO: 2108 - protein, 629 aa, Sorghum bicolor
  misc_feature: Ceres ANNOT ID no. 6018527
  misc_feature (56)..(166): Pfam Id: PA Pfam Desc: PA domain
  misc_feature (2)..(629): NCBI GI: 8886326 NCBI Desc: vacuolar targeting receptor bp-80 [triticum aestivum]
  misc_feature (2)..(621): NCBI GI: 7484768 NCBI Desc: vacuolar sorting receptor protein homolog pv72 - cucurbit
  misc_feature (2)..(621): NCBI GI: 2943792 NCBI Desc: pv72 [cucurbita cv. kurokawa amakuri]
  misc_feature (8)..(627): NCBI GI: 83284015 NCBI Desc: vacuolar sorting receptor protein pv72-like protein [solanum tuberosum]
  misc_feature (8)..(615): NCBI GI: 1737218 NCBI Desc: vacuolar sorting receptor homolog [arabidopsis thaliana]
  misc_feature: Up-regulated in shoot tissues in response to methyl jasmonate treatment
  misc_feature: Up-regulated in shoot tissues in response to salicylic acid treatment
MMRGQAWLALLLVVALALADAAAGRFVVEKNSIQVTSPDELKGKYECAIGNFGVPQYGGTLHGWVEYPKSNRKACQSFDQFDISFKPKQAGGRPTFVLVDRGECFFTTKAWNAQNAGAAAVLVVDDKSEPLITMDNPEEGKEHLENITIPSVLITKKLGESLKKSVENGDMLSVLLDWRESLPHPDERVEYEFWTNSNDECGPKCDMQMDFVRSFRGTAQILEKKGYTQFTPHYITWYCPEAFVSSKQCKSQCINHGRYCAPDPEQDFSQGYDGRDVVVQNLHQICVFKIANETGKPWLWWDYVHDFALRCPMKDKKYNHDCASDVIKSLGLEMEKINKCIGDPEADVENEILKAEQDAQIGHGNRGDVTILPTLVINNRQYRGTLDKVAVMKAICSGFEETTEPAVCLSEEVQTNECLENNGGCWLDTANNVTACKDTFRGRVCECPIVRGVKFVGDGYTHCEASGIGRCEINNGGCWQETKDGKTISACSNEVSEGCKCPVGFKGDGEKSCEDIDECKDKLYCQCKGCSCKNTWGSYECSCGDDNMLYMREHDTCISKKGTTSTVGWSFLWVIFFGLVFAGVGAYAVYKYRLRSYMDSEIRAIMAQYMPLDNQEGANQHQVVHANDI

SEQ ID NO: 2109 - DNA, 687 bp, Sorghum bicolor
  misc_feature: Ceres ANNOT ID no. 6018535
  misc_feature: Encodes the peptide sequence at SEQ ID NO 2110
atggacgctgccggcggggtggaggccgccgccaacggcgggatcgagggctccgccgacccctgcagctcaggcggcgccggtgggtacaggttctccgtccaccagatagccggcggcgggaaagctgctgatatcatcttatggaggcgagggcgtgttacaattggtgttatatttggtgctactgtggcatggtggttgtttgagaagtctggactatcattattaactatttgctgtgatatatttctcatcttgatagttctgcagttcttacgggttaaaatagctggactgctaaataggcagcctaggccactacctgagttagttttatcagaggagatggttagcaatgctgcggcttcattccgtgttaaagttaacaacatgctgatgatagcgcatgacattactcttggcaaggacttccgactatttttccaggttgtgcttgttctttggctgttatctgttattggaaatttctgctcgtcaatcactcttgcttacataggaaccattgcattggtcactatacctgcattgtacaacaaataccagcggcctgttgataggtatgctgggatggtccaccggaacatatcgaggcattacaagatagttgatgagaatgtgatcagcagactaccgagaaggtttatcagagataaagaggattga

SEQ ID NO: 2110 - protein, 228 aa, Sorghum bicolor
  misc_feature: Ceres ANNOT ID no. 6018535
  misc_feature (43)..(226): Pfam Id: Reticulon Pfam Desc: Reticulon
  misc_feature (1)..(227): NCBI GI: 145332022 NCBI Desc: reticulon family protein [arabidopsis thaliana]
  misc_feature (44)..(227): NCBI GI: 140070341 NCBI Desc: reticulon [medicago truncatula]
  misc_feature (31)..(206): NCBI GI: 38345298 NCBI Desc: osjnba0043a12.26 [oryza sativa (japonica cultivar-group)]
  misc_feature (33)..(220): NCBI GI: 78714222 NCBI Desc: reticulon [hordeum vulgare]
  misc_feature (20)..(225): NCBI GI: 115457912 NCBI Desc: os04g0367400 [oryza sativa (japonica cultivar-group)]
MDAAGGVEAAANGGIEGSADPCSSGGAGGYRFSVHQIAGGGKAADIILWRRGRVTIGVIFGATVAWWLFEKSGLSLLTICCDIFLILIVLQFLRVKIAGLLNRQPRPLPELVLSEEMVSNAAASFRVKVNNMLMIAHDITLGKDFRLFFQVVLVLWLLSVIGNFCSSITLAYIGTIALVTIPALYNKYQRPVDRYAGMVHRNISRHYKIVDENVISRLPRRFIRDKED

SEQ ID NO: 2111 - DNA, 2418 bp, Sorghum bicolor
  misc_feature: Ceres ANNOT ID no. 6018540
  misc_feature: Encodes the peptide sequence at SEQ ID NO 2112
atggatcttgagttcgggagagccctgagatccccaaagagggactcatggaagaccaccttgctgctggcctaccagagcttgggggtggtctatggagacctcagcatatctccgctgtacgtgtactcgagcaccttcgccgaggacatccagcactcggacacgaacgaggagatctttggcgtgctctccttcgtcttctggacgctcaccttgatccctctcatcaagtacgtctccgttgtcctacgagctgacgacaatggcgagggaggaacgtttgccctgtactctctgatttgcaggcacgccaatgtgagccttctcccgaaccggcagattgctgatgaggagctttccacctataaactggaatgccctcctgaaataaccgacaagtcccggatcaaagtgtggcttgagaagcacaggaagctgcgcgttgctctactgatcatggttatgattggcacatgcatggttatcggggatggcgttctcacgccagcaatatctgtgttctcagcagtttcaggccttgagttttctctgtccaaggatcaccatgaatatgctgtcattccaataacctgtgtcatattagcattcctatttgccctccaacactatggtacacaccgggttggattcctctttgccccgatagttctagcctggctattctgcatgagtgctcttggcctttataatatcatccactggaatcctcacatctacaaagctctaaatccttctcatatgttcaagttcttaaaaaagactagaaagtatggttggatgtcacttggtggaatcttgctctgcatgacagggtcggaagcaatgtttgcagatcttggacacttctcatacagtgcaatccagcttgctttcacttgtctagtttaccccgcactgattctggcatatatgggccaagctgcttacttatcaagacatcatgacttttactctggttcaaaagttggattttacatcgcagttccagataagatcagatggccagtgctcatattggcaatcttggcttcggtagttggaagtcaagcgatcatcagcggaacattctcaatcatcaatcagagccagtccctgagctgctttcctcgagtaaaagttgtacacacatctgagaaaattcatggccaaatatacattcctgagatcaattggttgctcatgatcctctgcattgctgtgaccgttggatttagggacaccaaacacatgggaaatgcatctggtttggctgtgatcacagtgatgctggtgaccacgttcctgacgtccttggtcatcgttctgtgctggcacaggccaccgctgctggcattggctttcctcctgttctttggatccatcgaggcgctctacttctctgcgtccctgatcaagttcctggaaggcgcgtggctgcccatcctgctggcgctgatcctgatggcggtcatgctcatctggcactacaccaccatcaagaagtacgagttcgacctgcacaacaaggtgacactggagtggctcctcgccctcggggacaagctgggcatggtccgcgtccccggcatcggcctcgtgtacacggacctgacgtcgggcgtcccggccaacttctcccggttcgtgaccaacctcccggcgttccaccaggtgctggtgttcgtgtgcgtcaagtcggtgccggtgccgtacgtgttcccggcggagcggtacctcatcgggcgcgtcggcccgccgggccaccgctcgtaccggtgcatcgtgcgctacggctaccgcgacgtgcaccaggacgtggactcgttcgagacggagctcgtggagaccccggccacgttcataaagctggacgcctcgtaccggtgcagcgaggccagcgagcgggagcaggagcaggagctggagcccggcgagcgggagcggcggctgaccgtgatcgcgagccacccgctcaggcaccgcgccagctacgacctccaggacagcatgcagcactcggcagcatccacggtggagatgcgcgccacggccaccgccgcctccgctgacgacgacgacgacagacggagccccgggcgcgcggagatcagctcggcggcagcgggggcgaagcaggtgcggttcttcatcgacagccacgtggcgagcccggagttcgcggagaacaagcaggtggcggaggagctggaggcgctggcggcggcccgggagtgcggcacggcgttcatcctggggcactcgcacgtccagtgcaagcccgggtcgtcggtgctcaagcggctggcggtggacgtcgggtacaacttcctgcggcgcaactgccgcggcccggacgttgcgctgcgcgtgcccccggcgtcgctgctggaggtcggcatggtgtacgtgctttga

SEQ ID NO: 2112 - protein, 805 aa, Sorghum bicolor
  misc_feature: Ceres ANNOT ID no. 6018540
  misc_feature (22)..(805): Pfam Id: K_trans Pfam Desc: K+ potassium transporter
  misc_feature (1)..(683): NCBI GI: 91204708 NCBI Desc: potassium transporter [phragmites australis]
  misc_feature (1)..(683): NCBI GI: 91204712 NCBI Desc: potassium transporter [phragmites australis]
  misc_feature (1)..(683): NCBI GI: 91204710 NCBI Desc: potassium transporter [phragmites australis]
  misc_feature (1)..(742): NCBI GI: 75232649 NCBI Desc: probable potassium transporter 9 (oshak9)
  misc_feature (1)..(805): NCBI GI: 93115181 NCBI Desc: kup2 [vitis vinifera]
  misc_feature: Useful for making plants with modulated biomass
  misc_feature: Functional homolog of the protein sequence given in SEQ ID NO 13565
  misc_feature: The sequence is a functional homolog of SEQ ID NO. 279 in the 11/188,298 US application
MDLEFGRALRSPKRDSWKTTLLLAYQSLGVVYGDLSISPLYVYSSTFAEDIQHSDTNEEIFGVLSFVFWTLTLIPLIKYVSVVLRADDNGEGGTFALYSLICRHANVSLLPNRQIADEELSTYKLECPPEITDKSRIKVWLEKHRKLRVALLIMVMIGTCMVIGDGVLTPAISVFSAVSGLEFSLSKDHHEYAVIPITCVILAFLFALQHYGTHRVGFLFAPIVLAWLFCMSALGLYNIIHWNPHIYKALNPSHMFKFLKKTRKYGWMSLGGILLCMTGSEAMFADLGHFSYSAIQLAFTCLVYPALILAYMGQAAYLSRHHDFYSGSKVGFYIAVPDKIRWPVLILAILASVVGSQAIISGTFSIINQSQSLSCFPRVKVVHTSEKIHGQIYIPEINWLLMILCIAVTVGFRDTKHMGNASGLAVITVMLVTTFLTSLVIVLCWHRPPLLALAFLLFFGSIEALYFSASLIKFLEGAWLPILLALILMAVMLIWHYTTIKKYEFDLHNKVTLEWLLALGDKLGMVRVPGIGLVYTDLTSGVPANFSRFVTNLPAFHQVLVFVCVKSVPVPYVFPAERYLIGRVGPPGHRSYRCIVRYGYRDVHQDVDSFETELVETPATFIKLDASYRCSEASEREQEQELEPGERERRLTVIASHPLRHRASYDLQDSMQHSAASTVEMRATATAASADDDDDRRSPGRAEISSAAAGAKQVRFFIDSHVASPEFAENKQVAEELEALAAARECGTAFILGHSHVQCKPGSSVLKRLAVDVGYNFLRRNCRGPDVALRVPPASLLEVGMVYVL

SEQ ID NO: 2113 - DNA, 1479 bp, Sorghum bicolor
  misc_feature: Ceres ANNOT ID no. 6018541
  misc_feature: Encodes the peptide sequence at SEQ ID NO 2114
atgaagaataagaagggtagtcgccgcaaccgcaataaatcagcagctcacaatggccactcactagtagtggataggttcaccaagcttcctgatgatctcctgctcaacatcctcgaccgcctcaacacgcccgacgccgtcagaacctgcctcctttctaagaggacgctccacctccgacatttgctctcaaacttacacgtttggttcacttcctttgtgcctgattgtggttatatcactttcaaggatacaattcagatgaacgctgcggtagccggtgcaacagacaacattctcactttcagaagccaagagatcccccttcgccaactcagcataggcttctacttgaaatactacgactgtctcaccattggtaaagctgttgcccgagccatggccacccacaacctccacagcgctgaattccttattatgccagagaagaagccacaatattgcactattgaagatcgccgctgcaaagggaagcttctcatgacatttttttatgcctgtactgatgcatttgccggccttacacgtctctatctacacaacttagagcttgctgaaaatgacattcccaacatcattgccacatgcaaacggctagagtatctcggtttgtccatgtgtgaaacagaagagagtgtgttgcaactgcaggtggaacacccacggcttgttgagcttgatatctgcagtgcaggcttagaactagttgagctcagctccctaccgaacctcaaacggctggtttttagtgtgtgggtctgtccccaagaacccttgtcttttggcaacatcccattgctttcaagcctaagcctcactaatgtaagcatgggatggcagaaggttatcagattaagtcagttccttcctagtgtcccctacataagagacctgcacctcagcttcctaagtgaaaagatttgggttcagccagagtgccccaaacttctgtcgccggttctccagaatctgcaatttttgaatctggaaaaactccctgaaggatgtgatatagcttggacaagattcttcctcgaggctgcacctaacctgaaggaggtatgcatcacggtttgggaccattggtgtgatatggagacagacatggtggaacgggaagaacggggttactgtgacaaaagaaacgtggagtgggagtcatctgcacctgatggtttcaggcatcacaacctgactaagctcaccatctatggtttccagccaaatgagaacttcatgggatacatcaggcacgtcattgaagctgcagttaaactagaggagatatccttatacgaccgggaagttctcgagtgctgtgaagacttggatccaaaggtcgaggttgctccatcaagatatccccagaccatcgaggaacaggagttgctgagggagcaaattacagagggattggtgatggcgtcacctcatataattcacttccggtcttaa

SEQ ID NO: 2114 - protein, 492 aa, Sorghum bicolor
  misc_feature: Ceres ANNOT ID no. 6018541
  misc_feature (25)..(75): Pfam Id: F-box Pfam Desc: F-box domain
  misc_feature (1)..(492): NCBI GI: 115449901 NCBI Desc: os02g0825100 [oryza sativa (japonica cultivar-group)]
  misc_feature (56)..(492): NCBI GI: 115449917 NCBI Desc: os02g0826000 [oryza sativa (japonica cultivar-group)]
  misc_feature (73)..(384): NCBI GI: 115449897 NCBI Desc: os02g0824900 [oryza sativa (japonica cultivar-group)]
  misc_feature (349)..(492): NCBI GI: 115449913 NCBI Desc: os02g0825700 [oryza sativa (japonica cultivar-group)]
  misc_feature (25)..(376): NCBI GI: 21741445 NCBI Desc: oj000223_09.1 [oryza sativa (japonica cultivar-group)]
MKNKKGSRRNRNKSAAHNGHSLVVDRFTKLPDDLLLNILDRLNTPDAVRTCLLSKRTLHLRHLLSNLHVWFTSFVPDCGYITFKDTIQMNAAVAGATDNILTFRSQEIPLRQLSIGFYLKYYDCLTIGKAVARAMATHNLHSAEFLIMPEKKPQYCTIEDRRCKGKLLMTFFYACTDAFAGLTRLYLHNLELAENDIPNIIATCKRLEYLGLSMCETEESVLQLQVEHPRLVELDICSAGLELVELSSLPNLKRLVFSVWVCPQEPLSFGNIPLLSSLSLTNVSMGWQKVIRLSQFLPSVPYIRDLHLSFLSEKIWVQPECPKLLSPVLQNLQFLNLEKLPEGCDIAWTRFFLEAAPNLKEVCITVWDHWCDMETDMVEREERGYCDKRNVEWESSAPDGFRHHNLTKLTIYGFQPNENFMGYIRHVIEAAVKLEEISLYDREVLECCEDLDPKVEVAPSRYPQTIEEQELLREQITEGLVMASPHIIHFRS

SEQ ID NO: 2115 - DNA, 1185 bp, Sorghum bicolor
  misc_feature: Ceres ANNOT ID no. 6018542
  misc_feature: Encodes the peptide sequence at SEQ ID NO 2116
atggcgacggcgtgcccgccgctctcgctgccgtccacctccctcttccgcggcaggtccgcccgcgccgggcccagacgccggcagctctccgccgtccgctgcagcgccgtcggagaggcggtagtggaggaggcctcgctcgggacggcggaggagccgctgctggtgagcgcaatcagagggaggaaggtcgacaggccacccgtatggctcatgaggcaggccgggaggtacatgaagagctaccaatcgctctgcgagcgatatccttcgttccgtgaaagatcagaaaatgtcgaccttgttgttgagatctctttgcaaccatggaaggttttcaagcctgacggagtcatcttgttctcggatatccttactccacttcctgggatgaacatacctttcgacattgtgaagggaaaaggtccagtgatctatgatcctttgagaacagcagctgctgttaatgaagtcagagaatttgttcctgaggagtgggtcccttatgtggggcaggctctgaatttgttgcgagaagaggttaagaatgaagctgctgtactaggttttgttggagctccgtttaccttggcatcttattgtgtggaaggaggttcatcaaagaactttacaatgattaagaaaatggccttctcagaaccagcgattctacataatttgctacaaaagttcacaacatcgatgtctaactatattaaataccaagcggacaatggggcgcaggctgtccaaatttttgattcatgggccactgaactcagcccggctgattttgaggagtttagccttccttatctaaagcagatagtggatagtgttaaggaaacacatcctaacttgcctctgatactatatgcaagtggatctgggggcttgctggagaggcttcctttgacaggtgttgatgttgtcagcttggactggacagttgatatggcagagggcaggaaaagattgggatctaacatagcagttcaagggaatgtggaccctggtgttctttttggatccaaagagtttataagcaagcggatttacgacactgtgcagaaggctggcaatgttggacatgtattgaaccttggccatggcatcaaggttggaactccagaggaaaatgttgctcacttctttgaggttgcaaaagggataagatactaa

SEQ ID NO: 2116 - protein, 394 aa, Sorghum bicolor
  misc_feature: Ceres ANNOT ID no. 6018542
  misc_feature (51)..(392): Pfam Id: URO-D Pfam Desc: Uroporphyrinogen decarboxylase (URO-D)
  misc_feature (1)..(394): NCBI GI: 3420233 NCBI Desc: uroporphyrinogen decarboxylase [zea mays]
  misc_feature (65)..(394): NCBI GI: 2501646 NCBI Desc: uroporphyrinogen decarboxylase (uro-d) (upd)
  misc_feature (65)..(394): NCBI GI: 1016347 NCBI Desc: uroporphyrinogen decarboxylase [hordeum vulgare subsp. vulgare]
  misc_feature (19)..(394): NCBI GI: 1009429 NCBI Desc: uroporphyrinogen decarboxylase [nicotiana tabacum]
  misc_feature (43)..(394): NCBI GI: 16975230 NCBI Desc: chain a, crystal structure and substrate binding modeling of the uroporphyrinogen-iii decarboxylase from nicotiana tabacum: implications for the catalytic mechanism
  misc_feature (1)..(394): SWISSPROT Homolog: EC 4.1.1.37 Uroporphyrinogen decarboxylase, chloroplast precursor
MATACPPLSLPSTSLFRGRSARAGPRRRQLSAVRCSAVGEAVVEEASLGTAEEPLLVSAIRGRKVDRPPVWLMRQAGRYMKSYQSLCERYPSFRERSENVDLVVEISLQPWKVFKPDGVILFSDILTPLPGMNIPFDIVKGKGPVIYDPLRTAAAVNEVREFVPEEWVPYVGQALNLLREEVKNEAAVLGFVGAPFTLASYCVEGGSSKNFTMIKKMAFSEPAILHNLLQKFTTSMSNYIKYQADNGAQAVQIFDSWATELSPADFEEFSLPYLKQIVDSVKETHPNLPLILYASGSGGLLERLPLTGVDVVSLDWTVDMAEGRKRLGSNIAVQGNVDPGVLFGSKEFISKRIYDTVQKAGNVGHVLNLGHGIKVGTPEENVAHFFEVAKGIRY

SEQ ID NO: 2117 - DNA, 936 bp, Sorghum bicolor
  misc_feature: Ceres ANNOT ID no. 6018546
  misc_feature: Encodes the peptide sequence at SEQ ID NO 2118
atgtctcgccgtttcgtggcggcggcgtgtgtcgtcgcgaccgtggcgttcgctctcttggcctcgaccagcagcgcgcagctggacccgcacttctacgacaaggcgtgccccgcggctctccccaccatcaagaggctcgtgcaggaggctgtggcggcggagccccgcatgggcgcgtcgctgctgcggctgcacttccacgactgcttcgtcaacgggtgcgacgggtccatcctgctcgacgacacgcccttcttcaccggcgagaagatggccgcgcccaacgccaactccgtccgcggcttcgacgtgatcgaccgcatcaagggcgccgtcaacgccgcctgcaggggcaatgtggtctcctgtgccgacatcgtcgccgtcgcggcacgtgactccgtcctgggaggcccgtcgtacaacgtgccgctgggccgccgggacgcgcggacggcgagccaggcggcggcgaacaacagcatcccggcgccgaccttcagcctggaccgcctcgcctccaacttcgcgtcgcacggcctctccctccaggacctcgtcgtgctgtccggaggccacacgctgggcttcgcccgctgcacaaacttccgggaccgcctctacaacgagaccgccaccctggacggctccctcgccgcctcgctgcgggccgtgtgcccgcgcgccaccggcagcggcgacgacagcctcgcgccgctcgaccccacgccggcgggagtcctccactccgaccagcagctgttcgccggcgggctcggcgtcacggacgctctcgtcaggttctacgccgcgaacgccgacgcgttcaggagggacttcgcggaggccatggtgaggatggccagcctgagctcgctcaccgggagcagcggcgagatccgctacgactgcaggaaagtgaactactcttga

SEQ ID NO: 2118 - protein, 311 aa, Sorghum bicolor
  misc_feature: Ceres ANNOT ID no. 6018546
  misc_feature (44)..(273): Pfam Id: peroxidase Pfam Desc: Peroxidase
  misc_feature (11)..(308): NCBI GI: 571484 NCBI Desc: peroxidase precursor
  misc_feature (11)..(309): NCBI GI: 92877586 NCBI Desc: haem peroxidase, plant/fungal/bacterial [medicago truncatula]
  misc_feature (11)..(309): NCBI GI: 92877584 NCBI Desc: haem peroxidase, plant/fungal/bacterial [medicago truncatula]
  misc_feature (9)..(309): NCBI GI: 37783279 NCBI Desc: anionic peroxidase swpb3 [ipomoea batatas]
  misc_feature (11)..(309): NCBI GI: 5381253 NCBI Desc: peroxidase [nicotiana tabacum]
  misc_feature (26)..(309): SWISSPROT Homolog: EC 1.11.1.7 Peroxidase 52 precursor
  misc_feature: Useful for making plants with altered cell wall content and/or composition
  misc_feature: Functional homolog of the protein sequence encoded by LOCUS at5g05340
  misc_feature: Useful for making plants with altered carbohydrate content
  misc_feature: Functional homolog of the protein sequence given in SEQ ID NO 13606
  misc_feature: Useful for making plants with altered cell wall content and/or composition
  misc_feature: Functional homolog of the protein sequence given in SEQ ID NO 13605
MSRRFVAAACVVATVAFALLASTSSAQLDPHFYDKACPAALPTIKRLVQEAVAAEPRMGASLLRLHFHDCFVNGCDGSILLDDTPFFTGEKMAAPNANSVRGFDVIDRIKGAVNAACRGNVVSCADIVAVAARDSVLGGPSYNVPLGRRDARTASQAAANNSIPAPTFSLDRLASNFASHGLSLQDLVVLSGGHTLGFARCTNFRDRLYNETATLDGSLAASLRAVCPRATGSGDDSLAPLDPTPAGVLHSDQQLFAGGLGVTDALVRFYAANADAFRRDFAEAMVRMASLSSLTGSSGEIRYDCRKVNYS

SEQ ID NO: 2119 - DNA, 957 bp, Sorghum bicolor
  misc_feature: Ceres ANNOT ID no. 6018547
  misc_feature: Encodes the peptide sequence at SEQ ID NO 2120
atggctgctgcctcagtttccgttcagacgatcgtcctcctgctcctggccgttgccgctgtggcgtcggcgcagctgtcggcgacgttctacgactcgtcctgcccgagggcgctgggcaccatcaggagcgccgtgacggcggcggtcaacagggacccccgcatgggggcctccctgctcaggcttcacttccacgactgcttcgtccagggatgcgatgcgtcggtgctgctgtccgacaggggcagcttcacaggggagcagaacgcgttccccaaccggggctcgctcaggggcttcgacgtcgtcgacagcatcaaggcgcaggtcgaggccgtctgcccgcggaccgtctcctgcgccgacatcctcgccgtcgccgcgcgcgactccgtcgtaaccttaggagggccgccgtacacggtgctcttggggaggagggactccaccacggcgagcctctcgcaggccaacagcgacctcccttctccgggctccagcctcgccagcctcatcagcggcttcgccaggaaggggctcaccaccactgacatggtcgcgctctcaggagctcacacggtcgggcaggcgcagtgcaccaacttccggagccggctctacggcgagtccaacctcaaccagtcggacgcggcggcgctcagggccaactgcccgcagtcaggcggcgacggcaaccttgcgcccatggacctggcgacgcccaacacgttcgacgccgccttcttccgcggcctgctctcgcagcgcggggtgctgcactccgaccagcagctcttcagcgggggctccaccgacgcgctggtgcagagctacgcgtccaacgcggggcagttcagaaacgacttcgccgcggccatggtccgcatgggcagcatcggcgtgctcaccggctcgcagggccagatcaggctcagttgctccagcgtcaactga

SEQ ID NO: 2120 - protein, 318 aa, Sorghum bicolor
  misc_feature: Ceres ANNOT ID no. 6018547
  misc_feature (42)..(282): Pfam Id: peroxidase Pfam Desc: Peroxidase
  misc_feature (1)..(318): NCBI GI: 55701091 NCBI Desc: tpa: class iii peroxidase 112 precursor [oryza sativa (japonica cultivar-group)]
  misc_feature (1)..(318): NCBI GI: 585662 NCBI Desc: peroxidase 2 precursor
  misc_feature (1)..(318): NCBI GI: 2429292 NCBI Desc: peroxidase [oryza sativa]
  misc_feature (1)..(318): NCBI GI: 125657560 NCBI Desc: plasma membrane-bound peroxidase 2b [zea mays]
  misc_feature (12)..(318): NCBI GI: 34393250 NCBI Desc: peroxidase [oryza sativa (japonica cultivar-group)]
  misc_feature (1)..(318): SWISSPROT Homolog: EC 1.11.1.7 Peroxidase 2 precursor
  misc_feature: Useful for making plants with altered cell wall content and/or composition
  misc_feature: Functional homolog of the protein sequence encoded by LOCUS at1g14540
  misc_feature: Functional homolog of the protein sequence encoded by LOCUS at5g05340
  misc_feature: Useful for making plants with altered cell wall content and/or composition
  misc_feature: Functional homolog of the protein sequence given in SEQ ID NO 13605
  misc_feature: Useful for making plants with altered carbohydrate content
  misc_feature: Functional homolog of the protein sequence given in SEQ ID NO 13662
MAAASVSVQTIVLLLLAVAAVASAQLSATFYDSSCPRALGTIRSAVTAAVNRDPRMGASLLRLHFHDCFVQGCDASVLLSDRGSFTGEQNAFPNRGSLRGFDVVDSIKAQVEAVCPRTVSCADILAVAARDSVVTLGGPPYTVLLGRRDSTTASLSQANSDLPSPGSSLASLISGFARKGLTTTDMVALSGAHTVGQAQCTNFRSRLYGESNLNQSDAAALRANCPQSGGDGNLAPMDLATPNTFDAAFFRGLLSQRGVLHSDQQLFSGGSTDALVQSYASNAGQFRNDFAAAMVRMGSIGVLTGSQGQIRLSCSSVN

SEQ ID NO: 2121 - DNA, 1563 bp, Sorghum bicolor
  misc_feature: Ceres ANNOT ID no. 6018548
  misc_feature: Encodes the peptide sequence at SEQ ID NO 2122
atggccgccgccgccgccgccatcgccacggcgtcggcgtcgtggcttctcaagaggtctatatcctccgctttccttgcgaggcgcgcgggccctagcatcctgcgtacagcccttagctattcctcctccgcatccgcctgccccaaaccagcgccgtccctgtctccgcctgacacatccgccaatgatggaggcggcgggatgaggtgggagtctgcgcgcaagaagagagtggtgctccgcatcggctacataggcaccgaataccgagggcttcaaaagcagcgagagcttggcgtggattcgaccattgagtcagtcttggaatctgccatcttcaagtcaggtggaattcttgagagtaattatggaaaactgcaaaaggttgggtgggagaggagtagccgaactgataaaggggtacactcactggctacaatgatttcccttaaaatggaaatccctgatagagcgtgggaggatgatcctgatggcattgctcttgccagtttcatcaactcaaatttgccggacaatgtgagggtttttagtatcttgcctgcacaaaggagttttgatgtgaggagggagtgcttataccgtgagtacttctatcttcttcctgctgaagttattggaatcaaagatggttatagccctgaagaaatacaagagcacttgtcagaattcaacagcatactgaaaggcttcgagggaaaccatccatttcataattacactgcacgtgccaagtacaggaaggttcttgcgggaaggcacccgagggccaaaggagcaagcttgacgttgaagtccatgtcctctgaaatgggtatggcagaaagctcttctttagaaagcacttcttcagatgatgatgaggacttgaatatttcatcaatcgactctggtgcatcagaaaacatttttgtgaatgatatcctgaaattttctgagagtcgagtgcagattcaagctaggtggctgcatgaacctgatgaaagtgatagattaaatgcttcacatttcagagatatcattacctgttcatgtggagagttgcaaacttcatcaggaattcaatttgtggaattgaccatatgtggggtatctttcatgctacaccagatccggaaaatggttggaactgccgtggcagtgaagcgtggattactacccaaagatatcatagaactgtctcttgcaaagttttctagaatcgttctaccaatagccccttcagaagttctgatccttaaggacaatagtttctgcacaaagagcaaggaagggagaatcgtacgccctgggatccagtcaatgaacaagtcagcagcaatcaggaagggggttgaggaattctacaaggcagctcttctgccagaagtagcgaaattcttggatcctgctgtgccaccatggaaagagtgggtggagaacttggacaggtttgctggcatatcagattcgcagctggacgaagttagggaggcctacagagcatggaaggctgattatgaccgcgtgaaaatggctagaaagagtgctagcagtgtctaa

SEQ ID NO: 2122 - protein, 520 aa, Sorghum bicolor
  misc_feature: Ceres ANNOT ID no. 6018548
  misc_feature (81)..(198): Pfam Id: PseudoU_synth_1 Pfam Desc: tRNA pseudouridine synthase
  misc_feature (71)..(513): NCBI GI: 140053171 NCBI Desc: trna pseudouridine synthase [medicago truncatula]
  misc_feature (70)..(516): NCBI GI: 140053173 NCBI Desc: trna pseudouridine synthase [medicago truncatula]
  misc_feature (71)..(190): NCBI GI: 140039948 NCBI Desc: trna pseudouridine synthase [medicago truncatula]
  misc_feature (49)..(256): NCBI GI: 60463746 NCBI Desc: trna pseudouridylate synthase [dictyostelium discoideum]
  misc_feature (58)..(250): NCBI GI: 4455035 NCBI Desc: pseudouridine synthase 1 [homo sapiens]
MAAAAAAIATASASWLLKRSISSAFLARRAGPSILRTALSYSSSASACPKPAPSLSPPDTSANDGGGGMRWESARKKRVVLRIGYIGTEYRGLQKQRELGVDSTIESVLESAIFKSGGILESNYGKLQKVGWERSSRTDKGVHSLATMISLKMEIPDRAWEDDPDGIALASFINSNLPDNVRVFSILPAQRSFDVRRECLYREYFYLLPAEVIGIKDGYSPEEIQEHLSEFNSILKGFEGNHPFHNYTARAKYRKVLAGRHPRAKGASLTLKSMSSEMGMAESSSLESTSSDDDEDLNISSIDSGASENIFVNDILKFSESRVQIQARWLHEPDESDRLNASHFRDIITCSCGELQTSSGIQFVELTICGVSFMLHQIRKMVGTAVAVKRGLLPKDIIELSLAKFSRIVLPIAPSEVLILKDNSFCTKSKEGRIVRPGIQSMNKSAAIRKGVEEFYKAALLPEVAKFLDPAVPPWKEWVENLDRFAGISDSQLDEVREAYRAWKADYDRVKMARKSASSV

SEQ ID NO: 2123 - DNA, 1497 bp, Sorghum bicolor
  misc_feature: Ceres ANNOT ID no. 6018556
  misc_feature: Encodes the peptide sequence at SEQ ID NO 2124
atggcgatggctctgcgccgcctcgcgggcgtgtccggctcgccgtcggcctccgctgccgcggccgcgctgctactccggccggcgctgacccgcccgatctccaccggcttccgcgaggagcgcgacaccttcggtcccatccaagtccccaacgacaagctgtggggcgcgcagacgcagaggtcgctgcagaacttcgacattggcggggagcgcgagaggatgcccgtgcccatcatccgcgcttttggcgtgctaaaaaaatgcgccgctaaggtgaatatggagtatggtctggatccaacaatagggaaggccataatgcaggcagctgaggaggtcgcagagggaaagttggatgatcacttcccacttgttatctggcaaactggcagtggcacgcaaagcaacatgaatgccaatgaggtaattgcaaatagggcagccgagatccttggacacaagcgcggtgagaagtttgtgcacccaaatgatcatgtgaataggtcacaatcttcaaatgatacatttcccactgtaatgcatatagcagcggccgttgagataaattcgaggtttatcccaagtttgcaacagttgcatgattcacttcattcaaaaactgttgagtttaaagacataattaaaattggacgtacacatacccaagatgccaccccgttgactcttggccaagaattcagtggttacactacacaggtcaaatatggaattgaccgtattaattgtacattacctcggatgtaccagcttgctcaaggtggaactgcagttggaactggcttgaacactaagaaaggatttgatgtcaaaatagctgctgcagtggctgaggaaacaaacctaccctttgtgacagcagagaacaagtttgaagctttggcagcgcatgacgcttttgtcgagagcagtggcgcggtaaatacaatttctgcatctcttatgaagatagcaaatgacatacgcttgctaggaagtggtcctcgatgtggtcttggtgaactaatcctaccagaaaatgagcctgggagcagcattatgcctggaaaagttaatccaacccagtgcgaagctctgacaatggtttgtgctcaggttatgggtaatcatgttggtgttacagttggtggtgcaaatgggcattttgaactgaatgtttttaagccaatgatagcagccggattgcttcgatcattgaggttgttaggggatgcatctgtgtccttcgagaaaaattgtgtcaggggaattcaagcaaaccataagagaatttcacaacttttgcatgagtctctgatgttggtgacatctttgaaccctaaaattggctatgacaatgctgcagctgttgctaagaaagcccacaaagaaggaaccacgttgaagaaagctgcattagaccttggagtattaacggagcaagaattccatgaacttgttgtcccagagaaaatgatcggtccttctgattga

SEQ ID NO: 2124 - protein, 498 aa, Sorghum bicolor
  misc_feature: Ceres ANNOT ID no. 6018556
  misc_feature (46)..(376): Pfam Id: Lyase_1 Pfam Desc: Lyase
  misc_feature (230)..(498): NCBI GI: 115452903 NCBI Desc: os03g0337900 [oryza sativa (japonica cultivar-group)]
  misc_feature (11)..(498): NCBI GI: 1769568 NCBI Desc: fumarase; fumarate hydratase [arabidopsis thaliana]
  misc_feature (35)..(498): NCBI GI: 92878289 NCBI Desc: fumarate lyase [medicago truncatula]
  misc_feature (16)..(498): NCBI GI: 1488652 NCBI Desc: fumarase [solanum tuberosum]
  misc_feature (38)..(498): NCBI GI: 2118296 NCBI Desc: fumarate hydratase (ec 4.2.1.2) precursor - rhizopus oryzae
  misc_feature (18)..(498): SWISSPROT Homolog: EC 4.2.1.2 Fumarate hydratase 1, mitochondrial precursor
MAMALRRLAGVSGSPSASAAAAALLLRPALTRPISTGFREERDTFGPIQVPNDKLWGAQTQRSLQNFDIGGERERMPVPIIRAFGVLKKCAAKVNMEYGLDPTIGKAIMQAAEEVAEGKLDDHFPLVIWQTGSGTQSNMNANEVIANRAAEILGHKRGEKFVHPNDHVNRSQSSNDTFPTVMHIAAAVEINSRFIPSLQQLHDSLHSKTVEFKDIIKIGRTHTQDATPLTLGQEFSGYTTQVKYGIDRINCTLPRMYQLAQGGTAVGTGLNTKKGFDVKIAAAVAEETNLPFVTAENKFEALAAHDAFVESSGAVNTISASLMKIANDIRLLGSGPRCGLGELILPENEPGSSIMPGKVNPTQCEALTMVCAQVMGNHVGVTVGGANGHFELNVFKPMIAAGLLRSLRLLGDASVSFEKNCVRGIQANHKRISQLLHESLMLVTSLNPKIGYDNAAAVAKKAHKEGTTLKKAALDLGVLTEQEFHELVVPEKMIGPSD

SEQ ID NO: 2125 - DNA, 2454 bp, Sorghum bicolor
  misc_feature: Ceres ANNOT ID no. 6018569
  misc_feature: Encodes the peptide sequence at SEQ ID NO 2126
atgtctgccccgaagctggaccgcaacgcgagcatccgggaccgcgtcgaggacaccctccacgcgcaccgcaacgagctcgtcgctctcctctcaaagtacgtgaacaaggggaagggcatcctgcagccgcaccacatcctcgacgcgctcgacgaggtccagggctccggggtccgcgcgctcgccgagggacccttcctcgacgtcctccgctccgcgcaggaggcgatcgtgctgccgccgttcgtggccatcgcggtgcgcccgcgcccgggggtttgggagtacgtccgcgtcaacgtgcacgagctcagcgtcgagcagctcactgtctcggagtacctccgcttcaaggaggacctcgtcgacggccagcacaacgatccctacattcttgagcttgactttgagccattcaatgcctcagtcccacgcccaaatcgatcatcatctattggaaatggcgtgcagtttctcaaccggcacttgtcgtcaatcatgtttcgcaacagggattgcctggagcccctgttggatttcctccgtggccaccgacacaagggtcatgttatgatgctaaatgatagagtacagagcttggggaggcttcagtctgtgctgactaaagctgaagagtacttgtcaaagctcccagctgagacaccatacgcacaatttgcttataaatttcaagaatggggcctggagaaaggttggggtgatacagcagaacatgttttggaaatggttcatctccttctagacatcattcaagcgccagacccatcaaccctagagaaattcttggggaggatccccatgatttttaacgttgttgtggtatcccctcatggatactttggtcaagctaatgtattgggcttgccagacacaggaggacagattgtctatatactggaccaagttcgtgcactagaaaatgagatggttcttcgtttgaagaaacaagggcttgatttttccccaaagattctcattgttactcggctgataccagatgcaaaaggaacatcatgcaatcagcggcttgagagaattagtggaacacagcatacttacatattacgagttcccttcagaaatgaaaatgggatacttaagaaatggatatcaagatttgatgtgtggccatacttggaaacatttgctgaggatgctgctggtgaaattgctgctgaattacaaggtactccggacttcataattggaaactatagtgatggaaatcttgtggcatcattgctatcttacaagatgggaattacccagtgcaatattgctcatgctctggaaaagactaaatatccagattcagatatatactggaagaagttcgatgagaaatatcatttctcctgtcagttcactgctgatataattgctatgaacaatgctgattttatcatcaccagcacataccaagaaattgctggaagcaaaaatactgttggacagtatgagagtcatactgcttttactctgcctggactgtaccgcgttgtccatgggattgatgtcttcgatccaaagttcaatatagtctctcctggagctgacatgtccatatattttccacataccgaaaaggccaagcggctcacttctcttcatggttcaatcgaaaatttgctttatgacccagagcaaaatgatcaacacacatgtgagtactttctgttatcctgtgggcatctggatgaccgatcaaaaccaatcctcttctcaatggcaagacttgacagggtgaagaacataacaggactagttgaagcttttgctaaatgcactaagttgagggagctggtaaaccttgttgttgttgctgggtacaatgatgtcaagaagtccaaggacagagaagagatcgcagagatagagaaaatgcatgaacttattaagacctataacttgttcgggcagttccgctggatctctgctcagacaaacagggcccgtaacggcgagctctatcgctacatcgctgatactcatggtgcttttgtacagccagccttttatgaagcatttggtctcactgtcgtggaggccatgacctgtggacttcctactttcgcaacactccatggagggccagctgagattatagagcatggaatctcgggcttccacattgacccataccaccccgagcaggctgctaatttgatggctgacttcttcgagcgatgcaagcaagacccaaatcactgggtgaaaatatctgaagcaggacttaagcgcatatacgaaaagtacacatggaagatatactctgagaggttgatgacattggccggggtctatggtttctggaagtatgtgtccaagcttgagaggcgggagacaaggcgctaccttgagatgttctacatattgaagttccgcgagctggcgaagaccgtgccgcttgcaattgaccagccacagtag

SEQ ID NO: 2126 - protein, 817 aa, Sorghum bicolor
  misc_feature: Ceres ANNOT ID no. 6018569
  misc_feature (7)..(554): Pfam Id: Sucrose_synth Pfam Desc: Sucrose synthase
  misc_feature (565)..(755): Pfam Id: Glycos_transf_1 Pfam Desc: Glycosyl transferases group 1
  misc_feature (1)..(817): NCBI GI: 22121990 NCBI Desc: sucrose synthase 3 [zea mays]
  misc_feature (14)..(817): NCBI GI: 16797785 NCBI Desc: sucrose synthase [zea mays]
  misc_feature (1)..(812): NCBI GI: 6682841 NCBI Desc: sucrose synthase [citrus unshiu]
  misc_feature (1)..(812): NCBI GI: 6682995 NCBI Desc: sucrose synthase [citrus unshiu]
  misc_feature (4)..(812): NCBI GI: 2570067 NCBI Desc: second sucrose synthase [pisum sativum]
  misc_feature (4)..(812): SWISSPROT Homolog: EC 2.4.1.13 Sucrose synthase 2
  misc_feature: Useful for making plants with altered cell wall content and/or composition
  misc_feature: GREAT-hit functional homolog of the protein sequence encoded by LOCUS at4g02280
  misc_feature: Functional homolog of the protein sequence encoded by LOCUS at5g49190
  misc_feature: The sequence is a functional homolog of SEQ ID NO 12 in US patent 7091398
  misc_feature: Useful for making plants with altered carbohydrate content
  misc_feature: Functional homolog of the protein sequence given in SEQ ID NO 13777
  misc_feature: The sequence is a functional homolog of SEQ ID NO 2 in US patent 7091398
  misc_feature: Useful for making plants with altered cell wall content and/or composition
  misc_feature: Functional homolog of the protein sequence given in SEQ ID NO 13778
MSAPKLDRNASIRDRVEDTLHAHRNELVALLSKYVNKGKGILQPHHILDALDEVQGSGVRALAEGPFLDVLRSAQEAIVLPPFVAIAVRPRPGVWEYVRVNVHELSVEQLTVSEYLRFKEDLVDGQHNDPYILELDFEPFNASVPRPNRSSSIGNGVQFLNRHLSSIMFRNRDCLEPLLDFLRGHRHKGHVMMLNDRVQSLGRLQSVLTKAEEYLSKLPAETPYAQFAYKFQEWGLEKGWGDTAEHVLEMVHLLLDIIQAPDPSTLEKFLGRIPMIFNVVVVSPHGYFGQANVLGLPDTGGQIVYILDQVRALENEMVLRLKKQGLDFSPKILIVTRLIPDAKGTSCNQRLERISGTQHTYILRVPFRNENGILKKWISRFDVWPYLETFAEDAAGEIAAELQGTPDFIIGNYSDGNLVASLLSYKMGITQCNIAHALEKTKYPDSDIYWKKFDEKYHFSCQFTADIIAMNNADFIITSTYQEIAGSKNTVGQYESHTAFTLPGLYRVVHGIDVFDPKFNIVSPGADMSIYFPHTEKAKRLTSLHGSIENLLYDPEQNDQHTCEYFLLSCGHLDDRSKPILFSMARLDRVKNITGLVEAFAKCTKLRELVNLVVVAGYNDVKKSKDREEIAEIEKMHELIKTYNLFGQFRWISAQTNRARNGELYRYIADTHGAFVQPAFYEAFGLTVVEAMTCGLPTFATLHGGPAEIIEHGISGFHIDPYHPEQAANLMADFFERCKQDPNHWVKISEAGLKRIYEKYTWKIYSERLMTLAGVYGFWKYVSKLERRETRRYLEMFYILKFRELAKTVPLAIDQPQ

SEQ ID NO: 2127 - DNA, 2664 bp, Sorghum bicolor
  misc_feature: Ceres ANNOT ID no. 6018571
  misc_feature: Encodes the peptide sequence at SEQ ID NO 2128
atgcagacccggccgcccaccgtacccgcgtcgtcgtctctggagtgcgtgagctcgtgcacggccgcctcgtggaaggggggcggaaggccctacgaatgcagcgtactctcttgcgcgtggaacgcgccgcgcgcgctcacgggcgcgctcgccagcaccgcgcagtgctcctcgtgcggccacgccgaggccggaggcggctggaggaggcgcgggcgctcgcgtcggagtaacaactcgttactgcatatcacctttgatgaggacatcaatagagggaaatttggttatgatccatcacctgcctactctgcaagttttgtcagaccttggtctactactgtcgacccaacatggagagcttactgctattcatcatctgaatccttcatcatctccccagagactttgtgggaggatctcaaaccagctgtttcatatcttcaacctgaagagttaaactttgtgcgtgacgctttgaagttggcgtacgaagcacacagtggacaaaaacggcgaagtggagaaccattcattattcatcctgtcgaagttgctcgtatccttggagagcatgaacttgactgggaatccattgctgctggtttattgcatgacactgttgaagatacagacgtggttacctttgaaagaatagaaaatgagtttgggccaactgtgcgccgtattgttgaaggggagacaaaggtatctaagttggggaaacttcagtgtaaaagtgaaggtagctcgaaacaagatcttaaagcagacgacctaaggcagatgtttcttgccatgacagaagaggttcgtgtgatcatcgtcaaactggcagacaggttgcataacatgcgtactctcacacatatgcctcagcacaagcagtatgccatcgccatggagacactgcaggtctttgcccctctagcaaaactccttgggatgtaccgtataaagtctgagctggaatatctatccttcatgtacgttaaccccactggttttgctgaactaaggaaaagagttgaagacctgtacaaggcccatgaacaagaattggaagaggcgaataggattttaaggcaaaagattgttgaggatcagtttcttgatcttgttagtgttgaaacagaagtgcgctcagtttacaaagagctctacagcatttacaaaagtacactcaaatccaagagttcaataaacgaggtgaatcaggttgctcagctgaggatcatcataaaaccaaaatcctgcaatggtgttgggccattgtgcactgcacaacagatctgctatcatgttcttggccttgttcatggtatatggacacccattcctcaagctgtgaaagattacattgcaactccaaaacctaatggctaccaaagtctacacacaacagtgataccatttcttaacgagagtatgttccatttggaagttcagataagaacagaagatatggatttaatagcagaaagaggtattgctgcacattacagtggaagaggggtggtttctggacctgttcgccctggaatatcaagtggaagaaatgccaaggggaaagtaatctgcttgaacaacacaggctttgctctgaggattggttggctcaatgcaatccgtgagtggcaggaagagtttgttggtaatatgagttctagggaatttgttgatactatcacccgagatcttctgggaagccgtgtctttgtgtttactcctaaaggcgagattaaaaacctgcctgagggagccacagtggttgattatgcttatctgatccatactgaaatcggcaacaaaatgattgcagcaaaggtgaatggcaatctggtttcaccaatccatgtacttgcaaatgctgaagtggtggagattataacttatgataaattatctagtaagtatgctttccagcgtcaccagcagtggctacagcacgcaaaaactcgcagtgctaggcacaaaattatgaaattcttaagggagcaagctgctctttctgctgctgaaattactgctgacgcagttaataattttgttgcggatcttgaagacgaaagtgatagtgagctttcacttccaagcaccaagaacgaagatagtaaattcaactgggagaagatattaagttctgataaattattctttgtcaacaaaagtagcgatggttttttacctgttaataatgtccatccaaagctcaatgggaagcaaaacaaaactgttaaggagttgggcatcaaaatcaatggtcattctacaattcgaggtgatagcttcaatgagttaatgcaccctggcaattccacctgcaaggaagttttccctggtttggatcgctggaaatctggtaaaatttctagttggcatagtacggaaggcaactctgtccaatggctttgcatagcctgtgttaaccgaaaagggatgatggcggaggttacatcagctcttacagcttgtggaattaccatatgttcttgtgtggcagaagtcaataaaaggaggggaatgggtgtgatgctgttccattttgagggaagctatgagaatgtggtcagtgcatgttccagtgttgacatgattcttggtgttcttggttggtctgtgggatgtagctggtgtccattgggtgttcttgagtgctag

SEQ ID NO: 2128 - protein, 887 aa, Sorghum bicolor
  misc_feature: Ceres ANNOT ID no. 6018571
  misc_feature (383)..(506): Pfam Id: RelA_SpoT Pfam Desc: Region found in RelA / SpoT proteins
  misc_feature (573)..(632): Pfam Id: TGS Pfam Desc: TGS domain
  misc_feature (179)..(286): Pfam Id: HD Pfam Desc: HD domain
  misc_feature (11)..(887): NCBI GI: 30268666 NCBI Desc: rela-spot like protein rsh1 [nicotiana tabacum]
  misc_feature (11)..(887): NCBI GI: 110742286 NCBI Desc: rsh1 [arabidopsis thaliana]
  misc_feature (431)..(815): NCBI GI: 3377803 NCBI Desc: similar to (p)ppgpp synthetase; t2h3.9 [arabidopsis thaliana]
  misc_feature (138)..(502): NCBI GI: 46199657 NCBI Desc: guanosine-3',5'-bis(diphosphate) 3'-pyrophosphohydrolase [thermus thermophilus hb27]
  misc_feature (138)..(502): NCBI GI: 55981686 NCBI Desc: guanosine-3',5'-bis(diphosphate) 3'-pyrophosphohydrolase (ppgpp synthase) [thermus thermophilus hb8]
MQTRPPTVPASSSLECVSSCTAASWKGGGRPYECSVLSCAWNAPRALTGALASTAQCSSCGHAEAGGGWRRRGRSRRSNNSLLHITFDEDINRGKFGYDPSPAYSASFVRPWSTTVDPTWRAYCYSSSESFIISPETLWEDLKPAVSYLQPEELNFVRDALKLAYEAHSGQKRRSGEPFIIHPVEVARILGEHELDWESIAAGLLHDTVEDTDVVTFERIENEFGPTVRRIVEGETKVSKLGKLQCKSEGSSKQDLKADDLRQMFLAMTEEVRVIIVKLADRLHNMRTLTHMPQHKQYAIAMETLQVFAPLAKLLGMYRIKSELEYLSFMYVNPTGFAELRKRVEDLYKAHEQELEEANRILRQKIVEDQFLDLVSVETEVRSVYKELYSIYKSTLKSKSSINEVNQVAQLRIIIKPKSCNGVGPLCTAQQICYHVLGLVHGIWTPIPQAVKDYIATPKPNGYQSLHTTVIPFLNESMFHLEVQIRTEDMDLIAERGIAAHYSGRGVVSGPVRPGISSGRNAKGKVICLNNTGFALRIGWLNAIREWQEEFVGNMSSREFVDTITRDLLGSRVFVFTPKGEIKNLPEGATVVDYAYLIHTEIGNKMIAAKVNGNLVSPIHVLANAEVVEIITYDKLSSKYAFQRHQQWLQHAKTRSARHKIMKFLREQAALSAAEITADAVNNFVADLEDESDSELSLPSTKNEDSKFNWEKILSSDKLFFVNKSSDGFLPVNNVHPKLNGKQNKTVKELGIKINGHSTIRGDSFNELMHPGNSTCKEVFPGLDRWKSGKISSWHSTEGNSVQWLCIACVNRKGMMAEVTSALTACGITICSCVAEVNKRRGMGVMLFHFEGSYENVVSACSSVDMILGVLGWSVGCSWCPLGVLEC

SEQ ID NO: 2129 - DNA, 705 bp, Sorghum bicolor
  misc_feature: Ceres ANNOT ID no. 6018625
  misc_feature: Encodes the peptide sequence at SEQ ID NO 2130
atggaggatgggagcggcagctcgtcgtctccagccatcctacggaacaagtactggatcctccgccacggccgcagcgtccccaacgagcgcggcctcatcgtctcatctctggagaacggcacgaagccggagttcgggttggccccgcagggtgtcgagcaggcccgcgcggccggcgaacagttccggaaggagcttgaggagattggtgtgccggtggattctgtcaagattcgttactcaccgttcacacggaccaccgagacggctagagtggtcgccggtgtgcttggcatcccctttgagggtcctagctgcgaagcggtgctgggactccgtgagcgctactttgggccatcatatgagttactttcacatgataagtatgcagacatatggtcagtagatgaagcgcatccctattcggctcctgaaggtggtgagagtgttgcagatgttgctagtagattttcagctgtgttgtcatctatggagacagagtttaatggctctgcaattcttattgtcagccatggtgatccactacaaatctttcaagctgtcctcagtggagccaaggagaacttgtctttcctcgacaatctgaccaacctgaaagcgaaagacacggtggtggcatccattctgtcaccgcaccgtaagtttgcgctcaacacaggagacctgcgccaagttgtgtaa

SEQ ID NO: 2130 - protein, 234 aa, Sorghum bicolor
  misc_feature: Ceres ANNOT ID no. 6018625
  misc_feature (17)..(186): Pfam Id: PGAM Pfam Desc: Phosphoglycerate mutase family
  misc_feature (1)..(234): NCBI GI: 116308905 NCBI Desc: h0515c11.13 [oryza sativa (indica cultivar-group)]
  misc_feature (3)..(234): NCBI GI: 38344128 NCBI Desc: osjnbb0072n21.7 [oryza sativa (japonica cultivar-group)]
  misc_feature (17)..(192): NCBI GI: 67922863 NCBI Desc: phosphoglycerate/bisphosphoglycerate mutase [crocosphaera watsonii wh 8501]
  misc_feature (11)..(192): NCBI GI: 115438993 NCBI Desc: os01g0660900 [oryza sativa (japonica cultivar-group)]
  misc_feature (20)..(195): NCBI GI: 67987081 NCBI Desc: phosphoglycerate/bisphosphoglycerate mutase [kineococcus radiotolerans srs30216]
MEDGSGSSSSPAILRNKYWILRHGRSVPNERGLIVSSLENGTKPEFGLAPQGVEQARAAGEQFRKELEEIGVPVDSVKIRYSPFTRTTETARVVAGVLGIPFEGPSCEAVLGLRERYFGPSYELLSHDKYADIWSVDEAHPYSAPEGGESVADVASRFSAVLSSMETEFNGSAILIVSHGDPLQIFQAVLSGAKENLSFLDNLTNLKAKDTVVASILSPHRKFALNTGDLRQVV

SEQ ID NO: 2131 - DNA, 1281 bp, Sorghum bicolor
  misc_feature: Ceres ANNOT ID no. 6018663
  misc_feature: Encodes the peptide sequence at SEQ ID NO 2132
atgacctcacacgtcaacaggtcgctgccttttctcatcgccccgtcggaggccacgcccgccggcgccctccccctcaccgccatggacagagctcttgcttcccttcctatgacagcgctgttcgtcttcgagaaccccatcgatcagccagccgaaaccatagcgagagctctgtcccgtgcgcttgttccctactacccaatggccggccgcctcaccatcaccggcgaccagctgaaaatcgcgtgcaccggcgagggcgtcgcgttcgctggcgcgtccgcgagctgcaccctgcaggaggccgggctctccggcccgcgtccggtgatcaccgtcgaggacctcactatgaactacgccggccagtacagcacggaggaaccgccgttgttgctggtgcaggtgaccgagttctcctgcggtggcttcgccgtcggggtgacgtggaaccacgtcgtcaccgacggcgccgggatggcgcagttcttgcaggccgtcggcgagtttgcccgcgggttcccttcttccccttctgtctggccggtgagggtggaccacgccctccctgagcttcccccgccgataacaaacatgaccaaggcactcgtcggcggccagcacagcgacttcccatcctcctacatcactgttccgctcagcttcatcgaccacgtcaaggatgagttccgtcgccgtcgcagcagcggcgaggtggcgccggcgtcgtgcaccgcgttcgatgtcttcacggccgccatatggaagtgtcgtgcacgcgcgacgatcgccagcgccgcctgccaggacgctcccacggtgctcaccttcaccgtgaacgtgaggaagccggcgaaggccaaggacggctactacggcaacgtcttcgccttcggccttgctgcctcgacgctgcgtgaggtcgccgacggcgacatccttgacctcgtgaggctggtaaaggatgccaaggcacgggtcccgtacacgtttgctgacggagcggcgtacatcgccgacgagatgggcggccggctcaagggcctcgacggttatgacaccttgtatgtgaccagctggtggaatctcggcttggacgacgtcgacttcggcagcggcggcgctgaacgtgtccttgggaacatggagcgcaaggtggtgccaggctgcatcctgtgtgggaggaaggacaaggccgacggtgtcgccgccatggcgctctgtgtcaagcaggagcacgtggagaccttccatgcggagctgcaaagcctcaagtga

SEQ ID NO: 2132 - protein, 426 aa, Sorghum bicolor
  misc_feature: Ceres ANNOT ID no. 6018663
  misc_feature (3)..(425): Pfam Id: Transferase Pfam Desc: Transferase family
  misc_feature (1)..(426): NCBI GI: 115457220 NCBI Desc: os04g0194400 [oryza sativa (japonica cultivar-group)]
  misc_feature (5)..(422): NCBI GI: 11034585 NCBI Desc: 10-deacetylbaccatin iii-10-o-acetyl transferase-like [oryza sativa (japonica cultivar-group)]
  misc_feature (13)..(425): NCBI GI: 115434876 NCBI Desc: os01g0179000 [oryza sativa (japonica cultivar-group)]
  misc_feature (1)..(425): NCBI GI: 84570492 NCBI Desc: acyltransferase [iris hollandica]
  misc_feature (1)..(425): NCBI GI: 96775754 NCBI Desc: acyltransferase [iris x hollandica]
  misc_feature: Useful for making plants with altered carbohydrate content
  misc_feature: Functional homolog of the protein sequence given in SEQ ID NO 13775
MTSHVNRSLPFLIAPSEATPAGALPLTAMDRALASLPMTALFVFENPIDQPAETIARALSRALVPYYPMAGRLTITGDQLKIACTGEGVAFAGASASCTLQEAGLSGPRPVITVEDLTMNYAGQYSTEEPPLLLVQVTEFSCGGFAVGVTWNHVVTDGAGMAQFLQAVGEFARGFPSSPSVWPVRVDHALPELPPPITNMTKALVGGQHSDFPSSYITVPLSFIDHVKDEFRRRRSSGEVAPASCTAFDVFTAAIWKCRARATIASAACQDAPTVLTFTVNVRKPAKAKDGYYGNVFAFGLAASTLREVADGDILDLVRLVKDAKARVPYTFADGAAYIADEMGGRLKGLDGYDTLYVTSWWNLGLDDVDFGSGGAERVLGNMERKVVPGCILCGRKDKADGVAAMALCVKQEHVETFHAELQSLK

SEQ ID NO: 2133 - DNA, 1686 bp, Sorghum bicolor
  misc_feature: Ceres ANNOT ID no. 6018682
  misc_feature: Encodes the peptide sequence at SEQ ID NO 2134
atgggggtgctcacatcgacggagctcaacttcctcgtcttccgctacctgcaggagtcaggttttattcatgctgcatttactctaggttatgaagctgggatccataagggtggcattgatggcaatgcagtcccacctggtgctcttatcactattgtgcagaaaggcctccagtacatagaactggaagcaaataacgatgagaatgatgatgaagttgagagggattttgcgcttctggagccacttgaaatcatcacaaaagatgttgaagagttgcaacagattgtgaaaaagaggaaattggagagatctcaaactgaacatgagaaggataagggaaaagagaaagaacgtaatgaggagcatgaacgacgtcctgttggcgaacgggagagggaacgccatgacaaagaaaaagagcaagtcagggagaaggatagatctgaaaaagataaggaccatgataaagagaaggagaaagagaaagaaagagaaaggcagcatgcagagcgtattgataaggttaagcacgaggatgattctcttgctggtggaggtcccactccaatggatgtaagtacaactgctcaggagatatctaacactgatgttactgttttggaaggacacagttcagaggttttcgcttgtgcatggagtccaactggttctcttctagcttctgggtcaggagactcaaccgctagaatctggacaattccagatggtccatgtggttccaacatgcaatcatctcctcccggtgttcatgttttaaaacattttaaaggtcgtaccaatgaaaagagcaaggatgtcaccacacttgactggaatggtgaaggtacactactggctacgggctcctacgatggacaggcaagaatatggagtagagatggagaccttaagcagacactgttcaaacacaagggacccatattttcattgaaatggaataagaaaggagattttctcctaagtggaagtgttgataaaactgctattgtttgggatacaaagacatgggaatgcaagcagcagtttgaatttcattcagctccaacacttgatgttgattggagaaataataactcttttgcaacatgttcaaccgataacatgatctatgtatgcaagattggggaacagcgtccagttaaaacattcagtggtcatcagaatgaagttaatgctatcaagtgggatccgactggttcttttttggcttcatgttctgatgattggacagcaaagatatggagtatgaaacaagacaaatgtttattcgatttcaaggagcataccaaggaaatatacactattcggtggagcccaacaggcccaggaacaaacaatcctaatcagcagttgctgttggctagcgcatcttttgattcaactatcaagctttgggaagttgagcatggacgccttctgtacagcttgtctggtcataggcaaccagtgtattctgttgcatttagccctgacggtgaatacttagcgagtgggtccttggatcagtgcctacacatctggtctgtgaaagaaggcaggatcctgaagacctacagaggtagtgggggcatattcgaagtttgctggaacaaagaaggcagcaagattgctgcctgtttctcgaacaacaccgtctgcgtgatggatttcaggatgtag

SEQ ID NO: 2134 - protein, 561 aa, Sorghum bicolor
  misc_feature: Ceres ANNOT ID no. 6018682
  misc_feature (203)..(241): Pfam Id: WD40 Pfam Desc: WD domain, G-beta repeat
  misc_feature (262)..(300): Pfam Id: WD40 Pfam Desc: WD domain, G-beta repeat
  misc_feature (303)..(341): Pfam Id: WD40 Pfam Desc: WD domain, G-beta repeat
  misc_feature (345)..(382): Pfam Id: WD40 Pfam Desc: WD domain, G-beta repeat
  misc_feature (386)..(424): Pfam Id: WD40 Pfam Desc: WD domain, G-beta repeat
  misc_feature (428)..(475): Pfam Id: WD40 Pfam Desc: WD domain, G-beta repeat
  misc_feature (479)..(517): Pfam Id: WD40 Pfam Desc: WD domain, G-beta repeat
  misc_feature (7)..(33): Pfam Id: LisH Pfam Desc: LisH
  misc_feature (1)..(561): NCBI GI: 115471661 NCBI Desc: os07g0405100 [oryza sativa (japonica cultivar-group)]
  misc_feature (183)..(560): NCBI GI: 82240309 NCBI Desc: f-box-like/wd-repeat protein tbl1xr1-a (transducin beta-like 1x related protein 1-a) (nuclear receptor corepressor/hdac3 complex subunit tblr1-a) (tbl1-related protein
  misc_feature (183)..(560): NCBI GI: 82240309 (continued) 1-a) (xtblr1)
  misc_feature (183)..(560): NCBI GI: 62859665 NCBI Desc: tbl1xr1 [xenopus tropicalis]
  misc_feature (191)..(560): NCBI GI: 5032159 NCBI Desc: transducin beta-like 1x [homo sapiens]
  misc_feature (191)..(560): NCBI GI: 21619190 NCBI Desc: tbl1x protein [homo sapiens]
  misc_feature: The sequence is a functional homolog of SEQ ID NO. 502 in the 11/188,298 US application
  misc_feature: The sequence is a functional homolog of SEQ ID NO. 485 in the 11/188,298 US application
MGVLTSTELNFLVFRYLQESGFIHAAFTLGYEAGIHKGGIDGNAVPPGALITIVQKGLQYIELEANNDENDDEVERDFALLEPLEIITKDVEELQQIVKKRKLERSQTEHEKDKGKEKERNEEHERRPVGERERERHDKEKEQVREKDRSEKDKDHDKEKEKEKERERQHAERIDKVKHEDDSLAGGGPTPMDVSTTAQEISNTDVTVLEGHSSEVFACAWSPTGSLLASGSGDSTARIWTIPDGPCGSNMQSSPPGVHVLKHFKGRTNEKSKDVTTLDWNGEGTLLATGSYDGQARIWSRDGDLKQTLFKHKGPIFSLKWNKKGDFLLSGSVDKTAIVWDTKTWECKQQFEFHSAPTLDVDWRNNNSFATCSTDNMIYVCKIGEQRPVKTFSGHQNEVNAIKWDPTGSFLASCSDDWTAKIWSMKQDKCLFDFKEHTKEIYTIRWSPTGPGTNNPNQQLLLASASFDSTIKLWEVEHGRLLYSLSGHRQPVYSVAFSPDGEYLASGSLDQCLHIWSVKEGRILKTYRGSGGIFEVCWNKEGSKIAACFSNNTVCVMDFRM

SEQ ID NO: 2135 - DNA, 2322 bp, Sorghum bicolor
  misc_feature: Ceres ANNOT ID no. 6018708
  misc_feature: Encodes the peptide sequence at SEQ ID NO 2136
  misc_feature: Up-regulated in root tissues in response to aminocyclopropane carboxylic treatment
atggtggtgggaacggcgctgctgcgcggcggggtctccatctccatctcctcggtgtggatcctcctgttcctctcctccctgctcctcctctcgccgtcggcggcgtccgtcgacttcagccactgcggcggctgcgacgacgccgacgacggcgccctctccagcgcctacaacatcctgcagtgccagaaggtcagcgacttcctcatcgccgcggcctacttctccatcccgctcgagctgctctacttcgccacctgctccgacctcttccccctcaaatggatcgtgctgcagttcggcgccttcatcgtgctctgcggcctcacgcacctcatcaccgtcttcacctacgagccgcactccttccacctcgtgctcgccctcaccgtcgccaagttcctcactgcactcgtctccttcgccacggccatcaccctgctcacgctcataccgcagctcctcagggtcaaggtcagggaaaacttcctgatgaacaaggcgcgcgagctggaccgggaggtggggatgatgaaaaggaaagaggaggccagctggcacgtgcgcatgctcacgcaggagatccgcaagtcgctcgacaggcacaccatcttgtacaccaccatggttgagctctcaaaggcgctggagctgcagaactgtgctgtctggatgcctaatgagaccaggagcgagatgatcttgacgcatcagctgagggaaagggatataatggacccacagaaccgctctattcctatcgatgatccggatgttctagaaataaaggcgaccaaggatgcaaaagttattgggccagattcggcgctaggggttgctagccgaagcaagcttgaagcagggcctgtggctgcaataaggatgccgatgttaagggtgtcgaacttcaaaggagggactccggaagtgatgcagacgagctatgccatcttggttctggttttgcctaatgatgcttcgttagggtggggtcggagagagctggagattgttgaagtagttgctgaccaagttgcagtcgctctgtcacatgctgcgctcctagaggagtctcagctgatgcgagagaagcttgccgagcagcatagggacttgctacgggcaaagcatgaagccatgagggcaggggaagctcggaattccttccagactgcaatgtacgatggaatgcgaaggccaatgcactcaatccttggtctcgtctcgatgatgcaacaggagagcatgaatccagagcaaaggcttgtgatggatgccattgccaagacaagcagtgttgcatccacgctgatgaacgatgtgatgcaaacatcaacaatgaattgtgagcacttgtctttggtaaggaggccggtcaaccttcattcctttatcaaagaagctgttggagtggtcagatgtctaactggttgcaagggtgtggagtttgagtttcaagtggataattctttgccagaaaggatcattggtgatgagaagagagtcttccatattgtcctgcacatggtaggcaccctaataaaccgatgtaatgccggctgtatctcgttatatgttagtggtcataatgaggttgaagagaggcataatcatgactggatgctgcgaagagcaaacttctctggaggctatgtatgtgtcaaatttgagattagggttagaaaatccaaggacaatcttttgagttcatcaagcagtgagataaggcatgggtccaaacccaacaattctgagatggggcttagcttcaatatgtgtaagaagattgtgcagatgatgaatggtaatatttggtcagtatcagattctaaatgcattggagaaaccatcatgcttgtcctccagttccagttgcaacctgtgactccagtctctggagcgtcgtcagatttgtaccgatcgtccgccattcccaactttaatgggctcagagtcctccttgcggacagtgatgacaccaaccgagctgtaactcacaggcttctggagaagcttggttgccgagtcctatcagtcgcttctggtgtccaatgcatgagctcctttgctgccgagtcatccttccagctggtgattcttgatcttgccatgcagacgatggacggattcgaagtagcccgcgcgatcaggaagttcagtagcaatagttggctgccgttgattgttgccctagcagcaagaatcgacgacaacatccgggatcgatgccagaggtcaggaataaatggcctgatccagaaaccagtcacactagctgcactgggagatgaactgtatagagtccttcagaacaattaa

SEQ ID NO: 2136 - protein, 773 aa, Sorghum bicolor
  misc_feature: Ceres ANNOT ID no. 6018708
  misc_feature (651)..(767): Pfam Id: Response_reg Pfam Desc: Response regulator receiver domain
  misc_feature (201)..(350): Pfam Id: GAF Pfam Desc: GAF domain
  misc_feature (1)..(773): NCBI GI: 38607378 NCBI Desc: ethylene receptor [zea mays]
  misc_feature (1)..(773): NCBI GI: 38607380 NCBI Desc: ethylene receptor [zea mays]
  misc_feature (16)..(773): NCBI GI: 115457086 NCBI Desc: os04g0169100 [oryza sativa (japonica cultivar-group)]
  misc_feature (16)..(773): NCBI GI: 24464588 NCBI Desc: ethylene receptor-like protein 1 [oryza sativa]
  misc_feature (27)..(770): NCBI GI: 54260394 NCBI Desc: ethylene receptor [pyrus pyrifolia]
  misc_feature: Up-regulated in root tissues in response to aminocyclopropane carboxylic treatment
  misc_feature: The sequence is a functional homolog of SEQ ID NO. 378 in the 11/188,298 US application
MVVGTALLRGGVSISISSVWILLFLSSLLLLSPSAASVDFSHCGGCDDADDGALSSAYNILQCQKVSDFLIAAAYFSIPLELLYFATCSDLFPLKWIVLQFGAFIVLCGLTHLITVFTYEPHSFHLVLALTVAKFLTALVSFATAITLLTLIPQLLRVKVRENFLMNKARELDREVGMMKRKEEASWHVRMLTQEIRKSLDRHTILYTTMVELSKALELQNCAVWMPNETRSEMILTHQLRERDIMDPQNRSIPIDDPDVLEIKATKDAKVIGPDSALGVASRSKLEAGPVAAIRMPMLRVSNFKGGTPEVMQTSYAILVLVLPNDASLGWGRRELEIVEVVADQVAVALSHAALLEESQLMREKLAEQHRDLLRAKHEAMRAGEARNSFQTAMYDGMRRPMHSILGLVSMMQQESMNPEQRLVMDAIAKTSSVASTLMNDVMQTSTMNCEHLSLVRRPVNLHSFIKEAVGVVRCLTGCKGVEFEFQVDNSLPERIIGDEKRVFHIVLHMVGTLINRCNAGCISLYVSGHNEVEERHNHDWMLRRANFSGGYVCVKFEIRVRKSKDNLLSSSSSEIRHGSKPNNSEMGLSFNMCKKIVQMMNGNIWSVSDSKCIGETIMLVLQFQLQPVTPVSGASSDLYRSSAIPNFNGLRVLLADSDDTNRAVTHRLLEKLGCRVLSVASGVQCMSSFAAESSFQLVILDLAMQTMDGFEVARAIRKFSSNSWLPLIVALAARIDDNIRDRCQRSGINGLIQKPVTLAALGDELYRVLQNN

SEQ ID NO: 2137 - DNA, 1440 bp, Sorghum bicolor
  misc_feature: Ceres ANNOT ID no. 6018793
  misc_feature: Encodes the peptide sequence at SEQ ID NO 2138
atggcgacgacggcggcggcggacgggcccccggtagagccgcagtccctgaagaagctgagcctccggtcgctgaaacggtccctggacctcttcgcgcccgcgcacgccctcctcttcacgcccgatgccgagagcaagaggattcgtaccgggtgtaaggtgagggcggagtacggcgcggtgaaggacctgccgcccgagcaagggcgcggagggcagggcaagggttctgcgccgacgtcgtcgacggcgttggcactgccaggaacacaggatacaaaagatggtcacagagaaggcactagtaatgccattgtccctgtgccacttatgctgccaaaagcacctgagtctaccatacctggcaaaaatacaactatgtcaattcctggatcatctgacagattttctacatctgcactgatggaaaggatacctagtagatggccacggcctacatggcatgctccttggaagaactatcgggtcatcagtggtcacttgggatgggttcgatctattgcatttgatccagggaatgaatggttctgcactggttctgctgataggacaataaagatatgggatcttgcatcaggaaccctgaagcttacactgactggtcacattgaacaaattcgtggacttgctgtcagccaacgtcacacttatttattttctgctggtgatgacaaacaagtaaaatgttgggatcttgaacaaaacaaggttattaggtcataccatgggcatctgagtggtgtttactgcctagctctccatccaacaattgatatcttactgactggtggtcgagattcagtttgcagggtgtgggacatcagaacaaaagcacatgtttctgctttaacagggcatgacaacactgtctgttcagtgtttgctcggcctacggatcctcaagttgtcactggttcacatgatacaactattaaattctgggatcttgtagctgggaggactatgtgtactcttacacaccataaaaagtctgtccgagctatggcacttcatccaaaggagaaagcatttgcatcagcgtcagcagacaacataaagaagtttagccttcccagaggcgaatttctgcacaacatgctgtcgcagcagaaaacaattatcaattcaatggctgtcaatgaggatggtgtcttggcaactggaggggataatggaagcctgtggttttgggactggaagagtggccataactttcaacaagatcagactatagtccagcctggatcactggagagcgaggcatgcatatatgccctggcctatgacgccagtggatcaaggcttgtgacctgcgaggcggataagaccataaagatgtggaaggaggacttaacagcgacgccagagactcatcccatcaatttcaagcccccaaaggacatccgaagatattga

SEQ ID NO: 2138 - protein, 479 aa, Sorghum bicolor
  misc_feature: Ceres ANNOT ID no. 6018793
  misc_feature (159)..(197): Pfam Id: WD40 Pfam Desc: WD domain, G-beta repeat
  misc_feature (201)..(239): Pfam Id: WD40 Pfam Desc: WD domain, G-beta repeat
  misc_feature (243)..(281): Pfam Id: WD40 Pfam Desc: WD domain, G-beta repeat
  misc_feature (285)..(323): Pfam Id: WD40 Pfam Desc: WD domain, G-beta repeat
  misc_feature (7)..(479): NCBI GI: 115452915 NCBI Desc: os03g0339100 [oryza sativa (japonica cultivar-group)]
  misc_feature (11)..(479): NCBI GI: 21537191 NCBI Desc: prl1 protein [arabidopsis thaliana]
  misc_feature (11)..(479): NCBI GI: 7268338 NCBI Desc: prl1 protein [arabidopsis thaliana]
  misc_feature (12)..(479): NCBI GI: 56382029 NCBI Desc: at3g16650 [arabidopsis thaliana]
  misc_feature (12)..(479): NCBI GI: 15809828 NCBI Desc: at3g16650/mgl6_10 [arabidopsis thaliana]
  misc_feature: The sequence is a functional homolog of SEQ ID NO. 485 in the 11/188,298 US application
  misc_feature: The sequence is a functional homolog of SEQ ID NO. 502 in the 11/188,298 US application
MATTAAADGPPVEPQSLKKLSLRSLKRSLDLFAPAHALLFTPDAESKRIRTGCKVRAEYGAVKDLPPEQGRGGQGKGSAPTSSTALALPGTQDTKDGHREGTSNAIVPVPLMLPKAPESTIPGKNTTMSIPGSSDRFSTSALMERIPSRWPRPTWHAPWKNYRVISGHLGWVRSIAFDPGNEWFCTGSADRTIKIWDLASGTLKLTLTGHIEQIRGLAVSQRHTYLFSAGDDKQVKCWDLEQNKVIRSYHGHLSGVYCLALHPTIDILLTGGRDSVCRVWDIRTKAHVSALTGHDNTVCSVFARPTDPQVVTGSHDTTIKFWDLVAGRTMCTLTHHKKSVRAMALHPKEKAFASASADNIKKFSLPRGEFLHNMLSQQKTIINSMAVNEDGVLATGGDNGSLWFWDWKSGHNFQQDQTIVQPGSLESEACIYALAYDASGSRLVTCEADKTIKMWKEDLTATPETHPINFKPPKDIRRY

SEQ ID NO: 2139 - DNA, 2856 bp, Sorghum bicolor
  misc_feature: Ceres ANNOT ID no. 6018831
  misc_feature: Encodes the peptide sequence at SEQ ID NO 2140
atgctgctccacgccggaccctcgttccagctcgcgccaccaccgcgcttcgccgccgctgccgccccgtcgtcagcttcgccgaggagatcgaggacaccgcaatcctcgccgccgacgtcgcattccgcgcgcgccgctgcacccggggcccggagggtgcgtccggtcgcgccgagggcccccatggcgacgggggaggagggcgccggctctgacgtcggcctcgccgaggccacccaggtgttcttgttggatgcgagggcttactgggtgacaggatccttgattgcatgggatgtcagtgatcaggaaacttctctcttcttatatgcaagcagaaatgctacaatgtgcatgtcaagtggggttattgaaggttatgattccaaagttgagctgcaaccagaaaatgatggacttccatccagtgtgacccagaaattcccttttatcagctcttatagagccttcagaattccgagctctgttgatgttgataccttggtgaaatgtcaacttgctgttgcttcttttgatgctcatgggaacaggcaagatgttactgggttgcaactacctggagtattggatgacatgttcgcctacactggaccacttggtactatttttagtgagggagctgatgtaagtgtgaacttctatgatggtccagctggccctttactggaaacagttcaactcaacgaatcaaatggtgtttggagtgttactggtccaagaaactgggagaaccggtattatctatatgaagtcacagtatatcatccagctacagcaaacattgagaaatgtttagccgctgatccttatgctagagggctttctgcaaatagcacacggacttggttggttgatattaataatgaaacattaaagccacttgcctgggatggattggcggctgaaaagccaaagcttgattccttctctgacataagcatatacgaattgcacattcgtgatttcagtgcccatgatagcacagcggactgtcattttcgaggaggattctgtgcatttacatgtcaggattctgcaggcatagaacacctaaagaaactatctgatgctggtttgactcatgtccatttgttgccaagctttcagtttggtggtgttgatgacataaagaacaattggaaatgtgttgatgaggctgaactgtcaaaactccctccagggtcagatttgcaacaagctgcaattgtggctattcaggaagacgacccttataattgggggtataaccctgtgctttggggggttccgaaaggaagctatgcaagtaacccagatggtccaagtcgtatcattgagtaccgacagatggtgcaggccttgaatcggttaggtcttcgagttgtcatggatgttgtatacaatcatctatactcaagtggcccttttgccatcacttctgtgcttgacaagatcgtacctggatactaccttagaagggactctaatggtcagattgagaacagcgcagctgtgaacaatacagcaagtgagcatttcatggttgatagattaatcgtggatgaccttctgaattgggcagtaaattacaaagttgatggattcagatttgatctaatgggacatatcatgaaaaggacaatggttagagcaaaatcggctcttcaaagccttacaattgatgaacatggagtagatggttcaaagatatacttgtatggtgaaggatgggacttcggtgaagttgcgcaaaatcaacgtgggataaatggatcccagcttaatatgagtggcactggcattggtagtttcaacgatagagtccgtgatgctataaatggtggcagtccgtttgggaatccactacaacaaggtttctctactggattgttcttagagccaaatggattttatcagggcaatgaaacagagacaaggcgcacgcttgctacatacgctgaccatatacagattggattagctggcaatttgaaggactatgtattaatatctcaaactggagaagctaggaaaggatctgaaattcgcaccttcgatggctcaccagttggctatgcttcatcccctatagaaacaatcaactacgcctctgctcatgacaatgaaacactatttgatattattagtctaaagactccgatgaacctctcaattgacgagcgatgcaggataaatcatttgtccacaagcatgattgcattatcccagggaataccatttttccatgctggtgatgagatactacgatctaagtcgcttgatcgagattcatataactctggtgattggtttaacaagattgatttcacctatgaaacaaacaattggggtgttgggcttccaccaagagaaaagaatgaagggagttggcctttgatgaagccaagattggagaatccgtcattcaaacctgctaaatgtgacattattgctaccttagacaaatttgtcgatatcctgaagatcagatactcatcacctctctttcgtctaactacagcaagtgacattgagcaaagggttcactttcacaacacagggccctcctcggttccaggagttattgtcatgagcattgaagatgcacgaaatgataggcatgagatggctcagatagataaaaccttctcttgtgtcgttacagtcttcaatgtatgtccgcacgaagtgactatagaaatccctgatcttgcatcactggggcttcagttgcatccagtgcaggtgaattcatcagatgctttagtcaggcagtctgcctacgaggccaccacaggtcgattcaccgtgccaaaaagaacaacagcagtgtttgttgaacccaggtgctga

SEQ ID NO: 2140 - protein, 951 aa, Sorghum bicolor
  misc_feature: Ceres ANNOT ID no. 6018831
  misc_feature (324)..(852): Pfam Id: Alpha-amylase Pfam Desc: Alpha amylase, catalytic domain
  misc_feature (196)..(279): Pfam Id: Isoamylase_N Pfam Desc: Isoamylase N-terminal domain
  misc_feature (1)..(951): NCBI GI: 3411266 NCBI Desc: pullulanase-type starch debranching enzyme [zea mays]
  misc_feature (1)..(951): NCBI GI: 90265109 NCBI Desc: h0806h05.4 [oryza sativa (indica cultivar-group)]
  misc_feature (11)..(951): NCBI GI: 119633045 NCBI Desc: limit dextrinase type starch debranching enzyme [triticum aestivum]
  misc_feature (1)..(951): NCBI GI: 4959436 NCBI Desc: limit dextrinase [hordeum vulgare]
  misc_feature (63)..(951): NCBI GI: 9799064 NCBI Desc: limit dextrinase [hordeum vulgare]
MLLHAGPSFQLAPPPRFAAAAAPSSASPRRSRTPQSSPPTSHSARAAAPGARRVRPVAPRAPMATGEEGAGSDVGLAEATQVFLLDARAYWVTGSLIAWDVSDQETSLFLYASRNATMCMSSGVIEGYDSKVELQPENDGLPSSVTQKFPFISSYRAFRIPSSVDVDTLVKCQLAVASFDAHGNRQDVTGLQLPGVLDDMFAYTGPLGTIFSEGADVSVNFYDGPAGPLLETVQLNESNGVWSVTGPRNWENRYYLYEVTVYHPATANIEKCLAADPYARGLSANSTRTWLVDINNETLKPLAWDGLAAEKPKLDSFSDISIYELHIRDFSAHDSTADCHFRGGFCAFTCQDSAGIEHLKKLSDAGLTHVHLLPSFQFGGVDDIKNNWKCVDEAELSKLPPGSDLQQAAIVAIQEDDPYNWGYNPVLWGVPKGSYASNPDGPSRIIEYRQMVQALNRLGLRVVMDVVYNHLYSSGPFAITSVLDKIVPGYYLRRDSNGQIENSAAVNNTASEHFMVDRLIVDDLLNWAVNYKVDGFRFDLMGHIMKRTMVRAKSALQSLTIDEHGVDGSKIYLYGEGWDFGEVAQNQRGINGSQLNMSGTGIGSFNDRVRDAINGGSPFGNPLQQGFSTGLFLEPNGFYQGNETETRRTLATYADHIQIGLAGNLKDYVLISQTGEARKGSEIRTFDGSPVGYASSPIETINYASAHDNETLFDIISLKTPMNLSIDERCRINHLSTSMIALSQGIPFFHAGDEILRSKSLDRDSYNSGDWFNKIDFTYETNNWGVGLPPREKNEGSWPLMKPRLENPSFKPAKCDIIATLDKFVDILKIRYSSPLFRLTTASDIEQRVHFHNTGPSSVPGVIVMSIEDARNDRHEMAQIDKTFSCVVTVFNVCPHEVTIEIPDLASLGLQLHPVQVNSSDALVRQSAYEATTGRFTVPKRTTAVFVEPRC

SEQ ID NO: 2141 - DNA, 1449 bp, Sorghum bicolor
  misc_feature: Ceres ANNOT ID no. 6019540
  misc_feature: Encodes the peptide sequence at SEQ ID NO 2142
atggcctccggcaccggcaccggctcccgccagctgcaacccccagcagcggcggcagatgctgacccgggagccggcggcgacaagctcgtcttcgaggcgccgccgcagcccgtgagggacgactacgtcgagaacgccgtcaagttcctctcccacccaaaggtcaggggttcccccgtcgtctacaggcgatctttcctcgagaagaagggcctcaccaccgaggagatcgacgaggccttccgaagagtccctgatcctcaacccagcactacggctaccacttctccacagcagcaggtcaacagccaaaatcattccgctggcgtgcaaacttacactccagcgcaacctgtgcacccagcaactgctggccctgttgcccttcgaacacaacccaggttcagctggtaccaagcattcctcgctgcagggctcttgcttggttttggtgctagcgctgctgtctttatcaagaaactgttccttcctaggctcaagtcttggatacgcaatgtcgtagcggaaggtgatggcactgaaggcaaccaacttaaggccaggatagatgaggaaacagccgaggctgtaaaggcctctgcttcagctgtttctgctattgccaaaacaaaccaacatctgcttgcttcaaaggatgaagaaaagaagatactagtgacgttaacacatgctctagattcccaagccaaggagttaaaatccttgaccgagtcaatcagtcataccagggaacccatcaacattactagggatgataggttttctcagtaccgcccactggaagaccacgcccctcctgttatgaggaatggggcaattaacagttcatggagggcttctcagcaaactaacatgtacggtgcgtcaaacggtgactttggttctgcgaggtcttcattcgcgccagcacctgttgaacctacagctggatcattttcaagatcctatgccgagacgatgtccactacacaacgaggggataggtcttctggcagtaagccatgggagatgcagcagtattcgcaacagaggcctggttatggatccaactcccagttgagtgatgatggatcatactctgatgcccaggacagctatgctccttcctatcaccagaatggaaaggcccctgattttcaagcagatgaacctaggcctttgacctacaacactggggttgaggaaagaccgccgcctcagcgccgctgggtgccccctcagcctccaggtgtcgtgatgccagaagcagctgctgccatacgtcaaccaaagacccctccaaagcaaccctccagcaatgcctctgaggcagctggtgaggtgcaggtgaatggtgcctcaagtgcatcagatgctgtgactgaggttcctgttaatggtgctacggcaagtgatgctggacacagcgagatcgaagaacaatga

SEQ ID NO: 2142 - protein, 482 aa, Sorghum bicolor
  misc_feature: Ceres ANNOT ID no. 6019540
  misc_feature (39)..(167): Pfam Id: Pex14_N Pfam Desc: Peroxisomal membrane anchor protein (Pex14p) conserved region
  misc_feature (37)..(482): NCBI GI: 11094252 NCBI Desc: pex14 [arabidopsis thaliana]
  misc_feature (37)..(482): NCBI GI: 11121113 NCBI Desc: peroxin pex14 [arabidopsis thaliana]
  misc_feature (11)..(221): NCBI GI: 115434046 NCBI Desc: os01g0107000 [oryza sativa (japonica cultivar-group)]
  misc_feature (40)..(280): NCBI GI: 111609732 NCBI Desc: peroxin 14 [penicillium chrysogenum]
  misc_feature (40)..(247): NCBI GI: 4126964 NCBI Desc: peroxisomal membrane anchor protein [cricetulus longicaudatus]
MASGTGTGSRQLQPPAAAADADPGAGGDKLVFEAPPQPVRDDYVENAVKFLSHPKVRGSPVVYRRSFLEKKGLTTEEIDEAFRRVPDPQPSTTATTSPQQQVNSQNHSAGVQTYTPAQPVHPATAGPVALRTQPRFSWYQAFLAAGLLLGFGASAAVFIKKLFLPRLKSWIRNVVAEGDGTEGNQLKARIDEETAEAVKASASAVSAIAKTNQHLLASKDEEKKILVTLTHALDSQAKELKSLTESISHTREPINITRDDRFSQYRPLEDHAPPVMRNGAINSSWRASQQTNMYGASNGDFGSARSSFAPAPVEPTAGSFSRSYAETMSTTQRGDRSSGSKPWEMQQYSQQRPGYGSNSQLSDDGSYSDAQDSYAPSYHQNGKAPDFQADEPRPLTYNTGVEERPPPQRRWVPPQPPGVVMPEAAAAIRQPKTPPKQPSSNASEAAGEVQVNGASSASDAVTEVPVNGATASDAGHSEIEEQ

SEQ ID NO: 2143 - DNA, 255 bp, Sorghum bicolor
  misc_feature: Ceres ANNOT ID no. 6019544
  misc_feature: Encodes the peptide sequence at SEQ ID NO 2144
atgggaggccggatgttgttggtgcatgtgttccaggttctgcgtgaccgcgaccgtgagcgcgcggcggcgcggaagcccaacgccaagggctctcaggacgggctcaccccggagcagcgccgcgagagggacaagaaggcgctggaggagaaggcggccaagaaggcgcagcaggcagcggccggcggcaccgggacctccaccgacaacaacaacaacaacaacaagaataaggcaggtggcaagaagtag

SEQ ID NO: 2144 - protein, 84 aa, Sorghum bicolor
  misc_feature: Ceres ANNOT ID no. 6019544
  misc_feature (15)..(84): NCBI GI: 115485265 NCBI Desc: os11g0425600 [oryza sativa (japonica cultivar-group)]
  misc_feature (15)..(64): NCBI GI: 115463837 NCBI Desc: os05g0407100 [oryza sativa (japonica cultivar-group)]
  misc_feature (15)..(75): NCBI GI: 92879455 NCBI Desc: four f5 protein [medicago truncatula]
MGGRMLLVHVFQVLRDRDRERAAARKPNAKGSQDGLTPEQRRERDKKALEEKAAKKAQQAAAGGTGTSTDNNNNNNKNKAGGKK

SEQ ID NO: 2145 - DNA, 1176 bp, Sorghum bicolor
  misc_feature: Ceres ANNOT ID no. 6019546
  misc_feature: Encodes the peptide sequence at SEQ ID NO 2146
  misc_feature: Up-regulated in shoot tissues in response to methyl jasmonate treatment
atggagatgcaggacgaggcgatagtcgtcgtcgcgaggccagaagaagcagcagcagcagcggtcgtcgccgtgcgccgcatgaacagcagcggcgttggcaagatgagctacgccgacaactccgacttccagcgggtcatcgcctccgtcaccaagaaggccaggcaggagctggcggcggcgctgtaccgcgcccgtggccgcccggactccatggccatcgccgacctgggctgcgccacggggcccaacgcgctgctcaatgtgtccgacgccgtcgaggccgtgctggcggagaaccagcaccacccgccgccccagctccacgtcttcctcaacgacctccccgccaacgacttcaacgccgtcttccgcctgctgccgtcgtcgccgctcgccgccaccggctgctgcctggtgtcggcatggcctggatccttctacgagcgcgtcttcccggaggccagcctggactacgtcgtgtcctcaagcagcctgcacttcctgtccaaggcgccgacgatgaggatggagcatcccgttaaccttggccgcgtctacgtctccgagtccggccccgccgcggtgctggacgcctaccgctcccagttccacgccgacttcctcgctttcctctcctgccgcgccgtcgaggtgaggccccgcggactgctcctcctcaccttcgtcgccaggaggaccgcccgccccaccgcgcacgactgctacctctgggacctcctcgccgacgccctcatggacatggccgccgccggcctcgtcgacgaggaccaggtccacgccttcaacgcgccctactacagcccctgcccggacgacctcgccaaggtcatcgccaaggaaggctccttcaccgtcaggaccatgcagctcttcgtcaccacgcgccgctgcctcctcctccaggcccaggcacaggcggacgacgacgacgacgagttgccgcggtggctagccatggagacggcgagcaccgttagggcggtcgtggagcccatgctgcgaacgcacttcggctgggacgccatcgccatggatggactcttctgcaggtacagcctcctgctcgaggcatactaccgcagcaacaccagcagaaacaaggacgacctcaccaacgtcttcctcgtcttggagaagaaacagcactag

SEQ ID NO: 2146 - protein, 391 aa, Sorghum bicolor
  misc_feature: Ceres ANNOT ID no. 6019546
  misc_feature (56)..(389): Pfam Id: Methyltransf_7 Pfam Desc: SAM dependent carboxyl methyltransferase
  misc_feature (22)..(388): NCBI GI: 140067009 NCBI Desc: sam dependent carboxyl methyltransferase [medicago truncatula]
  misc_feature (137)..(374): NCBI GI: 6651395 NCBI Desc: floral nectary-specific protein [brassica rapa subsp. pekinensis]
  misc_feature (137)..(374): NCBI GI: 55442027 NCBI Desc: methyl transferase [brassica juncea]
  misc_feature (33)..(372): NCBI GI: 134303364 NCBI Desc: benzoic acid/salicylic acid methyltransferase [protoschwenkia mandonii]
  misc_feature (32)..(389): NCBI GI: 9279749 NCBI Desc: s-adenosyl-l-methionine:salicylic acid carboxyl methyltransferase-like protein; floral nectary-specific protein-like [arabidopsis thaliana]
  misc_feature: Up-regulated in shoot tissues in response to methyl jasmonate treatment
MEMQDEAIVVVARPEEAAAAAVVAVRRMNSSGVGKMSYADNSDFQRVIASVTKKARQELAAALYRARGRPDSMAIADLGCATGPNALLNVSDAVEAVLAENQHHPPPQLHVFLNDLPANDFNAVFRLLPSSPLAATGCCLVSAWPGSFYERVFPEASLDYVVSSSSLHFLSKAPTMRMEHPVNLGRVYVSESGPAAVLDAYRSQFHADFLAFLSCRAVEVRPRGLLLLTFVARRTARPTAHDCYLWDLLADALMDMAAAGLVDEDQVHAFNAPYYSPCPDDLAKVIAKEGSFTVRTMQLFVTTRRCLLLQAQAQADDDDDELPRWLAMETASTVRAVVEPMLRTHFGWDAIAMDGLFCRYSLLLEAYYRSNTSRNKDDLTNVFLVLEKKQH

SEQ ID NO: 2147 - DNA, 678 bp, Sorghum bicolor
  misc_feature: Ceres ANNOT ID no. 6019558
  misc_feature: Encodes the peptide sequence at SEQ ID NO 2148
atgaagaagatcttcggcgccaagaagaacaaggacccgccgcccaccatccaggacgcaaccgacagaatcaccaagcgcggcgacaccgtcgatgaaaagatcaagaagctcgacgctgagctcgcgcgctacaaggagcagatcaagaagacgcgcccaggccccgcgcaggaagccgtcaaggcacgagccatgagggtcctcaagcagtacgaggggcagcgtgatatgctctacaaccaaacatataaccttgaccaagttgcttttgccgcagagggacttaaagatgcacagcaaactatgactgcaatgaaggctgccaataaagagctcaaagggatgatgaaaactgtcaagctcgaagatattgatagcatgcaagatgagatgatggatcttatggatgtgagcaacgaaatacaagaaactcttggcagaagctacaatgttcctgatgacatcgatgaggaagaacttatgggagagctcgatgctttggaagctgacatggactttgaatcagagtcagtcccatcttacctccaaccagaccaagaatctgaactcaacttgcctgctgcaccaactggccatgcagcagtcccagcaaatcagcagcaggaggatgagctagggttgccgacagtaccacaagcttccattcgtacctag

SEQ ID NO: 2148 - protein, 225 aa, Sorghum bicolor
  misc_feature: Ceres ANNOT ID no. 6019558
  misc_feature (12)..(201): Pfam Id: Snf7 Pfam Desc: Snf7
  misc_feature (66)..(224): NCBI GI: 42572355 NCBI Desc: snf7 family protein [arabidopsis thaliana]
  misc_feature (1)..(219): NCBI GI: 18088721 NCBI Desc: snf7 domain containing 2 [homo sapiens]
  misc_feature (1)..(219): NCBI GI: 119578917 NCBI Desc: chromatin modifying protein 5, isoform cra_b [homo sapiens]
  misc_feature (1)..(219): NCBI GI: 119578916 NCBI Desc: chromatin modifying protein 5, isoform cra_a [homo sapiens]
  misc_feature (1)..(219): NCBI GI: 123993007 NCBI Desc: chromatin modifying protein 5 [synthetic construct]
MKKIFGAKKNKDPPPTIQDATDRITKRGDTVDEKIKKLDAELARYKEQIKKTRPGPAQEAVKARAMRVLKQYEGQRDMLYNQTYNLDQVAFAAEGLKDAQQTMTAMKAANKELKGMMKTVKLEDIDSMQDEMMDLMDVSNEIQETLGRSYNVPDDIDEEELMGELDALEADMDFESESVPSYLQPDQESELNLPAAPTGHAAVPANQQQEDELGLPTVPQASIRT

SEQ ID NO: 2149 - DNA, 195 bp, Sorghum bicolor
  misc_feature: Ceres ANNOT ID no. 6019561
  misc_feature: Encodes the peptide sequence at SEQ ID NO 2150
atgcaggactgggcaccggtgttcatctcgttggtgccagggctcctcttccagatgcctgccaagtcgcgcctcatcgccttcggcaacttccacaccagcgtcgcctccatcatcgtccacaccatcctcttcttcgccctcgacgccatcctcctcgtcgccatcggcgtccggatcgagctcggcaactag

SEQ ID NO: 2150 - protein, 64 aa, Sorghum bicolor
  misc_feature: Ceres ANNOT ID no. 6019561
  misc_feature (1)..(63): NCBI GI: 115485585 NCBI Desc: os11g0496500 [oryza sativa (japonica cultivar-group)]
  misc_feature (3)..(60): NCBI GI: 1532167 NCBI Desc: localized according to blastn similarity to est sequences; therefore, the coding span corresponds only to an area of similarity since the initation codon and stop codon could not
  misc_feature (3)..(60): NCBI GI: 1532167 (continued) be precisely determined [arabidopsis thaliana]
  misc_feature (3)..(62): NCBI GI: 1532168 NCBI Desc: localized according to blastn similarity to est sequences; therefore, the coding span corresponds only to an area of similarity since the initation codon and stop codon could not
  misc_feature (3)..(62): NCBI GI: 1532168 (continued) be precisely determined [arabidopsis thaliana]
  misc_feature: Useful for making plants with altered cell wall content and/or composition
  misc_feature: Functional homolog of the protein sequence encoded by LOCUS at5g63500
  misc_feature: Useful for making plants with altered cell wall content and/or composition
  misc_feature: Functional homolog of the protein sequence given in SEQ ID NO 13690
MQDWAPVFISLVPGLLFQMPAKSRLIAFGNFHTSVASIIVHTILFFALDAILLVAIGVRIELGN

SEQ ID NO: 2151 - DNA, 1383 bp, Sorghum bicolor
  misc_feature: Ceres ANNOT ID no. 6019565
  misc_feature: Encodes the peptide sequence at SEQ ID NO 2152
atggccgaggccgaggccgacgccaccgccgccctctcagctcggagcaaagtgcaggcgttcctggaggctgcgcgcgccggcgacctccagtctctcaagagcttagtcgcggtgctcgacgaggacggcacgggcgccgcctccgtcgcctccgccgtgcgcgacgccaacaagcgcactgctctccacttcgccgcgcgcgagggccgcgccgacgtctgtgaattcctcatcggcgagctcggcctccctgtcgacccaaaggacgatgatggcgaaactccactcatccatgctacacgccagggccatctggacactgccaagtacctccttgaccatggagctgatccttcggtggccaccaacctaggagccacagcgctacaccatgctgcaggcatagggaatacggagctcatgaagcttctcctctccaagggagttgacgtcgaatcagaaagcgacgctggcactccccttgtgtgggctgctggtcatggcaactcggatgctgtcaaacttctgcttcaacacaatgctaagccaaatactgaaaacgatgatggtgtcacagcattgctatctgctgttgctgcaggttccctcccatgcttggaggttctaatcaaggctggtgcaaacccaaatgtcaaggctggtggagcaacccctttgcatattgctgcagatagtggaaatatagaagtcatcaaatgtttgcttaaagctggagctgacccgaatatctgcgatgatgatgaactgaagccagttcaggttgctgcttggagaaataaccgggaagctgtggaacttcttttaccattaacatccccaattccaggtgtttcaaactggaacgtagatgggattatagaacagatgctacctaaagaatatggggaaaagtctcaatcgaaggaagcagcatctctgaaatcaggccgaacacaaactgttgaggtgtcacctgaagcaaagaaaagatccttggaagccaaatcaagaggtgatgatgccttcagaagaaaggactaccttgtagcagtggatgcttatacgcaggctacagagttggacccaactgatgcaacagtgctctcaaacaggagcctctgctggctgcgagcagggcaagctgaacgtgctctggaagatgcgaaagcatgccgggcattaagaccagattgggcgaaagcttgctacagggaaggtgcagcccatcgtctgttacagaggtttgaggacgccgcaaatgccttttatgagggggtgcagctggatccagagaacaaagagcttgtcagcgcattcagggaggccatcgaagctgggagaaagttccatggcgtggacacgccaagctcaacacaatga

SEQ ID NO: 2152 - protein, 460 aa, Sorghum bicolor
  misc_feature: Ceres ANNOT ID no. 6019565
  misc_feature (58)..(91): Pfam Id: Ank Pfam Desc: Ankyrin repeat
  misc_feature (92)..(124): Pfam Id: Ank Pfam Desc: Ankyrin repeat
  misc_feature (125)..(157): Pfam Id: Ank Pfam Desc: Ankyrin repeat
  misc_feature (190)..(222): Pfam Id: Ank Pfam Desc: Ankyrin repeat
  misc_feature (223)..(254): Pfam Id: Ank Pfam Desc: Ankyrin repeat
  misc_feature (400)..(433): Pfam Id: TPR_2 Pfam Desc: Tetratricopeptide repeat
  misc_feature (400)..(433): Pfam Id: TPR_1 Pfam Desc: Tetratricopeptide repeat
  misc_feature (7)..(452): NCBI GI: 6175185 NCBI Desc: ankyrin-like protein [arabidopsis thaliana]
  misc_feature (7)..(458): NCBI GI: 24745936 NCBI Desc: ankyrin-like protein [solanum tuberosum]
  misc_feature (22)..(446): NCBI GI: 47497788 NCBI Desc: ankyrin repeat protein e4_8-like [oryza sativa (japonica cultivar-group)]
  misc_feature (14)..(449): NCBI GI: 77556983 NCBI Desc: ankyrin-like protein-like protein [oryza sativa (japonica cultivar-group)]
  misc_feature (12)..(446): NCBI GI: 47496993 NCBI Desc: ankyrin repeat protein-like [oryza sativa (japonica cultivar-group)]
  misc_feature: The sequence is a functional homolog of SEQ ID NO 1467 in the 10/374,780US patent application
  misc_feature: The sequence is a functional homolog of SEQ ID NO 1813 in the 10/374,780US patent application
  misc_feature: The sequence is a functional homolog of SEQ ID NO 1839 in the 10/374,780US patent application
  misc_feature: The sequence is a functional homolog of SEQ ID NO 1840 in the 10/374,780US patent application
  misc_feature: The sequence is a functional homolog of SEQ ID NO 1841 in the 10/374,780US patent application
  misc_feature: The sequence is a functional homolog of SEQ ID NO 1843 in the 10/374,780US patent application
  misc_feature: The sequence is a functional homolog of SEQ ID NO 1844 in the 10/374,780US patent application
  misc_feature: The sequence is a functional homolog of SEQ ID NO 1845 in the 10/374,780US patent application
  misc_feature: The sequence is a functional homolog of SEQ ID NO 1846 in the 10/374,780US patent application
  misc_feature: The sequence is a functional homolog of SEQ ID NO 873 in the 10/666,642US patent application
  misc_feature: Useful for making plants with modulated growth and phenotype characteristics
  misc_feature: The sequence is a functional homolog of SEQ ID NO 1467 in the 20060162006 US patent application
  misc_feature: The sequence is a functional homolog of SEQ ID NO 1813 in the 20060162006 US patent application
  misc_feature: The sequence is a functional homolog of SEQ ID NO 1839 in the 20060162006 US patent application
  misc_feature: The sequence is a functional homolog of SEQ ID NO 1840 in the 20060162006 US patent application
  misc_feature: The sequence is a functional homolog of SEQ ID NO 1841 in the 20060162006 US patent application
  misc_feature: The sequence is a functional homolog of SEQ ID NO 1843 in the 20060162006 US patent application
  misc_feature: The sequence is a functional homolog of SEQ ID NO 1844 in the 20060162006 US patent application
  misc_feature: The sequence is a functional homolog of SEQ ID NO 1845 in the 20060162006 US patent application
MAEAEADATAALSARSKVQAFLEAARAGDLQSLKSLVAVLDEDGTGAASVASAVRDANKRTALHFAAREGRADVCEFLIGELGLPVDPKDDDGETPLIHATRQGHLDTAKYLLDHGADPSVATNLGATALHHAAGIGNTELMKLLLSKGVDVESESDAGTPLVWAAGHGNSDAVKLLLQHNAKPNTENDDGVTALLSAVAAGSLPCLEVLIKAGANPNVKAGGATPLHIAADSGNIEVIKCLLKAGADPNICDDDELKPVQVAAWRNNREAVELLLPLTSPIPGVSNWNVDGIIEQMLPKEYGEKSQSKEAASLKSGRTQTVEVSPEAKKRSLEAKSRGDDAFRRKDYLVAVDAYTQATELDPTDATVLSNRSLCWLRAGQAERALEDAKACRALRPDWAKACYREGAAHRLLQRFEDAANAFYEGVQLDPENKELVSAFREAIEAGRKFHGVDTPSSTQ

SEQ ID NO: 2153 - DNA, 3285 bp, Sorghum bicolor
  misc_feature: Ceres ANNOT ID no. 6019578
  misc_feature: Encodes the peptide sequence at SEQ ID NO 2154
  misc_feature: Up-regulated in shoot tissues in response to methyl jasmonate treatment
  misc_feature: Down-regulated in shoot tissues in response to salicylic acid treatment
atggcggcgacggcgggcgaggacaaggacgtcgacgccttcctcgcggactgcacgccctcgggcgacgccgcgtacggcgccgccaaggccgtgctcgagcgcctccacgaccccgccacccgccccgccgcgcgccgcctcctcggcgccgtccgccgacgcttcgccgcctcacgcgccgcgggggaggagtgcttccgcaccttccacttccgcatccacgacgtcgtcctcgacccacacgtacaaggtttccaacaaaggaagaagctgacaatgatggagataccaagcatcttcattcctgaagattggtccttcactttctacgagggcctcaaccgtcatccagactccattttcagggacaagacagtagcagagctgggatgtggcaatggttggatatccattgctcttgcagaaaagtggtgcccttcaaaggtctatggtctggatataaacccaagagctgtgaagattgcatggataaacctgtacttgaacgcattagatgatgatggtctcccaatatatgatggggagggcaaaacattgctcgatagagttgaattctatgaatcagatctcctttcttactgtagagacaacaagatagagcttgatcgcattgttggatgcataccacagattctcaacccaaatccagaggcgatgtcaaagattgtaacagagaattcaagtgaggagttcttgtactccttgagtaactactgtgctcttcagggttttgtcgaggaccaatttggccttgggttgattgcacgggcggtggaagaagggatatctgtcataaagccttcaggtattatggtattcaacatgggaggtcgaccaggacagggtgtctgtgaacgtctatttcgacgacgtggatttcgcatcactaagctctggcaaaccaaaattatgcaggctgctgacacagatatttcagctttggttgaaattgagaaaaatagcagacatcggtttgagttcttcatggatcttgttggggatcagcctatctgtgctcgcacagcctgggcatacttgaaatctggtggccgcatttcacatgctttgtctgtgtatagctgtcaacttcgccagcccaaccaggtgaagaaaatatttgagtttcttaaagatggattccatgaagtcagcagttcccttgatttatcctttgacgacgattctgtagctgatgaaaaaattcccttcctagcataccttgctagttttctgaaagagaataagtcaaatccctgtgagccgccagctggatgtctaaactttaggaaacttgttgctggatttatgaagagctaccatcacattcctctaactcctgataatgtcgttgtgttcccttcccgtgctgtggcaatagagaatgctcttcaattgttctcaccggcgcttgcaatcgttgatgaacatttgaccagacacttgcccaagcaatggttaacatccttagcaattgagggaagagcagattgtaatcacgcagacggtacagtcactgtaattgaggcaccacgccagtcagatttactgattgagttgatcaggaagctgaagcctcaggtggttgttactggcatggctcaatttgaggctatcaccagtgctgcttttgagaacttactaaatgtaacaaaagatgttggttcccggttgttcctggatatttctgagcatttggagttgtctagtctgccaagctctaatggtgtattaaaatatcttgctggaaagacattaccgtcgcatgcagctatactgtgtggtttagtaaaaaatcaggtgtattctgatctggaagttgcttttgccatttccgaagatgcagctgtatacaaagcattatcacaaactattgagctattggaaggtcacacttctctgatcagccagcactattacggctgccttttccatgagcttctggcatttcaaattgctgaccggcatccacagcaagagagacaacctgcagaagtgatacctcagcagatgataggattttctgatccagctatgtctactctaaaggctgctgaatttttcgttcctgattcagctgagtccagcattattcatatggatttagatcgcagctttctgccagtaccttctgcagtgagtgcctctgtttttgaaagttttgtcaggcagaacatcactgattctgaaactgatgtccattccagcatccagcagctggtgaaagatagctatggtttatccgcagatggttgttcagaaattatctatggcaacacctccctagcactcttcaacaagcttgttctttgttgcatgcaagaacagggcaccttgcttttccccttgggcaccaatggccattacgtctctgcagcaaagtttgtgaacgcgagcaccttgactataccgacaaattttggtacaggattcaggattgaaccaaaggttctagctgacactcttaagaatgtatctcagccatgggtgtatatttctggccccacaatcaaccctactggttttctgtacagtgacaatgatattcaagagctgctctctgtatgcgctgaatatggcgctagggtagtgatagatacctccttctctggcctggagtaccaaactgatggctggagtcagtggaatctggaaggatgcctttcctctttgaaacgttcaaagccatcattctctgtggtcctgcttggagagctgtcctttgagctgactgcagcagggcatgactttgggtttgtgatattgagcgactcatcattggctgagacgtttcatagtttccccagcttgagtcggccgcacaacacattaaagtacactttcaaaaagctactgggtcttaagaaccagaaggatcagcatttctcgaatctaatggtggagcagaaggaggaactgaagaatcgcgccaaccacttgataaagacactggagagctgtggctgggatgttgccattggttgtggtggcatctcaatgttggcgaagccaactgcctacatcgggaagcccttcaaagctgatggtttcgacggcaagctggatgcaagcaacatcagggaagccatcctcaaggccactgggctcagcataaacagcagctcctggacggggatccctgactactgccggttcagctttgctctggagagcggtgaattcgagcgtgcaatgggatgcatagctcggttcaaggagctggttctgggaggcagtggccaggctcagatgaatggtgtctga

SEQ ID NO: 2154 - protein, 1094 aa, Sorghum bicolor
  misc_feature: Ceres ANNOT ID no. 6019578
  misc_feature (704)..(1075): Pfam Id: Aminotran_1_2 Pfam Desc: Aminotransferase class I and II
  misc_feature (1)..(1093): NCBI GI: 13786624 NCBI Desc: s-adenosyl-l-methionine:l-methionine s-methyltransferase [zea mays]
  misc_feature (1)..(1093): NCBI GI: 50401177 NCBI Desc: methionine s-methyltransferase (adomet:met s-methyltransferase) (hv-mmt1)
  misc_feature (1)..(1093): NCBI GI: 7634680 NCBI Desc: s-adenosyl-l-methionine: l-methionine s-methyltransferase [hordeum vulgare subsp. vulgare]
  misc_feature (11)..(1084): NCBI GI: 92869027 NCBI Desc: sam (and some other nucleotide) binding motif [medicago truncatula]
  misc_feature (11)..(1084): NCBI GI: 92893696 NCBI Desc: sam (and some other nucleotide) binding motif [medicago truncatula]
  misc_feature (1)..(1093): SWISSPROT Homolog: EC 2.1.1.12 Methionine S-methyltransferase
  misc_feature: Up-regulated in shoot tissues in response to methyl jasmonate treatment
  misc_feature: Down-regulated in shoot tissues in response to salicylic acid treatment
  misc_feature: The sequence is a functional homolog of SEQ ID NO. 286 in the 11/188,298 US application
MAATAGEDKDVDAFLADCTPSGDAAYGAAKAVLERLHDPATRPAARRLLGAVRRRFAASRAAGEECFRTFHFRIHDVVLDPHVQGFQQRKKLTMMEIPSIFIPEDWSFTFYEGLNRHPDSIFRDKTVAELGCGNGWISIALAEKWCPSKVYGLDINPRAVKIAWINLYLNALDDDGLPIYDGEGKTLLDRVEFYESDLLSYCRDNKIELDRIVGCIPQILNPNPEAMSKIVTENSSEEFLYSLSNYCALQGFVEDQFGLGLIARAVEEGISVIKPSGIMVFNMGGRPGQGVCERLFRRRGFRITKLWQTKIMQAADTDISALVEIEKNSRHRFEFFMDLVGDQPICARTAWAYLKSGGRISHALSVYSCQLRQPNQVKKIFEFLKDGFHEVSSSLDLSFDDDSVADEKIPFLAYLASFLKENKSNPCEPPAGCLNFRKLVAGFMKSYHHIPLTPDNVVVFPSRAVAIENALQLFSPALAIVDEHLTRHLPKQWLTSLAIEGRADCNHADGTVTVIEAPRQSDLLIELIRKLKPQVVVTGMAQFEAITSAAFENLLNVTKDVGSRLFLDISEHLELSSLPSSNGVLKYLAGKTLPSHAAILCGLVKNQVYSDLEVAFAISEDAAVYKALSQTIELLEGHTSLISQHYYGCLFHELLAFQIADRHPQQERQPAEVIPQQMIGFSDPAMSTLKAAEFFVPDSAESSIIHMDLDRSFLPVPSAVSASVFESFVRQNITDSETDVHSSIQQLVKDSYGLSADGCSEIIYGNTSLALFNKLVLCCMQEQGTLLFPLGTNGHYVSAAKFVNASTLTIPTNFGTGFRIEPKVLADTLKNVSQPWVYISGPTINPTGFLYSDNDIQELLSVCAEYGARVVIDTSFSGLEYQTDGWSQWNLEGCLSSLKRSKPSFSVVLLGELSFELTAAGHDFGFVILSDSSLAETFHSFPSLSRPHNTLKYTFKKLLGLKNQKDQHFSNLMVEQKEELKNRANHLIKTLESCGWDVAIGCGGISMLAKPTAYIGKPFKADGFDGKLDASNIREAILKATGLSINSSSWTGIPDYCRFSFALESGEFERAMGCIARFKELVLGGSGQAQMNGV

SEQ ID NO: 2155 - DNA, 1293 bp, Sorghum bicolor
  misc_feature: Ceres ANNOT ID no. 6019601
  misc_feature: Encodes the peptide sequence at SEQ ID NO 2156
atggcgccgctccacgccgcgctgcggccgccctcctccgctgccgccgccgctgctcaccaccacgcggcagccccgcctgtcttcctcgctcgctcgccgtaccacccccgcagggcggcggcctcctgctcgctcgccaccgccgccgcgccctcgtcgagaaaagcgttcctgtcatgcccgccggaccactggatgacggccgcgccgccgcgcgccatcccctcctcctcgtcgtcgtccccggcgctcgtcgcgtccgtgcaggacctgtacgacttcatctacagcggcccgctggtggacaggatcggctacaccgatgagaagatcgccgagtccatcgaccgctggcttcttgccggggctcggttggcgcgccttttccgcctcaacgagctccagctgtcggaggccgagaaggcccggatataccacttctacatccccgtctttctctggtgcgaggaccaggtcatggagcacagagccaagtacaacgacggtgatgacatcccaccattggtgattggggtcagtgctcctcaaggaagtggaaagacgactcttgtcttcgcacttgattatctttttcgggttgctggtaggaattctgtcacattgtctatagatgacttctatttgacagcaaaagaacagaatgaactgagggacagaaatcctggaaatgctcttttagagctccgtggaaacgctggaagccacgatctccaattctcagttgaaacacttgagtcactgatcaaactaacaaaggaaggtatgaagatgaaggttccacggtatgacaagtctgcttttgggggaaggggtgaccgggctgatccttctgtatggacagaggttgaagggcccttagaggttgttctgtttgaaggatggatgcttggatttaaacctcttccaaatgaagaagtgaaaaaagtggatccacagcttgaggtggttaacaagaaccttgaagcatactatggtgcttgggacaggttcatccaatcatggattgttattaaaataagagaacccaattgtgtataccagtggaggctgcaggcagaggtagctatgagagcagatggaaaacctggaatgtccgatgaggaggttatggattttgtatcacgctacctaccagcataccaagcatatttgcccactttatacaaagatggaccaaatggttcgaatccagaccatctgctggtcatcgacatagatgaaaataggaatcctatttgtggtggagactgggatgtggcatgtttgtga

SEQ ID NO: 2156 - protein, 430 aa, Sorghum bicolor
  misc_feature: Ceres ANNOT ID no. 6019601
  misc_feature (1)..(422): NCBI GI: 56202305 NCBI Desc: phosphoribulokinase/uridine kinase-like [oryza sativa (japonica cultivar-group)]
  misc_feature (74)..(420): NCBI GI: 145327759 NCBI Desc: phosphoribulokinase/uridine kinase-related [arabidopsis thaliana]
  misc_feature (74)..(420): NCBI GI: 16226442 NCBI Desc: at1g80380/f5i6_13 [arabidopsis thaliana]
  misc_feature (267)..(420): NCBI GI: 18412831 NCBI Desc: phosphoribulokinase/uridine kinase-related [arabidopsis thaliana]
  misc_feature (175)..(420): NCBI GI: 5734470 NCBI Desc: spac630.09c [schizosaccharomyces pombe]
  misc_feature (74)..(420): SWISSPROT Homolog: EC 2.7.1.31 D-glycerate 3-kinase, chloroplast precursor
MAPLHAALRPPSSAAAAAAHHHAAAPPVFLARSPYHPRRAAASCSLATAAAPSSRKAFLSCPPDHWMTAAPPRAIPSSSSSSPALVASVQDLYDFIYSGPLVDRIGYTDEKIAESIDRWLLAGARLARLFRLNELQLSEAEKARIYHFYIPVFLWCEDQVMEHRAKYNDGDDIPPLVIGVSAPQGSGKTTLVFALDYLFRVAGRNSVTLSIDDFYLTAKEQNELRDRNPGNALLELRGNAGSHDLQFSVETLESLIKLTKEGMKMKVPRYDKSAFGGRGDRADPSVWTEVEGPLEVVLFEGWMLGFKPLPNEEVKKVDPQLEVVNKNLEAYYGAWDRFIQSWIVIKIREPNCVYQWRLQAEVAMRADGKPGMSDEEVMDFVSRYLPAYQAYLPTLYKDGPNGSNPDHLLVIDIDENRNPICGGDWDVACL

SEQ ID NO: 2157 - DNA, 1824 bp, Sorghum bicolor
  misc_feature: Ceres ANNOT ID no. 6019602
  misc_feature: Encodes the peptide sequence at SEQ ID NO 2158
atggcgcttaaggccacggcgcagggcgccgcggaggcggccgtagcggccatcggccggggctacgacgtcgtctccgacgtccgcctcaagtactgcaagggcaagctcgcggacccggacgcgcgcctcattgacgtctctcgcgatgacgtccaggacgtcctgctccccgccgggatcagggtcgccgccgtccccaagtccatcaagtgcgacaagggcgagcgcacgcgcttccgctccgatgtcctctccttccagcagatgtcagagcagttcaaccgggagctatcgttgactgggaaaattccctccggcatgttcaatagcatgtttgatttttctgggtgctggcagaaagatgcagctaacaccaagtcacttgcctttgatggttggtacatttcgctatacaccgtcgcgctatcaaaatctcggatcctactgcgtgatcatgttactcaggcagttccttcaacctgggaccctgctgctttggcaaggtttattgaaaagtttggaacacacatagttgttggtgtgaaaatgggagggaaagatgttatctatttgaaacaacaacattcatcaagcttgcaaccagccgctgtccaaaaacgactcaaggacatgtcggacaagagatttctggatgcaaacggacagtatgacatgaataacaaggatgtttatgggaaggacaagcatgatgcaagagaccaacggctaagatttgtggaatcaagcccatcaagttcatactgtacgaaggaggacttggtgatggtggttaagcggagaggtggtaaggaatgggacaaagatatgcctcacagcgaatggataaacactgttcaatcagaacctgatgttatctcaatgtccttcttacctatcacttctttgttgaacggagtacctggctgtgggtttctcaaccatgcaattaatctgtacctacgctataagcctccgattgaagaactacatcaatttttggagttccagctaccaagacaatgggcacctgtgtacagtgaccaccctcttggccctcaaaggaggaaacagagcagtgcatctttggccttaagttttatgggaccaaggctctatgtctgcactaatatggttgatgtgggtgaaagacctgttactgggattcggttgtatcttgaggggaagaagagcaacatgctgggtatccaccttcaacatctatgctcgcttcctcaaatcctgcagctccaggatgatccatacaaccaccgaactccagaaccatatgaccgcaagtacctggaaccatttggatcctggaagcgtttctctcatgtttacacagcgccagtggagtcagacgatgattcctcaatcgtgaccggggcacagctacatgtgagcagccatgggttgaggaaggtcctcttcctccgcctcaatttctccaaagtcagtaatgccgcgcttgtcaagaaccctgagtgggaagggtcgccgaatctggggcagaaatctggcctcatctcaacgctcatcagcacacatttctctacagcggctcagaagcctgcccctcgccctgctgatgtgaacatcaactcggctgtgtaccctggtggtccgccagtgcctgcgcaggcaccaaagcttctgaagtatgtggacacagcagagatggtgcgcggaccgcaggacacaccgggatactgggtggtctctggtgccaagctgcagctggagaggggcaaaatatcgctgcgggtgaagtattcgctgttgacagccatggtacctgacgagtatacacttgatgaatga

SEQ ID NO: 2158 - protein, 607 aa, Sorghum bicolor
  misc_feature: Ceres ANNOT ID no. 6019602
  misc_feature (126)..(322): Pfam Id: MACPF Pfam Desc: MAC/Perforin domain
  misc_feature (7)..(602): NCBI GI: 92870237 NCBI Desc: membrane attack complex component/perforin/complement c9 [medicago truncatula]
  misc_feature (10)..(604): NCBI GI: 92875831 NCBI Desc: membrane attack complex component/perforin/complement c9 [medicago truncatula]
  misc_feature (258)..(602): NCBI GI: 92875832 NCBI Desc: membrane attack complex component/perforin/complement c9 [medicago truncatula]
  misc_feature (8)..(595): NCBI GI: 92895124 NCBI Desc: membrane attack complex component/perforin/complement c9 [medicago truncatula]
  misc_feature (249)..(595): NCBI GI: 140053390 NCBI Desc: aldehyde oxidase and xanthine dehydrogenase, a/b hammerhead; membrane attack complex component/perforin/complement c9 [medicago truncatula]
MALKATAQGAAEAAVAAIGRGYDVVSDVRLKYCKGKLADPDARLIDVSRDDVQDVLLPAGIRVAAVPKSIKCDKGERTRFRSDVLSFQQMSEQFNRELSLTGKIPSGMFNSMFDFSGCWQKDAANTKSLAFDGWYISLYTVALSKSRILLRDHVTQAVPSTWDPAALARFIEKFGTHIVVGVKMGGKDVIYLKQQHSSSLQPAAVQKRLKDMSDKRFLDANGQYDMNNKDVYGKDKHDARDQRLRFVESSPSSSYCTKEDLVMVVKRRGGKEWDKDMPHSEWINTVQSEPDVISMSFLPITSLLNGVPGCGFLNHAINLYLRYKPPIEELHQFLEFQLPRQWAPVYSDHPLGPQRRKQSSASLALSFMGPRLYVCTNMVDVGERPVTGIRLYLEGKKSNMLGIHLQHLCSLPQILQLQDDPYNHRTPEPYDRKYLEPFGSWKRFSHVYTAPVESDDDSSIVTGAQLHVSSHGLRKVLFLRLNFSKVSNAALVKNPEWEGSPNLGQKSGLISTLISTHFSTAAQKPAPRPADVNINSAVYPGGPPVPAQAPKLLKYVDTAEMVRGPQDTPGYWVVSGAKLQLERGKISLRVKYSLLTAMVPDEYTLDE

SEQ ID NO: 2159 - DNA, 969 bp, Sorghum bicolor
  misc_feature: Ceres ANNOT ID no. 6019604
  misc_feature: Encodes the peptide sequence at SEQ ID NO 2160
atgacgatggtccccctcgacccctcgtccaagcccacctcgcagcgtcttatcacggagggcgacacggtggtggtgtacgagcgccacgacgcgatgcgagccgtcgcggtgcgcgccggcggggtgctccagaaccgcttcggcgtcttccgccacgacgactggatcggccgccccttcggatccaaggtattcggttcttgcggcggaggaggcaaggccaaggccaaggcgggcggcggtgggttcgtgcacctcctcgcgcccaccccggagctctggactctcgtgctcagccaccggacacagatcctttacatcgccgacatcagcctcgtcgtcgcctacctcgagcttgtgcctggttgccttgtgctcgagtcgggtacgggcagcgggtcgctcaccacttcgctggcacgcgccgtcgcgccgcatggccaagtccataccttcgatttccaccagcagagggccgcctcagctagggaagactttgagaagaatggcttgagcagcctcatcacagtcaatgtgagggatgtacaaggggaaggattcccagaggaacattgtggtgctgctgatgctgtcttcctggacttgccccagccttggcttgcaataccatctgttgggtcgatgctaaagaaagacggtgttctatgctccttttcgccttgtattgagcaagtgcagcgtgcttgtgaagccatgaaaacatctttcacagatattagaacctttgagattcttcttcgcacgtatgaagtacgagatgttgctctgaagagtgtcacctccgaggaagcatgtgtggggcctcttccgcagaaaagaagaatgttgacaagcccaggtgaaaacacaggctgcacacaaaggagttcctccattttggttaggccgtgcagcactgctaaagggcacactgggtacttaacctttgcaaggctttgcgtgtga

SEQ ID NO: 2160 - protein, 322 aa, Sorghum bicolor
  misc_feature: Ceres ANNOT ID no. 6019604
  misc_feature (3)..(320): Pfam Id: GCD14 Pfam Desc: tRNA methyltransferase complex GCD14 subunit
  misc_feature (3)..(322): NCBI GI: 38344774 NCBI Desc: osjnbb0026l04.5 [oryza sativa (japonica cultivar-group)]
  misc_feature (3)..(245): NCBI GI: 115457708 NCBI Desc: os04g0319600 [oryza sativa (japonica cultivar-group)]
  misc_feature (3)..(245): NCBI GI: 115457748 NCBI Desc: os04g0326300 [oryza sativa (japonica cultivar-group)]
  misc_feature (7)..(320): NCBI GI: 124360739 NCBI Desc: sam (and some other nucleotide) binding motif [medicago truncatula]
  misc_feature (15)..(318): NCBI GI: 89269055 NCBI Desc: novel protein [xenopus tropicalis]
MTMVPLDPSSKPTSQRLITEGDTVVVYERHDAMRAVAVRAGGVLQNRFGVFRHDDWIGRPFGSKVFGSCGGGGKAKAKAGGGGFVHLLAPTPELWTLVLSHRTQILYIADISLVVAYLELVPGCLVLESGTGSGSLTTSLARAVAPHGQVHTFDFHQQRAASAREDFEKNGLSSLITVNVRDVQGEGFPEEHCGAADAVFLDLPQPWLAIPSVGSMLKKDGVLCSFSPCIEQVQRACEAMKTSFTDIRTFEILLRTYEVRDVALKSVTSEEACVGPLPQKRRMLTSPGENTGCTQRSSSILVRPCSTAKGHTGYLTFARLCV

SEQ ID NO: 2161 - DNA, 720 bp, Sorghum bicolor
  misc_feature: Ceres ANNOT ID no. 6019630
  misc_feature: Encodes the peptide sequence at SEQ ID NO 2162
atgctgacagcagcggccgcacggaggggcgcggcggcggcggcggcggcggcggcggcaccggccttccactcctccgccccagcgctctccaaatccacgcctcatatccgtttcgccgtccgtgaaaagcgtggggatgcaaagagcgcccttaagaaccttctgctcaatggcagcccatgtcaggaaagcagtagcaaacaaatgagaaagcagaaaggtgttagcagatcaaaggtccagcgctctactccaggaaaaaacccctatggaaaaaataagcgtgggcagaactggaaaagctttgatgatgatgatgaatgcacagacacaccatatggtacctatggtggcaagaaatcttttacatggtactggcctggggagaatgatggccttggtagtaatcctagtggttttcaatggagggaggaatctcagtctgccaaatcaaaggaaaagttctggaacgaaagtgatgtcgatgaggaagaggagtcgggccaagatgatttgcgaagctataggatctcacttgggttgccagttttaggccccttaaagctggatcatattaaggctgcttttcgtgcatctgctctcaaatggcaccccgacaaacatcaagggccttcacaggctgaagcagaagaaaaattcagacaatgcgtggaagcgtacaacaaattgacctttgccttcaagtcaagtggctaa

SEQ ID NO: 2162 - protein, 239 aa, Sorghum bicolor
  misc_feature: Ceres ANNOT ID no. 6019630
  misc_feature (175)..(237): Pfam Id: DnaJ Pfam Desc: DnaJ domain
  misc_feature (32)..(231): NCBI GI: 92876008 NCBI Desc: heat shock protein dnaj, n-terminal [medicago truncatula]
  misc_feature (27)..(238): NCBI GI: 38345831 NCBI Desc: osjnba0070m12.14 [oryza sativa (japonica cultivar-group)]
  misc_feature (117)..(238): NCBI GI: 5777634 NCBI Desc: caa303722.1 protein [oryza sativa]
  misc_feature (14)..(196): NCBI GI: 22093656 NCBI Desc: dnaj protein family-like protein [oryza sativa (japonica cultivar-group)]
  misc_feature (174)..(231): NCBI GI: 121077782 NCBI Desc: hsp40-like heat shock protein [volvox carteri f. nagariensis]
MLTAAAARRGAAAAAAAAAAPAFHSSAPALSKSTPHIRFAVREKRGDAKSALKNLLLNGSPCQESSSKQMRKQKGVSRSKVQRSTPGKNPYGKNKRGQNWKSFDDDDECTDTPYGTYGGKKSFTWYWPGENDGLGSNPSGFQWREESQSAKSKEKFWNESDVDEEEESGQDDLRSYRISLGLPVLGPLKLDHIKAAFRASALKWHPDKHQGPSQAEAEEKFRQCVEAYNKLTFAFKSSG

SEQ ID NO: 2163 - DNA, 1638 bp, Sorghum bicolor
  misc_feature: Ceres ANNOT ID no. 6019877
  misc_feature: Encodes the peptide sequence at SEQ ID NO 2164
atggccgacgaccccaccaccggcggcggcgggggtgagggcggggaccgcgtcgaggacgtcgtccgagccgagggtgaaacgcaacctcatgatgatggctcgtcgaaatccaaggatagggagaaagatagagaaaaagacaaggacagagatcgtcgcagggaccgtgacagagatagagggagagacagggatcgtgatagagatagagatagggatagggacagggatcgggacagagacaaggatcgccaaagtaggcatcaccgtgaaagacgggaaccgcgagaccgtcctgatgatcacagaggccgtgattctgaaaggagaagagaacgtgacagagatggacatcgtaggcatcgttctcggtctcgttcaaggggtagagatcgaagatctaggtcacgttcaagaagcaagcgagttagtggattcgatgcaccacccccacaagccatgggttcaccatttccagttattccaaccccaagtcagttaccaggcacttcccttcccaacattggcggcatgtttccaaacatgctcccttttggtgttgctgggcagttcaacccccttgtcatccagccacaagcaatgactcaacaggctactcgtcatgctcggcgtgtttatgtcggcggccttcctccatctgctaacgaacagacagtggcagtttactttaatcaagtcatggctgctattggtggaaacactgctggtccaggtgacgctgttctcaatgtatacataaatcatgacaagaaatttgcttttgtggagatgagatcagttgaggaagcaagcaatgcaatggccctggatggcattatgtttgaaggggcgcctgtgaaggtcagaaggccaacagattacaacccttcccttgcagctgcactgggcccaagccagccaagccccaatctgaatcttgcagcagttggcctaacagcaggatctactggagggctagaaggtccggaccgtatttttgtgggtggccttccgtattacttcactgaagctcaagttcgggagttgcttgaatcattcggtcctcttcgagggtttgatcttgtgaaggacagggaaaccggtaactcaaaaggctatgcattctgtgtttaccaggacctcactgtcactgacattgcttgtgctgcactaaatggtatcaagatgggtgacaaaacccttactgtcagacgagcaaaccagggggcatctcagcccagaccagagcaggaaagtatcctattgcaggcacagcaacaggtgcagttacagaaacttgtgtatcaagttggggcgctccctacaaaggttgtttgcctcacccaggtggtaacagcagatgaattgaaagatgatgaagaatatgaggacattatggaagacatgaggctagaagcaggcaaatatggtactttggtgaaagtcatcatcccacgtcctgaccccagcggacagccagtcgcaggagttgggaaggtgttcctggaatatgcagatatcgatggtgcggccaaagcaaagacagcattgcatggaaggaaatttggtgggaaccctgtggtcgctgtctgctatgctgaggacaagtttgccaatggggaatatgatggatga

SEQ ID NO: 2164 - protein, 545 aa, Sorghum bicolor
  misc_feature: Ceres ANNOT ID no. 6019877
  misc_feature (213)..(289): Pfam Id: RRM_1 Pfam Desc: RNA recognition motif. (a.k.a. RRM, RBD, or RNP domain)
  misc_feature (333)..(404): Pfam Id: RRM_1 Pfam Desc: RNA recognition motif. (a.k.a. RRM, RBD, or RNP domain)
  misc_feature (1)..(544): NCBI GI: 68036764 NCBI Desc: u2af large subunit [triticum aestivum]
  misc_feature (10)..(545): NCBI GI: 3850821 NCBI Desc: u2 snrnp auxiliary factor, large subunit [nicotiana plumbaginifolia]
  misc_feature (32)..(544): NCBI GI: 3850823 NCBI Desc: u2 snrnp auxiliary factor, large subunit [nicotiana plumbaginifolia]
  misc_feature (167)..(544): NCBI GI: 115486631 NCBI Desc: os11g0682300 [oryza sativa (japonica cultivar-group)]
  misc_feature (34)..(544): NCBI GI: 9858779 NCBI Desc: bac19.11 [lycopersicon esculentum]
MADDPTTGGGGGEGGDRVEDVVRAEGETQPHDDGSSKSKDREKDREKDKDRDRRRDRDRDRGRDRDRDRDRDRDRDRDRDRDKDRQSRHHRERREPRDRPDDHRGRDSERRRERDRDGHRRHRSRSRSRGRDRRSRSRSRSKRVSGFDAPPPQAMGSPFPVIPTPSQLPGTSLPNIGGMFPNMLPFGVAGQFNPLVIQPQAMTQQATRHARRVYVGGLPPSANEQTVAVYFNQVMAAIGGNTAGPGDAVLNVYINHDKKFAFVEMRSVEEASNAMALDGIMFEGAPVKVRRPTDYNPSLAAALGPSQPSPNLNLAAVGLTAGSTGGLEGPDRIFVGGLPYYFTEAQVRELLESFGPLRGFDLVKDRETGNSKGYAFCVYQDLTVTDIACAALNGIKMGDKTLTVRRANQGASQPRPEQESILLQAQQQVQLQKLVYQVGALPTKVVCLTQVVTADELKDDEEYEDIMEDMRLEAGKYGTLVKVIIPRPDPSGQPVAGVGKVFLEYADIDGAAKAKTALHGRKFGGNPVVAVCYAEDKFANGEYDG

SEQ ID NO: 2165 - DNA, 1965 bp, Sorghum bicolor
  misc_feature: Ceres ANNOT ID no. 6019891
  misc_feature: Encodes the peptide sequence at SEQ ID NO 2166
atgccgctcccggcgttcctggcggcggcggcgaggctggccgtcctggtggccgctgccgtgacggcggccaacgcggcctccttcgcgcggtaccggcgccgccacctccgccgcatccccaaccccatcgacgagtccgccgaccccatcgccgacttccgcgccctcccctccaactccgccgccgcctccgccggcgaggatgtcgcagaagatggcaatttcttctttgggctagcgactgcgccggcgcatgtcgaggacaggttggaagatgcttggcttcagtttgcagtggagcattcctgtgatgacaaggaggccatgcgcgaccataagacagcagacgcggtgatggcatcggctgcaggggatggaggcgctcagctggcttctaggtccagaggggacgaaaaggctgttgatggagagaagaggaagcctcttaaggttgccatggaggcgatgctcagggggtttgaaatgtttgcttacggtggtgaagctggttctggcgataactgcagccacaacgtcgcagcttggcacaatgttccttgcccgcaagaaaggcttaaattttggtctgatcctgatactgagttgaaactcgctaaggaaaccgggatcagtgttttccgcctgggaattgattggacaagggtaatgcctaaggcaccaactgaagaatccaagagttcagtcaacttcgcagcacttgagcggtatagatggatcattcaaagagttcatgaatatggaatgaaagtgatgcttacgctatttcaccactcacttccaccttgggctggggaatatggggggtggaggatggaaaaaaccgtgaagtactttatggattttgtgaggcttgttgttgatcgtgtatctgatttggtagactactgggtggtttttaatgaacctcatgtgtttgtaatgctgacctattgtgctggtgcttggcctggtggagaccctaatgcaattgaagtagcaacatctgctttaccgactggtgtatataaccaagcattacattggatggctattgcacatgcagaagcctatgactacatacattcagaaagcaaaagtaaaaggaagccattcgttggtgtcgctcatcatgtatcatttacacggccctatggtctatttgatgttgctgctgtcacactggctaattcattgacccttttcccttacgttgatagcatatgtgataaattggattttatcggcatcaactactatgggcaggaggtgatatcaggccctggtctaaagctcgtggacaatgacgagtacagtgaatctggtcgtggtgtttatcctgatgggctgtttcgtatcctgattcagtttaatgaacgatacaagagcttaaatataccttttataattactgaaaatggagtttctgacgagactgatctgattcggaaaccatatattctggagcacctgttagccatttatgctgcaatcattatgggtgtgcctgtgcttggttatctattctggacgatgtcagataattgggaatgggctgatggctatggtcctaagtttgggcttgtggctgttgatcgtgctaacaacctagcacggaaacctaggccttcatactatttattctccaaggttgttacaactgggaaaattacaagacaggacaggctgggtgcttggagggagctgcaacaagcagcatttcagaagaaaacacgcccatttttcagggcagtagataaacatggtcggatgtatgcagggggtttagatcggcctatccagagaccattcatattgcgggattggcgatttggtcattatgaaatggaaggcttgcaggatcctttcagtcgctttataagatccattttttcaccaattttgcgcaagaagaagattcattacattgagtatgaggatatttcttatgctatttccccctga

SEQ ID NO: 2166 - protein, 654 aa, Sorghum bicolor
  misc_feature: Ceres ANNOT ID no. 6019891
  misc_feature (154)..(557): Pfam Id: Glyco_hydro_1 Pfam Desc: Glycosyl hydrolase family 1
  misc_feature (115)..(422): NCBI GI: 16930457 NCBI Desc: at3g06510/f5e6_16 [arabidopsis thaliana]
  misc_feature (115)..(644): NCBI GI: 6685165 NCBI Desc: beta-glucosidase [arabidopsis thaliana]
  misc_feature (196)..(558): NCBI GI: 126015104 NCBI Desc: glycoside hydrolase, family 1 [staphylothermus marinus f1]
  misc_feature (183)..(557): NCBI GI: 106891335 NCBI Desc: glycoside hydrolase, family 1 [roseiflexus sp. rs-1]
  misc_feature (173)..(557): NCBI GI: 1914799 NCBI Desc: beta-glucosidase [thermococcus sp.]
  misc_feature: Useful for making plants with altered cell wall content and/or composition
  misc_feature: GREAT-hit functional homolog of the protein sequence encoded by LOCUS at3g06510
  misc_feature: Useful for making plants with altered cell wall content and/or composition
  misc_feature: Functional homolog of the protein sequence given in SEQ ID NO 13779
MPLPAFLAAAARLAVLVAAAVTAANAASFARYRRRHLRRIPNPIDESADPIADFRALPSNSAAASAGEDVAEDGNFFFGLATAPAHVEDRLEDAWLQFAVEHSCDDKEAMRDHKTADAVMASAAGDGGAQLASRSRGDEKAVDGEKRKPLKVAMEAMLRGFEMFAYGGEAGSGDNCSHNVAAWHNVPCPQERLKFWSDPDTELKLAKETGISVFRLGIDWTRVMPKAPTEESKSSVNFAALERYRWIIQRVHEYGMKVMLTLFHHSLPPWAGEYGGWRMEKTVKYFMDFVRLVVDRVSDLVDYWVVFNEPHVFVMLTYCAGAWPGGDPNAIEVATSALPTGVYNQALHWMAIAHAEAYDYIHSESKSKRKPFVGVAHHVSFTRPYGLFDVAAVTLANSLTLFPYVDSICDKLDFIGINYYGQEVISGPGLKLVDNDEYSESGRGVYPDGLFRILIQFNERYKSLNIPFIITENGVSDETDLIRKPYILEHLLAIYAAIIMGVPVLGYLFWTMSDNWEWADGYGPKFGLVAVDRANNLARKPRPSYYLFSKVVTTGKITRQDRLGAWRELQQAAFQKKTRPFFRAVDKHGRMYAGGLDRPIQRPFILRDWRFGHYEMEGLQDPFSRFIRSIFSPILRKKKIHYIEYEDISYAISP

SEQ ID NO: 2167 - DNA, 3267 bp, Sorghum bicolor
  misc_feature: Ceres ANNOT ID no. 6019980
  misc_feature: Encodes the peptide sequence at SEQ ID NO 2168
atggagttcgacaccgcccccgccgccgcccttgccggcgacgagctgcggcggttcctcgccgccaccctcagccccgacaaggcgtcggtggacgccgcggccgcggggctcgacgcgctcgctgcggacccacgcttcccgctcgccatcctcgccgtcgccgcaggggatggtgatcaggggatgagagttgctgcagcggcatacttgaaaaactttacccggcggaatttggaaagcagtctgtcttcgtctgagcattacaaggagttccgtgaccaacttgcccaggctttgcttcgagtggaacctgcaatttttcgagtgctgattgaagttttccgccaagttgttgaaaaagattttgtcaaggataacttgtggcctgagcttatccctcagttgaaattagtgatccagagcagcaatctagttagtccaggccagcagcctgaatggaataccatcaatgctctcaaagtacttcaatctgttgtgaggcccttccagtatttcttgaatccaaaagttgcaaaagagcctgttccacaacagttggaggaaattgccgcagagattcttgtaccattgcaagtgacattccatcacttctctgacaaggttctgtcgtcacctgatgggactaacatggaatatgagcagctcctactcatcacatgcaaatgcatgaatttcactgtgaggtcatacatgccatctagggtgaaacagattttgccttccttttgcaaagacatgttccgtatactagattctttgaactttaatagtcttattgaagacggacctactgtgaggctcaagattgcaaagagatgtctcattatattttgcgcacttgttacacgtcaccggaaacatgcagataaccagatgccacatattgtcaactgcgcaatcaaaatatcaaaacaaagcattcatttaagtaaacttgactctctccccaatcggattttttcattagcatttgatgtgatttctcgagttttggaaacaggaccgggatggcgactagtttcaccacatttttcttcacttcttgattcagcaatttttccagcattagcgttgaatgagaaggatatagcagaatgggaggaggatactgatgagtatatgcaaaagaatcttccttctgaacttgatgacatttcaggatggactgaggatttgttcactgccagaaaaagtgcaatcaatttacttggtgttatagcgctgtcaaagggtccaccagttgcatctgcagcatccaagcgtaagaaaggtgataaaagtaaagggaaatctgaaaggagctcaattggggagttattggtcatcccattcctgtcaaaatttcctataccttcccatggtgaagatgcatcatcaatggcagtgcggaattattttggagttttgatggcatatggaggcctacaagattttctgactgaaaagaaagatttgacaattacattgatcaggaaccggattcttccactatattctttggatccatgcagcccgtatttgatttctacagctaattgggttattggtcagcttgctatatgcctaccagaggacatgagtactagtatttatcagtccttaatgaaggcattgaagatggaggatgtggatgacataacttgctatccggtttgtgcctctgcttctggtgctattgcagaactcatcgagaatagttatgctccacctgactggctcgttcttttgcaagtggttgtgaaaagaataagtaccggagacgaaaatgagtctgctcttctgtttaagcttctgggcacaatagttgagggtggacaagaaaaagttctatctcatatccctgaaattgtgtctaacattgctaatactgtaatggagcacctgccccctgtcccagatccttggcctcagggttttgcagccctggtagcaatggttcaagcttgggagagctctgcaccagatgaaaacaagacacatgaaaagagggtctggcagtcaggccagtctgccattgctcaaacaatttcattgctgttacaaaaagcttggttgttgcaagttgacaatatggagaatatcggttctgcattgccacctccgtcatgtgtaaatgatgcttctatgttacttgagtttgtcatgagttctgttacttgcatggaagaaactgcaagtatgaaggtctttgagctggtagctatatgggctgacactattgctaactgggactcctgggaggagatggaggatcagggttttttcaacgcaattaaagaagctgtcaatttccaccaaagatttgaccttgacggtttcttcctgaaaatgcttccgtcgcagtctgaaattggttcacagagttcagtcattggtcgggtttctaattttgtgaccagggcaattgcagcttacccatctgcaacatggagggcatgctcatgcgtccatacagtactgcacgctccaaatttctcccttgcaacacaagatgctagaaaaactattgctgaatcctttgcacaagcagcgttttcccatttcaaatctatatctgacagtcctgctgggctatggaaaccactattgttggcaatatcttcatgctacatttgctatccagatgccattgaacaagtcttaaacaaatttgatggtaatggttttgcaatctggacatctgcattggcacaagtctcaagcagctcattcaatcctggcctgtcatctgaatctgagatcaagttagctgtgctgaccttatcaactgtgattaaccatctcgtgtccctttccatgggtggcaccaaagtggtacaagactgctatgtatcactgatggaatcttgcattcagctgaaggaagttgaagaggatggggacaatgatgatgatgatggcgctgaagatcttgatgatgacgatgaagaggaagacaccgaagacgatgatgaggattcggacgatgatgatgtgcgagaagaaacagaagaggaattccttgaaagatatgcactagcagctgcgggtgagtcaatcgaggctatcgaggaaggagacattgatgaagaaacccaagacattgaattaggctctctggatgacgtggacatacaacaggtggttatttccctgatgcagaaacatcctgctttgcaggcccaaacgtttccagacagcctggttgaaagaattacagaaacattcccagaataccaacagtttttccaagtccatcgataa

SEQ ID NO: 2168 - protein, 1088 aa, Sorghum bicolor
  misc_feature: Ceres ANNOT ID no. 6019980
  misc_feature (15)..(1084): NCBI GI: 145338625 NCBI Desc: protein transporter [arabidopsis thaliana]
  misc_feature (897)..(1080): NCBI GI: 79315642 NCBI Desc: protein transporter [arabidopsis thaliana]
  misc_feature (897)..(1080): NCBI GI: 79450170 NCBI Desc: protein transporter [arabidopsis thaliana]
  misc_feature (897)..(1045): NCBI GI: 116309516 NCBI Desc: osigba0137o04.8 [oryza sativa (indica cultivar-group)]
  misc_feature (20)..(403): NCBI GI: 5453998 NCBI Desc: importin 7 [homo sapiens]
MEFDTAPAAALAGDELRRFLAATLSPDKASVDAAAAGLDALAADPRFPLAILAVAAGDGDQGMRVAAAAYLKNFTRRNLESSLSSSEHYKEFRDQLAQALLRVEPAIFRVLIEVFRQVVEKDFVKDNLWPELIPQLKLVIQSSNLVSPGQQPEWNTINALKVLQSVVRPFQYFLNPKVAKEPVPQQLEEIAAEILVPLQVTFHHFSDKVLSSPDGTNMEYEQLLLITCKCMNFTVRSYMPSRVKQILPSFCKDMFRILDSLNFNSLIEDGPTVRLKIAKRCLIIFCALVTRHRKHADNQMPHIVNCAIKISKQSIHLSKLDSLPNRIFSLAFDVISRVLETGPGWRLVSPHFSSLLDSAIFPALALNEKDIAEWEEDTDEYMQKNLPSELDDISGWTEDLFTARKSAINLLGVIALSKGPPVASAASKRKKGDKSKGKSERSSIGELLVIPFLSKFPIPSHGEDASSMAVRNYFGVLMAYGGLQDFLTEKKDLTITLIRNRILPLYSLDPCSPYLISTANWVIGQLAICLPEDMSTSIYQSLMKALKMEDVDDITCYPVCASASGAIAELIENSYAPPDWLVLLQVVVKRISTGDENESALLFKLLGTIVEGGQEKVLSHIPEIVSNIANTVMEHLPPVPDPWPQGFAALVAMVQAWESSAPDENKTHEKRVWQSGQSAIAQTISLLLQKAWLLQVDNMENIGSALPPPSCVNDASMLLEFVMSSVTCMEETASMKVFELVAIWADTIANWDSWEEMEDQGFFNAIKEAVNFHQRFDLDGFFLKMLPSQSEIGSQSSVIGRVSNFVTRAIAAYPSATWRACSCVHTVLHAPNFSLATQDARKTIAESFAQAAFSHFKSISDSPAGLWKPLLLAISSCYICYPDAIEQVLNKFDGNGFAIWTSALAQVSSSSFNPGLSSESEIKLAVLTLSTVINHLVSLSMGGTKVVQDCYVSLMESCIQLKEVEEDGDNDDDDGAEDLDDDDEEEDTEDDDEDSDDDDVREETEEEFLERYALAAAGESIEAIEEGDIDEETQDIELGSLDDVDIQQVVISLMQKHPALQAQTFPDSLVERITETFPEYQQFFQVHR

SEQ ID NO: 2169 - DNA, 1272 bp, Sorghum bicolor
  misc_feature: Ceres ANNOT ID no. 6019984
  misc_feature: Encodes the peptide sequence at SEQ ID NO 2170
atggcgcgcaagaagatccgggagtacgactccaagcgcctcctcagggagcacctcaagcgcctcgccggcatcgacctcaccatcctctccgcccagatcacacagtcaacggactttgcagagcttgtgagccagcagccatggctgtcaaccatgaagctagtggtgaagcctgatatgctgttcgggaagcgtgggaagagcggcctcgtcgctctcaacttggacttcgatcaagtcaaggagtttgtcaaggagcggcttggagttgagattgagatgggcggttgcaaggctccaatcacgaccttcatcgtcgagccgtttgtgccccatgatcaagagtactacctttcaattgtttcagagaggctgggcagcaccatcagcttctcagagtgtggtgggattgagatcgaggagaactgggacaaggttaagacgatttttctgcctactgagaagccaatgacacctgattcatgtgctccgttgattgcaacgcttccattggaggcacgtgggaaaattggtgacttcattaaaggagtgtttgctgtcttccaagacttggatttctcatttcttgagatgaatccattcaccatggtcaacggggagccatatcctctggacatgaggggagaactagatgacacagcagctttcaagaacttcaagaagtggggagatatagagttccctctaccttttggaagagtactcagctctacagaaagtttcatccatgaacttgatgagaagacaagtgcctctctgaagttcacagttttgaacccaaaaggtcgtatctggacaatggttgcgggtggtggtgctagtgtcatatatgctgatacagttggagacttgggatacgcgtcagagcttggaaactatgcagagtatagtggtgctcctaatgaggaggaggttctgaattatgccagagttgtacttgattgtgcaactgctgatcctgatggccgcaagagagcccttctcattggaggtggcatagctaacttcactgatgttgctgccacattcaatggcatcatccgggccttaagagagaaggaatccaagttgaaggcatcaaggatgcacatttatgttcgccgaggtggtccaaattaccaatctggactggccaaaatgcgcaagcttggtgcggaactcggtgttccaatcgaggtgtatggaccagaagagactatgactggaatctgcaaacaagcaattgaatgcatcatggctgcagcgtaa

SEQ ID NO: 2170 - protein, 423 aa, Sorghum bicolor
  misc_feature: Ceres ANNOT ID no. 6019984
  misc_feature (5)..(204): Pfam Id: ATP-grasp_2 Pfam Desc: ATP-grasp domain
  misc_feature (1)..(423): NCBI GI: 15919089 NCBI Desc: atp citrate lyase b-subunit [lupinus albus]
  misc_feature (1)..(423): NCBI GI: 2462746 NCBI Desc: similar to atp-citrate-lyase [arabidopsis thaliana]
  misc_feature (1)..(423): NCBI GI: 22136126 NCBI Desc: similar to atp-citrate-lyase [arabidopsis thaliana]
  misc_feature (1)..(233): NCBI GI: 115486715 NCBI Desc: os11g0693800 [oryza sativa (japonica cultivar-group)]
  misc_feature (1)..(416): NCBI GI: 114054990 NCBI Desc: atp citrate lyase beta subunit [desulfurobacterium crinifex]
  misc_feature: Useful for making plants with modulated root development
  misc_feature: Functional homolog of the protein sequence given in SEQ ID NO 13780
MARKKIREYDSKRLLREHLKRLAGIDLTILSAQITQSTDFAELVSQQPWLSTMKLVVKPDMLFGKRGKSGLVALNLDFDQVKEFVKERLGVEIEMGGCKAPITTFIVEPFVPHDQEYYLSIVSERLGSTISFSECGGIEIEENWDKVKTIFLPTEKPMTPDSCAPLIATLPLEARGKIGDFIKGVFAVFQDLDFSFLEMNPFTMVNGEPYPLDMRGELDDTAAFKNFKKWGDIEFPLPFGRVLSSTESFIHELDEKTSASLKFTVLNPKGRIWTMVAGGGASVIYADTVGDLGYASELGNYAEYSGAPNEEEVLNYARVVLDCATADPDGRKRALLIGGGIANFTDVAATFNGIIRALREKESKLKASRMHIYVRRGGPNYQSGLAKMRKLGAELGVPIEVYGPEETMTGICKQAIECIMAAA

SEQ ID NO: 2171 - DNA, 732 bp, Sorghum bicolor
  misc_feature: Ceres ANNOT ID no. 6020020
  misc_feature: Encodes the peptide sequence at SEQ ID NO 2172
atggtgacagtgagagaggagatgcgcaaggggccatggacagaggaggaggacatgcaactggtatgtactgtccgccttctcggtgaccgccgctgggactccattgcccaggtctcaggcctcaaccggtcgggcaagagctgccgcatgcggtgggtgaactacctccaccctagccgcaagcatggacgcttgtcgcagcaagaggaacggcttgtcatcgagctccattctcgctggggtaacagttggtctaggatagcccggaggctgccgggccgcaccgacaacgacatcaagaactactggaagacacgcatgagaatgaaagcgcaagagagggagacgagcatgtcaccttcgtcactgacgacatacacgtcctgcctccttgacagtaattctccagtcgatgtgatgagctgtggtgacactcacaataatttcagtagctgcatcataggtagtgcccttgagagcacacggactgtcgacgatggattcgtcatggatcagatttggagggagatggagacaccactgcaggcgcctgccttgccgcaggtcattcatcaagcagacgagaaaacatgcagcagtattgttcccttgtgcactccggcaacaacagctgccatgtgggatgatcaatgccctgaggtgttctggaacatggatgctgaagaaataaggatgttggctccacaatttgactgcgctgaatcgtga

SEQ ID NO: 2172 - protein, 243 aa, Sorghum bicolor
  misc_feature: Ceres ANNOT ID no. 6020020
  misc_feature (10)..(57): Pfam Id: Myb_DNA-binding Pfam Desc: Myb-like DNA-binding domain
  misc_feature (63)..(108): Pfam Id: Myb_DNA-binding Pfam Desc: Myb-like DNA-binding domain
  misc_feature (1)..(237): NCBI GI: 68480278 NCBI Desc: myb transcription factor mybas1-3 [oryza sativa (japonica cultivar-group)]
  misc_feature (1)..(238): NCBI GI: 56605398 NCBI Desc: myb17 protein [oryza sativa (japonica cultivar-group)]
  misc_feature (1)..(238): NCBI GI: 69001888 NCBI Desc: myb transcription factor mybas2-3 [oryza sativa (japonica cultivar-group)]
  misc_feature (1)..(221): NCBI GI: 9758843 NCBI Desc: myb-related transcription factor-like protein [arabidopsis thaliana]
  misc_feature (66)..(237): NCBI GI: 68480252 NCBI Desc: myb transcription factor mybas1-2 [oryza sativa (japonica cultivar-group)]
  misc_feature: The sequence is a functional homolog of SEQ ID NO 126 in the 10/412,699 US patent application
  misc_feature: The sequence is a functional homolog of SEQ ID NO 1564 in the 10/374,780 US patent application
  misc_feature: Useful for making plants with altered alkaloid content
  misc_feature: Useful for making plants with altered lignin content
  misc_feature: Useful for making plants with modulated nitrogen use efficiency
  misc_feature: Functional homolog of the protein sequence given in SEQ ID NO 13600
  misc_feature: The sequence is a functional homolog of SEQ ID NO 2898 in the 10/374,780 US patent application
  misc_feature: The sequence is a functional homolog of SEQ ID NO 494 in the 10/225,066 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO. 395 in the 11/188,298 US application
MVTVREEMRKGPWTEEEDMQLVCTVRLLGDRRWDSIAQVSGLNRSGKSCRMRWVNYLHPSRKHGRLSQQEERLVIELHSRWGNSWSRIARRLPGRTDNDIKNYWKTRMRMKAQERETSMSPSSLTTYTSCLLDSNSPVDVMSCGDTHNNFSSCIIGSALESTRTVDDGFVMDQIWREMETPLQAPALPQVIHQADEKTCSSIVPLCTPATTAAMWDDQCPEVFWNMDAEEIRMLAPQFDCAES

SEQ ID NO: 2173 - DNA, 687 bp, Sorghum bicolor
  misc_feature: Ceres ANNOT ID no. 6020022
  misc_feature: Encodes the peptide sequence at SEQ ID NO 2174
atggtgactgtgagagaggagatgcgtaaagggccatggacagagcaggaggacatgcaactggtatgcactgtccgcctctttggtgaccgtcgttgggacttcattgcccaagtctcaggcctcaacaggacaggaaagagctgccgcctgcggtgggtgaactaccttcatcctggcctcaagcatggccgcatgtcaccacaagaagaacgccttattattgagctccatgctcggtgggggaacaggtggtctaggatagcacggaggctgccagggcgtacagacaacgagatcaagaactactggagaacacacatgagaaagaaagcacaggagaggaagatgagcatgtcatcaccttcatcctcatgctcctcactgacataccaagcctgccatcttgacactgttccagtcattgggatgagcagtggtgacactcacaatggtggctgcgtcaccagcgccctcgagaacacacagagtgtcatggatggatatcccatggaccagatatggaaggagattgaggcacctcaggcacctgccttgctgggtattgctgaagggaaagagaagacatgcagcagtatcccctgtcatctaccatcatctgctatgtgggactacaaatatcctgaggtattctggaagatggaagatcaagaaatcatgatgtga

SEQ ID NO: 2174 - protein, 228 aa, Sorghum bicolor
  misc_feature: Ceres ANNOT ID no. 6020022
  misc_feature (10)..(57): Pfam Id: Myb_DNA-binding Pfam Desc: Myb-like DNA-binding domain
  misc_feature (63)..(108): Pfam Id: Myb_DNA-binding Pfam Desc: Myb-like DNA-binding domain
  misc_feature (1)..(228): NCBI GI: 68480278 NCBI Desc: myb transcription factor mybas1-3 [oryza sativa (japonica cultivar-group)]
  misc_feature (1)..(224): NCBI GI: 56605398 NCBI Desc: myb17 protein [oryza sativa (japonica cultivar-group)]
  misc_feature (1)..(224): NCBI GI: 69001888 NCBI Desc: myb transcription factor mybas2-3 [oryza sativa (japonica cultivar-group)]
  misc_feature (66)..(228): NCBI GI: 68480252 NCBI Desc: myb transcription factor mybas1-2 [oryza sativa (japonica cultivar-group)]
  misc_feature (1)..(228): NCBI GI: 9758843 NCBI Desc: myb-related transcription factor-like protein [arabidopsis thaliana]
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: The sequence is a functional homolog of SEQ ID NO 126 in the 10/412,699 US patent application
  misc_feature: The sequence is a functional homolog of SEQ ID NO 1564 in the 10/374,780 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: Useful for making plants with altered alkaloid content
  misc_feature: Useful for making plants with altered lignin content
  misc_feature: Useful for making plants with modulated nitrogen use efficiency
  misc_feature: Functional homolog of the protein sequence given in SEQ ID NO 13600
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO 1083 in the 10/374,780 US patent application
  misc_feature: The sequence is a functional homolog of SEQ ID NO 2159 in the 10/666,642 US patent application
  misc_feature: The sequence is a functional homolog of SEQ ID NO 372 in the 11/435,388 US patent application
  misc_feature: The sequence is a functional homolog of SEQ ID NO 374 in the 10/714,887 US patent application
  misc_feature: The sequence is a functional homolog of SEQ ID NO 1085 in the 10/374,780 US patent application
  misc_feature: The sequence is a functional homolog of SEQ ID NO 1086 in the 10/374,780 US patent application
  misc_feature: The sequence is a functional homolog of SEQ ID NO 2161 in the 10/666,642 US patent application
  misc_feature: The sequence is a functional homolog of SEQ ID NO 2163 in the 10/666,642 US patent application
  misc_feature: The sequence is a functional homolog of SEQ ID NO 374 in the 11/435,388 US patent application
  misc_feature: The sequence is a functional homolog of SEQ ID NO 376 in the 10/714,887 US patent application
  misc_feature: The sequence is a functional homolog of SEQ ID NO 376 in the 11/435,388 US patent application
  misc_feature: The sequence is a functional homolog of SEQ ID NO 378 in the 10/714,887 US patent application
  misc_feature: The sequence is a functional homolog of SEQ ID NO. 395 in the 11/188,298 US application
MVTVREEMRKGPWTEQEDMQLVCTVRLFGDRRWDFIAQVSGLNRTGKSCRLRWVNYLHPGLKHGRMSPQEERLIIELHARWGNRWSRIARRLPGRTDNEIKNYWRTHMRKKAQERKMSMSSPSSSCSSLTYQACHLDTVPVIGMSSGDTHNGGCVTSALENTQSVMDGYPMDQIWKEIEAPQAPALLGIAEGKEKTCSSIPCHLPSSAMWDYKYPEVFWKMEDQEIMM

SEQ ID NO: 2175 - DNA, 552 bp, Sorghum bicolor
  misc_feature: Ceres ANNOT ID no. 6020045
  misc_feature: Encodes the peptide sequence at SEQ ID NO 2176
atggccaccacgaccaccgaacgaccgacggcgacggcgagcaaccacacccagctgctgcggctgtacctgtcgctgtcgacgacggcgagcaaggtgatcgcgaagaagcagcacggcggcgtcatctgcagccaccaacagcagcagcaccgggccggcggcggcgcgttccggtgcaagacgtgcgggcgcgcgttcccgacgttccaggcgctgggcgggcaccggacgagccacaagcggccgctggtgcgcgcgcacggcctcgacctcctcctcggcgcgcgccccggcaagggcgccgccgccaccgacgtgcaccggtgcaccacctgcgccgccgtgttccccaccgggcaggcgctcggcggacacatgcgccggcacagggcagcggcggcggcggcggcgttcgacttcaatgtcgccgtgcacggcgagagcgagacggcggcaagggttgctgttgatgcctgcttgtctggagagatgcaggacgagagcgaggatgatgtcgcggggcccattaggttattcaagttcatatga

SEQ ID NO: 2176 - protein, 183 aa, Sorghum bicolor
  misc_feature: Ceres ANNOT ID no. 6020045
  misc_feature (7)..(173): NCBI GI: 32172482 NCBI Desc: c2h2 type zinc finger transcription factor zfp17 [oryza sativa (japonica cultivar-group)]
  misc_feature (40)..(163): NCBI GI: 30420734 NCBI Desc: zinc finger transcription factor zfp19 [oryza sativa (japonica cultivar-group)]
  misc_feature (40)..(163): NCBI GI: 56784648 NCBI Desc: zinc finger transcription factor zfp19 [oryza sativa (japonica cultivar-group)]
  misc_feature (40)..(163): NCBI GI: 115440935 NCBI Desc: os01g0838600 [oryza sativa (japonica cultivar-group)]
  misc_feature (25)..(138): NCBI GI: 55734106 NCBI Desc: zinc finger dna-binding protein [catharanthus roseus]
  misc_feature: The plant flowers significantly late compared to wild-type.
  misc_feature: The plant is abnormally large.
  misc_feature: The plant is abnormally small.
  misc_feature: The sequence is a functional homolog of SEQ ID NO 1212 in the 10/412,699US patent application
  misc_feature: The sequence is a functional homolog of SEQ ID NO 1213 in the 10/412,699US patent application
  misc_feature: The sequence is a functional homolog of SEQ ID NO 1214 in the 10/412,699US patent application
  misc_feature: The sequence is a functional homolog of SEQ ID NO 1215 in the 10/412,699US patent application
  misc_feature: The sequence is a functional homolog of SEQ ID NO 1288 in the 10/666,642US patent application
  misc_feature: The sequence is a functional homolog of SEQ ID NO 1289 in the 10/666,642US patent application
  misc_feature: The sequence is a functional homolog of SEQ ID NO 1290 in the 10/666,642US patent application
  misc_feature: The sequence is a functional homolog of SEQ ID NO 1291 in the 10/666,642US patent application
  misc_feature: The sequence is a functional homolog of SEQ ID NO 1292 in the 10/666,642US patent application
  misc_feature: The sequence is a functional homolog of SEQ ID NO 1382 in the 10/666,642US patent application
  misc_feature: The sequence is a functional homolog of SEQ ID NO 140 in the 10/225,066US patent application
  misc_feature: The sequence is a functional homolog of SEQ ID NO 2200 in the 10/374,780US patent application
  misc_feature: The sequence is a functional homolog of SEQ ID NO 228 in the 10/714,887US patent application
  misc_feature: The sequence is a functional homolog of SEQ ID NO 228 in the 11/435,388US patent application
  misc_feature: The sequence is a functional homolog of SEQ ID NO 250 in the 10/714,887US patent application
  misc_feature: The sequence is a functional homolog of SEQ ID NO 250 in the 11/435,388US patent application
  misc_feature: The sequence is a functional homolog of SEQ ID NO 558 in the 10/666,642US patent application
  misc_feature: The sequence is a functional homolog of SEQ ID NO 62 in the 10/374,780US patent application
  misc_feature: The sequence is a functional homolog of SEQ ID NO 622 in the 10/374,780US patent application
  misc_feature: The sequence is a functional homolog of SEQ ID NO 623 in the 10/374,780US patent application
  misc_feature: The sequence is a functional homolog of SEQ ID NO 624 in the 10/374,780US patent application
  misc_feature: The sequence is a functional homolog of SEQ ID NO 625 in the 10/374,780US patent application
  misc_feature: The sequence is a functional homolog of SEQ ID NO 626 in the 10/374,780US patent application
  misc_feature: The sequence is a functional homolog of SEQ ID NO 830 in the 10/666,642US patent application
  misc_feature: The sequence is a functional homolog of SEQ ID NO 831 in the 10/666,642US patent application
  misc_feature: The sequence is a functional homolog of SEQ ID NO 832 in the 10/666,642US patent application
  misc_feature: The sequence is a functional homolog of SEQ ID NO 903 in the 10/374,780US patent application
  misc_feature: The sequence is a functional homolog of SEQ ID NO 904 in the 10/374,780US patent application
  misc_feature: The sequence is a functional homolog of SEQ ID NO 905 in the 10/374,780US patent application
  misc_feature: The sequence is a functional homolog of SEQ ID NO 906 in the 10/374,780US patent application
  misc_feature: The sequence is a functional homolog of SEQ ID NO 907 in the 10/374,780US patent application
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated nitrogen use efficiency
  misc_feature: Useful for making plants with modulated drought sensitivity
  misc_feature: Functional homolog of the protein sequence given in SEQ ID NO 13265
  misc_feature: Functional homolog of the protein sequence given in SEQ ID NO 13271
  misc_feature: The sequence is a functional homolog of SEQ ID NO 1212 in the 20040045049 US patent application
  misc_feature: The sequence is a functional homolog of SEQ ID NO 1213 in the 20040045049 US patent application
  misc_feature: The sequence is a functional homolog of SEQ ID NO 1214 in the 20040045049 US patent application
  misc_feature: The sequence is a functional homolog of SEQ ID NO 1215 in the 20040045049 US patent application
  misc_feature: The sequence is a functional homolog of SEQ ID NO 140 in the 20050160493 US patent application
  misc_feature: The sequence is a functional homolog of SEQ ID NO 250 in the 20060015972 US patent application
  misc_feature: The sequence is a functional homolog of SEQ ID NO 622 in the 20060162006 US patent application
  misc_feature: The sequence is a functional homolog of SEQ ID NO 623 in the 20060162006 US patent application
  misc_feature: The sequence is a functional homolog of SEQ ID NO 624 in the 20060162006 US patent application
  misc_feature: The sequence is a functional homolog of SEQ ID NO 625 in the 20060162006 US patent application
  misc_feature: The sequence is a functional homolog of SEQ ID NO 626 in the 20060162006 US patent application
  misc_feature: The sequence is a functional homolog of SEQ ID NO 907 in the 20060162006 US patent application
  misc_feature: The sequence is a functional homolog of SEQ ID NO 830 in the 20070033671 US patent application
  misc_feature: The sequence is a functional homolog of SEQ ID NO 831 in the 20070033671 US patent application
  misc_feature: The sequence is a functional homolog of SEQ ID NO 832 in the 20070033671 US patent application
  misc_feature: Functional homolog of the protein sequence given in SEQ ID NO 13580
  misc_feature: The sequence is a functional homolog of SEQ ID NO. 457 in the 11/188,298 US application
  misc_feature: The sequence is a functional homolog of SEQ ID NO. 351 in the 11/188,298 US application
MATTTTERPTATASNHTQLLRLYLSLSTTASKVIAKKQHGGVICSHQQQQHRAGGGAFRCKTCGRAFPTFQALGGHRTSHKRPLVRAHGLDLLLGARPGKGAAATDVHRCTTCAAVFPTGQALGGHMRRHRAAAAAAAFDFNVAVHGESETAARVAVDACLSGEMQDESEDDVAGPIRLFKFI

SEQ ID NO: 2177 - DNA, 1023 bp, Sorghum bicolor
  misc_feature: Ceres ANNOT ID no. 6020049
  misc_feature: Encodes the peptide sequence at SEQ ID NO 2178
atgaagccacagatcgaagaggccatcatggaactgtgtggcaactccacaccccttcccagaagcatggtgatcgcggaccttggctgctcttgtggccccaatgcactcaccatggtctctgctgctgttgatgccattcatcgccagtgtcttgaactccaacagccaccgcctgagctgagtctactcctcaacgaccttcccagcaatgatttcaacactacaatcaagcacttggtagagttccaagaaaggaaaaacatcgacaagggtcagcatggtttctctccatttgtcatgactagtattgtgcctgggtccttctatggaagactgttcactactggatccgtgcatcttgtcctctcatcaaatagcttgcactggctttcaaaggtacctgaagacctactgaagaatggcattccgatgtaccatagcgacgagcaactaaggcggaaaacatggcccgttgtgcttgatgcttatgcccagcaatttagaaaggacctcctttggtttttggagtgcagggcgcaagagatggttcctggaggaaggttaattgtttccttgactggaacacaatctccggctactgccagcaatggatcagctcaacaaatgttggagttcatagcccgtattttagacgacatggcatcaaggggtgtgcttgataagcaaaaattgaaggctttctacataccattatattcgccgtctgagaaagaagtaaaggagataatagaagagcaaggttctttctccattaataaacttcaagttcatgaccctatagctggtgtgaacaaagcaatgatcagccccaagataaaggcatatgcgcttagggctgccattgagccaataatactggaccattttggctcgtcggaagatcttatggatgaatttaccaacacagcagagaagttcaacagccaagctctcttacaaaatgaacttaccaagaatcctatggttttccttgctctttctcttgaaaggcagagttga

SEQ ID NO: 2178 - protein, 340 aa, Sorghum bicolor
  misc_feature: Ceres ANNOT ID no. 6020049
  misc_feature (5)..(337): Pfam Id: Methyltransf_7 Pfam Desc: SAM dependent carboxyl methyltransferase
  misc_feature (1)..(293): NCBI GI: 115467776 NCBI Desc: os06g0313200 [oryza sativa (japonica cultivar-group)]
  misc_feature (2)..(300): NCBI GI: 23957318 NCBI Desc: s-adenosyl-l-methionine:salicylic acid methyltransferase [antirrhinum majus]
  misc_feature (2)..(339): NCBI GI: 13235641 NCBI Desc: s-adenosyl-l-methionine:salicylic acid carboxyl methyltransferase [stephanotis floribunda]
  misc_feature (2)..(336): NCBI GI: 68146505 NCBI Desc: s-adenosyl-l-methionine:salicylic acid carboxyl methyltransferase [hoya carnosa]
  misc_feature (6)..(314): NCBI GI: 134303364 NCBI Desc: benzoic acid/salicylic acid methyltransferase [protoschwenkia mandonii]
MKPQIEEAIMELCGNSTPLPRSMVIADLGCSCGPNALTMVSAAVDAIHRQCLELQQPPPELSLLLNDLPSNDFNTTIKHLVEFQERKNIDKGQHGFSPFVMTSIVPGSFYGRLFTTGSVHLVLSSNSLHWLSKVPEDLLKNGIPMYHSDEQLRRKTWPVVLDAYAQQFRKDLLWFLECRAQEMVPGGRLIVSLTGTQSPATASNGSAQQMLEFIARILDDMASRGVLDKQKLKAFYIPLYSPSEKEVKEIIEEQGSFSINKLQVHDPIAGVNKAMISPKIKAYALRAAIEPIILDHFGSSEDLMDEFTNTAEKFNSQALLQNELTKNPMVFLALSLERQS

SEQ ID NO: 2179 - DNA, 588 bp, Sorghum bicolor
  misc_feature: Ceres ANNOT ID no. 6020057
  misc_feature: Encodes the peptide sequence at SEQ ID NO 2180
atgtcgctgtcgtggctgacgagcagcaacgcgtacaagtcgccggcgttcatcgcgctggtgagcgcgctgtgcgtggccgtggtgctgctgctgcaccaatgcgtcctcgtcaactgctgccacggcggcgccgccgccgccgaccgcgaccggcgccgacgcaggcagcagcaccaccagcggcacgtcgtcggcgtggtcaccacgaccacgtcaaccgacgcgcggcggcgccagcaggacggcaacgacgacgacgtcagcgtggaggtgagcgcgacgtcgcgcacgcacctcgtcgccgcggcggtggtgtgccggtaccgcaaggaggaggcctggaaggagacgacgtgcccggtgtgcctggccgacttcgacgacggcgaggccgtgcgggtgctccccgagtgcatgcactacttccacgccgagtgcatcgacacctggctccgcggcagcaccagctgcccgatgtgccgcgccgagaccacgccgtcgcccacgccgacacctagctcggcgtccgtgcgccaccacctcgagctctccgtctcgctcgaggagatcctcgtcagatcgtag

SEQ ID NO: 2180 - protein, 195 aa, Sorghum bicolor
  misc_feature: Ceres ANNOT ID no. 6020057
  misc_feature (120)..(161): Pfam Id: zf-C3HC4 Pfam Desc: Zinc finger, C3HC4 type (RING finger)
  misc_feature (8)..(166): NCBI GI: 116311028 NCBI Desc: osigba0142i02-osigba0101b20.2 [oryza sativa (indica cultivar-group)]
  misc_feature (8)..(162): NCBI GI: 41053267 NCBI Desc: zinc finger (c3hc4-type ring finger)-like [oryza sativa (japonica cultivar-group)]
  misc_feature (117)..(173): NCBI GI: 22831074 NCBI Desc: c3hc4-type ring zinc finger protein-like [oryza sativa (japonica cultivar-group)]
  misc_feature (120)..(174): NCBI GI: 116310081 NCBI Desc: h0818e04.19 [oryza sativa (indica cultivar-group)]
  misc_feature (37)..(174): NCBI GI: 92896158 NCBI Desc: zinc finger, ring-type; ringv [medicago truncatula]
  misc_feature: Useful for making plants with altered alkaloid content
  misc_feature: Functional homolog of the protein sequence given in SEQ ID NO 12951
  misc_feature: The sequence is a functional homolog of SEQ ID NO. 329 in the 11/188,298 US application
  misc_feature: The sequence is a functional homolog of SEQ ID NO. 424 in the 11/188,298 US application
  misc_feature: The sequence is a functional homolog of SEQ ID NO. 271 in the 11/188,298 US application
  misc_feature: The sequence is a functional homolog of SEQ ID NO. 350 in the 11/188,298 US application
  misc_feature: The sequence is a functional homolog of SEQ ID NO. 468 in the 11/188,298 US application
MSLSWLTSSNAYKSPAFIALVSALCVAVVLLLHQCVLVNCCHGGAAAADRDRRRRRQQHHQRHVVGVVTTTTSTDARRRQQDGNDDDVSVEVSATSRTHLVAAAVVCRYRKEEAWKETTCPVCLADFDDGEAVRVLPECMHYFHAECIDTWLRGSTSCPMCRAETTPSPTPTPSSASVRHHLELSVSLEEILVRS

SEQ ID NO: 2181 - DNA, 420 bp, Sorghum bicolor
  misc_feature: Ceres ANNOT ID no. 6020091
  misc_feature: Encodes the peptide sequence at SEQ ID NO 2182
atggcgaaactcgccgtcacggtcatcgtcctgctgctcacgttcctcgccggctccactgcgacgaccatgctagcaggtcgccaacaagccaccaggaggagccggttcctgcttgcgaacagcgcggtctacaactcaccgccgccgtcgtacgccgccggttgctccaagaagtcggccgccgccgtgtgcttggctccgggcagcccgggcccgacgtgctgcggcgggcagtgcgtggacacgacggccagcgtcgaccactgtggcggatgcaacaagctctgtaagcacgatcgtagcacgtgctgcggcggccggtgcgtcgacctgctctccgacgaggacaactgcggcgcgtgcgggaaccggtgcaacaacaagtgcagcaacggcttctgtgattacgccctgtaa

SEQ ID NO: 2182 - protein, 139 aa, Sorghum bicolor
  misc_feature: Ceres ANNOT ID no. 6020091
  misc_feature (3)..(138): Pfam Id: Stig1 Pfam Desc: Stigma-specific protein, Stig1
  misc_feature (1)..(138): NCBI GI: 115435646 NCBI Desc: os01g0248000 [oryza sativa (japonica cultivar-group)]
  misc_feature (6)..(138): NCBI GI: 5596435 NCBI Desc: stig1 [petunia x hybrida]
  misc_feature (6)..(138): NCBI GI: 496647 NCBI Desc: stig1 [nicotiana tabacum]
  misc_feature (8)..(138): NCBI GI: 5596437 NCBI Desc: stig1 [petunia x hybrida]
  misc_feature (3)..(138): NCBI GI: 116830031 NCBI Desc: stigma-specific stig1 family protein [arabidopsis thaliana]
MAKLAVTVIVLLLTFLAGSTATTMLAGRQQATRRSRFLLANSAVYNSPPPSYAAGCSKKSAAAVCLAPGSPGPTCCGGQCVDTTASVDHCGGCNKLCKHDRSTCCGGRCVDLLSDEDNCGACGNRCNNKCSNGFCDYAL

SEQ ID NO: 2183 - DNA, 231 bp, Sorghum bicolor
  misc_feature: Ceres ANNOT ID no. 6020108
  misc_feature: Encodes the peptide sequence at SEQ ID NO 2184
atgtcttgcagctgcggatcaagctgcaactgcggctcaagctgcaagtgcggcaagaagtaccccgacctggaggagaagagcaccgcggcgcaggccaccgtcgtcctgggtgtcgccccggagaagacagctgctgccgagttcgaggccgcggcggagtccggcgccgagacctcccacggctgcagctgcggtgacagctgcaagtgcaacccctgcaactgctga

SEQ ID NO: 2184 - protein, 76 aa, Sorghum bicolor
  misc_feature: Ceres ANNOT ID no. 6020108
  misc_feature (1)..(76): Pfam Id: Metallothio_2 Pfam Desc: Metallothionein
  misc_feature (1)..(76): NCBI GI: 236730 NCBI Desc: metallothionein-like protein [zea mays]
  misc_feature (1)..(76): NCBI GI: 90855458 NCBI Desc: metallothioneine [paspalum vaginatum]
  misc_feature (1)..(76): NCBI GI: 4097154 NCBI Desc: type 1 rice metallothionein-like gene; method: conceptual translation supplied by author. [oryza sativa]
  misc_feature (1)..(76): NCBI GI: 2497883 NCBI Desc: metallothionein-like protein type 1
  misc_feature (1)..(76): NCBI GI: 68132182 NCBI Desc: metallothionein [eleusine indica]
MSCSCGSSCNCGSSCKCGKKYPDLEEKSTAAQATVVLGVAPEKTAAAEFEAAAESGAETSHGCSCGDSCKCNPCNC

SEQ ID NO: 2185 - DNA, 813 bp, Sorghum bicolor
  misc_feature: Ceres ANNOT ID no. 6020111
  misc_feature: Encodes the peptide sequence at SEQ ID NO 2186
atggggaggtacagccccgcgtacagccccccgaggagaggatacggcggcaggggaaggagcccgcctccgaggagaggatacggcggtggcggtggccgtggtgaccatggctctgtcagcctcctggtccgcaacattccattgagatgcaggcctgaggaactccgtgtccctttcgaacggtttggccctgttcgggatgtttacctgccaagagactatcacactggggagccaagagggtttggattcgtggagtttgttgatgcttatgatgcttctgaggcgcaataccacatgaaccgtcagatgtttgctgggcgtgaaataactgttgtacttgctgctgatacaaggaagaggcctgaggatatgcgtagacgaactggtccaagaggttattctggtcatgaagggcgtcgtccttatcgccatggccggtctcgttctcgttcatactcgcgttcccgctctccacgcccgcgtggccgtggtagatcacagtcatactcccctgccccgaaaaggcgtgatgactactctgcttccccaccacggtcaaaggaagagaatccgaggtcatcaaaacagcctaaagaaaatgacagggataagaagaggaggtcctatactcccgatgatagaaatgatcgccgtggtgcggagaacggtcatgacgagaggaagaagtccccagcaggcgaggaggacgagaagcctcatcgcggtcgccgcaggtcgccccggccagcgtccatgtcgcctccagggtcgcggtcaaggtcggcgtcgccagctatcagcagctga

SEQ ID NO: 2186 - protein, 270 aa, Sorghum bicolor
  misc_feature: Ceres ANNOT ID no. 6020111
  misc_feature (42)..(113): Pfam Id: RRM_1 Pfam Desc: RNA recognition motif. (a.k.a. RRM, RBD, or RNP domain)
  misc_feature (1)..(269): NCBI GI: 66394215 NCBI Desc: pre-mrna splicing factor [oryza sativa]
  misc_feature (1)..(269): NCBI GI: 113535979 NCBI Desc: os02g0252100 [oryza sativa (japonica cultivar-group)]
  misc_feature (36)..(269): NCBI GI: 32352198 NCBI Desc: pre-mrna splicing factor [oryza sativa (japonica cultivar-group)]
  misc_feature (1)..(263): NCBI GI: 9843657 NCBI Desc: sc35-like splicing factor scl30, 30 kd [arabidopsis thaliana]
  misc_feature (2)..(261): NCBI GI: 9843659 NCBI Desc: sc35-like splicing factor scl33, 33 kd [arabidopsis thaliana]
  misc_feature: The sequence is a functional homolog of SEQ ID NO. 458 in the 11/188,298 US application
MGRYSPAYSPPRRGYGGRGRSPPPRRGYGGGGGRGDHGSVSLLVRNIPLRCRPEELRVPFERFGPVRDVYLPRDYHTGEPRGFGFVEFVDAYDASEAQYHMNRQMFAGREITVVLAADTRKRPEDMRRRTGPRGYSGHEGRRPYRHGRSRSRSYSRSRSPRPRGRGRSQSYSPAPKRRDDYSASPPRSKEENPRSSKQPKENDRDKKRRSYTPDDRNDRRGAENGHDERKKSPAGEEDEKPHRGRRRSPRPASMSPPGSRSRSASPAISS

SEQ ID NO: 2187 - DNA, 2097 bp, Sorghum bicolor
  misc_feature: Ceres ANNOT ID no. 6020114
  misc_feature: Encodes the peptide sequence at SEQ ID NO 2188
atgtccgccgcgccggaggagttcctggcccaggggacctacctcgccgcccccgagcccttctccccctccatcttcctcgacctgcccccgacgccccgccccgatggcgatgacccgacctccgacgacccggcctcctccgacgacctcgtcctccccttcatctcgcggatgctcatggaggaggacatcgacgacaagttcttctaccagttccccgaccaccccgcgctcctcagcgcccagcagccgtacgcacagatcctctccgacgccaccgccgcctcctcatccgactccgccgccatcaccagctcagggaccggcggcagctccaccttctcctcgtcctcttccgcccccgcatctgccgaccccacctggccctatgatccaatcgagctctcccagctgctgcgctcccctccgtacccggacatgggggatgccggcgatggcgtgggcatccagagttcggcatgcgcggaggagacgaagacagagtccaccaccttgcctgctggtgatggtgaccatgccgcgctgttctcagccttcttcggtgcccagaatggggaaaatatggacatgctcaacatggcgttcctcaaaggcatggaagaggccaagaagttcttgcccaccaacaatagccttctgatcaaccttgacgacacctctggccaatccttgggccgcaagaaccatcactcccaagaggacttggaagtggagacaggcagaaacagcaaactgatgatgcctgaacaggaagaagccggtgctagtgagctgttcgacgaattaatgtccggcaaacatgatggattcttgaaaaacatgcaggatcttcgcatcgccatggatagcgagtctgagaagagtgccaggagggtgagtgggaagggggcgcgggggaagcagcatgggaacgagtttgttgacctgcacaccatgctcatccattgcgcacaggcaatggccactggtgatcgccgaagtgcaaccgagatgctgaaacagatcaagcagcactcctctctcagaggggatgcctcagagaggttggcctattgttttgcagaaggactggaggcgcgacttgctggcacagggagccaggtgtaccagtcgctcgtggcaaaacggacatcggttgtggagttcctcaaggcatacaagctattcttggcggccatcagcctcaataaggtgcatatcttcttctccaacaggaacatcatggattccgtggcagggaggagcaaattgcacattgtggcatatggtgtacagcatggtttacagtggccaggtttgctaaattccctagcaggtagagaaggtgggcctccagaggtgaggttcactggcattgaccttccgcaacctgggttccgcccagcctaccagattgaagaaacgggccgccggcttagcaactgtgcccgtgaattcggcgtgccattcaagttccatgctatagcagcaaagtgggagacgatctgtgctaaggacctcaacattgatccagatgaggtgcttgttgtgaacagcgagtgccacttcagcaatttgatggatgagagtgttgacgctgacaccccaagccccagagatttggtgctcaacaacattcgaaagatgcaacccaatattttcatccagattgtccatagtggcacatttggtgctccattcttcctgacacggttccgggaggcactgttctactactcagcactatttgacatgctggatgcaaccattccccgggacaatgatgtacggctgctgatcgagcgggatattgttgggcgatctgccctgaatgttattgcttgtgagggtgcagacaggttggatcgccctgagacttataagcaatggcaggtgcggaaccaccgggctgggctcaagcagctaccattgaatccagagattgtaaagcttgcgagggataaggtcaagaagtattaccacaaagactttctcatcgatgaggatcatcgatggttgttgcagggatggaaagggcgggtcctctttgccatgtcaacatgggttgctgaggataataactccatctgttag

SEQ ID NO: 2188 - protein, 698 aa, Sorghum bicolor
  misc_feature: Ceres ANNOT ID no. 6020114
  misc_feature (291)..(599): Pfam Id: GRAS Pfam Desc: GRAS family transcription factor
  misc_feature (159)..(692): NCBI GI: 115486811 NCBI Desc: os11g0705800 [oryza sativa (japonica cultivar-group)]
  misc_feature (233)..(690): NCBI GI: 15222433 NCBI Desc: scarecrow-like transcription factor 14 (scl14) [arabidopsis thaliana]
  misc_feature (225)..(689): NCBI GI: 125743130 NCBI Desc: scarecrow-like protein 1 [pinus radiata]
  misc_feature (35)..(690): NCBI GI: 8778540 NCBI Desc: f22g5.9 [arabidopsis thaliana]
  misc_feature (112)..(689): NCBI GI: 32813435 NCBI Desc: scarecrow-like protein [lilium longiflorum]
  misc_feature: The sequence is a functional homolog of SEQ ID NO 1324 in the 10/374,780US patent application
  misc_feature: The sequence is a functional homolog of SEQ ID NO 1471 in the 10/412,699US patent application
  misc_feature: The sequence is a functional homolog of SEQ ID NO 1938 in the 10/412,699US patent application
  misc_feature: The sequence is a functional homolog of SEQ ID NO 2202 in the 10/374,780US patent application
  misc_feature: Useful for making plants with modulated growth and phenotype characteristics
  misc_feature: The sequence is a functional homolog of SEQ ID NO 1471 in the 20040045049 US patent application
  misc_feature: The sequence is a functional homolog of SEQ ID NO 1938 in the 20040045049 US patent application
MSAAPEEFLAQGTYLAAPEPFSPSIFLDLPPTPRPDGDDPTSDDPASSDDLVLPFISRMLMEEDIDDKFFYQFPDHPALLSAQQPYAQILSDATAASSSDSAAITSSGTGGSSTFSSSSSAPASADPTWPYDPIELSQLLRSPPYPDMGDAGDGVGIQSSACAEETKTESTTLPAGDGDHAALFSAFFGAQNGENMDMLNMAFLKGMEEAKKFLPTNNSLLINLDDTSGQSLGRKNHHSQEDLEVETGRNSKLMMPEQEEAGASELFDELMSGKHDGFLKNMQDLRIAMDSESEKSARRVSGKGARGKQHGNEFVDLHTMLIHCAQAMATGDRRSATEMLKQIKQHSSLRGDASERLAYCFAEGLEARLAGTGSQVYQSLVAKRTSVVEFLKAYKLFLAAISLNKVHIFFSNRNIMDSVAGRSKLHIVAYGVQHGLQWPGLLNSLAGREGGPPEVRFTGIDLPQPGFRPAYQIEETGRRLSNCAREFGVPFKFHAIAAKWETICAKDLNIDPDEVLVVNSECHFSNLMDESVDADTPSPRDLVLNNIRKMQPNIFIQIVHSGTFGAPFFLTRFREALFYYSALFDMLDATIPRDNDVRLLIERDIVGRSALNVIACEGADRLDRPETYKQWQVRNHRAGLKQLPLNPEIVKLARDKVKKYYHKDFLIDEDHRWLLQGWKGRVLFAMSTWVAEDNNSIC

SEQ ID NO: 2189 - DNA, 1950 bp, Sorghum bicolor
  misc_feature: Ceres ANNOT ID no. 6020117
  misc_feature: Encodes the peptide sequence at SEQ ID NO 2190
atggcagcctcgccggaggttttcttgcctgacctcgaagagcccttctccccctccgtcttccttgacctgcccccgacgcctcgctctgatggcaatggcgacggcaaggacccggcctccgacgatatcgtcctccccttcatcgagcgcatgctcatggaggaggggatcgacgaagagttcttgtaccagtacccgtgccaccccgcgcttctccaagcccaggaatcgtacgcgcaggtcctctccgagcccaccgcggattcgtcttcggacggcaggctgtccgtgtcggtgtcctccggctccgacgcgggagtgggggccgacgacctcaccgcggacgccatcacggcgtccgagcagagtccggcgcgattgggggatgctgtcgtcgatgggctgaactccgcattcttcagtgcccagcaggatgggggaggcaaggccatgttcctcaagggcatggaagaggccaacaagttcctgcctagggacatcgacctgctgcgcggcggctctgccaccgtcatccaagtgaatgaagaggaaagtgccaatggcaggggccgcgagaaccggcacaaccgggatggtgtcctagaggccaatttgggcagggagagcaaaatgatggcgccggagccggaggaatctggtgtggtagttgacgaaatggttgccaatgggttccaattgttcttcagagagatggagggcctccgcatcagtatgggcagcgaggctgagaagaagagcaggaaagggagtgtgcggagtgccaaaggagtggtggacttgtgcaccttgctcatgcattgtgcacaggctgtggcagtggatgaccgccggagcgcagccgaactgctttggaagattaagcagcactcttctccacggggagatgcgacacaaaggctggcacattatttcgcagaggggttggaggcgcgtctggctggttcaggtagcaaactgtacaattcgctcatggcaaagcgcacctcggctgtggacttcctcaaagcctaccggctgtacgcggcagcctgctgcttccgagtggtggcgttcaagttttccaacatgaccatctgcaagtctattgcagggaggaaaagggtacacattgtggattacggcatacagtatggatcccagtggccaggtttgctgaaatgtttatctatatgcccgggagggccaccggaagtgaggatcactggcattgatcttccccagcctgggttccgtccagcttctcaggtcaaggagacagggcggcggcttagcaattatgcctctcaggtcggcatgccgttcaagtaccgtggcattgcggctaagtgggagacggtaggcgttgatgatttagacatcgaccctgatgaggtactcattgtcaatagcatcctccattttggaaacttgatggacgaaggtatcgacactagtagcccaagcccgagggatgttgttctcagcaacatcaggaagatgcgacctgatgcgttcatccttttcgtcacgaatggcacatatagctcaccgtattttgtacaaaggttccgggaagcgctattccactactctgcaatgtttgacatgatggatgccacgaccccacgggacaatgatctacgcgttctggttgagcgtgatctttttggccagtgtgcccaaaatgtcattgcttgtgaaggcttggacagggtggagcgccctgagacatataagaagtggcaattgcggaaccaccgggcagggctgagacagctgccgttggatccagatattgtcaaggctgtgcaggagagtgtcagggacaagtttcatgaggactttgtcattgatgtggatcgtcagtggctcctgggagggtggaagggacgcatactctatgcaatgtcaacatgggctgctgctgattccatgtcggattcttag

SEQ ID NO: 2190 - protein, 649 aa, Sorghum bicolor
  misc_feature: Ceres ANNOT ID no. 6020117
  misc_feature (242)..(550): Pfam Id: GRAS Pfam Desc: GRAS family transcription factor
  misc_feature (2)..(634): NCBI GI: 115486811 NCBI Desc: os11g0705800 [oryza sativa (japonica cultivar-group)]
  misc_feature (89)..(640): NCBI GI: 32813435 NCBI Desc: scarecrow-like protein [lilium longiflorum]
  misc_feature (247)..(640): NCBI GI: 125743148 NCBI Desc: scarecrow-like protein 1 [castanea sativa]
  misc_feature (192)..(645): NCBI GI: 15222433 NCBI Desc: scarecrow-like transcription factor 14 (scl14) [arabidopsis thaliana]
  misc_feature (23)..(640): NCBI GI: 89474466 NCBI Desc: gras4 [solanum lycopersicum]
  misc_feature: The sequence is a functional homolog of SEQ ID NO 1324 in the 10/374,780 US patent application
  misc_feature: The sequence is a functional homolog of SEQ ID NO 1471 in the 10/412,699 US patent application
MAASPEVFLPDLEEPFSPSVFLDLPPTPRSDGNGDGKDPASDDIVLPFIERMLMEEGIDEEFLYQYPCHPALLQAQESYAQVLSEPTADSSSDGRLSVSVSSGSDAGVGADDLTADAITASEQSPARLGDAVVDGLNSAFFSAQQDGGGKAMFLKGMEEANKFLPRDIDLLRGGSATVIQVNEEESANGRGRENRHNRDGVLEANLGRESKMMAPEPEESGVVVDEMVANGFQLFFREMEGLRISMGSEAEKKSRKGSVRSAKGVVDLCTLLMHCAQAVAVDDRRSAAELLWKIKQHSSPRGDATQRLAHYFAEGLEARLAGSGSKLYNSLMAKRTSAVDFLKAYRLYAAACCFRVVAFKFSNMTICKSIAGRKRVHIVDYGIQYGSQWPGLLKCLSICPGGPPEVRITGIDLPQPGFRPASQVKETGRRLSNYASQVGMPFKYRGIAAKWETVGVDDLDIDPDEVLIVNSILHFGNLMDEGIDTSSPSPRDVVLSNIRKMRPDAFILFVTNGTYSSPYFVQRFREALFHYSAMFDMMDATTPRDNDLRVLVERDLFGQCAQNVIACEGLDRVERPETYKKWQLRNHRAGLRQLPLDPDIVKAVQESVRDKFHEDFVIDVDRQWLLGGWKGRILYAMSTWAAADSMSDS

SEQ ID NO: 2191 - DNA, 2058 bp, Sorghum bicolor
  misc_feature: Ceres ANNOT ID no. 6020122
  misc_feature: Encodes the peptide sequence at SEQ ID NO 2192
atggccgcaacgccggaggatgtcgcggacccggagcccttctccccctcgctcttcctcgacctgcctccgacgccccatccccaccaccccgacggcgaaggagacggcgaggacgacctgcaggtgctcccgttcatcagccgcatgctcatggaagaggagggcaccgacgacgacgccatcttgtaccaggagtaccccgaccaccaccctgcgctcctccgtgcgaagcagcccttcgcccagatcctctcggctcccgcggccgccaccgactctgtttccggccccgtcaccaccaactctgctttcgacgcattcgccgacgccacctggccctatgatccagtcgagctctccgagctgctcttttctaggacacgctccggcacgggagtcggagtccatggcttcaccggcggcgctgatgctgccaactccttttcctcgccgggaccaggagtgggacaaggcagcgccagtgcatgcggccaggcccgcgcgttcttcaatgcgttcctcaagggaatggaggaggccaacaagttcttgcccaccaccaccaccaccatttttggacccgacgccacctccagagagcacctacccatcagtagtgtggtggattatggcagagtcagcggcagaggctgcaagaaccggcacaactgggacgacgacgacgacgacaccggcaggaggagcaacaagctgctggcacctgagccggagaagaacggcgagcaggtcgacgccgtgttcgtccaaggatacgagatggccattgagaagatgcacggcctgagcatcagcaacgacaacaacaacaacgggaaagcgaagaggaagtcagcatcacagggcgacgaggcggtggacctgcgcaccctgctcacccactgcgcggaggccgtgtccacgggcgaccgccgcagcgcgaccgagctgctccggcagatcaggcagcggtcctcccctaggggagacgcctcgcagaggctggcgcactgtttcgccgaggcgctcgaggcgcggctcgccggcacgggggcgctcgtggcggcgaggcgcacctccggatccggtggtgtggacttcctcagggcctacaagctgtacctggaggtttgctccttcaagatgatcgccttcaagttcgcccacatcgccatctgcaaggccattaatattacagggaggaagaaggtgcacatcgtggagtacggcgaccatcacggcctccactggccacctttgctggaggcctggtccaaggatcgggacggcgggccgcctgaggtgaggatcacgagcatcgactgcccgcagcctggttttcgtccggcagctcggatcgaggagaccgggcggcggctcagcgacttcgctcgccggcgtggggttccgttcaggttccgcagcgtcgtcgcgtccaagtgggagacggtttgcgccgacgacttggacattgagcccgacgacgacgacgacgaggtgctcgtcgtcaatggcttgttccatttcgggagattgatggacgagggcgtggacattgacaacacaagccctagggacatggttctccgcaacatccagaagatgcgtcctgatgtgttcatcctctgcgtcgagaacagctcctacaatgcgcccttcttcgtgacacggttcagggaggcgctgttctactactcggcaatgttcgacatgatggagacgacgaccccgcggcgggacagcgaggagcgactgctggttgagcaggacatcctgggggcttgtgtgctgaacgccattgcttgcgagggctctgaaagggtggagcgtcctgagacgtataagcaatggcaggtgcgaggccaccgggcaggactgaagcagctgcccctgaatcctaatacggtcaagtatctgactaggaaggtgaaggatggctaccacaaggactttgtggttgatgtcgatcaacaatggcttctgcaagggtggaagggacgtatcctctatgccatgtccacatgggttgcagatcatactcagctctcccagagctaa

SEQ ID NO: 2192 - protein, 685 aa, Sorghum bicolor
  misc_feature: Ceres ANNOT ID no. 6020122
  misc_feature (270)..(585): Pfam Id: GRAS Pfam Desc: GRAS family transcription factor
  misc_feature (144)..(683): NCBI GI: 115486811 NCBI Desc: os11g0705800 [oryza sativa (japonica cultivar-group)]
  misc_feature (174)..(675): NCBI GI: 32813435 NCBI Desc: scarecrow-like protein [lilium longiflorum]
  misc_feature (277)..(676): NCBI GI: 125743148 NCBI Desc: scarecrow-like protein 1 [castanea sativa]
  misc_feature (220)..(676): NCBI GI: 15222433 NCBI Desc: scarecrow-like transcription factor 14 (scl14) [arabidopsis thaliana]
  misc_feature (220)..(675): NCBI GI: 89474466 NCBI Desc: gras4 [solanum lycopersicum]
  misc_feature: The sequence is a functional homolog of SEQ ID NO 1324 in the 10/374,780US patent application
  misc_feature: The sequence is a functional homolog of SEQ ID NO 1471 in the 10/412,699US patent application
  misc_feature: The sequence is a functional homolog of SEQ ID NO 1938 in the 10/412,699US patent application
  misc_feature: The sequence is a functional homolog of SEQ ID NO 2202 in the 10/374,780US patent application
  misc_feature: Useful for making plants with modulated growth and phenotype characteristics
  misc_feature: The sequence is a functional homolog of SEQ ID NO 1471 in the 20040045049 US patent application
  misc_feature: The sequence is a functional homolog of SEQ ID NO 1938 in the 20040045049 US patent application
MAATPEDVADPEPFSPSLFLDLPPTPHPHHPDGEGDGEDDLQVLPFISRMLMEEEGTDDDAILYQEYPDHHPALLRAKQPFAQILSAPAAATDSVSGPVTTNSAFDAFADATWPYDPVELSELLFSRTRSGTGVGVHGFTGGADAANSFSSPGPGVGQGSASACGQARAFFNAFLKGMEEANKFLPTTTTTIFGPDATSREHLPISSVVDYGRVSGRGCKNRHNWDDDDDDTGRRSNKLLAPEPEKNGEQVDAVFVQGYEMAIEKMHGLSISNDNNNNGKAKRKSASQGDEAVDLRTLLTHCAEAVSTGDRRSATELLRQIRQRSSPRGDASQRLAHCFAEALEARLAGTGALVAARRTSGSGGVDFLRAYKLYLEVCSFKMIAFKFAHIAICKAINITGRKKVHIVEYGDHHGLHWPPLLEAWSKDRDGGPPEVRITSIDCPQPGFRPAARIEETGRRLSDFARRRGVPFRFRSVVASKWETVCADDLDIEPDDDDDEVLVVNGLFHFGRLMDEGVDIDNTSPRDMVLRNIQKMRPDVFILCVENSSYNAPFFVTRFREALFYYSAMFDMMETTTPRRDSEERLLVEQDILGACVLNAIACEGSERVERPETYKQWQVRGHRAGLKQLPLNPNTVKYLTRKVKDGYHKDFVVDVDQQWLLQGWKGRILYAMSTWVADHTQLSQS

SEQ ID NO: 2193 - DNA, 2043 bp, Sorghum bicolor
  misc_feature: Ceres ANNOT ID no. 6020134
  misc_feature: Encodes the peptide sequence at SEQ ID NO 2194
atggggattcccccggagctggagttctcagagaagcgcccccaggtggtggacttcacagagcctgtgccaccttccccatccacctatctcctcgacctgctccaggcgccccaagtcgataacggcaaggacgatcaatcctacatctcgcacatgctcttggaggaggacactattggcaacttgttgtaccaataccccaaccaccctgctgcactcctcaccggcaccgccgagcagccctttgcccagatcctctccgccgctgatgctacctctgatgcgctcaccatatggccgtgcaactccatcaaaaacacctcgctgcagttgtcggtggcgacacctgatgagtactactcatattgcgacatgactacctccgaaaagctgcctggtgacatggacagcatgcacgtccgtcaggatgcttcctccttgctgatgaacagcatgcacgaggcgttggcaatggagcccaacagattgttatcagcagccaagagcagcagctgttgcatggacgtgatcagcatggcattcttcaagggcatggaggaggccaacaagttgttgccactccaggacagtgagacgacattggctcgtggtaggggctggaagaagaggctacaagctggcaagggcgatgatgcgaatgtcgtcgccatgtgcaggagcagcaagcagaaggtggcgcagatgacgcaacctgactcagaggaggaagccgcagcacgtgagatgctggaccggttgatgcttaacgacaacgcaagccatgctgccgacgtgcagcaggagctaattattggctctatggagttggagaagccacgtggaaggcggcatggtgccagcgcgagccacacggcggtggacctgcacgccttgctcatccgatgcgcagaggctgtggccaccaatgaccggcagggcgtggccgacctgctgctgcggatcaggcatcactcatcaccgacaggggatgggacgcagcggcttgcgcactgcttcgcccagggactggaggcacggctgatgggcacggggagccagatgtaccattcgcttgtggcaaagagtgcatccgctacagtcatcctcaaggtctacaggctgtacatggccgcatgttccattctcccgctgaggtttccccttaccaacaagaccacctatgaggctgtcgcagggaggaagaagctgcacgttgtccactacggtttaggccctgggttccaatggccggatttgctgcgtatgctctcacacagggagggtggcccgccggaggtaaggctcaccggcattgacaatccactgccagggttccatccgggccagatcattgaggagacagggcgccgcctcagtgactgtgctcgtcagtttagggtcccattcaagttccgtgctattgcagcgaaatcagatgatgtccgtgctgaggacctggacattgaccctgaagaggtgctcgtcgtcatctcccatttccatttcaggaccttgatggatgagagtgtcatcatcgacaggccaaaccccagagacacggtgctcaaaaacatcaagaagatgaggccaaaagtgttcatccacggtatcctcaatggatcatacagcggtgctttctttgtgtcacggttccgcgaggcgctcaacaactttgctgcgctgttcgacctgatggacaccactgtgccccaggaaaaccagaacaggctgctggtagagcaggaattagcacgatgcgccatgaacatcattgcctgtgagggcgtggatagggtggagcggcctcacagctacaagcagtggcatgtgcggtgcgagcgagcagggctgaggcaactgccattggatccagacattgttcgggcgagcaaagacaaggtgaataaggaatgccgcaagtacatcgttatcaatgaggatcacgggtggctcctcaagggatggaaagggcgggtgctcgctgccatctccacgtggatggcagaggatgatagatctgacttgggaaatgaccagtga

SEQ ID NO: 2194 - protein, 680 aa, Sorghum bicolor
  misc_feature: Ceres ANNOT ID no. 6020134
  misc_feature (272)..(578): Pfam Id: GRAS Pfam Desc: GRAS family transcription factor
  misc_feature (122)..(661): NCBI GI: 115486811 NCBI Desc: os11g0705800 [oryza sativa (japonica cultivar-group)]
  misc_feature (196)..(667): NCBI GI: 32813435 NCBI Desc: scarecrow-like protein [lilium longiflorum]
  misc_feature (144)..(667): NCBI GI: 89474466 NCBI Desc: gras4 [solanum lycopersicum]
  misc_feature (227)..(667): NCBI GI: 90970946 NCBI Desc: gras1 [nicotiana tabacum]
  misc_feature (227)..(668): NCBI GI: 15222433 NCBI Desc: scarecrow-like transcription factor 14 (scl14) [arabidopsis thaliana]
MGIPPELEFSEKRPQVVDFTEPVPPSPSTYLLDLLQAPQVDNGKDDQSYISHMLLEEDTIGNLLYQYPNHPAALLTGTAEQPFAQILSAADATSDALTIWPCNSIKNTSLQLSVATPDEYYSYCDMTTSEKLPGDMDSMHVRQDASSLLMNSMHEALAMEPNRLLSAAKSSSCCMDVISMAFFKGMEEANKLLPLQDSETTLARGRGWKKRLQAGKGDDANVVAMCRSSKQKVAQMTQPDSEEEAAAREMLDRLMLNDNASHAADVQQELIIGSMELEKPRGRRHGASASHTAVDLHALLIRCAEAVATNDRQGVADLLLRIRHHSSPTGDGTQRLAHCFAQGLEARLMGTGSQMYHSLVAKSASATVILKVYRLYMAACSILPLRFPLTNKTTYEAVAGRKKLHVVHYGLGPGFQWPDLLRMLSHREGGPPEVRLTGIDNPLPGFHPGQIIEETGRRLSDCARQFRVPFKFRAIAAKSDDVRAEDLDIDPEEVLVVISHFHFRTLMDESVIIDRPNPRDTVLKNIKKMRPKVFIHGILNGSYSGAFFVSRFREALNNFAALFDLMDTTVPQENQNRLLVEQELARCAMNIIACEGVDRVERPHSYKQWHVRCERAGLRQLPLDPDIVRASKDKVNKECRKYIVINEDHGWLLKGWKGRVLAAISTWMAEDDRSDLGNDQ

SEQ ID NO: 2195 - DNA, 1323 bp, Sorghum bicolor
  misc_feature: Ceres ANNOT ID no. 6020142
  misc_feature: Encodes the peptide sequence at SEQ ID NO 2196
atggcggccgccttctcctccaccgttggagctccggcctccaccccgagcaggagcagcttcctcgggaagaagctcagcaagcagcaggtgtctgcggcggcggccgtgaactactaccatggcaagagctccagcagcgccgccgccaacgttaacaggttcaaggtgatggcggccaaggaggtggacgagacgaagcagtcggaccaggacaggtggaagggcctggcctacgacgtctcggacgaccagcaggatatcaccaggggcaagggcatgatcgactccctcttccaggcgcccatgggggacggcacccacgtcgccgtgctcagctcctacgactacatcagccagggccaaaagacttacagcttcgacaacatgatggatggtttctacatatccaagagcttcatggacaagctcgtggtccacctctccaagaacttcatgagcctgccaaacatcaaagttcccctgatcctgggtatctggggaggcaaaggtcaggggaagtccttccaatgcgagctcgtcttctccaagatgggcatcatccccatcatgatgagcgccggcgagctggagagcggcaacgccggagagcccgccaagctcatcaggcagcggtaccgtgaggctgccgacctcatctccaagggcaagatgtcctgcctgttcatcaacgatctggacgccggcgcaggtcgcatgggcggcaccacccagtacacggtgaacaaccagatggtgaacgccaccctgatgaacatcgccgacaaccccaccaacgtgcagctcccggggatgtacaacaaggtggacaacgcccgggtgcccatcatcgtcaccggcaacgacttctccacgctgtacgcgccgctcatccgtgatggacgtatggagaagttctactgggcgcccacccgcgaggaccgcatcggcgtctgcaagggcatcttccgcaccgacggcgtcgacgaggagcacgtcgtccagctcgtcgacaccttcccgggccagtccatcgacttcttcggcgccctgcgtgcccgggtgtacgacgacgaggtgcgccggtgggtggccgagaccggcgtcgagaacatcgccaagaagctcgtcaactccaaggagggcccgccgacgttcgagcagcccaagatgacgatcgagaagctcttggagtacggccacatgctggtggcggagcaggagaacgtcaagcgtgtgcagcttgctgacaagtacctcaacgaggctgctcttggtgcagccaacgaggacgccatgaagactggcaacttcttcaagtag

SEQ ID NO: 2196 - protein, 440 aa, Sorghum bicolor
  misc_feature: Ceres ANNOT ID no. 6020142
  misc_feature (163)..(361): Pfam Id: AAA Pfam Desc: ATPase family associated with various cellular activities(AAA)
  misc_feature (1)..(440): NCBI GI: 19855034 NCBI Desc: ribulose-1,5-bisphosphate carboxylase/oxygenase activase precursor [zea mays]
  misc_feature (1)..(439): NCBI GI: 109940135 NCBI Desc: ribulose bisphosphate carboxylase/oxygenase activase, chloroplast precursor (rubisco activase) (ra)
  misc_feature (1)..(439): NCBI GI: 8918361 NCBI Desc: rubisco activase small isoform precursor [oryza sativa]
  misc_feature (1)..(439): NCBI GI: 1778414 NCBI Desc: ribulose-1,5-bisphosphate carboxylase/oxygenase activase [oryza sativa]
  misc_feature (1)..(439): NCBI GI: 7960277 NCBI Desc: ribulose bisphosphate carboxylase activase b [triticum aestivum]
  misc_feature: Useful for making plants with modulated biomass
  misc_feature: Functional homolog of the protein sequence given in SEQ ID NO 13781
  misc_feature: The sequence is a functional homolog of SEQ ID NO. 462 in the 11/188,298 US application
MAAAFSSTVGAPASTPSRSSFLGKKLSKQQVSAAAAVNYYHGKSSSSAAANVNRFKVMAAKEVDETKQSDQDRWKGLAYDVSDDQQDITRGKGMIDSLFQAPMGDGTHVAVLSSYDYISQGQKTYSFDNMMDGFYISKSFMDKLVVHLSKNFMSLPNIKVPLILGIWGGKGQGKSFQCELVFSKMGIIPIMMSAGELESGNAGEPAKLIRQRYREAADLISKGKMSCLFINDLDAGAGRMGGTTQYTVNNQMVNATLMNIADNPTNVQLPGMYNKVDNARVPIIVTGNDFSTLYAPLIRDGRMEKFYWAPTREDRIGVCKGIFRTDGVDEEHVVQLVDTFPGQSIDFFGALRARVYDDEVRRWVAETGVENIAKKLVNSKEGPPTFEQPKMTIEKLLEYGHMLVAEQENVKRVQLADKYLNEAALGAANEDAMKTGNFFK

SEQ ID NO: 2197 - DNA, 927 bp, Sorghum bicolor
  misc_feature: Ceres ANNOT ID no. 6020150
  misc_feature: Encodes the peptide sequence at SEQ ID NO 2198
atgaactcctccaccgccaccgccatggatcaaacaggcaagtactggggcatgtggggagcaagcagcagcagcagcaccagcaccgcgagccccatctctgcttgggcagcggcgtacggcggcagcagcgaaccgtcgtgggaggagcaggcctttgcgcgtgatgcggcggcgcacctcggcggctgcgtgtggccgccgcgctcttactcgtgcaccttctgccagcgcgagttccggtcggcgcaggcgctcggtggccacatgaacgtccaccgccgtgaccgggctcttctccggcaggggggctcgtcgtcccctgatgacgtgcacgcccccaacgacgatcagtcacacccacagcaaggtgctctcctgtacagggcagcagcagcctctaaccctagcaccactaccacgccgactactactactgcagctgcaggtactactactgccggctcagcagcagccatgggccaggatggggatgccaacaccaccactcctacttcctacttatcaacaattatcaaggagagcaagaacaagctcttcatgcccataccagatcactctgtggcggagatgagagaagatcaggcggccatagatgatcatcagtgtgatcgtcatgacgatggcgacagcgtgcagtcagccaggaaaaagaggaggcgtttggatcatccattggcagcggcggcggcacttctgatctttgtgcagccaacggcaaaggccgctaccgatgtttcacaagaaggaagagctgatcatgagacaaaggtaccacaaatgacaaccccaacaagccctagctctatttcccctcttctggatcaacgacaggaattagatctagagttaaggcttgggactactccaaaagttacatatatggcgatacacaaagctagctag

SEQ ID NO: 2198 - protein, 308 aa, Sorghum bicolor
  misc_feature: Ceres ANNOT ID no. 6020150
  misc_feature (6)..(296): NCBI GI: 50508927 NCBI Desc: c2h2-type zinc finger protein-like protein [oryza sativa (japonica cultivar-group)]
  misc_feature (9)..(184): NCBI GI: 115462991 NCBI Desc: os05g0286100 [oryza sativa (japonica cultivar-group)]
  misc_feature (9)..(122): NCBI GI: 77378044 NCBI Desc: superman-like zinc finger protein [gossypium hirsutum]
  misc_feature (11)..(102): NCBI GI: 144923279 NCBI Desc: zinc finger, c2h2-type [medicago truncatula]
  misc_feature (61)..(159): NCBI GI: 87241088 NCBI Desc: zinc finger, c2h2-type [medicago truncatula]
  misc_feature: The plant is abnormally small.
  misc_feature: The sequence is a functional homolog of SEQ ID NO 1013 in the 10/666,642US patent application
  misc_feature: Useful for making plants with altered terpenoid content
  misc_feature: Useful for making plants with modulated biomass
  misc_feature: Useful for making plants with modulated growth and phenotype characteristics
  misc_feature: GREAT-hit functional homolog of the protein sequence given in SEQ ID NO 13138
  misc_feature: Functional homolog of the protein sequence given in SEQ ID NO 13159
  misc_feature: Functional homolog of the protein sequence given in SEQ ID NO 13304
  misc_feature: The sequence is a functional homolog of SEQ ID NO 1013 in the 20070033671 US patent application
  misc_feature: Useful for making plants with modulated biomass
  misc_feature: Functional homolog of the protein sequence given in SEQ ID NO 13138
MNSSTATAMDQTGKYWGMWGASSSSSTSTASPISAWAAAYGGSSEPSWEEQAFARDAAAHLGGCVWPPRSYSCTFCQREFRSAQALGGHMNVHRRDRALLRQGGSSSPDDVHAPNDDQSHPQQGALLYRAAAASNPSTTTTPTTTTAAAGTTTAGSAAAMGQDGDANTTTPTSYLSTIIKESKNKLFMPIPDHSVAEMREDQAAIDDHQCDRHDDGDSVQSARKKRRRLDHPLAAAAALLIFVQPTAKAATDVSQEGRADHETKVPQMTTPTSPSSISPLLDQRQELDLELRLGTTPKVTYMAIHKAS

SEQ ID NO: 2199 - DNA, 549 bp, Sorghum bicolor
  misc_feature: Ceres ANNOT ID no. 6020178
  misc_feature: Encodes the peptide sequence at SEQ ID NO 2200
atgcgccgggcgaagccgccgcagccgcagccctcgccgtcgccggagatccggtaccgcggcgtgcggaggcggccgtcggggcgctacgccgccgagatccgggacccggccaagaagaccccgatctggctcggcaccttcgactccgccgaggccgccgcgcgcgcctacgacgccgccgcccgatccctacgcgggcccaccgcacgcaccaactttcccagcgccgcgtcaccggcccccgcggcggcggcggcggccacgtccagccacagcagtaccgtcgagtcgtggagcggcggcgcaccccgcgccccctccgccctgccgcggagcgccgccgcgcccatggaggaggacgacgacgaggactgccacagctactgcggatcctcgtcgtccgtcctctgcgaagacgcctgcggcgacgacgcggccgcgtcccgcgcgcccctgcctttcgatctgaacctgccgccgcctcttgacgcggccgctgaggccgatcagatgggtgcccgctacgacacgctactccgcctctag

SEQ ID NO: 2200 - protein, 182 aa, Sorghum bicolor
  misc_feature: Ceres ANNOT ID no. 6020178
  misc_feature (17)..(68): Pfam Id: AP2 Pfam Desc: AP2 domain
  misc_feature (2)..(75): NCBI GI: 4587373 NCBI Desc: ethylene responsive element binding factor [nicotiana tabacum]
  misc_feature (16)..(82): NCBI GI: 12322345 NCBI Desc: ethylene responsive element binding factor 3 (erf3) [arabidopsis thaliana]
  misc_feature (5)..(83): NCBI GI: 73761695 NCBI Desc: ethylene-responsive element-binding factor [gossypium hirsutum]
  misc_feature (16)..(77): NCBI GI: 56384582 NCBI Desc: at-rich element binding factor 2 [pisum sativum]
  misc_feature (14)..(98): NCBI GI: 67009989 NCBI Desc: class ii ethylene responsive element binding factor-like protein [nicotiana benthamiana]
  misc_feature: The sequence is a functional homolog of SEQ ID NO 1419 in the 11/479,226US patent application
  misc_feature: The sequence is a functional homolog of SEQ ID NO 668 in the 10/412,699US patent application
  misc_feature: Useful for making plants with modulated growth and phenotype characteristics
  misc_feature: The sequence is a functional homolog of SEQ ID NO 668 in the 20040045049 US patent application
MRRAKPPQPQPSPSPEIRYRGVRRRPSGRYAAEIRDPAKKTPIWLGTFDSAEAAARAYDAAARSLRGPTARTNFPSAASPAPAAAAAATSSHSSTVESWSGGAPRAPSALPRSAAAPMEEDDDEDCHSYCGSSSSVLCEDACGDDAAASRAPLPFDLNLPPPLDAAAEADQMGARYDTLLRL

SEQ ID NO: 2201 - DNA, 1524 bp, Sorghum bicolor
  misc_feature: Ceres ANNOT ID no. 6020182
  misc_feature: Encodes the peptide sequence at SEQ ID NO 2202
atggagcgcggcggcctgcgcgcgctaccgctgctgctgctgctcacgctgccgatgattcccgtgccggtcgccggcccggcaacgatgacgacggcggcgttcctggaggaggacgcgatcctgggcgccgtggggagcgcgaggcacggaggcaagggccccgcgaacgcgaacgcgaacgcgagcacgaggctgccgcgcggtgccggcgggaggcagcagcacagtcgctacgacgtggtggctgggtcgtcgtcgtcgtcgtggaaggaggagatcgcggggctggctggtcgtccggagctggcggcgtggctgcgcgctgtgcggcggcggatccacgagcggcccgagctggcgtacgaggaggtggagacgagccgcctggtccgcgacgagctggacgcgctgggcgtcgggttccgccaccccgtcgcgcgcacgggcgtcgtcgccacgctcggcaccggccgcccccccgtcgtcgcgctccgcgccgacatggacgcgctgcccatccaggaggccgtagagtgggagcacaagagccgggtccccgggaagatgcacgcgtgcgggcacgacgcacatgtcgccatgctcctcggcgccgccagcatcctcaaggctcgcgagcaccagctcaagccggcggaggagtcagggtgcggcgcgaagcggatgatcgaggacggcgcgctggagggcgtggaggccatcttcgccgtgcacgtctcccaccagcacccgacgtccgtcatcgggtccaggacgggcgccctcctcgccggctgcggcttcttcaaggccgtcatacgcggcggcggcggcggcggcgacacgcaggatcatccgcgccgggccgccgttcccgtcctggccgccgcgtccaccatcatcagcctgcagagcatcgtctcccgcgaggctgacccgctggactcgcaggtggtgtcggtggcactcgtgaacggcagcgacatccaccaccacgccgcggcggcgcagccaaagcctcaggaggagctggtgctggccggcacgttccgcgccttctcgaacgcgagcttctaccagctgcgacggcggatcgaggaggtgatcacggcgcagtcgcgggtgcacgggtgcgtggcttccgtggacttcttcgaggaccagagcttctacccgccgacggtgaacgacgcgaggatgtacggccacgtgcggcgcgtggcgacggagctcctgggcggcgccgcggcgtaccgcgacgtgccgcccatgatgggcgccgaggacttctccttctactcgcaggcggtccccgccgggttctactacatcggggtgcggaacgagacgctcgggtccgtgcacacggggcactcgccgtacttcatgatcgacgaggacgtgctccccaccggcgccgccgtacacgccgccatcgccgagaggttcctcgccgaccacgcctcactcatgggcaacggcgccgcctcctccgacgacgagacggttgaccaggagctgtaa

SEQ ID NO: 2202 - protein, 507 aa, Sorghum bicolor
  misc_feature: Ceres ANNOT ID no. 6020182
  misc_feature (164)..(482): Pfam Id: Peptidase_M20 Pfam Desc: Peptidase family M20/M25/M40
  misc_feature (92)..(487): NCBI GI: 92870502 NCBI Desc: peptidase m20 [medicago truncatula]
  misc_feature (92)..(486): NCBI GI: 81239131 NCBI Desc: iaa-amino acid hydrolase 6 [brassica rapa]
  misc_feature (92)..(489): NCBI GI: 17978838 NCBI Desc: iaa-amino acid conjugate hydrolase-like protein [arabidopsis thaliana]
  misc_feature (92)..(489): NCBI GI: 3559811 NCBI Desc: gr1-protein [arabidopsis thaliana]
  misc_feature (97)..(484): NCBI GI: 95106137 NCBI Desc: auxin conjugate hydrolase [medicago truncatula]
MERGGLRALPLLLLLTLPMIPVPVAGPATMTTAAFLEEDAILGAVGSARHGGKGPANANANASTRLPRGAGGRQQHSRYDVVAGSSSSSWKEEIAGLAGRPELAAWLRAVRRRIHERPELAYEEVETSRLVRDELDALGVGFRHPVARTGVVATLGTGRPPVVALRADMDALPIQEAVEWEHKSRVPGKMHACGHDAHVAMLLGAASILKAREHQLKPAEESGCGAKRMIEDGALEGVEAIFAVHVSHQHPTSVIGSRTGALLAGCGFFKAVIRGGGGGGDTQDHPRRAAVPVLAAASTIISLQSIVSREADPLDSQVVSVALVNGSDIHHHAAAAQPKPQEELVLAGTFRAFSNASFYQLRRRIEEVITAQSRVHGCVASVDFFEDQSFYPPTVNDARMYGHVRRVATELLGGAAAYRDVPPMMGAEDFSFYSQAVPAGFYYIGVRNETLGSVHTGHSPYFMIDEDVLPTGAAVHAAIAERFLADHASLMGNGAASSDDETVDQEL

SEQ ID NO: 2203 - DNA, 894 bp, Sorghum bicolor
  misc_feature: Ceres ANNOT ID no. 6020191
  misc_feature: Encodes the peptide sequence at SEQ ID NO 2204
atggcggcgccggtgccggagtgggctaccaaggagccctgcctcatggggatcgacgaggctggccgtggccctgtccttggtcctatggtgtatggatgcatgtactgcgcacgctcttacaataacactcttgccactctcaaattcgcagattctaagaccttgaaggaggaacaaagagaggagctatttgaaagtttaaaagtcaatagctctattgggtgggaagtggatgtcatatgcccaaaggatctatctgctaaaatgttaagaaagtcaaaagttaatctcaatgaaatatcacataactctgccatgggccttgttagaaaactgcttgacatgggagttctactggcagaagtatatatagatacagtgggagatcctgaaaagtataggatcaagctgacagaaaagtttccaggaatcaaatttgtggttgccaaaaaggctgatagcctttaccctgttgttagtggagcaagtatagttgcaaaggtcactagggacagagccttgcgaaattgggtgtttgatgaaacagctctgaatatgcacatgaaaactggatcaggatatccaggagacactgatactaagcaatggttacaagatcacaagcacccagtgtttggcttcccaactttagttcgttttagctggggaacttgcacgcccttcttcaaggatgcagttgaggttacatgggagtctgatgaagttgacgaagatgggactggcaatggaagcaccaagcgacaggtgaagctttcaagcctaggctttactggtttcaaaaggaagactgaggagattgaatcgagtggaaaaggccgctgcaaattcttccaggctcgcaaactcgagttggtcaggaagttccagtga

SEQ ID NO: 2204 - protein, 297 aa, Sorghum bicolor
  misc_feature: Ceres ANNOT ID no. 6020191
  misc_feature (16)..(226): Pfam Id: RNase_HII Pfam Desc: Ribonuclease HII
  misc_feature (109)..(296): NCBI GI: 145329613 NCBI Desc: ribonuclease hii family protein [arabidopsis thaliana]
  misc_feature (1)..(293): NCBI GI: 37362282 NCBI Desc: ribonuclease h2, large subunit [danio rerio]
  misc_feature (1)..(249): NCBI GI: 119604719 NCBI Desc: ribonuclease h2, large subunit [homo sapiens]
  misc_feature (1)..(249): NCBI GI: 3334761 NCBI Desc: ribonuclease hi large subunit [homo sapiens]
  misc_feature (5)..(296): NCBI GI: 24580635 NCBI Desc: cg13690-pa [drosophila melanogaster]
  misc_feature (6)..(296): SWISSPROT Homolog: EC 3.1.26.4 Ribonuclease H2 subunit A
MAAPVPEWATKEPCLMGIDEAGRGPVLGPMVYGCMYCARSYNNTLATLKFADSKTLKEEQREELFESLKVNSSIGWEVDVICPKDLSAKMLRKSKVNLNEISHNSAMGLVRKLLDMGVLLAEVYIDTVGDPEKYRIKLTEKFPGIKFVVAKKADSLYPVVSGASIVAKVTRDRALRNWVFDETALNMHMKTGSGYPGDTDTKQWLQDHKHPVFGFPTLVRFSWGTCTPFFKDAVEVTWESDEVDEDGTGNGSTKRQVKLSSLGFTGFKRKTEEIESSGKGRCKFFQARKLELVRKFQ

SEQ ID NO: 2205 - DNA, 1215 bp, Sorghum bicolor
  misc_feature: Ceres ANNOT ID no. 6020214
  misc_feature: Encodes the peptide sequence at SEQ ID NO 2206
  misc_feature: Up-regulated in root tissues in response to salicylic acid treatment
  misc_feature: Up-regulated in shoot tissues in response to salicylic acid treatment
atgccgacggttacctgcaacgcgtgcaacacggggttcgacgacgaggagcagcagcggctccactaccgctccgaatggcaccgctacaacctcaagcgcaaggtggctggagttcctggtgtcacagaggctttgtttctggctaggcaagctgctttggcggaggggagcaagcctgcaagcaccccaatgctttacagctgtgccctttgtggaaaggagtacaggagctccaaagctcatgagcagcatcttaactcacgatcacatcttttgaaagcctctcaggagcccaatgcctctattgctggtatcacaatagtcaagccacttcctgaacgagtcccacgcaaagctccatctgcagttgaggaagatgaagacgacgacgaggaggaagagtgggttgaagttgacccaaatgagatggaggtggctgatgagtctacttcaaacatgcaagaagatgaggagtcctccaaatctgatgatgagatggctgatcttgaagagttggatatctcgtcatgtttcatgtgtgatctgaagcatgataccatagaagactgcatggtccatatgcataagaagcatgggtttttcatacctgacagtgaatacttgaaggatcccagtggtcttcttacttatgtcggattgaaggtgaagcgtgattttatctgcctctactgcaatgacagatgccagcccttcttcagtctagaggctgtcaggaaacatatggaggcaaaggggcattgcaagttgcggtatggagatggtggagatgatgaagatgctgacctcgaggatttctatgattacagcagcagttatgttgatgcagaaggcaagcaattggttgctgttgatgagtctaacaacaacattgagctgggaaccggtgggtctgagctagtaataacaaacaagagtgagaaaggcacacgggtcagaacccttggttctagggaatttatccgctactatcgccagaaaccacggccttctgtcgcaacagaccgtgcacttgcactttcactggcttccagctacaagaacatgggtttggtgacagttcagtctaaggagcagatggtaaggctgaaagttctccgtgcaatgaacaagaccggggtcgagacgatgcggaacaagattgggatgaagagcaatgtgatccggaacctccctaagaactgcccgtattag

SEQ ID NO: 2206 - protein, 404 aa, Sorghum bicolor
  misc_feature: Ceres ANNOT ID no. 6020214
  misc_feature (1)..(404): NCBI GI: 42573111 NCBI Desc: zinc finger (c2h2 type) family protein [arabidopsis thaliana]
  misc_feature (114)..(398): NCBI GI: 15529978 NCBI Desc: zinc finger protein 622 [homo sapiens]
  misc_feature (125)..(364): NCBI GI: 46249981 NCBI Desc: loc407703 protein [danio rerio]
  misc_feature (1)..(396): NCBI GI: 18859899 NCBI Desc: cg6769-pa [drosophila melanogaster]
  misc_feature (124)..(396): NCBI GI: 125982827 NCBI Desc: ga19851-pa [drosophila pseudoobscura]
  misc_feature: The sequence is a functional homolog of SEQ ID NO 1304 in the 11/479,226US patent application
  misc_feature: The sequence is a functional homolog of SEQ ID NO 512 in the 11/479,226US patent application
  misc_feature: The sequence is a functional homolog of SEQ ID NO 610 in the 10/412,699US patent application
  misc_feature: Useful for making plants with modulated growth and phenotype characteristics
  misc_feature: The sequence is a functional homolog of SEQ ID NO 610 in the 20040045049 US patent application
  misc_feature: The sequence is a functional homolog of SEQ ID NO 512 in the 20070022495 US patent application
  misc_feature: The sequence is a functional homolog of SEQ ID NO 1304 in the 11/479,226 US patent application
  misc_feature: The sequence is a functional homolog of SEQ ID NO 610 in the 10/412,699 US patent application
  misc_feature: The sequence is a functional homolog of SEQ ID NO 512 in the 11/479,226 US patent application
  misc_feature: Up-regulated in root tissues in response to salicylic acid treatment
  misc_feature: Up-regulated in shoot tissues in response to salicylic acid treatment
MPTVTCNACNTGFDDEEQQRLHYRSEWHRYNLKRKVAGVPGVTEALFLARQAALAEGSKPASTPMLYSCALCGKEYRSSKAHEQHLNSRSHLLKASQEPNASIAGITIVKPLPERVPRKAPSAVEEDEDDDEEEEWVEVDPNEMEVADESTSNMQEDEESSKSDDEMADLEELDISSCFMCDLKHDTIEDCMVHMHKKHGFFIPDSEYLKDPSGLLTYVGLKVKRDFICLYCNDRCQPFFSLEAVRKHMEAKGHCKLRYGDGGDDEDADLEDFYDYSSSYVDAEGKQLVAVDESNNNIELGTGGSELVITNKSEKGTRVRTLGSREFIRYYRQKPRPSVATDRALALSLASSYKNMGLVTVQSKEQMVRLKVLRAMNKTGVETMRNKIGMKSNVIRNLPKNCPY

SEQ ID NO: 2207 - DNA, 1152 bp, Sorghum bicolor
  misc_feature: Ceres ANNOT ID no. 6020225
  misc_feature: Encodes the peptide sequence at SEQ ID NO 2208
atggcttcctctgcgtcagctctccttctggcggtctccctggccgctctgcacttgtgctgccgccatggccaggctgccgacgccggcagcggcaacggtatcacggccatctacagcctcggcgactccatcactgacaccgggaacctcgtcaaggaggcgcctccgggcatgttcgagaccatcaagcatctcccctacggcgtcacgttcgggcacccgactgggcggtgctctgacggcctcctcatgatcgacttcctggctcaggacctgggtctcccgttcctgaacccgtacctgggcaagaacaagagcttcgaccacggcgtcaacttcgccgtcgccggagccaccgccgtggacccagccgaccagtacaacgttaccgtccccgtgccggtcgcctccaactcgctcaaggtccagctccggtggttcaaggacttcctcaagtacaccttcggcaccgatcaagagatacgcagacggcttcgaacctctctggttttggtcggggagatcggcggaaacgactacaactacgccttctttgaggacaagccggtggccgaggtggagaagctcatcccgggggtcgtgaagaccatcatcgacgccgccaaggaggtgctggacatgggcgccagccgagtcatcgtcccgggcaacttccccatcggctgcgtgccggggtacctggccatgaacgccgccaagtcggagcccgccgactacgactcggcggggtgcctccgggagctcaacgacttcgccgccaagcacaactcgcggctccggcgcgccgtcgccgacctgcaggcgtcgtacccgcacgccgccgtcgcctacgccgactacttcgactccttcctcaccctcctccacaacgcctccttgctcggttttgacgcggcgagcacacgcaaggcctgctgtggcgccggcggcggcgagtacaacttcgactggcggaggatgtgcggcttcaacggggcggcggcgtgcgcggagccgtcgacgtacctgagctgggacgggatacacatgacgcaggcggcgtacagggccatgtccaggctcatctaccacggcaagtacctgcacccgcagatactgagcttcccggagaaatacggccagacgtag

SEQ ID NO: 2208 - protein, 383 aa, Sorghum bicolor
  misc_feature: Ceres ANNOT ID no. 6020225
  misc_feature (38)..(363): Pfam Id: Lipase_GDSL Pfam Desc: GDSL-like Lipase/Acylhydrolase
  misc_feature (7)..(366): NCBI GI: 77551166 NCBI Desc: gdsl-like lipase/acylhydrolase [oryza sativa (japonica cultivar-group)]
  misc_feature (5)..(374): NCBI GI: 115435276 NCBI Desc: os01g0215700 [oryza sativa (japonica cultivar-group)]
  misc_feature (29)..(366): NCBI GI: 59595625 NCBI Desc: acetylajmalan acetylesterase [rauvolfia serpentina]
  misc_feature (17)..(375): NCBI GI: 115435284 NCBI Desc: os01g0216500 [oryza sativa (japonica cultivar-group)]
  misc_feature (37)..(371): NCBI GI: 10764858 NCBI Desc: f1k23.17 [arabidopsis thaliana]
MASSASALLLAVSLAALHLCCRHGQAADAGSGNGITAIYSLGDSITDTGNLVKEAPPGMFETIKHLPYGVTFGHPTGRCSDGLLMIDFLAQDLGLPFLNPYLGKNKSFDHGVNFAVAGATAVDPADQYNVTVPVPVASNSLKVQLRWFKDFLKYTFGTDQEIRRRLRTSLVLVGEIGGNDYNYAFFEDKPVAEVEKLIPGVVKTIIDAAKEVLDMGASRVIVPGNFPIGCVPGYLAMNAAKSEPADYDSAGCLRELNDFAAKHNSRLRRAVADLQASYPHAAVAYADYFDSFLTLLHNASLLGFDAASTRKACCGAGGGEYNFDWRRMCGFNGAAACAEPSTYLSWDGIHMTQAAYRAMSRLIYHGKYLHPQILSFPEKYGQT

SEQ ID NO: 2209 - DNA, 651 bp, Sorghum bicolor
  misc_feature: Ceres ANNOT ID no. 6020228
  misc_feature: Encodes the peptide sequence at SEQ ID NO 2210
atgaggctctgtctccggcaagcggcggccgcggccacggccacctgcagctcccccgtcgcagccaccctccacggcaagagttctccaagctccctcgcccatggccggctcagcttcagccacatgtcgctgcagacgacgcccgaccatcgccgacaccgagcagggtgggcggtgcgcgtgcttccgctgacggaggagaacgtggagaaggtgctggacgaggtgcggccgagcctgatggcggacggcggcaacgtggcgctgcacgagatcgacggcctcgtcgtcgtgctcaagctgcagggggcgtgcggctcctgcccgagctccaccatgacgctcaagatgggtatcgagacgcgcctccgcgacaagatccccgacatcctcgaggtcgagcagatcgtcgacaccgagaccggcctcgacctcaacgccgacaacgtcgagaaggtgcttgatgaaatcagaccatacctctccggcactggaggtggaagcctcgagcaactccagattgatggatatgtcgtcaagatcaggatcagtggacctgcagctggtgtaatgacagtacgagtagctgtgacacaaaaactgagggaaaaaataccttccatcttggctgttcagctcactgaatag

SEQ ID NO: 2210 - protein, 216 aa, Sorghum bicolor
  misc_feature: Ceres ANNOT ID no. 6020228
  misc_feature (70)..(137): Pfam Id: NifU Pfam Desc: NifU-like domain
  misc_feature (151)..(215): Pfam Id: NifU Pfam Desc: NifU-like domain
  misc_feature (53)..(216): NCBI GI: 124360086 NCBI Desc: nitrogen-fixing nifu, c-terminal [medicago truncatula]
  misc_feature (11)..(216): NCBI GI: 21554503 NCBI Desc: nitrogen fixation like protein [arabidopsis thaliana]
  misc_feature (20)..(216): NCBI GI: 4538920 NCBI Desc: nitrogen fixation like protein [arabidopsis thaliana]
  misc_feature (63)..(216): NCBI GI: 110738975 NCBI Desc: nitrogen fixation like protein [arabidopsis thaliana]
  misc_feature (8)..(214): NCBI GI: 75147032 NCBI Desc: nifu-like protein 1, chloroplast precursor (osnifu1)
MRLCLRQAAAAATATCSSPVAATLHGKSSPSSLAHGRLSFSHMSLQTTPDHRRHRAGWAVRVLPLTEENVEKVLDEVRPSLMADGGNVALHEIDGLVVVLKLQGACGSCPSSTMTLKMGIETRLRDKIPDILEVEQIVDTETGLDLNADNVEKVLDEIRPYLSGTGGGSLEQLQIDGYVVKIRISGPAAGVMTVRVAVTQKLREKIPSILAVQLTE

SEQ ID NO: 2211 - DNA, 1773 bp, Sorghum bicolor
  misc_feature: Ceres ANNOT ID no. 6020242
  misc_feature: Encodes the peptide sequence at SEQ ID NO 2212
atggacgaatcctcctgtagatccactactccagttgggtttcttagaagaggttctggcatttccttgagaaatcaaagcaacgaggataggccaagccaatacaacaagcagccagggaagagttcaaatctcaatcctgtaaaatcacggttcactgaaaataaagagaagccaaggtattttcaagggccgtttcattcttcaggctccagggcctcatctgtaagctcttcaaaagctcctgttagaaaatattgtgatgagagacaaaaacggccctttttggcagagacagacattgctgaaagcagtaacagaagaaccgaggttagatgcctacaacgtggcaagaaagcttctgtatttggcgatgggcatccatacatgcagaagggtacatcagaagcttcatcatcctcaacaactactgaagaaagcttgccagaagagcatgatcttggagttttagatgtttctggttcttcagggaattctgcacatgcagttaattccagaaatactgcattgagtgctatggcacataggcaaaaggataaagaagaattgaattcaggtagtcatcaaggtgcttccacttttgttcgtcgacgtactttacctcaaagttttaccactggtgtcaagtcatcaactgcccctagcactaacattactggagcacagagacgtggtctaaaaaatcttggttgcacttcaatatctgatgttctgccttcaggatgttcttcatctgattctgtccgtgataggagggtcgaagttacaaagaagagaacttctgatgcagaaagttcttcaagatcaaggggaataagtgaacaatctaatttaagtcagccacgtgctagttatccgggtagtactggtcctagagctagagctgttgaacaattagcttctcaacaaatagcaaggaccaatagcagaagtattcaggatcctacagattcgataaggactagacgaccttttactctgcgtgccagggagaggatgataccaggtgaaagagaggacagcgtatttgctctgcatgagactgttgcaagcgttcatccagaatgtggtcattttcacacagatggtgctcccccagagagattaggaagacccttttatgcagaattacctcatgctatttattcatctaatcgtcaaggctcaagtagtcagacagcaaggagaagatctacgtctcgtactgaggaaagccctcaacggatgttccatggtatgtttggggagagagacggctacaggcacgtaagcatggaaggtattgcacaggcattgctagcattggataggattgaacatgatgatgaattgacttatgagcaactgctggtgctagaaactaatctgctcttaagcggccttgatttgcacgatcagcacgaagatttgagattggatatcgacaatatgtcatatgaggaactacttgctttagaagatcatattggctcagtgagtactgcccttactgaagagcaatttgccaagtgtgtaaaccaaagtgtgtatgaagcaagaaattctggtagagatgtgaacaagattgcagcagatgatgtgaaatgtagcatatgtcaggaggaatacattgaaggtgaagagattggtacaatgcaatgtgaacatcagtaccatgtgtgctgtattcacgaatggcttagacagaagaactggtgtccaatatgcaaagcttcagctataccttcagagatgaacaagggagacgcatga

SEQ ID NO: 2212 - protein, 590 aa, Sorghum bicolor
  misc_feature: Ceres ANNOT ID no. 6020242
  misc_feature (536)..(576): Pfam Id: zf-C3HC4 Pfam Desc: Zinc finger, C3HC4 type (RING finger)
  misc_feature (189)..(583): NCBI GI: 92871424 NCBI Desc: zinc finger, ring-type; ringv [medicago truncatula]
  misc_feature (379)..(580): NCBI GI: 20466428 NCBI Desc: pspzf zinc finger protein-like [arabidopsis thaliana]
  misc_feature (379)..(580): NCBI GI: 10129643 NCBI Desc: pspzf zinc finger protein-like [arabidopsis thaliana]
  misc_feature (379)..(580): NCBI GI: 58652060 NCBI Desc: at5g10650 [arabidopsis thaliana]
  misc_feature (388)..(580): NCBI GI: 25141205 NCBI Desc: at4g31450/f3l17_20 [arabidopsis thaliana]
  misc_feature: The sequence is a functional homolog of SEQ ID NO 1145 in the 11/479,226US patent application
  misc_feature: The sequence is a functional homolog of SEQ ID NO 140 in the 10/666,642US patent application
  misc_feature: The sequence is a functional homolog of SEQ ID NO 504 in the 10/412,699US patent application
  misc_feature: Useful for making plants with modulated growth and phenotype characteristics
  misc_feature: The sequence is a functional homolog of SEQ ID NO 504 in the 20040045049 US patent application
  misc_feature: The sequence is a functional homolog of SEQ ID NO. 271 in the 11/188,298 US application
  misc_feature: The sequence is a functional homolog of SEQ ID NO. 329 in the 11/188,298 US application
  misc_feature: The sequence is a functional homolog of SEQ ID NO. 468 in the 11/188,298 US application
MDESSCRSTTPVGFLRRGSGISLRNQSNEDRPSQYNKQPGKSSNLNPVKSRFTENKEKPRYFQGPFHSSGSRASSVSSSKAPVRKYCDERQKRPFLAETDIAESSNRRTEVRCLQRGKKASVFGDGHPYMQKGTSEASSSSTTTEESLPEEHDLGVLDVSGSSGNSAHAVNSRNTALSAMAHRQKDKEELNSGSHQGASTFVRRRTLPQSFTTGVKSSTAPSTNITGAQRRGLKNLGCTSISDVLPSGCSSSDSVRDRRVEVTKKRTSDAESSSRSRGISEQSNLSQPRASYPGSTGPRARAVEQLASQQIARTNSRSIQDPTDSIRTRRPFTLRARERMIPGEREDSVFALHETVASVHPECGHFHTDGAPPERLGRPFYAELPHAIYSSNRQGSSSQTARRRSTSRTEESPQRMFHGMFGERDGYRHVSMEGIAQALLALDRIEHDDELTYEQLLVLETNLLLSGLDLHDQHEDLRLDIDNMSYEELLALEDHIGSVSTALTEEQFAKCVNQSVYEARNSGRDVNKIAADDVKCSICQEEYIEGEEIGTMQCEHQYHVCCIHEWLRQKNWCPICKASAIPSEMNKGDA

SEQ ID NO: 2213 - DNA, 1761 bp, Sorghum bicolor
  misc_feature: Ceres ANNOT ID no. 6020245
  misc_feature: Encodes the peptide sequence at SEQ ID NO 2214
atggccacgcggccgtcgctgcggtcgagcgacggcgcgcgcccaagaagcaggagcgggaccggcactggcaggcccccgtcgagcccacgcagctccgacccgtcgcgcccgtccgccgccgccgccacggcggcggcggcggcggcgtccgacaagccgatgccgtccttcctccgccccaccgtgagctcgtcgatgcacagctcctcgtcgtcttcctcgctggcgtcgccctccccctcttcgtcgtcctccgccacggccgccggtgccggcggctccaagggcactgccgccacggcgaagcggtctgccgataaggccccggcgcagccggtgggcgcgtcccggccgatcacgcccaaggacaaggccccccctgtgagcgcgccgcggccgatcacgcccaaggacaaggccaaggccaaagcgccggtggcggcgtcgacatcctcgtcgcggtgggccgcggtgtcgccgaggcagctgatgcagagggcgtccaacgcgttcaaggccagcagcaggtcccgcagcaagaagagcaaggaggaggcggcgacctcggcgtccggaagcaagggcggcgctggtgccacctccgccagggccaaagaccagacggcgagagcacagcccgtcgaggagcagagccagcagccggagacgcccgccgagccgtcgcctgccgtgactcccgtggaagtagaggatcctgtgctgttggactccgaagctgctgaccagaacgaacaggacgtcccgacgtcgcaggaggctgtcagtactgacatcacgaccgtgccggtgaggtatcacaaggagcaggtcggcgcaggacagccgaagggaaaagcggaggaggaggacgtcgccgtggaggagaagatcatacaggtggaggctgaggaggtgaaggcggagaagctggagctgcatgaagacaggccgcagagcagcgaggctgtgcagacagaaacggaggcccagaagcacgcagatgatggttcgccggccgtcgttggagaagaagccgcggcgaaggaggcggcagcacatgagggagaagacgagccgacaaccagcacggtggaagaaaaggtcatcgaggagagccagcaagcagaggtgactgagaactcggaggcgaacgtgatctctgatgaaccaaaacaggaaaccagcgtgatctctgaagaacccaaggaggaaacgagcgtgatgtctgaagaatcaaaggaagcagctgatcccacgcctttgcagaagcacgaggaggtggtcgacgagtcaaaagtgactgccggatcgagcgtgtcagctccgacgacgccacttagagaagcggccaacgacgacgacgacgacgtggaggcagtgcctaaacaggtgagcgcgtcggagcccgtgacgccggtggcagaagccatcagcaaggggaaggaggtgatggatacgcagcagcagagcgcgtcggcgccgacgacgccggcgggcgcggcaaagaagagcgcgccatcgaagcaggcgacgatccccgaggggtcagcggcgtcggcgctggcgttcaaggggcgcaaggtgaagacggccatggagaagcggtcggaggaggagcagccgaagaagaaggaggtggcgcggagcaacgacgtgatcgaggaggccaagagggagctgatggagaagcggaagagcaaggtgaaggcgctggtgggggcgttcgagaccgtcatggacagcccccgggcgagctga

SEQ ID NO: 2214 - protein, 586 aa, Sorghum bicolor
  misc_feature: Ceres ANNOT ID no. 6020245
  misc_feature (2)..(521): NCBI GI: 72547036 NCBI Desc: proteophosphoglycan 5 [leishmania major]
  misc_feature (6)..(549): NCBI GI: 134065504 NCBI Desc: proteophosphoglycan ppg4 [leishmania braziliensis]
  misc_feature (2)..(521): NCBI GI: 72547023 NCBI Desc: proteophosphoglycan ppg4 [leishmania major]
  misc_feature (2)..(521): NCBI GI: 72547041 NCBI Desc: proteophosphoglycan ppg1 [leishmania major]
  misc_feature (41)..(570): NCBI GI: 387493 NCBI Desc: neurofilament largest subunit
MATRPSLRSSDGARPRSRSGTGTGRPPSSPRSSDPSRPSAAAATAAAAAASDKPMPSFLRPTVSSSMHSSSSSSSLASPSPSSSSSATAAGAGGSKGTAATAKRSADKAPAQPVGASRPITPKDKAPPVSAPRPITPKDKAKAKAPVAASTSSSRWAAVSPRQLMQRASNAFKASSRSRSKKSKEEAATSASGSKGGAGATSARAKDQTARAQPVEEQSQQPETPAEPSPAVTPVEVEDPVLLDSEAADQNEQDVPTSQEAVSTDITTVPVRYHKEQVGAGQPKGKAEEEDVAVEEKIIQVEAEEVKAEKLELHEDRPQSSEAVQTETEAQKHADDGSPAVVGEEAAAKEAAAHEGEDEPTTSTVEEKVIEESQQAEVTENSEANVISDEPKQETSVISEEPKEETSVMSEESKEAADPTPLQKHEEVVDESKVTAGSSVSAPTTPLREAANDDDDDVEAVPKQVSASEPVTPVAEAISKGKEVMDTQQQSASAPTTPAGAAKKSAPSKQATIPEGSAASALAFKGRKVKTAMEKRSEEEQPKKKEVARSNDVIEEAKRELMEKRKSKVKALVGAFETVMDSPRAS

SEQ ID NO: 2215 - DNA, 972 bp, Sorghum bicolor
  misc_feature: Ceres ANNOT ID no. 6020249
  misc_feature: Encodes the peptide sequence at SEQ ID NO 2216
atgcgcgtctctggtggccgtctacgccggctgctggccgtcaccgtcgtgctctccgtcgcgctgtccttggcgacggcggcggcgggaggcggcgagcacaacttccgccgggacttcgacgtggtgtggggcgcgggaaatgcgcggttccgcgacggcgggcggaccgtggagctgtccctggacgagcggacgggcgcgcggctgcagtccaagcagcgctacctcttcggcaagttcgacctcgagatgaagctcgtccccggcgagtccgccggcaccatcacctccttctatccagagtatactgccgcgtcgcagatttgcacgggcggcgcgcgacatgacgaggtggacttcgagttcctggggaacgcgagcggggagccatacctgctgcacaccaacatcttcagcgacgggcgtggggagcgggagcagcagttcgcgctgtggttcgaccccacgcggggcttccacacctacaccatcctgtggaacccgcacagcatcatcctctacgtcgacggcgtcccgatccgtgtcttcgccaacaacgccgcggcgggggtgccgttcccggcgcggcagccggtgcgggtgttcgctagcatctgggacgccgaggactgggccacgcagggcggccgcgtcaggaccgactggaaccgcgcgcctttcgtcgccacctaccgccggtacaacgtcaccaacgcctgcgtctgggaggatgaggaggatggaggtggtggtaatggtgggcgggtgcggtgcccgacgacggcggtggcgggcagtgggcggcggcggagggcggcggcgtggatggcgcagcggatggactggtggagctggatgacgctcagctgggtgcgcatgaactacatggtgtacgactactgcgctgaccggaggcggttcccgcacgagttcccgcccgagtgcgccatccccatcggcagatcgtga

SEQ ID NO: 2216 - protein, 323 aa, Sorghum bicolor
  misc_feature: Ceres ANNOT ID no. 6020249
  misc_feature (36)..(225): Pfam Id: Glyco_hydro_16 Pfam Desc: Glycosyl hydrolases family 16
  misc_feature (259)..(316): Pfam Id: XET_C Pfam Desc: Xyloglucan endo-transglycosylase (XET) C-terminus
  misc_feature (8)..(261): NCBI GI: 22947852 NCBI Desc: xyloglucan endotransglycosylase [malus x domestica]
  misc_feature (25)..(253): NCBI GI: 8886865 NCBI Desc: xyloglucan endotransglycosylase xet1 [asparagus officinalis]
  misc_feature (16)..(241): NCBI GI: 90811697 NCBI Desc: xyloglucan endotransglycosylase [striga asiatica]
  misc_feature (15)..(288): NCBI GI: 124109181 NCBI Desc: xyloglucan endotransglycosylase/hydrolase precursor xth-6 [populus tremula]
  misc_feature (11)..(318): NCBI GI: 68532877 NCBI Desc: xyloglucan endotransglucosylase/hydrolase [sagittaria pygmaea]
  misc_feature (23)..(237): SWISSPROT Homolog: EC 2.4.1.207 Xyloglucan endotransglucosylase/hydrolase protein 24 precursor
  misc_feature: Useful for making plants with altered cell wall content and/or composition
  misc_feature: Functional homolog of the protein sequence encoded by LOCUS at4g25810
  misc_feature: Functional homolog of the protein sequence encoded by LOCUS at5g57560
  misc_feature: Useful for making plants with altered cell wall content and/or composition
  misc_feature: Functional homolog of the protein sequence given in SEQ ID NO 13782
  misc_feature: Useful for making plants with altered carbohydrate content
  misc_feature: Functional homolog of the protein sequence given in SEQ ID NO 13783
  misc_feature: The sequence is a functional homolog of SEQ ID NO. 381 in the 11/188,298 US application
MRVSGGRLRRLLAVTVVLSVALSLATAAAGGGEHNFRRDFDVVWGAGNARFRDGGRTVELSLDERTGARLQSKQRYLFGKFDLEMKLVPGESAGTITSFYPEYTAASQICTGGARHDEVDFEFLGNASGEPYLLHTNIFSDGRGEREQQFALWFDPTRGFHTYTILWNPHSIILYVDGVPIRVFANNAAAGVPFPARQPVRVFASIWDAEDWATQGGRVRTDWNRAPFVATYRRYNVTNACVWEDEEDGGGGNGGRVRCPTTAVAGSGRRRRAAAWMAQRMDWWSWMTLSWVRMNYMVYDYCADRRRFPHEFPPECAIPIGRS

SEQ ID NO: 2217 - DNA, 1218 bp, Sorghum bicolor
  misc_feature: Ceres ANNOT ID no. 6020283
  misc_feature: Encodes the peptide sequence at SEQ ID NO 2218
atggcgactggccgatcgctcgccgcggtatactccgccagagcctcccgcaccgtgcctttccgcgccggcgcacggccggcccgagccgtcgccgccgccgccgcggccgagcacgtgcggaggctcgtggcggagttcgacccggcggtcccgctggactccgcgatcacgccgccgagcgggtggtacaccgacccaggcttcctccagcacgagctcgatcgtgtcttccaccgcggatggcaggctgtcggtcacatatggcaagtgaagaacccaaatgatttcttcacaggaagactgggaaatgtggaatttgtcatatgccgggatgcagatggaaaacttcatgctttccacaatgtgtgccgacatcacgcgtcactccttgcatgtggaagtggtcagaagacttgcttccagtgcccttatcatggatggacatatggattggatggcactctcctgaaggctacaagaatatcaggaataagaaatttcaataagaatgattttggtctcataccaatcaaggtggttacttggggaccttttgtgttggtcagatttgatgatgagtccactgaagataatgtttatgatgcagttggaaatgaatggttgggtagtgcttcagatctgttgggtacaaatggaattgacacttcactgccgcatatttgcaggcgagaatatattatcaactgtaactggaaggtcttttgtgacaattacctagatggtggatatcatgttccatacgcacatggggctcttgcatctggtctgcagctgcaatcctatgaaacacttacatatgaaagagttagtgttcaaagatgtgaaagtgcaccagcagaaccagatgattttgatcgcttagggacaaaagctctctatgcctttgtctatccaaactttatgatcaacaggtatggtccatggatggacactaatctagctgtcccattagactcaaccagctgcaaggtggtatttgattattttcttgacaagtctcttctggatgacgagagctttatcaagaaaagcctaaaagacagtgagcaagtacagatagaagacattgcactctgtgagggggttcagcgtggcctggaatcgccggcttacagtgttggaagatacgctccgtctgtggagatggccatgcaccacttccactgcctcatacatggtaaccttagtgggtag

SEQ ID NO: 2218 - protein, 405 aa, Sorghum bicolor
  misc_feature: Ceres ANNOT ID no. 6020283
  misc_feature (81)..(179): Pfam Id: Rieske Pfam Desc: Rieske [2Fe-2S] domain
  misc_feature (1)..(404): NCBI GI: 112790161 NCBI Desc: cmo protein [zea mays]
  misc_feature (1)..(405): NCBI GI: 33300598 NCBI Desc: choline monooxygenase [oryza sativa (japonica cultivar-group)]
  misc_feature (36)..(403): NCBI GI: 23978945 NCBI Desc: choline monooxygenase [arabidopsis thaliana]
  misc_feature (40)..(400): NCBI GI: 56463275 NCBI Desc: choline monooxygenase [salicornia europaea]
  misc_feature (39)..(404): NCBI GI: 15054919 NCBI Desc: choline monooxygenase [amaranthus tricolor]
  misc_feature (39)..(404): SWISSPROT Homolog: EC 1.14.15.7 Choline monooxygenase, chloroplast precursor
MATGRSLAAVYSARASRTVPFRAGARPARAVAAAAAAEHVRRLVAEFDPAVPLDSAITPPSGWYTDPGFLQHELDRVFHRGWQAVGHIWQVKNPNDFFTGRLGNVEFVICRDADGKLHAFHNVCRHHASLLACGSGQKTCFQCPYHGWTYGLDGTLLKATRISGIRNFNKNDFGLIPIKVVTWGPFVLVRFDDESTEDNVYDAVGNEWLGSASDLLGTNGIDTSLPHICRREYIINCNWKVFCDNYLDGGYHVPYAHGALASGLQLQSYETLTYERVSVQRCESAPAEPDDFDRLGTKALYAFVYPNFMINRYGPWMDTNLAVPLDSTSCKVVFDYFLDKSLLDDESFIKKSLKDSEQVQIEDIALCEGVQRGLESPAYSVGRYAPSVEMAMHHFHCLIHGNLSG

SEQ ID NO: 2219 - DNA, 1332 bp, Sorghum bicolor
  misc_feature: Ceres ANNOT ID no. 6020288
  misc_feature: Encodes the peptide sequence at SEQ ID NO 2220
atggaggccatggccgcggaaccatcctccccggcgccggctgccgctggaaatctccctactccgccgtacctccactgcctagctccatctgatgaggtagcaacgccgccgccgaagccgaagcaatcaaccgcggggccggggctgaggaccccctcgccggcgccgtcggttcaggtgtccgccgggcactctctgcacgacctgctgctgctgtccccgccacccccgagctctcgccgccaccggtcgaggacccgtggggccgccgggacgagcgtggacgagagcctggagattgttgcggtggtggggacgcccacgccgccaaggcggaggcggcgcggggccgcggagcagtgcgtggcgcccgctctggcgtccccgaggaacgcacgacgggcgaggcggaggctggagaaggacgtcgaggcggcggaggaggacgccgccaggaaggcccgcaggaggaagtccacaagggctgcgcccaaagctgcagcggccgcggacaaggcagcggcggtgctgaacgacgacgatacaaccatggctttggtcccggcttgtcctgttgctacctgcggaactgacttcgtggaacgatctgagttggaaggtttctgggaaaggatcgttgagttggtgatgtggaggaacgtggctaaatcggcactctggttcggatctggatctatgttcttctcatgctcattttcaagagacgtcaccttcagcccaatctcagctctctgtcacctcggcgttatgatcttaggcttggctttcttcaagaattctgttcctcagaggccgcaggtggagaataagagaagcttccagttgactgaagaagacgtgcttcgtgcttctcaagctgtgcttccgattgcaaattccatgatatccatggcacaagtgatcttctctggtgaaccctcaatgactctcaaagtactgcctgtacttttgttcggtgctaaatatgggggccttgttacagtgtggaggcttgtagctgcaggatttttcaccagttttacagtcccaaagctatatagctgttattcaagtcaaattcatagaagagttgagattttgagagatcaggctctagaagcatggaagtcttgcccacgcaaaaaacttgttgcagctatggtagtcacaatgtgctggaacatgtttagtgtgaagacacgcgtcatggcagcctttgtttcacttgtaatactgcgctacaatcagaagtaccacaaggcgaacataatgacagaagttggaagtagccgagatgagcaagggcagacaatggagatggatgagtaa

SEQ ID NO: 2220 - protein, 443 aa, Sorghum bicolor
  misc_feature: Ceres ANNOT ID no. 6020288
  misc_feature (213)..(391): Pfam Id: Reticulon Pfam Desc: Reticulon
  misc_feature (9)..(443): NCBI GI: 48716590 NCBI Desc: reticulon-like [oryza sativa (japonica cultivar-group)]
  misc_feature (41)..(418): NCBI GI: 18417196 NCBI Desc: reticulon family protein [arabidopsis thaliana]
  misc_feature (213)..(418): NCBI GI: 92887677 NCBI Desc: reticulon [medicago truncatula]
  misc_feature (114)..(366): NCBI GI: 42570829 NCBI Desc: reticulon family protein [arabidopsis thaliana]
  misc_feature (142)..(443): NCBI GI: 145359382 NCBI Desc: reticulon family protein [arabidopsis thaliana]
MEAMAAEPSSPAPAAAGNLPTPPYLHCLAPSDEVATPPPKPKQSTAGPGLRTPSPAPSVQVSAGHSLHDLLLLSPPPPSSRRHRSRTRGAAGTSVDESLEIVAVVGTPTPPRRRRRGAAEQCVAPALASPRNARRARRRLEKDVEAAEEDAARKARRRKSTRAAPKAAAAADKAAAVLNDDDTTMALVPACPVATCGTDFVERSELEGFWERIVELVMWRNVAKSALWFGSGSMFFSCSFSRDVTFSPISALCHLGVMILGLAFFKNSVPQRPQVENKRSFQLTEEDVLRASQAVLPIANSMISMAQVIFSGEPSMTLKVLPVLLFGAKYGGLVTVWRLVAAGFFTSFTVPKLYSCYSSQIHRRVEILRDQALEAWKSCPRKKLVAAMVVTMCWNMFSVKTRVMAAFVSLVILRYNQKYHKANIMTEVGSSRDEQGQTMEMDE

SEQ ID NO: 2221 - DNA, 1056 bp, Sorghum bicolor
  misc_feature: Ceres ANNOT ID no. 6020292
  misc_feature: Encodes the peptide sequence at SEQ ID NO 2222
atgtcccaccacgacggaagcaagccgtaccagccgcgccgggggcccgagcggcacccgcagccggcggacgggatggccgccccgcctcccgccgccgttggcccgtcggtggagcacctcgtggcggccgccgccgaggcggaggcgttgaaccgcttcgccgtggaaccacaggtgcacgagcaggaggttggggaggaagaagaggaggacgaggaggaagacgagatggaggaggaggaggacgagcaggaaggccagcacggtggcatcggtggggagcacgttcccatggacgcggatgctgctgccgcggcggctgcggccgccggcgcgcagatggacccgcactcggcgatggtgcctgggaccgtgccacccatggcgaccaaccagctcaccctgtcgttccagggcgaggtctatgtgttcgactccgtctcccctgataaggtccaagccgtgcttttgctgcttggagggagggagctgagcagcctgggcggagcgtcatcctctgcaccttatagtaagaggttgaattttccacatcgggtggcgtcactaatgagatttagggaaaaacggaaggagcggaactttgataagaagatccggtacactgttcggaaggaagttgcgcttaggatgcagcggaatagaggtcagtttacatcttcaaaaccaaagcctgatgaaatagcagcatcagaaatggcagctgtagatggctccccgaattgggcgttagttgaaggccgacctccatctgctgccgaatgtcatcattgtggtactaatgcaacagctacgccaatgatgcgtcgtggacctgatggaccaagaacactatgcaatgcctgcggcctcatgtgggcaaataagggtctcctgagggacctatcaaaatctcctgtaccacttcaagttatgcaatcagctccacttctagatggtggtaatggaaatgtcatgtctgcgcctggctctgagctagagaatgctgcagctgccatgaccaatggccacgagtcatcaagtagtggtgtttaa

SEQ ID NO: 2222 - protein, 351 aa, Sorghum bicolor
  misc_feature: Ceres ANNOT ID no. 6020292
  misc_feature (186)..(230): Pfam Id: CCT Pfam Desc: CCT motif
  misc_feature (262)..(299): Pfam Id: GATA Pfam Desc: GATA zinc finger
  misc_feature (1)..(314): NCBI GI: 115469738 NCBI Desc: os06g0698900 [oryza sativa (japonica cultivar-group)]
  misc_feature (40)..(309): NCBI GI: 47174868 NCBI Desc: male-specific transcription factor m88b7.2 [marchantia polymorpha]
  misc_feature (127)..(349): NCBI GI: 8918531 NCBI Desc: zim [arabidopsis thaliana]
  misc_feature (122)..(305): NCBI GI: 140071757 NCBI Desc: zinc finger, gata-type; zim; cct [medicago truncatula]
  misc_feature (186)..(306): NCBI GI: 126506754 NCBI Desc: gata-type zinc finger protein [triticum aestivum]
  misc_feature: The sequence is a functional homolog of SEQ ID NO 608 in the 10/374,780US patent application
  misc_feature: Useful for making plants with altered Lignin content
  misc_feature: Useful for making plants with altered terpenoid content
  misc_feature: Useful for making plants with modulated growth and phenotype characteristics
  misc_feature: Functional homolog of the protein sequence given in SEQ ID NO 12908
  misc_feature: Functional homolog of the protein sequence given in SEQ ID NO 12988
  misc_feature: The sequence is a functional homolog of SEQ ID NO 608 in the 20060162006 US patent application
  misc_feature: Useful for making plants with altered terpenoid content
  misc_feature: Functional homolog of the protein sequence given in SEQ ID NO 12908
  misc_feature: The sequence is a functional homolog of SEQ ID NO. 370 in the 11/188,298 US application
MSHHDGSKPYQPRRGPERHPQPADGMAAPPPAAVGPSVEHLVAAAAEAEALNRFAVEPQVHEQEVGEEEEEDEEEDEMEEEEDEQEGQHGGIGGEHVPMDADAAAAAAAAAGAQMDPHSAMVPGTVPPMATNQLTLSFQGEVYVFDSVSPDKVQAVLLLLGGRELSSLGGASSSAPYSKRLNFPHRVASLMRFREKRKERNFDKKIRYTVRKEVALRMQRNRGQFTSSKPKPDEIAASEMAAVDGSPNWALVEGRPPSAAECHHCGTNATATPMMRRGPDGPRTLCNACGLMWANKGLLRDLSKSPVPLQVMQSAPLLDGGNGNVMSAPGSELENAAAAMTNGHESSSSGV

SEQ ID NO: 2223 - DNA, 1170 bp, Sorghum bicolor
  misc_feature: Ceres ANNOT ID no. 6020293
  misc_feature: Encodes the peptide sequence at SEQ ID NO 2224
atggccttgtcccacctggcagctctcgtctccctgctgctcccctgcctcctcgcgctgctgctgctccgcctcgccgccgtgctggacccggactccgacgccgcggtgccccgcgtcaaggcggccgcgcccctccccctccgcttccgccatgacggcgccttcaagatcctccaggtggcggacatgcacttcggcaacggcgccgccacgcgctgccgggacgtgggccccgacggcggcggcgcgttgtgttcggacctcaacaccacgcggttcctgcgccgggtcatcgaggccgagaagcccgacctcatcgccttcacaggagacaacatatttgggggcagtgcaactgatgcagcggaatcactactcagagcaatcagccctgctatcgaatacaaggtgccatgggctgccattttaggtaatcatgaccaagagtcaacaatgacgcgggaggagctgatgaccttcatgtctctgatggattactcggtatctcaagtaaacccacctggttttttggtacatgggtttgggaattatcacattggcatccatgggtcatttggatccgagttggtcaatactagcctgcttaacctttacttcctggatagcggtgatcgtgaagtggtgaatggagttaaaacatatggatggatcaaagaatctcaactcacctggcttcgtgctacttcactggaacttcagaaaaaaacacatgcccctgcattagccttcttccacatcccaatcccagaggtccgaggactctggtactcaggcttcaagggtcagtatcaggagggagtcgcatgctcatctgtaaattctggtgtccttgggacccttgtctccatgggagatgtaaaagctgtctttcttggtcacgaccatctgaatgatttttgtggcaacctcaatgggatttggttctgttatggtggtggctttggttatcatgcctatggaagaccccattggccaaggagagctcggataatttacagcgagctcaagaaagggcagagatcgtggatggaagttgaatcaatccagacttggaagctgctagatgatgaaaagctttccaaaattgatgaacaggttctctggagacacagcacagatgattctgatcacagtgtatacttctga

SEQ ID NO: 2224 - protein, 389 aa, Sorghum bicolor
  misc_feature: Ceres ANNOT ID no. 6020293
  misc_feature (56)..(305): Pfam Id: Metallophos Pfam Desc: Calcineurin-like phosphoesterase
  misc_feature (1)..(380): NCBI GI: 115469740 NCBI Desc: os06g0699200 [oryza sativa (japonica cultivar-group)]
  misc_feature (110)..(380): NCBI GI: 53791873 NCBI Desc: calcineurin-like phosphoesterase-like [oryza sativa (japonica cultivar-group)]
  misc_feature (13)..(381): NCBI GI: 50725793 NCBI Desc: pts protein-like [oryza sativa (japonica cultivar-group)]
  misc_feature (53)..(383): NCBI GI: 6323393 NCBI Desc: dcr2p [saccharomyces cerevisiae]
  misc_feature (95)..(354): NCBI GI: 82745454 NCBI Desc: phosphohydrolase, icc family [clostridium beijerincki ncimb 8052]
MALSHLAALVSLLLPCLLALLLLRLAAVLDPDSDAAVPRVKAAAPLPLRFRHDGAFKILQVADMHFGNGAATRCRDVGPDGGGALCSDLNTTRFLRRVIEAEKPDLIAFTGDNIFGGSATDAAESLLRAISPAIEYKVPWAAILGNHDQESTMTREELMTFMSLMDYSVSQVNPPGFLVHGFGNYHIGIHGSFGSELVNTSLLNLYFLDSGDREVVNGVKTYGWIKESQLTWLRATSLELQKKTHAPALAFFHIPIPEVRGLWYSGFKGQYQEGVACSSVNSGVLGTLVSMGDVKAVFLGHDHLNDFCGNLNGIWFCYGGGFGYHAYGRPHWPRRARIIYSELKKGQRSWMEVESIQTWKLLDDEKLSKIDEQVLWRHSTDDSDHSVYF

SEQ ID NO: 2225 - DNA, 1305 bp, Sorghum bicolor
  misc_feature: Ceres ANNOT ID no. 6020302
  misc_feature: Encodes the peptide sequence at SEQ ID NO 2226
atggcacgtcagtcggcgctctcgctcgcgagagaccaggcgaaggtgggagcactgaagcgtctgaccctgggctcatccaagacggcggggcggaactcgtccgggcgcatcacctcttaccaccgtggcggaggggccaagaggctgcagaggaaagtcgatgtgaagcgggacacctcttccctgggcattgtggagcggatcgagtacgacccgaatcgctcctctagcgttgctctggtgcgatgggtccaaggggtgcatttccgccgccccaagactctgcaagagcccagcgccaagccaccggtcctcgaatctgccactgctgatgtctctgctcggttttcccttgctccgctgtctggtagagtgcacaaggaaaaggaagctgctgcgctgtactcttctttgggcagtggagatattgcatctcttaaatctggtgccagcttgcctaggatagcattagctggtgcaaagcccactttctatgctcaagtcagaggaattgaagaaaaacagacattctctctttctggaattcaaaaatgggcagcagatgatgcgctttggacacagaggatgaagcgtcaagctgctctctcttggcagaatgatctcaagaagaaacctttgctccagacacaggctaaccgcttcagtagctcggcagcaaagtctattggtatgagtaaagggtcaaagggaaaggctgattgtgtaccggtatcttatatactggccagtcaccaatgcatgccaggcagtacagtgatgaactatgactcctcgaaaccctctaagagtacatcctcttcaccatattcctcagctaatcagtttgatataattgatctcaactcaaaggttggaaattgtataccactagccaatgcacgaattggaacatgggtgcacgacattgaatgtcgtcctggtcagggtgggaagatggtacgagcagctggtacatatgctaaagtagtccaggagccaggtgtacagtgtgttctgcgtcttccttcaggtgctgagaagattgtcgattcaaaatgccgtgctacaattggtatagtctccaatccaagccatggaacacgcaagctaaggaaagcagggcatagccggtggttgggcagacgccctgttgtccgtggtgttgcgatgaatcctgtggatcatccccatggtggaggcgaggggcgtaccaaaggaggcaggccttcagtttctccttggggaaagcccaccaaagctgggtaccggtcaccaaatgtggccagccgtaaaacttcttag

SEQ ID NO: 2226 - protein, 434 aa, Sorghum bicolor
  misc_feature: Ceres ANNOT ID no. 6020302
  misc_feature (290)..(418): Pfam Id: Ribosomal_L2_C Pfam Desc: Ribosomal Proteins L2, C-terminal domain
  misc_feature (31)..(101): Pfam Id: Ribosomal_L2 Pfam Desc: Ribosomal Proteins L2, RNA binding domain
  misc_feature (1)..(432): NCBI GI: 17644110 NCBI Desc: ribosomal protein l2 [zea mays]
  misc_feature (257)..(425): NCBI GI: 6094106 NCBI Desc: mitochondrial 60s ribosomal protein l2
  misc_feature (257)..(425): NCBI GI: 74100083 NCBI Desc: ribosomal protein l2 [oryza sativa (indica cultivar-group)]
  misc_feature (257)..(425): NCBI GI: 23495405 NCBI Desc: ribosomal protein l2 [oryza sativa (japonica cultivar-group)]
  misc_feature (264)..(425): NCBI GI: 68449777 NCBI Desc: mitochondrial l2 ribosomal protein [triticum aestivum]
MARQSALSLARDQAKVGALKRLTLGSSKTAGRNSSGRITSYHRGGGAKRLQRKVDVKRDTSSLGIVERIEYDPNRSSSVALVRWVQGVHFRRPKTLQEPSAKPPVLESATADVSARFSLAPLSGRVHKEKEAAALYSSLGSGDIASLKSGASLPRIALAGAKPTFYAQVRGIEEKQTFSLSGIQKWAADDALWTQRMKRQAALSWQNDLKKKPLLQTQANRFSSSAAKSIGMSKGSKGKADCVPVSYILASHQCMPGSTVMNYDSSKPSKSTSSSPYSSANQFDIIDLNSKVGNCIPLANARIGTWVHDIECRPGQGGKMVRAAGTYAKVVQEPGVQCVLRLPSGAEKIVDSKCRATIGIVSNPSHGTRKLRKAGHSRWLGRRPVVRGVAMNPVDHPHGGGEGRTKGGRPSVSPWGKPTKAGYRSPNVASRKTS

SEQ ID NO: 2227 - DNA, 2640 bp, Sorghum bicolor
  misc_feature: Ceres ANNOT ID no. 6020306
  misc_feature: Encodes the peptide sequence at SEQ ID NO 2228
atggccgcactccgcctccccgcccagccggcggcgaggttgtcccaccttccaaccccagtgtccgcctccgccgccgcgcgtcgggtctcgccccctcgccatctcgtggtgcggcgggccaagggggaggacacgccggagccgccggtgaggacgctgctgatcgacaactacgacagctacacctacaacatcttccaggagctgtcggtcgtcaacggcgtgccgccggtggtcgtgcgcaacgacgagtggacgtggagggacgtcttcaaccgggtgtacaaggaccgggccttcgacaacatcgtcatctcgcctggccctggatctccggcttgccccgccgacataggtgtatgtctacgcatacttttggagtgtggagatgtacccatattgggtgtctgccttggacatcaggccctgggatttgtacatggtgctaagattgttcatgctccagaagctatacacgggcgactcagtgaaattgagcatgatggatcctacctctttaattgtgtcccgtcaggtagaaattctggcttcaaggtagtgaggtatcattcacttgtaatagaatctggttctctgcctgatgatctttcatctatagcgtggactgcttctcgaaatttgctttcttaccttgaaagtgatcgaagcaatgttggtaccttcttgggatcattggacaacaacttcatcacaaaccctctagagtacaataacaatagtggggaactatccaatataggacatgctagtgagtcagatgatggcagagttatcatgggcatcaggcactctagcaggcctcattttggagtgcagtttcacccagagagcgttgctactcatcatggaagacagattttccgaaactttaagaagatgacaggagattttggattgtgctcgtcatggctccaggaaagaaaggtcaattctgcaagacatcgtgattctatccctaaggacttgttgcgtactaaaagaatggagctttcagagcctgttgggtcttgtgtacttggaaagagaggcactgggaaaaagtgtttacgattacgatggaagaagattgaaaatttcctctgtcccacagttggctctgaagacatatttgcggtgctttttggccatcaaagtggtgaagacacgttttggttggatagctcatcagtcgaccagaatagagcacgtttttcattcatgggtggcaaaggtgggtccctgtggaagcaaatgacattccacttatctggtcaaagagccaattgtggaggaacgcttattacccaagatgcttatggatatactgctaaaaacttcatcaaagagggcttcttggagttccttaacaaggagatcgagtccattcaatacaacgagaaggattatgaagggctgccctttgaattccatggtggcttcgttggatatctggggtatggtcttaaagtggagtgtgatgcatcatccaacaatgccaaatcaagtactcctgatgcatgcttcgtctttgctgataacactgtggtggttgatcacagtaatggtgatgtgtatattttgtcactgcatgatgaattttattctagtaatggagatgggatatgcaaaaattcaacacatacttcatggttagttgagactgagaagaagcttctcaggttgggtggtatgcccccaggatcaccaattaatgggaaggcatatgctagatcatccagtgtgcataagcagagttttgttgtcgagaaatcaaaggatcagtatattagagaggttcagagttgcttggactatatcagggatggagaaagctatgagttgtgcttaactactcagatgaagagaagagtagactatataaatgcgctccaactctaccttaaactgagaaaacaaaatccagcgccttatgcagcctggcttaacttctcctcagaaaacttgagcatatgttgctcttctccagaaaggtttctacgactagaccgaggcggagttctagaagcaaaaccaatcaaaggtactatagcacgtggcagaacaccagaggaagatgaatgcttacgtttgcagttgaaatacagtgaaaaggatcaggctgagaacttgatgattgttgatctcctaagaaatgatcttggaaaggtttgtgaaccagggagtgtgcatgtcccttgtctcatggatgtagaatcatataaaactgtccacaccatggtgagtaccgtccgtggaacaaagaagtcaaatctaagccctgttgattgtgtgaaagcagcctttccaggtggttcaatgactggggccccgaaagttagatcaatggagatccttgattcacttgaaactagtccaagaggtgtgtactcaggatccattgggttcttttcgtataaccacacattcgatctgaacattgtgattcgaacggttgtcctgcatgatggagaagcctcggtaggggcaggtggggcgatcgtagcactgtcaaacccagaagcagaatacaacgaaatgttgcttaaagcaaaagcaccaacaaaggtggttgaggatttcattcaaacagtttacagctcagatcgatcagattcgatgcagacaaccttaagctag

SEQ ID NO: 2228 - protein, 879 aa, Sorghum bicolor
  misc_feature: Ceres ANNOT ID no. 6020306
  misc_feature (592)..(858): Pfam Id: Chorismate_bind Pfam Desc: chorismate binding enzyme
  misc_feature (54)..(301): Pfam Id: GATase Pfam Desc: Glutamine amidotransferase class-I
  misc_feature (367)..(527): Pfam Id: Anth_synt_I_N Pfam Desc: Anthranilate synthase component I, N terminal region
  misc_feature (1)..(879): NCBI GI: 144583299 NCBI Desc: 4-amino-4-deoxychorismate synthase [triticum aestivum]
  misc_feature (33)..(869): NCBI GI: 40218381 NCBI Desc: aminodeoxychorismate synthase/glutamine amidotransferase [lycopersicon esculentum]
  misc_feature (327)..(861): NCBI GI: 52078130 NCBI Desc: tpa: plastid aminodeoxychorismate synthase/glutamine amidotransferase [arabidopsis thaliana]
  misc_feature (551)..(866): NCBI GI: 75909674 NCBI Desc: glutamine amidotransferase of anthranilate synthase [anabaena variabilis atcc 29413]
  misc_feature (550)..(866): NCBI GI: 17230935 NCBI Desc: p-aminobenzoic acid synthase [nostoc sp. pcc 7120]
  misc_feature: The sequence is a functional homolog of SEQ ID NO. 469 in the 11/188,298 US application
MAALRLPAQPAARLSHLPTPVSASAAARRVSPPRHLVVRRAKGEDTPEPPVRTLLIDNYDSYTYNIFQELSVVNGVPPVVVRNDEWTWRDVFNRVYKDRAFDNIVISPGPGSPACPADIGVCLRILLECGDVPILGVCLGHQALGFVHGAKIVHAPEAIHGRLSEIEHDGSYLFNCVPSGRNSGFKVVRYHSLVIESGSLPDDLSSIAWTASRNLLSYLESDRSNVGTFLGSLDNNFITNPLEYNNNSGELSNIGHASESDDGRVIMGIRHSSRPHFGVQFHPESVATHHGRQIFRNFKKMTGDFGLCSSWLQERKVNSARHRDSIPKDLLRTKRMELSEPVGSCVLGKRGTGKKCLRLRWKKIENFLCPTVGSEDIFAVLFGHQSGEDTFWLDSSSVDQNRARFSFMGGKGGSLWKQMTFHLSGQRANCGGTLITQDAYGYTAKNFIKEGFLEFLNKEIESIQYNEKDYEGLPFEFHGGFVGYLGYGLKVECDASSNNAKSSTPDACFVFADNTVVVDHSNGDVYILSLHDEFYSSNGDGICKNSTHTSWLVETEKKLLRLGGMPPGSPINGKAYARSSSVHKQSFVVEKSKDQYIREVQSCLDYIRDGESYELCLTTQMKRRVDYINALQLYLKLRKQNPAPYAAWLNFSSENLSICCSSPERFLRLDRGGVLEAKPIKGTIARGRTPEEDECLRLQLKYSEKDQAENLMIVDLLRNDLGKVCEPGSVHVPCLMDVESYKTVHTMVSTVRGTKKSNLSPVDCVKAAFPGGSMTGAPKVRSMEILDSLETSPRGVYSGSIGFFSYNHTFDLNIVIRTVVLHDGEASVGAGGAIVALSNPEAEYNEMLLKAKAPTKVVEDFIQTVYSSDRSDSMQTTLS

SEQ ID NO: 2229 - DNA, 1512 bp, Sorghum bicolor
  misc_feature: Ceres ANNOT ID no. 6020337
  misc_feature: Encodes the peptide sequence at SEQ ID NO 2230
atggcctcgtcctctctcttcgccgcggcgcgccgcctgctcagcattggccgccgcggaggtctcctccccgttccgccatctcgcgccgttgcctcctcgtctcgcagcaacagagccgaggagggaacgccgccggcgcggccgccgaccctgtggtccacgctgtgcccgctgggcaaaccgggcacactcctcgtgccggagatcgaactgtgggcggcgcggtccggaaaacgcctccgaccttgtgagctccatttcgtcgtcaaggatctgcgcaggcgccaccgtcaccgccaggccctcgaggtctctgagtggatgaatctcaagggtcacgtcaaatttctgccaaaggatcatgctgttcacctggatttaatcggtcatattcatggagttggagcagcagagacctacttcaataacctatctgacaaagataagacagagaaaccatatggtgcacttctctactgctacacacgagaatgcttggttgacaaagcgttggcccattttcagaagatgaaagagctgggtttcgtgttcaccccactcccctacagcaacctcatgatcctctatgccaacgtagagcagcatgagagggtcccttcagtgatggcagaaatgaagagcaatgggattgttcccaataatttcagctacaacatatgcataaatgcttatggcacaagagctgacttttctggcttggagaacaccctggaagagatggaatttgcgtctcaagttgttgttgactggagaacctatgctgatgttgcaagccactacattaagggtgacctaagggaaaaggcatactctgccttacagaaagcagaggcaaaaatggatgaaaaggattcgtttgcctatagtcacttgatttccctgtatggccacctcggggacaaatcagagatcaagaggctatgggtgctgcaaatgttgaaatgtaaggggtgtatcaacaagggatacaagtacatgcttacagtgcttgtgaagcttgatgagatcgcggaagctgaagacttgctgaaaaagtgggagtccagcaaaaatgaattcgacttcaaagttccaaatatcctgctcaaaggatactgccaatggggcttgctggacaaggctgaggccctgcttgacggcttcttgagaaagggtaagaagccttctgcaaccagctgggcaattgtggcaagtgcctatgccgagaaaggtgatgtcccgagagcttatgagctgaccaaaagggccctctctatgtgcgtccctgattctggctggatccctgagccttcgatgattgaggtgatacttaagtatcttggagatgaaggggaggtcaaggatgtcgaagctttcattgatctgctgaaagttgttgtgccaatgaattctgatatgaccgaggctttgtcaagggctcgttcgagagaagaaaagaagaaagctgaagagacaacggaagctcctcgtgaggatagcactgcctga

SEQ ID NO: 2230 - protein, 503 aa, Sorghum bicolor
  misc_feature: Ceres ANNOT ID no. 6020337
  misc_feature (29)..(501): NCBI GI: 87162884 NCBI Desc: tetratricopeptide-like helical [medicago truncatula]
  misc_feature (48)..(465): NCBI GI: 29028736 NCBI Desc: at1g02150/t7i23.8 [arabidopsis thaliana]
  misc_feature (121)..(467): NCBI GI: 42570837 NCBI Desc: pentatricopeptide (ppr) repeat-containing protein [arabidopsis thaliana]
  misc_feature (53)..(465): NCBI GI: 32488964 NCBI Desc: osjnbb0038f03.9 [oryza sativa (japonica cultivar-group)]
  misc_feature (30)..(492): NCBI GI: 16323354 NCBI Desc: at4g01990/t7b11_26 [arabidopsis thaliana]
MASSSLFAAARRLLSIGRRGGLLPVPPSRAVASSSRSNRAEEGTPPARPPTLWSTLCPLGKPGTLLVPEIELWAARSGKRLRPCELHFVVKDLRRRHRHRQALEVSEWMNLKGHVKFLPKDHAVHLDLIGHIHGVGAAETYFNNLSDKDKTEKPYGALLYCYTRECLVDKALAHFQKMKELGFVFTPLPYSNLMILYANVEQHERVPSVMAEMKSNGIVPNNFSYNICINAYGTRADFSGLENTLEEMEFASQVVVDWRTYADVASHYIKGDLREKAYSALQKAEAKMDEKDSFAYSHLISLYGHLGDKSEIKRLWVLQMLKCKGCINKGYKYMLTVLVKLDEIAEAEDLLKKWESSKNEFDFKVPNILLKGYCQWGLLDKAEALLDGFLRKGKKPSATSWAIVASAYAEKGDVPRAYELTKRALSMCVPDSGWIPEPSMIEVILKYLGDEGEVKDVEAFIDLLKVVVPMNSDMTEALSRARSREEKKKAEETTEAPREDSTA

SEQ ID NO: 2231 - DNA, 1509 bp, Sorghum bicolor
  misc_feature: Ceres ANNOT ID no. 6020338
  misc_feature: Encodes the peptide sequence at SEQ ID NO 2232
atggcctcgtcctctctcttcgccgcggcgcgccgcctgctcagccttggccgccgcagagggctcctccccgtctcgccctctcgcgccgttgcctcctcgtctcgcagcaacagtggcgaggagggaacgccgcccgcgcggccgccgaccctggggtccacgctgtggccgctgggcaacccgggcacactccttgtgccagagattgaactgtgggcggcgcggcccgaaaaccacctccgagacgttgatctccgacgcattgtcaaggagctgcgcacgcgccgccgccaccgccaggccctcgaggtctctgagtggatgaatctgaagggtcacgtcaaatttctgccaaaggatcatgctgttcacctggatttaatcggtcatattcatggagttggagcagcagagacctacttcaataacctatctgacaaagataagacagagaaaccatatggtgcacttctcaactgctatacacgagaacgcttggtcgataaagcgttggcccattttcagaagatgaaagagctgggttttgtgttcaccgcgctcccctacaacaacctcatgagcctctataccaacatagagcagcatgagagggtcccttcggtgatggcagagatgaagagtaatggtattgttccagataattttagctacagaatatgcataaattcttatggcacaagagctgatttttttgggttggagaacaccctggaggagatggaatgtgagcctcaaattgttgttgactggaatacctacactgtcgtggcaagccaatacattaagggtgacctaagggagaaggcatactctgccttaaagaaagcagaggcaaaaatgggtataaaggatctggctgcctatagacacttgatttccttatatggccaccttggggacaaatcagaggtcaagaggctatgggcggtgcaaatgtcgaactgtcagaggcatcttaacacagactacaccaacattcttgcagtgcttgtgaagcttgatgagatcgcggaagctgaagacttgctgaaagagtgggagaccagcaaaaatgaattcgacttcaaagttccaaatgtgctgctcacatggtactgccaaaagggcttgctggacaaggccgaggcactgctcgacggcttcttgataaagggaaagatgcctccttcaacgagctgggaaattgtggcaagtggctatacggagaaaggtgatgtcgcgagagcttatgagctgaccaaaaatgccctctatatgtacgcccctaattctggctgggtccctgagccttcgatgattgagatgatacttaagtatcttggagatgaaagggaggtcaaggatgtcgaagctttcattgatctgctgaaagttgctgtgccaatgaactctgatatgacggaggctttgtcaagggctcgttcgagagaagaaaagaaaggtgaaggggcaagggaagctctccgtgaggatcttattgcctga

SEQ ID NO: 2232 - protein, 502 aa, Sorghum bicolor
  misc_feature: Ceres ANNOT ID no. 6020338
  misc_feature (153)..(187): Pfam Id: PPR Pfam Desc: PPR repeat
  misc_feature (188)..(222): Pfam Id: PPR Pfam Desc: PPR repeat
  misc_feature (29)..(501): NCBI GI: 87162884 NCBI Desc: tetratricopeptide-like helical [medicago truncatula]
  misc_feature (85)..(465): NCBI GI: 29028736 NCBI Desc: at1g02150/t7i23.8 [arabidopsis thaliana]
  misc_feature (78)..(465): NCBI GI: 32488964 NCBI Desc: osjnbb0038f03.9 [oryza sativa (japonica cultivar-group)]
  misc_feature (121)..(464): NCBI GI: 42570837 NCBI Desc: pentatricopeptide (ppr) repeat-containing protein [arabidopsis thaliana]
  misc_feature (85)..(498): NCBI GI: 16323354 NCBI Desc: at4g01990/t7b11_26 [arabidopsis thaliana]
MASSSLFAAARRLLSLGRRRGLLPVSPSRAVASSSRSNSGEEGTPPARPPTLGSTLWPLGNPGTLLVPEIELWAARPENHLRDVDLRRIVKELRTRRRHRQALEVSEWMNLKGHVKFLPKDHAVHLDLIGHIHGVGAAETYFNNLSDKDKTEKPYGALLNCYTRERLVDKALAHFQKMKELGFVFTALPYNNLMSLYTNIEQHERVPSVMAEMKSNGIVPDNFSYRICINSYGTRADFFGLENTLEEMECEPQIVVDWNTYTVVASQYIKGDLREKAYSALKKAEAKMGIKDLAAYRHLISLYGHLGDKSEVKRLWAVQMSNCQRHLNTDYTNILAVLVKLDEIAEAEDLLKEWETSKNEFDFKVPNVLLTWYCQKGLLDKAEALLDGFLIKGKMPPSTSWEIVASGYTEKGDVARAYELTKNALYMYAPNSGWVPEPSMIEMILKYLGDEREVKDVEAFIDLLKVAVPMNSDMTEALSRARSREEKKGEGAREALREDLIA

SEQ ID NO: 2233 - DNA, 720 bp, Sorghum bicolor
  misc_feature: Ceres ANNOT ID no. 6020344
  misc_feature: Encodes the peptide sequence at SEQ ID NO 2234
atgtcgcagccgccggagccggtgaagctgatcacggcgttcggcagcccgttcgcgcaccgcgtggaggtggcgctggcgctcaagggggtgccgtacgagctgctggtggaggacctgtccgccaagagcgacctcctgctgacgcacaaccccatccaccgctccgtcccggtgctcctccacgccggccgcgccgtctgcgagtccctcctcatcgtcgagtacgtcgacgaggccttccccgcctccgcctcccacggcgacgtcgtcaggatcctgcccgccgacccctacgcccgcgccaccgcccgcttctgggccgacttcgtcgccaccaagtgcctgaagccgctgtggctgtcgatgtggacggccgacggcgaggcgcgggcgaggttcgccgcggagacgaaggcgagcctggcggtgctggacgcggagctccgcggccgcgggacgaggttcttcggcggcgacgacctcggcttcgtcgacctcgccgcctgcacgctggcgcactggctcggcgtgctggaggaggtggccggggtgcgcctcgtggcggagggagagtacccgtctctgcggcggtgggccgacgagtacacctcccacgaggtcgtcaggcggtccctgccggacagggaccagctcgtcgccttcttcgccgccaacaaggagaggtacaggtccatggtcgacgcagcggtgcactag

SEQ ID NO: 2234 - protein, 239 aa, Sorghum bicolor
  misc_feature: Ceres ANNOT ID no. 6020344
  misc_feature (6)..(79): Pfam Id: GST_N Pfam Desc: Glutathione S-transferase, N-terminal domain
  misc_feature (111)..(207): Pfam Id: GST_C Pfam Desc: Glutathione S-transferase, C-terminal domain
  misc_feature (1)..(238): NCBI GI: 13699857 NCBI Desc: glutathione s-transferase gst 24 [zea mays]
  misc_feature (7)..(239): NCBI GI: 4468798 NCBI Desc: gst7 protein [zea mays]
  misc_feature (8)..(230): NCBI GI: 11385507 NCBI Desc: glutathione s-transferase gst 28 [zea mays]
  misc_feature (8)..(236): NCBI GI: 11385509 NCBI Desc: glutathione s-transferase gst 29 [zea mays]
  misc_feature (1)..(238): NCBI GI: 11385493 NCBI Desc: glutathione s-transferase gst 21 [zea mays]
  misc_feature: Useful for making plants with modulated nitrogen use efficiency
  misc_feature: Functional homolog of the protein sequence encoded by LOCUS at3g09270
MSQPPEPVKLITAFGSPFAHRVEVALALKGVPYELLVEDLSAKSDLLLTHNPIHRSVPVLLHAGRAVCESLLIVEYVDEAFPASASHGDVVRILPADPYARATARFWADFVATKCLKPLWLSMWTADGEARARFAAETKASLAVLDAELRGRGTRFFGGDDLGFVDLAACTLAHWLGVLEEVAGVRLVAEGEYPSLRRWADEYTSHEVVRRSLPDRDQLVAFFAANKERYRSMVDAAVH

SEQ ID NO: 2235 - DNA, 1047 bp, Sorghum bicolor
  misc_feature: Ceres ANNOT ID no. 6020345
  misc_feature: Encodes the peptide sequence at SEQ ID NO 2236
atgaggacttttcaacaaaaccctgaggataggagagtaaatacttccaagccttggacttcaaaaaagaagttttgtgagctgcctgactctgttgaagtgcatataattgatgatgacagtaatgacagcagcaaggattactcagtggaagatgcatcaaagcagcttgccatttacaatcctgatatcacacatgacaagcaaactgacatggatcactatgcttcaccgcaccagagttctaagaagccaagacgtggatatggcacagttttaccttctattggtacttatactgtacagtgtgccaaatgctacaaatggaggatcgttccaaccaaagaaaaatatcaagagctacgagggagtatttctcaggagctttttgtatgcgcaagggctcgtgagtggaaccgcgaattatcatgtgttgaactagaagatatttcacaagatggaagtaggatgtgggcgattgataggccaaacattgtccaaccccctcctggctgggacagggaggtcagactcaggggagcttccaccaagtttgcagatgtgtattacacttctccatctgggaaaaagttgaggtcattggttgaaattgggaggtacttggaacagaacccacactacatcagagaaggggttaacttatcccagttttcatttgccactcccaaacctctgcaagaagactatgttcagaagcatacatttggagatggtcatgagttactagggcttcatgagatatctcaagtcgatcctctgtgttgggcaggacctccttctcgcagagaactgctcggtgaacttggcatttcagctttgggtcgtgttgacactgaccagcccgagatgtcagatagtgtcagtcttcaccagctcaaggtgtctgaaccaccagctcagcactgcaagagaactgtgaagcaagtatcatcgaggaagtgtcgaaggactcctccagcagcgaggtatccattcgaagaacaatctggtggccacacgaacgacatcgagcatgtgcagctgtga

SEQ ID NO: 2236 - protein, 348 aa, Sorghum bicolor
  misc_feature: Ceres ANNOT ID no. 6020345
  misc_feature (98)..(151): Pfam Id: zf-CW Pfam Desc: CW-type Zinc Finger
  misc_feature (158)..(234): Pfam Id: MBD Pfam Desc: Methyl-CpG binding domain
  misc_feature (1)..(348): NCBI GI: 115469778 NCBI Desc: os06g0702100 [oryza sativa (japonica cultivar-group)]
  misc_feature (1)..(191): NCBI GI: 53792746 NCBI Desc: methyl-binding domain protein-like [oryza sativa (japonica cultivar-group)]
  misc_feature (14)..(305): NCBI GI: 115479913 NCBI Desc: os09g0494300 [oryza sativa (japonica cultivar-group)]
  misc_feature (65)..(304): NCBI GI: 134285526 NCBI Desc: mbd2 [triticum aestivum]
  misc_feature (51)..(189): NCBI GI: 3047090 NCBI Desc: t26d22.18 gene product [arabidopsis thaliana]
  misc_feature: The plant flowers significantly late compared to wild-type.
  misc_feature: The plant is abnormally large.
  misc_feature: Useful for making plants with altered alkaloid content
  misc_feature: Useful for making plants with altered terpenoid content
  misc_feature: Useful for making plants with modulated biomass
  misc_feature: Useful for making plants with modulated flowering time
  misc_feature: Functional homolog of the protein sequence given in SEQ ID NO 13053
  misc_feature: Functional homolog of the protein sequence given in SEQ ID NO 13054
  misc_feature: Functional homolog of the protein sequence given in SEQ ID NO 13172
  misc_feature: Useful for making plants with altered terpenoid content
  misc_feature: Functional homolog of the protein sequence given in SEQ ID NO 13054
MRTFQQNPEDRRVNTSKPWTSKKKFCELPDSVEVHIIDDDSNDSSKDYSVEDASKQLAIYNPDITHDKQTDMDHYASPHQSSKKPRRGYGTVLPSIGTYTVQCAKCYKWRIVPTKEKYQELRGSISQELFVCARAREWNRELSCVELEDISQDGSRMWAIDRPNIVQPPPGWDREVRLRGASTKFADVYYTSPSGKKLRSLVEIGRYLEQNPHYIREGVNLSQFSFATPKPLQEDYVQKHTFGDGHELLGLHEISQVDPLCWAGPPSRRELLGELGISALGRVDTDQPEMSDSVSLHQLKVSEPPAQHCKRTVKQVSSRKCRRTPPAARYPFEEQSGGHTNDIEHVQL

SEQ ID NO: 2237 - DNA, 3432 bp, Sorghum bicolor
  misc_feature: Ceres ANNOT ID no. 6020350
  misc_feature: Encodes the peptide sequence at SEQ ID NO 2238
atgccggcgagctccgccgcgccaccggcgcctgctgtcccggcggcggcaacggcgcccagcggatgcgaaggggagaagaaggcgccgccgatcaactcggagctctggcacgcctgcgcggggcctctggtgtcgctgccgccggcgggcagcctcgtcgtctacttcccccaaggccacagcgagcaggttgcagcttctatgcaaaaggatgttgatggacatgttccaagctacccaaatcttccgtcaaagctgatttgccttctgcataatgtcactttacatgcggatccagaaacagatgaagtgtatgcgcaaatgactctcctgccagttacttcatatggaaaggaggcgctgcaactatcagaactagcgctgaaacaacccaggcctcaaacagagttcttctgtaagacactaactgcaagtgacacaagcactcatggaggcttctccgttcctcgtcgagcagctgagaagatatttccaccccttgatttctccatgcaaccacccgctcaagagatccaagcaagagatttacatgataatgtatggacattccgccacatatatcgaggtcagccaaaaagacatctgcttaccactggctggagtctttttgtgagcggaaagagattatttgctggtgattctgtcatttttgttagggatgaaaggcagcaacttctacttggaatcaggcgtgctaatagacagccaactaacatatcatcatctgtcctttcaagtgacagcatgcatataggaattcttgctgctgcagctcatgccgctgctaacaatagtccattcaccatattttacaatcctagggccagtcctacagagtttgtcgtaccatttgctaagtatcagaaggcactctatggtaatcaaatatctttaggaatgcgctttcggatgatgtttgagactgaagagttaggcacaagaaggtacatgggtacaataactggcataagtgatctagatccagtaagatggaaaaactcacaatggcgcaacttacaggttggctgggatgagtctgcagcaggcgaaaggcgtaacagggtctcaatctgggaaatcgaaccagttgctgctccatttttcatatgccctccaccattttttggttcaaaacgtcccagacaattagatgacgagtcctcagaaatggagaatctcttaaagagggcaatgccatggcttggtgaggagatatgcataaaggatccacagacacagaacaccgtaatgcctggtctgagcttggttcagtggatgaacatgaatatgcagcagaactcctcgtttggaaactcggcgatgcagtccgagtacctacgatcactaagcaaccccaacatgcaaaatcttggcgcggctgatctctcaaggcagttaaacatgcagaaccagattctgcaacagaacagcattcagtttagttctcccaaacttcctcagcaaatgcagccggtcaatgagttgtcaaaggcatcacttccgctgaatcagcttggtgtgggcaccaaacagcaagaacagactcaagacccaagcagtctgcagaggcaacaacagtccatgaaccaactacttccattgagccaatctcaaaccaatcttgtccaggcgcaggtccttatccaaaatcaaatgcagcagcagcagcaaccaccatccatgactcaaaatctgcagccagctgccagccagtcgctgctcctgccccatcagcagcaacagcaacatcaacaacaaaagttggtgcatcaacagcagcaacttttacttcagcaacaacaattgcagcaacagcagcaaaatcagcaacagttaaataagatggctgcgcaagtgccaaatctggcaccacatcagctgcaactgtctgatcagcagcttcaactgcaactgctacaaaaattgcaacagcagcaccagtcgttgctatcacaaccaggtgttactcttgcacaattacctctaatccaagagcagcaaaagttgattattgatatgcagcagcagctgtcaaattctcaatcactttcccagcaacaaataatgactcaacaaagtaccaaagttccatcacaggcaacgccaccaccaccaaccgggcaacaagagtcacagcagaagcttccacagaagcatgttgggttcactgacacatcacatactgccattcctccaactacatcagtcaacgccatttcagctgtgggaagtcctttgatggcaactggtgccacacattctgtacttaccgatgaaatcccttcctgctcaacatcaccttcaacagctaatggtaatcaccttctgcaaccagtcctcgggagaaaccaacaatgcagcgtgatcaactatgagaagctgcctcagtctactgctcctatgtcaatcccaagctccctggaagctgtcacggcgacaccaagatcaatcaaagaattgccaaagttgaattctaatgtcaagcaaagtgtaatggcttcaaagctaccaaatacagggcctgtacctcaaaatttggctaacaatgcacccccgacggactatctggaaacagcttcatcagcaacttcagtgtggctttcccaagcagatggacttctacatcatggtttccccatgtctaacttcaatcagcagcagatgttcaaagatgtggctcctgagactgatattcatggtgctgatcccagtaataacacactgtttggaataaatggtgatggtcagctgggctttcccatgggagcggatggcttcttatcgaatggaattgatgcttccaagtatcagaatcacatttcagcagatattgatggtaactacaggatcccaaaggatggtcagcaggaaatatcgtcatccatggtttcacagtcatttggcgcatcagatatggcattcaattcaattgactctggtatgaatgatggcggtttcgtgaacagaacttcttggcctcctgctcctcccctaaagaggatgaggacatttaccaaggtgtataaacgcggagctgtaggtcggtccattgacattagtcagttcaatggatatgatgagttgaagcatgctctggctcgcatgtttagtatggaggggcaacttgaggaacgacagagaattggctggaaacttgtctacaaggatcacgaggatgacatcctacttcttggtgatgacccttgggaggaatttgtcaactgtgtgaagtgcattaggatcctgtcgcctcaagaagtgcagcagatgagcttggatggggatctggggaacaacatcctccccaaccaggcctgcagtagctcagacggcgggaacgcttggcgggctcgctgcgatcagaactctggtaacccttctactggttcatatgaccagtttgaatga

SEQ ID NO: 2238 - protein, 1143 aa, Sorghum bicolor
  misc_feature: Ceres ANNOT ID no. 6020350
  misc_feature (265)..(348): Pfam Id: Auxin_resp Pfam Desc: Auxin response factor
  misc_feature (138)..(243): Pfam Id: B3 Pfam Desc: B3 DNA binding domain
  misc_feature (25)..(1143): NCBI GI: 19352045 NCBI Desc: auxin response factor 7a [oryza sativa]
  misc_feature (25)..(1143): NCBI GI: 115469786 NCBI Desc: os06g0702600 [oryza sativa (japonica cultivar-group)]
  misc_feature (22)..(1128): NCBI GI: 42409173 NCBI Desc: auxin response factor 7b [oryza sativa (japonica cultivar-group)]
  misc_feature (29)..(1128): NCBI GI: 19352047 NCBI Desc: auxin response factor 7b [oryza sativa]
  misc_feature (29)..(1128): NCBI GI: 115477344 NCBI Desc: os08g0520500 [oryza sativa (japonica cultivar-group)]
  misc_feature: The sequence is a functional homolog of SEQ ID NO 1001 in the 10/666,642US patent application
  misc_feature: The sequence is a functional homolog of SEQ ID NO 1004 in the 10/666,642US patent application
  misc_feature: The sequence is a functional homolog of SEQ ID NO 16 in the 10/412,699US patent application
  misc_feature: The sequence is a functional homolog of SEQ ID NO 1621 in the 10/374,780US patent application
  misc_feature: The sequence is a functional homolog of SEQ ID NO 1624 in the 10/374,780US patent application
  misc_feature: The sequence is a functional homolog of SEQ ID NO 1654 in the 10/412,699US patent application
  misc_feature: The sequence is a functional homolog of SEQ ID NO 1657 in the 10/412,699US patent application
  misc_feature: The sequence is a functional homolog of SEQ ID NO 202 in the 10/225,066US patent application
  misc_feature: The sequence is a functional homolog of SEQ ID NO 2342 in the 10/374,780US patent application
  misc_feature: The sequence is a functional homolog of SEQ ID NO 286 in the 10/412,699US patent application
  misc_feature: Useful for making plants with modulated growth and phenotype characteristics
  misc_feature: The sequence is a functional homolog of SEQ ID NO 16 in the 20040045049 US patent application
  misc_feature: The sequence is a functional homolog of SEQ ID NO 1654 in the 20040045049 US patent application
  misc_feature: The sequence is a functional homolog of SEQ ID NO 1657 in the 20040045049 US patent application
  misc_feature: The sequence is a functional homolog of SEQ ID NO 286 in the 20040045049 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 100 in the 10/666,642 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 298 in the 10/412,699 US patent application
MPASSAAPPAPAVPAAATAPSGCEGEKKAPPINSELWHACAGPLVSLPPAGSLVVYFPQGHSEQVAASMQKDVDGHVPSYPNLPSKLICLLHNVTLHADPETDEVYAQMTLLPVTSYGKEALQLSELALKQPRPQTEFFCKTLTASDTSTHGGFSVPRRAAEKIFPPLDFSMQPPAQEIQARDLHDNVWTFRHIYRGQPKRHLLTTGWSLFVSGKRLFAGDSVIFVRDERQQLLLGIRRANRQPTNISSSVLSSDSMHIGILAAAAHAAANNSPFTIFYNPRASPTEFVVPFAKYQKALYGNQISLGMRFRMMFETEELGTRRYMGTITGISDLDPVRWKNSQWRNLQVGWDESAAGERRNRVSIWEIEPVAAPFFICPPPFFGSKRPRQLDDESSEMENLLKRAMPWLGEEICIKDPQTQNTVMPGLSLVQWMNMNMQQNSSFGNSAMQSEYLRSLSNPNMQNLGAADLSRQLNMQNQILQQNSIQFSSPKLPQQMQPVNELSKASLPLNQLGVGTKQQEQTQDPSSLQRQQQSMNQLLPLSQSQTNLVQAQVLIQNQMQQQQQPPSMTQNLQPAASQSLLLPHQQQQQHQQQKLVHQQQQLLLQQQQLQQQQQNQQQLNKMAAQVPNLAPHQLQLSDQQLQLQLLQKLQQQHQSLLSQPGVTLAQLPLIQEQQKLIIDMQQQLSNSQSLSQQQIMTQQSTKVPSQATPPPPTGQQESQQKLPQKHVGFTDTSHTAIPPTTSVNAISAVGSPLMATGATHSVLTDEIPSCSTSPSTANGNHLLQPVLGRNQQCSVINYEKLPQSTAPMSIPSSLEAVTATPRSIKELPKLNSNVKQSVMASKLPNTGPVPQNLANNAPPTDYLETASSATSVWLSQADGLLHHGFPMSNFNQQQMFKDVAPETDIHGADPSNNTLFGINGDGQLGFPMGADGFLSNGIDASKYQNHISADIDGNYRIPKDGQQEISSSMVSQSFGASDMAFNSIDSGMNDGGFVNRTSWPPAPPLKRMRTFTKVYKRGAVGRSIDISQFNGYDELKHALARMFSMEGQLEERQRIGWKLVYKDHEDDILLLGDDPWEEFVNCVKCIRILSPQEVQQMSLDGDLGNNILPNQACSSSDGGNAWRARCDQNSGNPSTGSYDQFE

SEQ ID NO: 2239 - DNA, 1452 bp, Sorghum bicolor
  misc_feature: Ceres ANNOT ID no. 6020355
  misc_feature: Encodes the peptide sequence at SEQ ID NO 2240
atggaccaggtttggaagcatgaacaggaggagggcgatgatgacaggctaagcaccctcccagacgacatcctgctcctgatcctgaataagctcgatctgatacgcgacgctgcaaggaccactgtcctttcaaagcgctggaggcatttgctagggctccattccgagatcgtcctggacgttctcaacttcgacggcgacgacgacgccgagtacactctcgacgacctggcgcggactagcgcctccgtggtcgaagccacaaagagcatcctgcggcagcaccgccgccaggacaccgccatccagctcctggtcatcacattctatctcagggacgaatccatcggcattgtccacgccgtggacagagccatggcggaccacatgatcctcgccgccgagttcaccatcataccagacacgccggacatctactgcgaagacgacgatgttctgctcgccaacgggagacgcttcatgacgttctttgatgcgtacccccgtgcatttggtggtctcacggacctcgacttacatactctaaggctcggccaatctgacatcgctaatgtgcttagcacatgcgagaagctggagtacttcagtcttgtgaactgtgacgccgggatggacgacgatcagtcgtctgtgttgcaaatagagcactcgcgacttgttgagttggtcattattttctgtgggtttgagactgttgagctcaagtggcttccaaggctcacacgcttgaaatgtgcaaattggatgccttcacatcaggatcgatatccactgtcaatgggctatgtcccacagcttcgcgtgctaactctgaggagttcttacacggctcagcacaaaactattaagctaagtgagttccttggtaatactgctgtttgtgaacttgatctgaatttcctacgcaaaaagatttcgattcaacctgaaggtccaaaacgacttgctcctctgctgcagaatttgagggttgttacactccggtttattcatgaagagtatgacctaatgtggacattgttcatcttagaagccgcacccctcttacatacacttgacatgcagatgtcacaccatatatgttacgtaaaccaagagaatcaagaggatgagaatacacgggaaaacgactttgatagggcagctgatttattgaaatgggagacacatcatgatttcaagcattataatatgaaaaagctcactatcgagggatttcaagttcaagtgaagttcacaagatacataagaagtgtcatggaagcagcgataaatctagaagttgtatcgctccgtgaaagtcgtcaatgcttgcattgcgagtttcttccttcaactgtatatccacggactcacaaggagatagatctggtaaagaagcacatttcaacatgggggtcctcatctattcaaatagagattatgtaa

SEQ ID NO: 2240 - protein, 483 aa, Sorghum bicolor
  misc_feature: Ceres ANNOT ID no. 6020355
  misc_feature (15)..(63): Pfam Id: F-box Pfam Desc: F-box domain
  misc_feature (11)..(436): NCBI GI: 21741445 NCBI Desc: oj000223_09.1 [oryza sativa (japonica cultivar-group)]
  misc_feature (11)..(349): NCBI GI: 116310475 NCBI Desc: h0805a05.8 [oryza sativa (indica cultivar-group)]
  misc_feature (17)..(443): NCBI GI: 116310473 NCBI Desc: h0805a05.6 [oryza sativa (indica cultivar-group)]
  misc_feature (17)..(443): NCBI GI: 38345336 NCBI Desc: osjnba0081l15.9 [oryza sativa (japonica cultivar-group)]
  misc_feature (15)..(471): NCBI GI: 115449901 NCBI Desc: os02g0825100 [oryza sativa (japonica cultivar-group)]
MDQVWKHEQEEGDDDRLSTLPDDILLLILNKLDLIRDAARTTVLSKRWRHLLGLHSEIVLDVLNFDGDDDAEYTLDDLARTSASVVEATKSILRQHRRQDTAIQLLVITFYLRDESIGIVHAVDRAMADHMILAAEFTIIPDTPDIYCEDDDVLLANGRRFMTFFDAYPRAFGGLTDLDLHTLRLGQSDIANVLSTCEKLEYFSLVNCDAGMDDDQSSVLQIEHSRLVELVIIFCGFETVELKWLPRLTRLKCANWMPSHQDRYPLSMGYVPQLRVLTLRSSYTAQHKTIKLSEFLGNTAVCELDLNFLRKKISIQPEGPKRLAPLLQNLRVVTLRFIHEEYDLMWTLFILEAAPLLHTLDMQMSHHICYVNQENQEDENTRENDFDRAADLLKWETHHDFKHYNMKKLTIEGFQVQVKFTRYIRSVMEAAINLEVVSLRESRQCLHCEFLPSTVYPRTHKEIDLVKKHISTWGSSSIQIEIM

SEQ ID NO: 2241 - DNA, 1467 bp, Sorghum bicolor
  misc_feature: Ceres ANNOT ID no. 6020364
  misc_feature: Encodes the peptide sequence at SEQ ID NO 2242
atgaactctcagagtcttcttgcgatggagcaaatcgctgcttccgacaaaacagcacatgtctctgcactttcagttcataagctgttcgatgctaaattggatcaccacagcttgatggatggcacctcggcatccacgagtcagtcatcaaacatcaagaccgagttgatccgatcatcaagcttgtcaaggagcctatcagttaaccttcagaaaagaagccctgaatctgatcctgaaagcccacagtctcacgtctcacatcctaaattttcagaacccatgttctcaaattcttcgacattctgcacaagcttgttttcgtcatcttcgacaaaaacagaaccatgccatcaaatgggcactttgcctttcctgcctcacccccctaagtgtgagcaacaagtttcagctgggcagtcatcaagctcctctctgctgttaagtggtgatactggcaatggtttagatgaagctgaacagtcagatgatctgaaagacttcctcgatctttctggagatgcttctgatggcagcttccaagaaaacaatgccttggcttatgatgaacagatggaatttcagttcctgtctgagcagctaggaattgccatcactgacaatgaaaagagtcctcatttagatgacatatatggcacaccaccacagctgtcatcacttccaatatcatcttgctccactcagagtatacaggatctaggatcaccagttaaagtccagcttagctcatctcagtcatcttctagctctgcaacaactaacaagtcaaggttgaggtggacacttgagcttcatgagcgttttctggaggctgtaaaaaagcttgaaggacctgaaaaagcaactcctaagggtgtgctgaaactaatgaaggtagaaggtctaaccatttatcatgtgaagagccatctgcagaagtatcggcttgcgaaatatcttcctgggcctaaagaagataagaaggcttcttcggaggataaaaaggcacaaacaggaaagagcggcagtgattcaagcaaaaacaagaatttacaagtggcagaagctctaaggatgcaaatcgaggttcagaaacagcttcatgaacaattagaggtgcaaaggcagttgcagctacggatagaggaacatgcaagatacttgcagaaaatactggaagagcagaaggccggcagtttgtcactaaaagctccaaccaaggcacaagcgacagagtcacctgaatcgacattagatgaggtaagcaccactccgcagccatccaggaacagaaatccagttgtagacacagaatgcaagtcgcctgtagacacagaatgcaagtcgccggcaaggccatccaagaacagaatcccagttgtagacacagaatgcaaatcgccggcaaggatcaagagaacaaaagttcaggttgatctcgagaacgagaccctgtgttcatag

SEQ ID NO: 2242 - protein, 488 aa, Sorghum bicolor
  misc_feature: Ceres ANNOT ID no. 6020364
  misc_feature (265)..(316): Pfam Id: Myb_DNA-binding Pfam Desc: Myb-like DNA-binding domain
  misc_feature (32)..(485): NCBI GI: 15795136 NCBI Desc: transfactor-like protein [arabidopsis thaliana]
  misc_feature (34)..(471): NCBI GI: 21536970 NCBI Desc: transfactor-like protein [arabidopsis thaliana]
  misc_feature (266)..(474): NCBI GI: 119655909 NCBI Desc: mybogu [brassica rapa subsp. chinensis]
  misc_feature (190)..(436): NCBI GI: 4519671 NCBI Desc: transfactor [nicotiana tabacum]
  misc_feature (255)..(476): NCBI GI: 77403669 NCBI Desc: myb-cc type transfactor [solanum tuberosum]
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1857 in the 10/374,780US patent application
  misc_feature: The sequence is a functional homolog of SEQ ID NO 1990 in the 11/479,226US patent application
  misc_feature: The sequence is a functional homolog of SEQ ID NO 1992 in the 11/479,226US patent application
  misc_feature: The sequence is a functional homolog of SEQ ID NO 1999 in the 11/479,226US patent application
  misc_feature: The sequence is a functional homolog of SEQ ID NO 2000 in the 11/479,226US patent application
  misc_feature: The sequence is a functional homolog of SEQ ID NO 933 in the 10/666,642US patent application
  misc_feature: Useful for making plants with modulated growth and phenotype characteristics
  misc_feature: Useful for making plants with modulated oxidative stress sensitivity
  misc_feature: GREAT-hit functional homolog of the protein sequence given in SEQ ID NO 12904
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 1990 in the 20070022495 US patent application
  misc_feature: The sequence is a functional homolog of SEQ ID NO 1992 in the 20070022495 US patent application
  misc_feature: The sequence is a functional homolog of SEQ ID NO 1999 in the 20070022495 US patent application
  misc_feature: The sequence is a functional homolog of SEQ ID NO 2000 in the 20070022495 US patent application
  misc_feature: The sequence is a functional homolog of SEQ ID NO 933 in the 20070033671 US patent application
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
MNSQSLLAMEQIAASDKTAHVSALSVHKLFDAKLDHHSLMDGTSASTSQSSNIKTELIRSSSLSRSLSVNLQKRSPESDPESPQSHVSHPKFSEPMFSNSSTFCTSLFSSSSTKTEPCHQMGTLPFLPHPPKCEQQVSAGQSSSSSLLLSGDTGNGLDEAEQSDDLKDFLDLSGDASDGSFQENNALAYDEQMEFQFLSEQLGIAITDNEKSPHLDDIYGTPPQLSSLPISSCSTQSIQDLGSPVKVQLSSSQSSSSSATTNKSRLRWTLELHERFLEAVKKLEGPEKATPKGVLKLMKVEGLTIYHVKSHLQKYRLAKYLPGPKEDKKASSEDKKAQTGKSGSDSSKNKNLQVAEALRMQIEVQKQLHEQLEVQRQLQLRIEEHARYLQKILEEQKAGSLSLKAPTKAQATESPESTLDEVSTTPQPSRNRNPVVDTECKSPVDTECKSPARPSKNRIPVVDTECKSPARIKRTKVQVDLENETLCS

SEQ ID NO: 2243 - DNA, 1191 bp, Sorghum bicolor
  misc_feature: Ceres ANNOT ID no. 6020373
  misc_feature: Encodes the peptide sequence at SEQ ID NO 2244
atgagccggcggcaggagctctgcaggaacttccagcgcggcagctgcaagtacggagcgcagtgtaggttcgtgcacgcgtcctctcagcagcagcagcagtcgaagcccaacccgtttgggttcggctctcagcagcagcagcagtcttcgttcggtgcgcagttccagcagcagcagcagaagcccaatccgtttggatttggagtgcaagggggtgcggccgcgcagtccagaaacgcctctggcacggcaaagccatttcaaaataagtgggtaagggacccctcagccccgacgaagcaacaggaagcggcacagcctgcaccagcagcccacacctcctgtacagatcctgagtcctgcaggcaccagattgctgaggattttaagaatgaaactccactctggaagcttacatgttatgctcacctcaggagtggtccttgtgacatcactggggatattagctttgaagagctgagagctaaagcgtatgaggaaggcaggcaggggcatcctctgccgtcaatagtcgagggtgaaagaaatttgcaaaatgcaaagctgacagagtttaataattttctgaacaatccacatctatcggtatcacaaactccaagctttccaactgtggcttccttccctgaagtgaaaaataactcgccatttggggtttctcaaaataacggaccaccagtgtttagtagtttcagtcaaattggagcagccaataatattggacctgggtccagaactacaccaggattcccaaccaatagtatttttggtcagtctaaccagccgagccatccaggatttcctacacctacttttggccgttctgatatgaaatttggagtttcaggttcatttggaagccagatatcacaacaatcatctgggagtttgcaaggctcaaacatgtccagtgttggcaatttcccaaagcctcatgctagctaccagcagtctccttcctcctctagccatcatagagacattgataggcagtcacaagatttacttagtggaatcgtggctcctacaagtgccacaaaccaagctcctgttgaggacaataaaaatgaaaatcaggatgatagtatctggttgaaggaaaaatggtcaattggagagattccgctaggtgaaccgccacagaggcacatcagtcacgtgttttag

SEQ ID NO: 2244 - protein, 396 aa, Sorghum bicolor
  misc_feature: Ceres ANNOT ID no. 6020373
  misc_feature (3)..(28): Pfam Id: zf-CCCH Pfam Desc: Zinc finger C-x8-C-x5-C-x3-H type (and similar)
  misc_feature (1)..(396): NCBI GI: 53791927 NCBI Desc: zinc finger protein-like [oryza sativa (japonica cultivar-group)]
  misc_feature (4)..(331): NCBI GI: 42563228 NCBI Desc: zinc finger (ccch-type) family protein [arabidopsis thaliana]
  misc_feature (128)..(331): NCBI GI: 28416541 NCBI Desc: at1g75340/f1b16_18 [arabidopsis thaliana]
  misc_feature (136)..(355): NCBI GI: 25012711 NCBI Desc: re59174p [drosophila melanogaster]
  misc_feature (136)..(355): NCBI GI: 21357281 NCBI Desc: cg18787-pa [drosophila melanogaster]
MSRRQELCRNFQRGSCKYGAQCRFVHASSQQQQQSKPNPFGFGSQQQQQSSFGAQFQQQQQKPNPFGFGVQGGAAAQSRNASGTAKPFQNKWVRDPSAPTKQQEAAQPAPAAHTSCTDPESCRHQIAEDFKNETPLWKLTCYAHLRSGPCDITGDISFEELRAKAYEEGRQGHPLPSIVEGERNLQNAKLTEFNNFLNNPHLSVSQTPSFPTVASFPEVKNNSPFGVSQNNGPPVFSSFSQIGAANNIGPGSRTTPGFPTNSIFGQSNQPSHPGFPTPTFGRSDMKFGVSGSFGSQISQQSSGSLQGSNMSSVGNFPKPHASYQQSPSSSSHHRDIDRQSQDLLSGIVAPTSATNQAPVEDNKNENQDDSIWLKEKWSIGEIPLGEPPQRHISHVF

SEQ ID NO: 2245 - DNA, 1281 bp, Sorghum bicolor
  misc_feature: Ceres ANNOT ID no. 6020375
  misc_feature: Encodes the peptide sequence at SEQ ID NO 2246
atggcgtccaccgtttccttctcccccgccaacgttcagatgctcccggctaggagtggccgaggccatgctgcctttgggagctgctctgccgtaccaagagctgggccaaggctgcgctccacggccgtcagggtcagcagcgagcaggaggcggcggcggccgtcagggcgccgtccgggaggaccatcgaggagtgcgaggccgacgccgtcgctgggaaattccctgcccccccgccgttggttaggccaaaggcccctgaaggaacaccggagatcaggccccttgacatggcaaagcgcccccgtcgcaacaggaaatcaccagctcttagggctgcattccaggagacgagcatctcgcctgccaatttcgtgctcccattgtttatccatgaaggagaagaagatgctcctattggagctatgccagggtgctataggcttgggtggaggcatgggctgcttgacgaggtttacaaggcccgtgatgttggtgttaacagttttgtgctctttcctaaagttcctgatgcattgaagtctccaacaggagatgaagcttacaacgacaatggtctggttccacgtacaatccgcttgctcaaagacaagttccctgatattgttatctacacggatgttgcgttagacccttattcatctgatggtcatgatggtattgtgagggaagatggagtaattatgaatgatgaaacagtttatcagttgtgcaagcaggctgtttcacaggctcgtgctggtgctgatgttgtcagccctagtgacatgatggatggccgtattggagcacttcgctctgctctggatgctgagggtttccatgatgtctccattatgtcctacactgcaaagtatgccagttccttttatggcccattccgagaagctttagattcaaatccaagatttggagataaaaagacctatcagatgaacccagccaactacagagaagccctcatagaaaccgcagcggatgaggcagaaggagctgacattctgcttgtgaaaccaggattaccttacttggatatcatccgacttcttcgggataattcagccctaccgattgctgcttaccaggtctccggcgagtactcgatgatcaaagctgccggtgcgctgggcatggtcgacgagcagaaggtgatgatggagtcgctcatgtgcctccggcgagccggcgccgacgtcatcctgacctacttcgcgcgtcacgccgccgcggtgctgtgcggcatagggcccaagtag

SEQ ID NO: 2246 - protein, 426 aa, Sorghum bicolor
  misc_feature: Ceres ANNOT ID no. 6020375
  misc_feature (98)..(420): Pfam Id: ALAD Pfam Desc: Delta-aminolevulinic acid dehydratase
  misc_feature (1)..(424): NCBI GI: 2495171 NCBI Desc: delta-aminolevulinic acid dehydratase, chloroplast precursor (porphobilinogen synthase) (aladh)
  misc_feature (1)..(424): NCBI GI: 1041423 NCBI Desc: aminolevulinate dehydratase [hordeum vulgare subsp. vulgare]
  misc_feature (1)..(421): NCBI GI: 13183730 NCBI Desc: aminolevulinate dehydratase [raphanus sativus]
  misc_feature (66)..(422): NCBI GI: 1170214 NCBI Desc: delta-aminolevulinic acid dehydratase, chloroplast precursor (porphobilinogen synthase) (aladh)
  misc_feature (40)..(422): NCBI GI: 1097877 NCBI Desc: aminolevulinate dehydratase
  misc_feature (1)..(424): SWISSPROT Homolog: EC 4.2.1.24 Delta-aminolevulinic acid dehydratase, chloroplast precursor
MASTVSFSPANVQMLPARSGRGHAAFGSCSAVPRAGPRLRSTAVRVSSEQEAAAAVRAPSGRTIEECEADAVAGKFPAPPPLVRPKAPEGTPEIRPLDMAKRPRRNRKSPALRAAFQETSISPANFVLPLFIHEGEEDAPIGAMPGCYRLGWRHGLLDEVYKARDVGVNSFVLFPKVPDALKSPTGDEAYNDNGLVPRTIRLLKDKFPDIVIYTDVALDPYSSDGHDGIVREDGVIMNDETVYQLCKQAVSQARAGADVVSPSDMMDGRIGALRSALDAEGFHDVSIMSYTAKYASSFYGPFREALDSNPRFGDKKTYQMNPANYREALIETAADEAEGADILLVKPGLPYLDIIRLLRDNSALPIAAYQVSGEYSMIKAAGALGMVDEQKVMMESLMCLRRAGADVILTYFARHAAAVLCGIGPK

SEQ ID NO: 2247 - DNA, 1914 bp, Sorghum bicolor
  misc_feature: Ceres ANNOT ID no. 6020379
  misc_feature: Encodes the peptide sequence at SEQ ID NO 2248
atggcggccatcgtggcggcgcgggcgtccgcccccggcggcgctgccgtgagcactatcgccgcgttccacagccacgcgtccccttcccgcgcgctcacgctcgcttcctcctccatcggcggcgccaggcggtaccaccacgcctccgcgtgctgcttcgccaccaagcccaccgcgccgaccgccgccgagctcgtcgaccaggaccccgccacggccacgcaggaggccgccaagccgcgccggaaacgccggtctcggaaggcgaagaagtctgccaccgccgccaaggaggaggacggcacggacgacgagccggtggcggcggcggcggcggcggaggacgaggcgaaaaggaagaagaaggacgcgcccagcgccgaggagagcgcccgggcattggtggccggcctcgacgacgtgatcgtcaaccccgtcggcctgggccggcggtcgcggcaggtgttcgacgaggtgtggcgcaagttctcgcggctgggccagatttcgagcgcctcctccaccgcgctggcggaggaggagcaggctgtgcttatccgcggagggcccatgtgtgagttcaccgtgccgggggcgcaggacaccaccgtcctcgtcatcggtgccaccagccgcatcggccgcatcgttgtgcgcaaactcatgctccgcggatacaatgtcaaggctttagtaagaagaaacgaccctgaagtgatagatatgctcccaaggtccgtggatattgttgttggtgatgttggtgatcctgcaactgtcaaagcagcagtatcaggctgcagcaagataatctattgtgcaactgcacgctcaactattacaggagacctaaatagggttgataaccaaggagtaaggaatgctagcaaggctttccaggattactacaacgaattggcccagctcagggctggtaaaagcagcaagagcaaactcctgatagcaaaattcaagtctgcaaagtccttgaagagttgggaggtgcggcagggatcttacttcccaaatacttttgtttctagatttgatgaaggtatcgatgcatcactggaattttcagaagatcagcaggctgttttctcaggatttgtatttacaagaggtggatatgttgagatatcaaaaaggctttctcttcctctaggttccaccctagacaggtatgatggtttacttttttcagtgggaggaaatggaagatcatatgttgttattcttgaaactggtccattagcagacacgacccagagcaagaagtattttgctcggatgactacaaaagtaggcttttgtagggtaagagtgccattttcatcttttcggccagtaaacccacaagatcctcccctcgacccttttcttgtgcatacactaaccattaggtttgaaccaaaaaggcagagacctggtgatggatctcaaaatgctagcgatcctcgaaactttgagctaaaattggaatacatcaaagctttacctactggtcaagaaacagacttcatattggtgtcatgttcaggttctggaattgaatctaacagaagagaacaagttctcaaagccaagaaggctggagaagatgcactgcggaggtcaggccttggatatacaatcgtgcgcccgggtcctttgcaggaagaacctggtggccagcgtgcattgatctttgatcaagggaacagaatctctcagggtatcagctgtgctgatgtggcagatatttgtgtcaaagcattgcatgattccactgcaagaaacaaaagttttgatgtatgctacgagtacgtcgctgaccaagggaacgagctgtatgagcttgtggctcatctcccagacaaggctaacaactaccttacaccagcactctctgttttagagaagaatacctga

SEQ ID NO: 2248 - protein, 637 aa, Sorghum bicolor
  misc_feature: Ceres ANNOT ID no. 6020379
  misc_feature (340)..(499): Pfam Id: CIA30 Pfam Desc: Complex I intermediate-associated protein 30 (CIA30)
  misc_feature (199)..(515): NCBI GI: 20339364 NCBI Desc: uos1 [pisum sativum]
  misc_feature (205)..(515): NCBI GI: 67922003 NCBI Desc: similar to nucleoside-diphosphate-sugar epimerases [crocosphaera watsonii wh 8501]
  misc_feature (207)..(295): NCBI GI: 86605827 NCBI Desc: 3-beta hydroxysteroid dehydrogenase/isomerase family protein [cyanobacteria bacterium yellowstone a-prime]
  misc_feature (207)..(295): NCBI GI: 86608008 NCBI Desc: 3-beta hydroxysteroid dehydrogenase/isomerase family protein [cyanobacteria bacterium yellowstone b-prime]
  misc_feature (207)..(295): NCBI GI: 75910514 NCBI Desc: 3-beta hydroxysteroid dehydrogenase/isomerase [anabaena variabilis atcc 29413]
MAAIVAARASAPGGAAVSTIAAFHSHASPSRALTLASSSIGGARRYHHASACCFATKPTAPTAAELVDQDPATATQEAAKPRRKRRSRKAKKSATAAKEEDGTDDEPVAAAAAAEDEAKRKKKDAPSAEESARALVAGLDDVIVNPVGLGRRSRQVFDEVWRKFSRLGQISSASSTALAEEEQAVLIRGGPMCEFTVPGAQDTTVLVIGATSRIGRIVVRKLMLRGYNVKALVRRNDPEVIDMLPRSVDIVVGDVGDPATVKAAVSGCSKIIYCATARSTITGDLNRVDNQGVRNASKAFQDYYNELAQLRAGKSSKSKLLIAKFKSAKSLKSWEVRQGSYFPNTFVSRFDEGIDASLEFSEDQQAVFSGFVFTRGGYVEISKRLSLPLGSTLDRYDGLLFSVGGNGRSYVVILETGPLADTTQSKKYFARMTTKVGFCRVRVPFSSFRPVNPQDPPLDPFLVHTLTIRFEPKRQRPGDGSQNASDPRNFELKLEYIKALPTGQETDFILVSCSGSGIESNRREQVLKAKKAGEDALRRSGLGYTIVRPGPLQEEPGGQRALIFDQGNRISQGISCADVADICVKALHDSTARNKSFDVCYEYVADQGNELYELVAHLPDKANNYLTPALSVLEKNT

SEQ ID NO: 2249 - DNA, 1068 bp, Sorghum bicolor
  misc_feature: Ceres ANNOT ID no. 6020384
  misc_feature: Encodes the peptide sequence at SEQ ID NO 2250
atgccgcggatggccaagctactgctcaagctgcaggcagtggcggcggcggacaggaggcacggccccggccccggccccggctccggctccagctccaaccgccgccacccgctcctgccccgccacgcgcccgccgccgccaccagattcgtgcccgcctgccttgccctctgcctcctcgccctcgccgccgccgccaccacgctggcgctggcgctcacgctccagaatcaccggctcggccccaccgacccttcctcctccgccgccatctcgccacgcggcggcttcgcggtggtgatcaacacgtggaggcgcccggcactgctgcggaggtcggtggcgcactacgccgcctgcgggggcgtcgacaccgtccacgtggtgtggagcgagccgcggccgccgccggagaccatgcgcgggggcgtcctcggcctcaacggcacccggcgcggcggcgcggccgtgcggttcgagatcaacgacgccgacagcctcaacaacaggttcaggcccatccgggggctcgcggcggacgccgtcttctccgtcgacgacgacctcatcgtcccttgctccacgctgcgcttcgccttctccgtgtggcagagcgcgccatccgccatggtcggcttcgtgccgcggatgcactggcttaccaacccgagaggtagtgaagaggaataccgatatggaagctggcggtcagtttggtggactgggacatacagcatggttctttccaaagcaagcttcttccacaagaagtacttggatatgtataccaaccaaatgctaccgtccattcgcaaatatgtgaatgagaacaggaactgtgaggatattgcgatggcttttcttgttgcaaatgctactggagctccaccggtatgggtgcaaggaaggatatttgagattggatcaagcggcatcagcagtttgaaaggccatggtttgcagagatcaagatgtctcaacgcgttcactgccatgtacggccatatgcctctcgtagccaccacagtcaaggctgtggacagccgccggagctggttctggtga

SEQ ID NO: 2250 - protein, 355 aa, Sorghum bicolor
  misc_feature: Ceres ANNOT ID no. 6020384
  misc_feature (98)..(353): Pfam Id: EXTL2 Pfam Desc: EXTL2, alpha-1,4-N-acetylhexosaminyltransferase
  misc_feature (55)..(344): NCBI GI: 49117931 NCBI Desc: mgc80258 protein [xenopus laevis]
  misc_feature (54)..(344): NCBI GI: 51513240 NCBI Desc: mgc89702 protein [xenopus tropicalis]
  misc_feature (54)..(344): NCBI GI: 89269068 NCBI Desc: exostoses (multiple)-like 2 [xenopus tropicalis]
  misc_feature (94)..(349): NCBI GI: 116116221 NCBI Desc: ensangp00000008532 [anopheles gambiae str. pest]
  misc_feature (94)..(349): NCBI GI: 108884234 NCBI Desc: exostosin-2 [aedes aegypti]
MPRMAKLLLKLQAVAAADRRHGPGPGPGSGSSSNRRHPLLPRHAPAAATRFVPACLALCLLALAAAATTLALALTLQNHRLGPTDPSSSAAISPRGGFAVVINTWRRPALLRRSVAHYAACGGVDTVHVVWSEPRPPPETMRGGVLGLNGTRRGGAAVRFEINDADSLNNRFRPIRGLAADAVFSVDDDLIVPCSTLRFAFSVWQSAPSAMVGFVPRMHWLTNPRGSEEEYRYGSWRSVWWTGTYSMVLSKASFFHKKYLDMYTNQMLPSIRKYVNENRNCEDIAMAFLVANATGAPPVWVQGRIFEIGSSGISSLKGHGLQRSRCLNAFTAMYGHMPLVATTVKAVDSRRSWFW

SEQ ID NO: 2251 - DNA, 1266 bp, Sorghum bicolor
  misc_feature: Ceres ANNOT ID no. 6020413
  misc_feature: Encodes the peptide sequence at SEQ ID NO 2252
atgaaggtggagctcaccgcgcggacctcccagacgagcaaggcgggggaggagaccccgccgccgtccccatcagcctctgctgcgtcgcccccggcggaggatgcgccgctcctccccgatgcgggcgtgcggcgccggccagcgtgcgggcggttctcgcagcgcagcggctccttccgccgcgaagtcagccgggccgccgccgagaccttcctcctcacaaggctcactttgatcctcctccgctacctcgggataggctacagatggatccggcagttcctagccctctgctgttataccctcttgctgatgccaggttttattcaagttgtatattattatttcttctctagccaagttcatagaagtgttgtatatggagatcagccaagaaacagactggacctgtatattcccactagtacgacagggttaaagccagttgtggcatttgtgactggtggagcgtggatcatagggtacaaagggtggggagcccttttaggcagacgcttagcagaaagaggcatcatagttgcatgcattgattacagaaactttcctcaggggactattggtgacatggtagaagatgcttctcaaggaatagcttttgtctgcaagaatatagcaagttatggaggtgatcctagcaggatatatcttgttggccaatcagctggtgcacatattgctgcttgtgctctcttaaatcaggccattagagaatgtggtgaagaagatacttcctcttggagtgtatcacagctaaaagcttattttggtatttctggcgggtacaacctccttaacttggttgatcatttccatagacgtggcctttaccggtccatctttctcagtattatggaaggtgaagaatcactccagaaattctctccacaagttatgattatgcaatcatctgctaggtctgcagttcctttattgcctcgtatcatccttttccatgggacaagtgattattcaataccttcagttgaaagccaagcgttcattgacgctttacaacagcaaggtgcaaaagcagatttatttctgtatgaagggaagacgcatactgatttgttccttcaggatcctcttcggggtggcagagataaaatgctcgaagagatcgccagtgtgatacacagtgaagatccagacaattctgctcagcaccttgtcgtgcctgttgcaaggcgtcttgttcctgagtttatgctgaagcttgctggaaaagtaagccctttctga

SEQ ID NO: 2252 - protein, 421 aa, Sorghum bicolor
  misc_feature: Ceres ANNOT ID no. 6020413
  misc_feature (151)..(366): Pfam Id: Abhydrolase_3 Pfam Desc: alpha/beta hydrolase fold
  misc_feature (47)..(335): NCBI GI: 55297181 NCBI Desc: carboxylesterase-like [oryza sativa (japonica cultivar-group)]
  misc_feature (56)..(421): NCBI GI: 9755631 NCBI Desc: carboxylesterase-like protein [arabidopsis thaliana]
  misc_feature (118)..(281): NCBI GI: 146401506 NCBI Desc: alpha/beta hydrolase fold-3 domain protein [acidiphilium cryptum jf-5]
  misc_feature (126)..(272): NCBI GI: 28855211 NCBI Desc: esterase/lipase/thioesterase family protein [pseudomonas syringae pv. tomato str. dc3000]
  misc_feature (118)..(281): NCBI GI: 88941897 NCBI Desc: esterase/lipase-like [acidiphilium cryptum jf-5]
MKVELTARTSQTSKAGEETPPPSPSASAASPPAEDAPLLPDAGVRRRPACGRFSQRSGSFRREVSRAAAETFLLTRLTLILLRYLGIGYRWIRQFLALCCYTLLLMPGFIQVVYYYFFSSQVHRSVVYGDQPRNRLDLYIPTSTTGLKPVVAFVTGGAWIIGYKGWGALLGRRLAERGIIVACIDYRNFPQGTIGDMVEDASQGIAFVCKNIASYGGDPSRIYLVGQSAGAHIAACALLNQAIRECGEEDTSSWSVSQLKAYFGISGGYNLLNLVDHFHRRGLYRSIFLSIMEGEESLQKFSPQVMIMQSSARSAVPLLPRIILFHGTSDYSIPSVESQAFIDALQQQGAKADLFLYEGKTHTDLFLQDPLRGGRDKMLEEIASVIHSEDPDNSAQHLVVPVARRLVPEFMLKLAGKVSPF

SEQ ID NO: 2253 - DNA, 573 bp, Sorghum bicolor
  misc_feature: Ceres ANNOT ID no. 6020416
  misc_feature: Encodes the peptide sequence at SEQ ID NO 2254
atggagccctccaccgtcggcgacggcggctcggcggagcggtggcgcgcggaggcggcgcgggcgttccagcactacctggaccgcgcggctccgcacacggcggggcggtgggcgggcacgctcgtggccgcggcggtgtacgcgctgcgggtctactacgtgcggggcttctacatcgtcacctacgggctgggcatctacctgctcaacctcctcatcggcttcctctcccccatggtcgacccggagctcgaggcgctcgaggccgggcccgggctccccacccgcggctccgacgagttcaagcccttcatccgccgcctccccgagttcaagttctggtatgccatcacaaaagccttttgcattgcttttgtcatgaccttcttctctgtattcgatgttcctgtcttctggccaatacttctttgctattggattgtgctctttgtcctgacaatgaagcgacagattgtacatatgatcaagtacaagtatgtcccgttcagcattggaaagcagaggtatggtggaaagaagggccctggagccagtgcatcaaaagagtaa

SEQ ID NO: 2254 - protein, 190 aa, Sorghum bicolor
  misc_feature: Ceres ANNOT ID no. 6020416
  misc_feature (2)..(180): Pfam Id: Rer1 Pfam Desc: Rer1 family
  misc_feature (1)..(185): NCBI GI: 115469868 NCBI Desc: os06g0708300 [oryza sativa (japonica cultivar-group)]
  misc_feature (14)..(188): NCBI GI: 92880921 NCBI Desc: retrieval of early er protein rer1 [medicago truncatula]
  misc_feature (1)..(186): NCBI GI: 21617987 NCBI Desc: atrer1b [arabidopsis thaliana]
  misc_feature (1)..(186): NCBI GI: 21360413 NCBI Desc: at2g21600/f2g1.13 [arabidopsis thaliana]
  misc_feature (24)..(187): NCBI GI: 30682033 NCBI Desc: rer1c protein [arabidopsis thaliana]
MEPSTVGDGGSAERWRAEAARAFQHYLDRAAPHTAGRWAGTLVAAAVYALRVYYVRGFYIVTYGLGIYLLNLLIGFLSPMVDPELEALEAGPGLPTRGSDEFKPFIRRLPEFKFWYAITKAFCIAFVMTFFSVFDVPVFWPILLCYWIVLFVLTMKRQIVHMIKYKYVPFSIGKQRYGGKKGPGASASKE

SEQ ID NO: 2255 - DNA, 666 bp, Sorghum bicolor
  misc_feature: Ceres ANNOT ID no. 6020417
  misc_feature: Encodes the peptide sequence at SEQ ID NO 2256
atggcgacgaggagcacggtggcaagggctgtcccgctgtgcctgtggctcgcgctcggcgtggccaccctgacgctgccccaggcacatgcagcagaggcagacgcggacctcaccaagatcacgagcaaggtcttcttcgacatccagatcgacggcaagcctgaaggccggattgtcattggactttttgggaagactgttcccaagacagcagagaacttcagagcacttagcacaggggagaaaggaatgggtgcgtatggcgaacctctgtggtacaagggatccacattccacaggatcatcccaggcttcatgattcaaggaggtgatttcgtaaaccacaacggaacaggctgcgataccatttatggcaaagacgtcttccctgacgagaacttcaagctcaaccacgccgaacctggtaccatatccatggccaattatgggaaagacacaaacggatgccagtttgccatcaccaccgtagaaggaagcaaattaccgaagaaattggatggggtacatgttgtgttcggcaaggtggtgagtggaatggacgtggtccacaagattgaagctcaaggccagccgagtggtgttcccaaggccaaagtcctcatagctgacagcggagagctgcccggatctgatgagctgtga

SEQ ID NO: 2256 - protein, 221 aa, Sorghum bicolor
  misc_feature: Ceres ANNOT ID no. 6020417
  misc_feature (44)..(215): Pfam Id: Pro_isomerase Pfam Desc: Cyclophilin type peptidyl-prolyl cis-trans isomerase/CLD
  misc_feature (4)..(216): NCBI GI: 32401384 NCBI Desc: cyclophilin [triticum aestivum]
  misc_feature (21)..(216): NCBI GI: 2443755 NCBI Desc: cyclophilin [arabidopsis thaliana]
  misc_feature (21)..(216): NCBI GI: 23197720 NCBI Desc: cyclophilin [arabidopsis thaliana]
  misc_feature (21)..(216): NCBI GI: 21554007 NCBI Desc: cyclophilin [arabidopsis thaliana]
  misc_feature (38)..(221): NCBI GI: 47028327 NCBI Desc: cyclophilin [bigelowiella natans]
  misc_feature (21)..(216): SWISSPROT Homolog: EC 5.2.1.8 Peptidyl-prolyl cis-trans isomerase CYP19-4 precursor
MATRSTVARAVPLCLWLALGVATLTLPQAHAAEADADLTKITSKVFFDIQIDGKPEGRIVIGLFGKTVPKTAENFRALSTGEKGMGAYGEPLWYKGSTFHRIIPGFMIQGGDFVNHNGTGCDTIYGKDVFPDENFKLNHAEPGTISMANYGKDTNGCQFAITTVEGSKLPKKLDGVHVVFGKVVSGMDVVHKIEAQGQPSGVPKAKVLIADSGELPGSDEL

SEQ ID NO: 2257 - DNA, 1140 bp, Sorghum bicolor
  misc_feature: Ceres ANNOT ID no. 6020427
  misc_feature: Encodes the peptide sequence at SEQ ID NO 2258
  misc_feature: Up-regulated in shoot tissues in response to salicylic acid treatment
atggccgacgtgcagggagacaaggaggcaggcctggaggacgacgattttcccgacgacgggcctttggtgccggaggatccaggtgaaggaggagaaccccgcagcggaggcgacgaggaagaggaggacgacgtcgacggcctcgccagcttcctcgagtcggagatcctctccggatccaacgacgaggatcctattgatcaggagcagcggaagcaggaggaggacggtggtgccgcgaagaataagcggaagcagggctcgggatcggacgggcatggctgcagcggcagcggcagtgagggggagcagaccaagagggcgaggagggaggagatgaggaggcaggcgaaagggaaggccgtggcgcctcagatcgacacgggcatgttcagcaacatcccccctgagctgttcctgcagatcttcaagttcctctcctccgaggacctcatctcctgcgctctggtctgccgcttcatgaacgctgctgcgtccgatgagaccctctggcgccgcttgtactgcatgaggtggggactggcatccaatgccaaattcagggagtgcgcttggaagaacctctacatacagagagatagagaggatatggttgaatttgtgaggaatacccctacagagttcaaggagtactatattcagatgcaggctgcaaaaaggagtcaaactccccatccgtcagaagtcaacgacgacaaggttatgcttgataagacagtagctgatcaagtatctagttggaaaaacagccgggggcttactgatgaagctgtcaaggggcactcttgttctggaaatacatgctcgtacacccagattggcgatgcttacatttgtgagaagactggtcgtgtccatgtttgtgatgacgcttgtcgtgaatttgtcttggaccaatctagtgggctgcttctttgtacaatatctggccactgctttgagaggtggctgtgtcctgatgatgaatgggaagctgatgataatgatctgcaacaagctggtgtagtggatgaagcagagccattcatgggatctggacgctacgcgcgagcaattatgttgggttacaactgcaccgatgagaaggaacttgaggatgccttgggtctctgttga

SEQ ID NO: 2258 - protein, 379 aa, Sorghum bicolor
  misc_feature: Ceres ANNOT ID no. 6020427
  misc_feature (130)..(177): Pfam Id: F-box Pfam Desc: F-box domain
  misc_feature (131)..(379): NCBI GI: 115469882 NCBI Desc: os06g0709100 [oryza sativa (japonica cultivar-group)]
  misc_feature (7)..(93): NCBI GI: 56204867 NCBI Desc: acidic (leucine-rich) nuclear phosphoprotein 32 family, member e [homo sapiens]
  misc_feature (60)..(176): NCBI GI: 6164741 NCBI Desc: f-box protein fbx11 [homo sapiens]
  misc_feature: Up-regulated in shoot tissues in response to salicylic acid treatment
MADVQGDKEAGLEDDDFPDDGPLVPEDPGEGGEPRSGGDEEEEDDVDGLASFLESEILSGSNDEDPIDQEQRKQEEDGGAAKNKRKQGSGSDGHGCSGSGSEGEQTKRARREEMRRQAKGKAVAPQIDTGMFSNIPPELFLQIFKFLSSEDLISCALVCRFMNAAASDETLWRRLYCMRWGLASNAKFRECAWKNLYIQRDREDMVEFVRNTPTEFKEYYIQMQAAKRSQTPHPSEVNDDKVMLDKTVADQVSSWKNSRGLTDEAVKGHSCSGNTCSYTQIGDAYICEKTGRVHVCDDACREFVLDQSSGLLLCTISGHCFERWLCPDDEWEADDNDLQQAGVVDEAEPFMGSGRYARAIMLGYNCTDEKELEDALGLC

SEQ ID NO: 2259 - DNA, 1062 bp, Sorghum bicolor
  misc_feature: Ceres ANNOT ID no. 6020451
  misc_feature: Encodes the peptide sequence at SEQ ID NO 2260
atggggagggagggcgtggtggcggggccggcggcggagggtagcaaatcgcggccggagtgcatcaactcgtccaacccgtaccacgagtgctccgactactgcctccgcaaaatcgccgaggccaggcagcgcctcgacgacgagctccccgactcgtggaagcgcccgccagagcaacgcaccgtccacccggactgcatcaacgcctccaacccctaccacgagtgctccgactactgcttcaggcgcatcgccgacgccaaatccgggctcgagcgtggggagggacagccaccagctgatgtggccaccgctgctggcacgtccgatgctgcggagcagcagcgacctgaagataatgacgccgacaaacaggagggcgcaggcgcggatgatggttatctgcagatgaccgaaaagcagaagaagctgttcgagctgcggcttaagatgaacgaagcgcggaaagcgaatcagcaggcaatggttgccgagaagaaaaggatggagcctcgcggtgagagccgaggtgtttctaagcagaagtggctagacgacaggaagaagaagatcgggaagctgctggactccaatgggcttgatatgtcgaaggcatacatgctcgatacgcaggagacggcagaaaccaagtacaagaaatgggagaaggaacctgctccatatgggtgggatgttttcaatcaaaagaccttgtatgatgcatacaaaaagaggaccaagaatatagaagtcgacatggaggcttacaataaagccaaggaagctgaccctgaattctaccgtgacgcctcaagtctccagtatgggaaggtatccaatgtcccagaagaaaacattgacaaaatggtcaaggaactcaaggagagggaagagaagcggaaatcgttcagcaggaggcgcaagttcaatgaagacaaggatattgactcgatcaacgaccggaatgagcacttcaacaagaagattgagcgtgcctttggcaagtacacgctcgagatcaagaacaacctggaaagaggtactgccttgccagactaa

SEQ ID NO: 2260 - protein, 353 aa, Sorghum bicolor
  misc_feature: Ceres ANNOT ID no. 6020451
  misc_feature (180)..(346): Pfam Id: SYF2 Pfam Desc: SYF2 splicing factor
  misc_feature (11)..(353): NCBI GI: 53792876 NCBI Desc: gcip-interacting family protein-like [oryza sativa (japonica cultivar-group)]
  misc_feature (114)..(351): NCBI GI: 27371122 NCBI Desc: mgc53740 protein [xenopus laevis]
  misc_feature (119)..(351): NCBI GI: 51889790 NCBI Desc: gcip-interacting protein [xenopus tropicalis]
  misc_feature (119)..(351): NCBI GI: 82524827 NCBI Desc: loc496706 [xenopus tropicalis]
  misc_feature (96)..(351): NCBI GI: 49659862 NCBI Desc: gekbs028p [gekko japonicus]
MGREGVVAGPAAEGSKSRPECINSSNPYHECSDYCLRKIAEARQRLDDELPDSWKRPPEQRTVHPDCINASNPYHECSDYCFRRIADAKSGLERGEGQPPADVATAAGTSDAAEQQRPEDNDADKQEGAGADDGYLQMTEKQKKLFELRLKMNEARKANQQAMVAEKKRMEPRGESRGVSKQKWLDDRKKKIGKLLDSNGLDMSKAYMLDTQETAETKYKKWEKEPAPYGWDVFNQKTLYDAYKKRTKNIEVDMEAYNKAKEADPEFYRDASSLQYGKVSNVPEENIDKMVKELKEREEKRKSFSRRRKFNEDKDIDSINDRNEHFNKKIERAFGKYTLEIKNNLERGTALPD

SEQ ID NO: 2261 - DNA, 609 bp, Sorghum bicolor
  misc_feature: Ceres ANNOT ID no. 6020458
  misc_feature: Encodes the peptide sequence at SEQ ID NO 2262
atggctcgcctgctcctcctcctcgccgccgccgccgcagcggcgttcctggccgtggaggccgcgtcgccggtggccagcgacttcatccgcaagtcttgccgcgcgacgcagtacccgtcggtgtgcgagcagagcctggcgtcgtacgggggcaccccgccgccgcggagcccgcgggagctggcgcgcgccgcgctgtccgtgagcgcggaccgcgcgcgcgccgcgtccgcgtacgtgggccgcctgtgcggcgccggcaccggcgcgaagaaggggtccgggtcgcggccggtggcggcgggccccgtgcgcgactgcctggagaacctggcggacagcgtgggccacctccgcgacgcggcgcaggagatgggcggcgccgggatgagccgctccgggacgcccgcgttcaagtggcacctcagcaacgtccagacctggtgcagcgccgcgctcaccgacgagaacacctgcctcgacggcctctcctcccgcggcgtcgacgccggcacgcgcgccgccatccgcggcaaggtcgtcgaggtcgcgcaggtcaccagcaacgcgctcgcgctcgtcaacaaggtcgggcctgggtactag

SEQ ID NO: 2262 - protein, 202 aa, Sorghum bicolor
  misc_feature: Ceres ANNOT ID no. 6020458
  misc_feature (24)..(194): Pfam Id: PMEI Pfam Desc: Plant invertase/pectin methylesterase inhibitor
  misc_feature (4)..(200): NCBI GI: 53792879 NCBI Desc: ripening-related protein-like [oryza sativa (japonica cultivar-group)]
  misc_feature (4)..(200): NCBI GI: 115469908 NCBI Desc: os06g0711800 [oryza sativa (japonica cultivar-group)]
  misc_feature (1)..(182): NCBI GI: 115475928 NCBI Desc: os08g0330400 [oryza sativa (japonica cultivar-group)]
  misc_feature (5)..(182): NCBI GI: 45735944 NCBI Desc: ripening-related protein-like [oryza sativa (japonica cultivar-group)]
  misc_feature (4)..(200): NCBI GI: 32489696 NCBI Desc: osjnbb0004g23.9 [oryza sativa (japonica cultivar-group)]
MARLLLLLAAAAAAAFLAVEAASPVASDFIRKSCRATQYPSVCEQSLASYGGTPPPRSPRELARAALSVSADRARAASAYVGRLCGAGTGAKKGSGSRPVAAGPVRDCLENLADSVGHLRDAAQEMGGAGMSRSGTPAFKWHLSNVQTWCSAALTDENTCLDGLSSRGVDAGTRAAIRGKVVEVAQVTSNALALVNKVGPGY

SEQ ID NO: 2263 - DNA, 1929 bp, Sorghum bicolor
  misc_feature: Ceres ANNOT ID no. 6020461
  misc_feature: Encodes the peptide sequence at SEQ ID NO 2264
atggggaaggggaagaagtcgaaggagaaggagatggagaagaaaccggtggacatcctcgcggggtccgacgaggactccgatggcggggaggatctctccaaggtccagatcaacgaggagtacgcgcgccgcttcgagcacaacaagcggcgggaggcgctgcagcgcctcgaggagcgcaggaagcagggcctcgtccccgcctctgacgacggcgagtcggattccgagtccgagtcgactgaggaggaggacgaggaggccgccattgcctcgcgcctcgtcgaccgccgcgtgttcgaggtgatccgccgcatccgcagcggcgacccccgcatcctagacaaggacgccaaggtctactcggagtcagaggaggaagagggcggcgaagaaggtgaggacgccgagaaggaagaagagtccaagcaggggaagaaaaagaccaagaaggagaagcctctatacctcaaggacgtcaatgcccgccacctgctcgaggagggcccggagttcgcagcgcaggccagccggagcagcagcaagttcgagaggatcgcctatgatgagcagcagaagaagggtttggaggctttccttgaggcacagaaagaagtattaggagacgacgacgacgacaatttgttccaggtgaagcccaaggttagagcaggggctgatgatgaagtggaggaggatgaggaggagaagcagaccaaggagcttgctggtgaggtctttgggaacgatgaggagctggatgagaatgagaagttcttgaaggaatttttccttaagaggccgtaccttgaggcagagaagaggaagtcctatctggatgatatccaggaattgtcagatgatgaagaagagctcgagattcaggaagaatatgagcatggttataattaccggcatgaggaggccatggcatcaggggcagtggtggcggaccgggtaatgggacattcaagggttgttgaagggtcagtaaggaagaaggagagcagcaggaagcagcagcgcaagagcaaagaggagcggatggctcgtattaagcaacagcaggcagaggagctgaagcatctcaagaatttgaagaagaaagagattgcagtgaagcttgagaggatccgaatgatcgctgggattgaaggcgatgctgcatgtaagcttggtgctgatgacttggaggaggattttgatccagaggattatgacaagaaaatgcaggagatgtttgatgacagttactatgatgctgatgatgttgatcctgagtttggaagtggtgtggagatggatctggagaagccggattttgacaaagaagacgaattgctcgggcttcctaagggatgggctagtgaccagtcaaaagaagagtctactgccgctgatgcgaaaggtgcaaaagggaagatctctctcaaagacaaggtggagcttgagaaagagatggaggagtactacaagttagactatgaggacactattggagatatcaagactcggttcaagtataaacaggttaagcccaacagttttggtctgagtgcctgtgatatattgacatcagatgacaaggatttgaaccagtatgtttccattaagaagctagctccttacagagaggatgaatggaaggttacgcatcataagatgcagagcaaggatttgatccttggaggccagaaggaagggaagaaggacaaatctgtcaagaaatctaggtctgaggaaggcggccctagttcttcaaaaacagagaaagacaggctgacaaatgggcaagagtcaacagatgacaagaaaaagactacccgaagtgagcgaaggaagcgtcgtaatgctgacctaaagatatccgatgatcgattagcggcatttggaaagacaaattcgaagcgtcacaagagccattga

SEQ ID NO: 2264 - protein, 642 aa, Sorghum bicolor
  misc_feature: Ceres ANNOT ID no. 6020461
  misc_feature (393)..(573): Pfam Id: Krr1 Pfam Desc: Krr1 family
  misc_feature (15)..(419): NCBI GI: 66361516 NCBI Desc: zz domain protein [cryptosporidium parvum]
  misc_feature (15)..(419): NCBI GI: 46228862 NCBI Desc: zz domain protein [cryptosporidium parvum]
  misc_feature (54)..(618): NCBI GI: 30687340 NCBI Desc: krr1 family protein [arabidopsis thaliana]
  misc_feature (24)..(446): NCBI GI: 125978631 NCBI Desc: ga19028-pa [drosophila pseudoobscura]
  misc_feature (18)..(446): NCBI GI: 21357951 NCBI Desc: cg5645-pa [drosophila melanogaster]
MGKGKKSKEKEMEKKPVDILAGSDEDSDGGEDLSKVQINEEYARRFEHNKRREALQRLEERRKQGLVPASDDGESDSESESTEEEDEEAAIASRLVDRRVFEVIRRIRSGDPRILDKDAKVYSESEEEEGGEEGEDAEKEEESKQGKKKTKKEKPLYLKDVNARHLLEEGPEFAAQASRSSSKFERIAYDEQQKKGLEAFLEAQKEVLGDDDDDNLFQVKPKVRAGADDEVEEDEEEKQTKELAGEVFGNDEELDENEKFLKEFFLKRPYLEAEKRKSYLDDIQELSDDEEELEIQEEYEHGYNYRHEEAMASGAVVADRVMGHSRVVEGSVRKKESSRKQQRKSKEERMARIKQQQAEELKHLKNLKKKEIAVKLERIRMIAGIEGDAACKLGADDLEEDFDPEDYDKKMQEMFDDSYYDADDVDPEFGSGVEMDLEKPDFDKEDELLGLPKGWASDQSKEESTAADAKGAKGKISLKDKVELEKEMEEYYKLDYEDTIGDIKTRFKYKQVKPNSFGLSACDILTSDDKDLNQYVSIKKLAPYREDEWKVTHHKMQSKDLILGGQKEGKKDKSVKKSRSEEGGPSSSKTEKDRLTNGQESTDDKKKTTRSERRKRRNADLKISDDRLAAFGKTNSKRHKSH

SEQ ID NO: 2265 - DNA, 1668 bp, Sorghum bicolor
  misc_feature: Ceres ANNOT ID no. 6020464
  misc_feature: Encodes the peptide sequence at SEQ ID NO 2266
atggcctctacaagccctacccccgcctccctctccacgcccttgctctccgactccatcgcgcccgccgccaacgggcacgccacaaaccaccgacactcccaccaccacgacgacagcgacggcgcggcggcggcggcctccgtgtgctgcgacgacggtggagacccgttcgcgttcctcgcggaggaccggccgccgcgggaccggggggcgccgtcccccgccgacccgttccgcaacggcacgccggcgtggggcggcggcgcgtacgcgtgggcgaggacgctgctgctccttcccgttgcggcggtccggctggtcctgtttgggctcgccatcgcgatcgggtacgcggccacgtgggtggctctccgcggctgggccaacacgcacggcaggccccgggagggcggcgggcctatgccggcgtggcgccgccggctcatgtggatcacgcggatctccgcccgctgcatcctcttctcattcgggtaccactggatcagaaagaaaggaaggcccgctcctagggaactcgcacctattgttgtttccaatcatatctcgtacatagaacccatattcttcttctatgaattgttcccaaccattgtttcgtccgagtctcatgatgccctaccatttgttggaacaattattcgagcgatgcaggttatatatgttgatagattctcaccagcttctcggaaggctgctgtaaatgaaataaagagaaaggcagcttgcaatagcttcccgcgggtcctgttattccctgaaggcaccacaacaaatgggagattcctgatttcgttccaacatggcgcattcatacctggctaccctgttcaaccagttgttgttcgttatccacatgtgcactttgatcaatcatgggggaatatatcattattaaagctcatgtttaagatgttcacccagtttcataatttcatggaggtagagtaccttcctgttgtctaccctcctgagatcaagcaagagaatgcccttcattttgcggaggataccagctatgctatggctcgcgccctcaatgtcttgccgacttcctattcatatggtgattctatgattatggcacgagcagtagaagctggaaaggtgaactgctcaaattacatggtagaaatggcttgggttaaagatatttatggtgtaagcacagcagaagcaatggaactattggaacatttcctggctatgaatccagataatgatggacgtgtgaaagcagaagatttttgggctcattttggcctggattgcagtcctctatgcaagaagatatttcactactttgatctaggcatcaaggaatcgattacgttccgtcagttcttggttgggtgcgcgcacctgaggaagcagccattgttccagggttcctgcgagaccgcctttgagaagtgccgggatcctgaaacatctgagatctccagggcacagctagctgatatcctgcggtcaagcatgctgctgccgtctgatgataagatggtggagctgttcaagacgttcgacatagatggtgacgaaaagataagcagggacgacttcatgacgtgtcttgggaggttcccgtttctgattgcgttctttgcagcccggatcaatggggaagtgtacatcgagatagtctga

SEQ ID NO: 2266 - protein, 555 aa, Sorghum bicolor
  misc_feature: Ceres ANNOT ID no. 6020464
  misc_feature (167)..(290): Pfam Id: Acyltransferase Pfam Desc: Acyltransferase
  misc_feature (507)..(535): Pfam Id: efhand Pfam Desc: EF hand
  misc_feature (168)..(543): NCBI GI: 12231951 NCBI Desc: jd1 [nicotiana tabacum]
  misc_feature (96)..(539): NCBI GI: 94733200 NCBI Desc: novel protein [danio rerio]
  misc_feature (102)..(536): NCBI GI: 103485105 NCBI Desc: lpc acyltransferase [rattus norvegicus]
  misc_feature (133)..(536): NCBI GI: 44890266 NCBI Desc: bc005662 protein [mus musculus]
  misc_feature (90)..(529): NCBI GI: 54643967 NCBI Desc: ga17084-pa [drosophila pseudoobscura]
  misc_feature: The sequence is a functional homolog of SEQ ID NO. 487 in the 11/188,298 US application
MASTSPTPASLSTPLLSDSIAPAANGHATNHRHSHHHDDSDGAAAAASVCCDDGGDPFAFLAEDRPPRDRGAPSPADPFRNGTPAWGGGAYAWARTLLLLPVAAVRLVLFGLAIAIGYAATWVALRGWANTHGRPREGGGPMPAWRRRLMWITRISARCILFSFGYHWIRKKGRPAPRELAPIVVSNHISYIEPIFFFYELFPTIVSSESHDALPFVGTIIRAMQVIYVDRFSPASRKAAVNEIKRKAACNSFPRVLLFPEGTTTNGRFLISFQHGAFIPGYPVQPVVVRYPHVHFDQSWGNISLLKLMFKMFTQFHNFMEVEYLPVVYPPEIKQENALHFAEDTSYAMARALNVLPTSYSYGDSMIMARAVEAGKVNCSNYMVEMAWVKDIYGVSTAEAMELLEHFLAMNPDNDGRVKAEDFWAHFGLDCSPLCKKIFHYFDLGIKESITFRQFLVGCAHLRKQPLFQGSCETAFEKCRDPETSEISRAQLADILRSSMLLPSDDKMVELFKTFDIDGDEKISRDDFMTCLGRFPFLIAFFAARINGEVYIEIV

SEQ ID NO: 2267 - DNA, 1362 bp, Sorghum bicolor
  misc_feature: Ceres ANNOT ID no. 6020699
  misc_feature: Encodes the peptide sequence at SEQ ID NO 2268
atggccgtaaacctcccagtatctcagccttcttccggcctatgcgtgaaaccccaccaacagcggggccatggctcgaccgccgcggcaatggcggccgtggccgcgccgccctccacgttcgctccacagacgacacggctctctgctgatccgtccatcgcggtgaacaccaaaaacacaacgctggcagcaacggtcgccatgactgaaagagtgacgaagaagaatgatgagacgctggcgagcatgtggcgggagattcagggcaccggcaactgggctggcttggtggagccgctgcacccactcctccgggccgagatcgtccggtacggcgagcttgtagcggccacgtacaaggcgttcgacctcgacacatgctccaagcgttacctcaactgcaagtacggcaaggcacgaatgcttgaggctatgggcatggccggcgccgggtacgacgtcacgaggtacatctacgcaacaccggacatcgcgcttcctggagcggcggagccttgccctatccggtggatcgggtacgtggcggtcgcgtccgacgagacggtgcgccgcctcgggcgccgcgacatcgtcgtgtcctttcgtggcacggtcaccggatcggagtgggtggccaacatgatgagctccctcgagcaggcgaggttcgatccgtcggacccacgcccagacgtgaaggtcgagtcgggctttctctctgtctacacctccgacgacgccacctgccgcttcacctgcggcagctgccgaaaccagctcctttctgaggtgactcgcctgatcaacaagtacagacaagaggacatcagcatcacgctggccggccacagcatgggcagctccctcgcccttctcttcgggtacgaccttgccgagcttggtctcaaccgcgatggtggtggcgataccgtgccgatcaccgtctactcttttgctggcccgagggttggcaatgctgggttcaagaatcggtgcgacgagctcggggtgaaggtgctaagggtggtaaatgtcaatgatcctatcaccaagttgcccggcatcttcttgaacgagaactttttgggggccaggttggagcttccatggagctgtgcgtgttacacgcatgttggtgtcgagcttgccctggatttcttcaaagcgagagatcctgcttgcgtgcatgacctagaatcctatatagggttgctcaagtgccctaagattgcaaaggtgaaaagagagcatcttttaagcaaggcaatgaagttcgtgcttcaacagagttttgatacttggaggtggcaaatggctgcaatccaagttggtgagttagtacaagccatggggttgtag

SEQ ID NO: 2268 - protein, 453 aa, Sorghum bicolor
  misc_feature: Ceres ANNOT ID no. 6020699
  misc_feature (199)..(358): Pfam Id: Lipase_3 Pfam Desc: Lipase (class 3)
  misc_feature (65)..(453): NCBI GI: 115441651 NCBI Desc: os01g0900400 [oryza sativa (japonica cultivar-group)]
  misc_feature (53)..(431): NCBI GI: 124360696 NCBI Desc: peptidase s26a, signal peptidase i; esterase/lipase/thioesterase; lipase, class 3 [medicago truncatula]
  misc_feature (39)..(414): NCBI GI: 6850308 NCBI Desc: contains similarity to a lipase-like protein from ipomoea nil gbu55867 and contains a lipase pf01764 domain. [arabidopsis thaliana]
  misc_feature (72)..(406): NCBI GI: 30684625 NCBI Desc: lipase class 3 family protein [arabidopsis thaliana]
  misc_feature (14)..(406): NCBI GI: 27363430 NCBI Desc: at1g06800/f4h5_10 [arabidopsis thaliana]
MAVNLPVSQPSSGLCVKPHQQRGHGSTAAAMAAVAAPPSTFAPQTTRLSADPSIAVNTKNTTLAATVAMTERVTKKNDETLASMWREIQGTGNWAGLVEPLHPLLRAEIVRYGELVAATYKAFDLDTCSKRYLNCKYGKARMLEAMGMAGAGYDVTRYIYATPDIALPGAAEPCPIRWIGYVAVASDETVRRLGRRDIVVSFRGTVTGSEWVANMMSSLEQARFDPSDPRPDVKVESGFLSVYTSDDATCRFTCGSCRNQLLSEVTRLINKYRQEDISITLAGHSMGSSLALLFGYDLAELGLNRDGGGDTVPITVYSFAGPRVGNAGFKNRCDELGVKVLRVVNVNDPITKLPGIFLNENFLGARLELPWSCACYTHVGVELALDFFKARDPACVHDLESYIGLLKCPKIAKVKREHLLSKAMKFVLQQSFDTWRWQMAAIQVGELVQAMGL

SEQ ID NO: 2269 - DNA, 648 bp, Sorghum bicolor
  misc_feature: Ceres ANNOT ID no. 6020879
  misc_feature: Encodes the peptide sequence at SEQ ID NO 2270
atgaacgtgttccggcttgcgggggacatgacccacctcctcagcgtggtggtgctgctcctcaagatccacaccatcaagtcgtgcgcaggcatatctctgaagacgcaggagctgtatgcacttgtttttgcagcccggtatctggacctgtttgttcattttgtgtctctgtacaacactgtcatgaagctggtcttcttggcaagttctttctcgatagtttggtacatgaagcggcataagattgtgcggaggacctatgacaaggatcatgacacctttcgccattacgttttagtgttgccttgtcttcttctagctctccttattaatgagaagtttacttttagagaggtgatgtgggcattctccatttatttggaagctgttgcgatatttccacagcttgttttgctacagcggacaaggaatattgacaacctgactggccaatatgtcttcttcttgggtgcctaccgcgtgctttatatccttaactggatttaccgatacttcagtgagccccattttgtccactggataagttgggtggcaggaatagtgcaaactctgttgtatgctgacttcttctattattacataatgagctggaagaacaatgtgaagctagagctgccagcttaa

SEQ ID NO: 2270 - protein, 215 aa, Sorghum bicolor
  misc_feature: Ceres ANNOT ID no. 6020879
  misc_feature (1)..(205): Pfam Id: ER_lumen_recept Pfam Desc: ER lumen protein retaining receptor
  misc_feature (1)..(215): NCBI GI: 77550860 NCBI Desc: er lumen protein retaining receptor [oryza sativa (japonica cultivar-group)]
  misc_feature (1)..(215): NCBI GI: 6685428 NCBI Desc: er lumen protein retaining receptor (hdel receptor) (pgp169-12)
  misc_feature (1)..(215): NCBI GI: 9293986 NCBI Desc: er lumen protein-retaining receptor-like protein [arabidopsis thaliana]
  misc_feature (1)..(215): NCBI GI: 32189301 NCBI Desc: at1g29330 [arabidopsis thaliana]
  misc_feature (1)..(215): NCBI GI: 92867121 NCBI Desc: er lumen protein retaining receptor [medicago truncatula]
MNVFRLAGDMTHLLSVVVLLLKIHTIKSCAGISLKTQELYALVFAARYLDLFVHFVSLYNTVMKLVFLASSFSIVWYMKRHKIVRRTYDKDHDTFRHYVLVLPCLLLALLINEKFTFREVMWAFSIYLEAVAIFPQLVLLQRTRNIDNLTGQYVFFLGAYRVLYILNWIYRYFSEPHFVHWISWVAGIVQTLLYADFFYYYIMSWKNNVKLELPA

SEQ ID NO: 2271 - DNA, 1290 bp, Sorghum bicolor
  misc_feature: Ceres ANNOT ID no. 6021871
  misc_feature: Encodes the peptide sequence at SEQ ID NO 2272
atgcggaagaaggggcgggcggtgccggagtggctcaacagcccaatttggtccgcgaccccgcctgcgcccaccccgccggacccctacggcgtcgacctcgccccgccgccgcccccaaagccgccgccgccagctgtacccccgccgccgtcgtacgagcaggccgtaggggtgggtggtggccgacgggatgaggatgagtacgagggcgccggggcggtgatacgggcgcacctgctctccgacttcaaggccgcgctgtcgaagaaggtggtgaacatgggagagctgcagcgcttagcctgccttggcgttcccgacggcggtggcggtgtccgacccgttgtctggaagcttcttttggggtatttgccaactgatcgttccttatgggcttatgagttagaaaagaagcggagtcaatatagtgcatacaaagaagagtttcttctaaatccttcagaaaaactacgaaggatggaggaaacaaagctgtcgagaaagaaagagttaaacattgagaggattggctttcttccgagattagaagttactaatgaagagcatcctttaagctctggtaaatctagcttgtggaatcaatattttcaggattcagagatactggaacagatagaccgagatgtaaagcgaacgcatcctgatatttcctttttctcatcaaagtctaaccaggaatctctgaggagaattctaattatattttcaaaattgaaccccagtataagatatgtgcaagggatgaatgaagttttggcacctctattttatgtattcaagaatgaccctgacccaagcagctcagcgtcagctgaagcagacacgtacttttgctttgtcgaattgttgagtggctttagagacaactattgtaagcatcttgacaatagcagcgtgggtatccgatctacactttcgaaattatcacaactattgaagcggcatgatgaggaactatggcgtcacatggaggtcacaacaaaggtttacccacaatattatgcgtttagatggatcacactgttgttgacaatggagttcagctttaacgtgtgtatacatatctgggacgctatcttgggtgatccagaaggcccatcggacacattaatgaggatatgctgtgccatgctcatcctagtccggaagcgcctcttagctggagacttcactgccaatatccagctgctgcaacattacccagccaccaacatcgatcacctcctccacattgccaaccggttgagagggactgtagccggctag

SEQ ID NO: 2272 - protein, 429 aa, Sorghum bicolor
  misc_feature: Ceres ANNOT ID no. 6021871
  misc_feature (160)..(396): Pfam Id: TBC Pfam Desc: TBC domain
  misc_feature (8)..(427): NCBI GI: 116634829 NCBI Desc: osigba0135c09.4 [oryza sativa (indica cultivar-group)]
  misc_feature (119)..(428): NCBI GI: 115485501 NCBI Desc: os11g0479300 [oryza sativa (japonica cultivar-group)]
  misc_feature (1)..(424): NCBI GI: 140059084 NCBI Desc: rabgap/tbc [medicago truncatula]
  misc_feature (18)..(424): NCBI GI: 92892994 NCBI Desc: rabgap/tbc [medicago truncatula]
  misc_feature (119)..(427): NCBI GI: 115457970 NCBI Desc: os04g0377600 [oryza sativa (japonica cultivar-group)]
MRKKGRAVPEWLNSPIWSATPPAPTPPDPYGVDLAPPPPPKPPPPAVPPPPSYEQAVGVGGGRRDEDEYEGAGAVIRAHLLSDFKAALSKKVVNMGELQRLACLGVPDGGGGVRPVVWKLLLGYLPTDRSLWAYELEKKRSQYSAYKEEFLLNPSEKLRRMEETKLSRKKELNIERIGFLPRLEVTNEEHPLSSGKSSLWNQYFQDSEILEQIDRDVKRTHPDISFFSSKSNQESLRRILIIFSKLNPSIRYVQGMNEVLAPLFYVFKNDPDPSSSASAEADTYFCFVELLSGFRDNYCKHLDNSSVGIRSTLSKLSQLLKRHDEELWRHMEVTTKVYPQYYAFRWITLLLTMEFSFNVCIHIWDAILGDPEGPSDTLMRICCAMLILVRKRLLAGDFTANIQLLQHYPATNIDHLLHIANRLRGTVAG

SEQ ID NO: 2273 - DNA, 1767 bp, Sorghum bicolor
  misc_feature: Ceres ANNOT ID no. 6022591
  misc_feature: Encodes the peptide sequence at SEQ ID NO 2274
atggccgccgcgccgcaccagaccggccccgccgcagatagcatgattccgctgcagtcggaacctgtacttgagaataacccctccaagagtgcaaacgccaaggaccagattctttctggtgcagagaatgtgtctgcaggcaatgcacgtggcgctagctccttgaaatcgccaaaaggcccgccagagaagcctagctctgtcggaaaagctggagaacagccttttgtctaccagcaaaatgtgtatgcaccgcagccacaaccactctatcctggaggacagtgggaggaatatccccattatgtgaatatggaggggctccattccgtatctcccggaatctacaatgacaaccagtccctcatgctatctcctggatatgcaagcaacccccaaatgatgtatggagcatattctcctgtttccaccgttggagatggccaacaatacttccctgtgcactatcccttctcaagtccttactatcaaccaccagcttctcctagcatgggatattcaagctctgcgactggaatatcccaaggagaccctatgctgcagcaagagtactttcttcctgatggccttctatattcacccacaccagggtatcatcatccattcagctcattcgacagagcaccgacacaaccaaataatgctcctgggctgtttggtcaagggaatctaccactggcttctggcatgcatcatggatcgatgtatggtcctggatcctacaagggacgccagcaaggtagcaaatttggtggcactactccaagttggagttctgctggccgcagatttggtacttttgacttgagtggcaatcaacaaaggggaagcatgccatttggtagtcacaatggctctctggagtttatgaatgagcaaaaccgtgggccacgcgctacaaaaccgaagacacaagacactgagaactcctcagatgagaaaaacgagaaaactgttcctctgattgacagtgaactgtacaatcgctctgattttatcactgagtacaaggatgccaaattctttgtaataaagtcctacaccgaggaccatgtacataggagcattaagtataatgtttgggccagcacagccagcgggaacaggaagctggattctgcttaccgtgcggccaaagagaaagaagagcattgccctattttcttgtttttctcggtcaatggaagtggccaattctgtggcgtggctgagatgattggacctgtcgatttcgacagaagtgttgattactggcagcaggataagtggagtggccaattccctgtgaagtggcacataattaaggatgtgccaaacaaccttctgaggcacatcattcttgagaacaatgacaataaacctgtcacaaatagcagggacacccaggaggtgaagctggaacagggcctccagatgcttacaatcttcaagagccatgaggctgagacaacaatcctggaagatttcgacttctatgagcaacgggagaaagccttgcaggagaacagacgtcaacagcagcctgccagcaccgaccctcagaagctggtggataccaaggctcaaggtcctgtggccgatatatcggatgcatttgctaaggccgttcagttgaaggatattgagaacagtgggacaaccccgaaagctgagggcgcatcagctgaaaacggatccgctgccacagccaaggttgaaggaagtgcagacctgaacatgggccctgcggaggaaagcagttga

SEQ ID NO: 2274 - protein, 588 aa, Sorghum bicolor
  misc_feature: Ceres ANNOT ID no. 6022591
  misc_feature (397)..(487): Pfam Id: YTH Pfam Desc: YT521-B-like family
  misc_feature (91)..(587): NCBI GI: 115460434 NCBI Desc: os04g0608800 [oryza sativa (japonica cultivar-group)]
  misc_feature (91)..(587): NCBI GI: 90265071 NCBI Desc: h0702g05.3 [oryza sativa (indica cultivar-group)]
  misc_feature (83)..(544): NCBI GI: 92892065 NCBI Desc: yt521-b-like protein [medicago truncatula]
  misc_feature (165)..(515): NCBI GI: 92884719 NCBI Desc: yt521-b-like protein [medicago truncatula]
  misc_feature (138)..(562): NCBI GI: 124365566 NCBI Desc: yt521-b-like protein [medicago truncatula]
MAAAPHQTGPAADSMIPLQSEPVLENNPSKSANAKDQILSGAENVSAGNARGASSLKSPKGPPEKPSSVGKAGEQPFVYQQNVYAPQPQPLYPGGQWEEYPHYVNMEGLHSVSPGIYNDNQSLMLSPGYASNPQMMYGAYSPVSTVGDGQQYFPVHYPFSSPYYQPPASPSMGYSSSATGISQGDPMLQQEYFLPDGLLYSPTPGYHHPFSSFDRAPTQPNNAPGLFGQGNLPLASGMHHGSMYGPGSYKGRQQGSKFGGTTPSWSSAGRRFGTFDLSGNQQRGSMPFGSHNGSLEFMNEQNRGPRATKPKTQDTENSSDEKNEKTVPLIDSELYNRSDFITEYKDAKFFVIKSYTEDHVHRSIKYNVWASTASGNRKLDSAYRAAKEKEEHCPIFLFFSVNGSGQFCGVAEMIGPVDFDRSVDYWQQDKWSGQFPVKWHIIKDVPNNLLRHIILENNDNKPVTNSRDTQEVKLEQGLQMLTIFKSHEAETTILEDFDFYEQREKALQENRRQQQPASTDPQKLVDTKAQGPVADISDAFAKAVQLKDIENSGTTPKAEGASAENGSAATAKVEGSADLNMGPAEESS

SEQ ID NO: 2275 - DNA, 2937 bp, Sorghum bicolor
  misc_feature: Ceres ANNOT ID no. 6022607
  misc_feature: Encodes the peptide sequence at SEQ ID NO 2276
  misc_feature: Up-regulated in shoot tissues in response to methyl jasmonate treatment
  misc_feature: Up-regulated in shoot tissues in response to salicylic acid treatment
atggctgcggcggcggtgatggtgagctcggcgggctccctgctggcgatgctgcaagagccggcgccggagctcaagctgcacgcgctctccagcctcaactccctcgtccacgccttctgtgagagtttgtatgaagacgaggagtttgtccagaggcaacttgcagcactagttgcctctaaggtgtttttctacttgggcgagctaaatgatgctctctcgtatgcacttggcgctggacccttgtttgatgtatcagatgactctgattacgctcaaacactgttagcaaaagctttggatgaatatgctgccatccaatctaggcccactggggaagaaaaaactatggaccctaggctggaggccattgtggaaaagatgctggacaagtgcattcttgatggaaaatatcaacaggccatgggtatgtctgttgagtgccggagactggataaactggagggagcaatttctcgatgtgataaccttcatggagctctttcatattgcatcaatctgtctcaccaatatgttagtcaccgcgaatatcgattggagattctacaatgtcttgtcaaaatatatcagacattgccaaatccagattatttaagcatttgccaatgtcttatgttcttgggtgagcctgaaagtgttgcaagcatcttggacaagctgatttctggaagcaaggatgatgctctgcttgcataccaaactgctttcgatcttgctgaaaatgaaaatcaggctttcctcctgaatgtgcggaatcaccttgatgcattgagttcacatacttctgcccatgtggacactgacagtggatcagctgtaccaagtaatcaaactaatgctgctacagaaccatctggggatggccagatgagagatgacataaacatgccaaatggcagtgctaccactgtggatccaaatgcagcaacacgtgctgataggctgacaaaaattaagggcatactgtcaggagagacatctattcagttgacattgcagttcctatacagccataataggtctgatcttcaaattttgaagactataaagcaagctgtggaaatgaggaacagtgtctgtcacagcgcaacaatatgctccaatgcaatcatgcatgcagggacaacagttgataccttcctcagagaaaacttggaatggctaggtagggcaaccaactgggccaagttcagtgcaactgctggactaggtgtcattcatagaggccatcttcaacaaggccgcgcattgatggccccctacctgcctcagaatggtgctggtggcagtggtagcccatactcggaaggaggtgccctctatgctcttggtttgattcatgccaaccatggtgaaggaatcaaagattttcttcgtgagagtctccgcaacgccacttctgaggtggtccagcatggtgcttgtctgggactcgggcttgcagcattaggtacatcagatgaggaaatatgcgaggacatcaagaatattttgtacacggatagtgctgtggctggtgaagcagctggtattggcatgggtttgctcatggttggcacggccagtgagaaggccacagagatgcttgcctatgctcatgatacacaacacgagaaaattatcaggggcttgtcacttggaattgcattgacagtgtatggcagggaagaagaagctgacaccttgattgaacaaatgactagagatcaagatcccatacttcgttatggtggtatgtatgcattggctctagcatacagagggactgcaaataacaaagctatccaccagcttctgcattttgctgtgtcggacgtgagtgacgatgtgcggaggactgcagtgttggctcttggctttgtcctgtacaacgagcctgaacagacacccagaattgtgtccctactatcagaatcatacaatccacatgtccgttatggtgcagcactagctgttggaatctcctgtgccggaacaggattaagtgaagccatctccttactggagcctctgacatcagacgtcgtcgactttgtacgccagggtgctctcattgcgatggcaatggtgatgatccagaccaatgaatcttacgattcacgtgtcggagcattcaggcgccagttggaaaagataatccttgacaagcatgaggataccatgagcaaaatgggtgccattctggcttctggcattctcgatgccggtggcaggaatgtcaccatcaagctcaagtcgaggtcaaagcatgacaggctcactgctgttgtcggactagctgttttcacccagttctggtactggtacccgctcacctacttcataagccttgccttctctccaacggccctcattggcctcaactctgacctgaaagtgccaaagtttgagttcttgtcgaacgccaagccatcactgtttgattaccccaagccagtgactcagcagactgcgaccgcctcagtcaaggtaccggcagccatcttgtcgacgtatgccaagtctaagtctagggcaaagaaggaagcagagagcaaggccaaggagaaagcagaggactcttccaatgcttctacttcaatgcaggtggacggcgctgctgctgcagagaagaaggcccctgaaccggagcctacgttccagattctgacgaacccagcccgggtcgttccagcccaggagaagttcataaaattcctggaagacagcaggtacaagccggtgaaggctgccccctcaggattcgtcctcctccaggacctcaagcccacggaggctgaggagctcgccctaactgacgcgccgtcaaccgctgccacgaccaatgccccggcatccagtgccagcgagccagccgccatggctgtcgacgatgagccccagccgcccccggctttcgagtacaccgaatag

SEQ ID NO: 2276 - protein, 978 aa, Sorghum bicolor
  misc_feature: Ceres ANNOT ID no. 6022607
  misc_feature (446)..(479): Pfam Id: PC_rep Pfam Desc: Proteasome/cyclosome repeat
  misc_feature (481)..(515): Pfam Id: PC_rep Pfam Desc: Proteasome/cyclosome repeat
  misc_feature (516)..(549): Pfam Id: PC_rep Pfam Desc: Proteasome/cyclosome repeat
  misc_feature (655)..(689): Pfam Id: PC_rep Pfam Desc: Proteasome/cyclosome repeat
  misc_feature (1)..(977): NCBI GI: 116310118 NCBI Desc: b0402a04.3 [oryza sativa (indica cultivar-group)]
  misc_feature (4)..(977): NCBI GI: 92898669 NCBI Desc: proteasome/cyclosome, regulatory subunit [medicago truncatula]
  misc_feature (4)..(974): NCBI GI: 37935812 NCBI Desc: 26s proteasome subunit rpn2b [arabidopsis thaliana]
  misc_feature (4)..(973): NCBI GI: 32442206 NCBI Desc: 26s proteasome subunit rpn2a [synthetic construct]
  misc_feature (4)..(973): NCBI GI: 32700014 NCBI Desc: 26s proteasome subunit rpn2a [arabidopsis thaliana]
  misc_feature: Up-regulated in shoot tissues in response to methyl jasmonate treatment
  misc_feature: Up-regulated in shoot tissues in response to salicylic acid treatment
MAAAAVMVSSAGSLLAMLQEPAPELKLHALSSLNSLVHAFCESLYEDEEFVQRQLAALVASKVFFYLGELNDALSYALGAGPLFDVSDDSDYAQTLLAKALDEYAAIQSRPTGEEKTMDPRLEAIVEKMLDKCILDGKYQQAMGMSVECRRLDKLEGAISRCDNLHGALSYCINLSHQYVSHREYRLEILQCLVKIYQTLPNPDYLSICQCLMFLGEPESVASILDKLISGSKDDALLAYQTAFDLAENENQAFLLNVRNHLDALSSHTSAHVDTDSGSAVPSNQTNAATEPSGDGQMRDDINMPNGSATTVDPNAATRADRLTKIKGILSGETSIQLTLQFLYSHNRSDLQILKTIKQAVEMRNSVCHSATICSNAIMHAGTTVDTFLRENLEWLGRATNWAKFSATAGLGVIHRGHLQQGRALMAPYLPQNGAGGSGSPYSEGGALYALGLIHANHGEGIKDFLRESLRNATSEVVQHGACLGLGLAALGTSDEEICEDIKNILYTDSAVAGEAAGIGMGLLMVGTASEKATEMLAYAHDTQHEKIIRGLSLGIALTVYGREEEADTLIEQMTRDQDPILRYGGMYALALAYRGTANNKAIHQLLHFAVSDVSDDVRRTAVLALGFVLYNEPEQTPRIVSLLSESYNPHVRYGAALAVGISCAGTGLSEAISLLEPLTSDVVDFVRQGALIAMAMVMIQTNESYDSRVGAFRRQLEKIILDKHEDTMSKMGAILASGILDAGGRNVTIKLKSRSKHDRLTAVVGLAVFTQFWYWYPLTYFISLAFSPTALIGLNSDLKVPKFEFLSNAKPSLFDYPKPVTQQTATASVKVPAAILSTYAKSKSRAKKEAESKAKEKAEDSSNASTSMQVDGAAAAEKKAPEPEPTFQILTNPARVVPAQEKFIKFLEDSRYKPVKAAPSGFVLLQDLKPTEAEELALTDAPSTAATTNAPASSASEPAAMAVDDEPQPPPAFEYTE

SEQ ID NO: 2277 - DNA, 1272 bp, Sorghum bicolor
  misc_feature: Ceres ANNOT ID no. 6022608
  misc_feature: Encodes the peptide sequence at SEQ ID NO 2278
atgggattactagcgtttgagagccaccaggggctctggaacagcggatactattcacagttgtttggaattggaggagttctgatcactcttaccattcttatgttatccacgggctactttgggggaatcggtgctccattttctccatttttctggccatatctaggacaagtgccaaagaagagggaacgcaaaaggcctgtcagagtgtacatggatggatgctttgatctcatgcactacggccatgcaaatgcattgcggcaggctaagttgctgggagatcagcttgtagttggagttgtcagtgatgaggagattgtggcaaataaaggtccacctgtcctttccatggaagagaggttgactcttgttagtggcctgaagtgggttgatgaggtcattcccaatgcaccgtatgagataacagaagaattcatgaatactctcttcaacaagtacaacattgattacattattcatggagatgatccttgtcttctacctgatggcactgatgcatatgcgttagcgaaaaaggtcgggcgctacaagcaaatcaagcgaacagaaggtgtctctagcactgatatagttgggaggatactgctaacattcaagcagaaagatgctggcactgatttaaatgttgccattgctgaaaaggctggagagaaatcaaacgatgaagtgaaaagtcagctatctcattttcttccaacttctcgccggatcatgcagttttcaaatgggcaggctccctcgccaggtgctcgtgttgtctatgtagatggtgcatttgatcttttccacgctggccatgtcgagttcctcaggagcgctagacaacttggtgacttcctacttgtgggtgtctatgacgaccagtctatcagggatagaagaggctgtcgtcctataatgcatctccatgagcgtactcttagtgttctttcctgccgctatgttgatgaagtcattattggtgcgccatgggaagtttctaaggacatgatcactacgtttaacatttcattggttgtccatgggactgtagctgagggcaattcagctggtgaaattgatccttatgctgttccaaagagcatgggcatttttcagacaatcaggagcccaaaatctataacaacattgtcagtggcgacaagaatagttgacaatcatgaagcttacaagaagaggaacttgaaaaagaaggctagtgaagaccggtactacacacaaaagaaatttgtttctggagactag

SEQ ID NO: 2278 - protein, 423 aa, Sorghum bicolor
  misc_feature: Ceres ANNOT ID no. 6022608
  misc_feature (72)..(202): Pfam Id: CTP_transf_2 Pfam Desc: Cytidylyltransferase
  misc_feature (263)..(395): Pfam Id: CTP_transf_2 Pfam Desc: Cytidylyltransferase
  misc_feature (1)..(423): NCBI GI: 78708489 NCBI Desc: phosphoethanolamine cytidylyltransferase [oryza sativa (japonica cultivar-group)]
  misc_feature (6)..(423): NCBI GI: 140052750 NCBI Desc: cytidylyltransferase [medicago truncatula]
  misc_feature (24)..(423): NCBI GI: 28566182 NCBI Desc: phosphoethanolamine cytidylyltransferase [hordeum vulgare subsp. vulgare]
  misc_feature (61)..(418): NCBI GI: 28932922 NCBI Desc: ctp:ethanolamine cytidylyltransferase [chlamydomonas reinhardtii]
  misc_feature (66)..(416): NCBI GI: 60474562 NCBI Desc: phophoethanolamine-cytidyltransferase [dictyostelium discoideum]
MGLLAFESHQGLWNSGYYSQLFGIGGVLITLTILMLSTGYFGGIGAPFSPFFWPYLGQVPKKRERKRPVRVYMDGCFDLMHYGHANALRQAKLLGDQLVVGVVSDEEIVANKGPPVLSMEERLTLVSGLKWVDEVIPNAPYEITEEFMNTLFNKYNIDYIIHGDDPCLLPDGTDAYALAKKVGRYKQIKRTEGVSSTDIVGRILLTFKQKDAGTDLNVAIAEKAGEKSNDEVKSQLSHFLPTSRRIMQFSNGQAPSPGARVVYVDGAFDLFHAGHVEFLRSARQLGDFLLVGVYDDQSIRDRRGCRPIMHLHERTLSVLSCRYVDEVIIGAPWEVSKDMITTFNISLVVHGTVAEGNSAGEIDPYAVPKSMGIFQTIRSPKSITTLSVATRIVDNHEAYKKRNLKKKASEDRYYTQKKFVSGD

SEQ ID NO: 2279 - DNA, 1245 bp, Sorghum bicolor
  misc_feature: Ceres ANNOT ID no. 6022684
  misc_feature: Encodes the peptide sequence at SEQ ID NO 2280
atgtttgggatccaaaccagggacgtggcagatgatttcaactccaggaggaggacactatggaacacgcccaccgcatcgatgcccaccaacacccacaccatcaggtacaacacagccaagaagagtttgttcaatgtacacctcatgtctgtcaagtttgaggacctgtacgggttcatggtgaagggcaatgtggatgatgtcaatgtgctgaacgaggtgagggagaggatcagggagcaaggcagggtgtggtgggcgctggaggcaagcaagggtgcaaattggtacctccaaccaaagatttcttcaaatgagggggtgatcagcgtcacatcactcaagttgtcagtgctcactaatacaattacattgaggaggttgatcaggaaaggtgtgccaccggtgctgaggccaaaggtttggttatctgtgtcaggagcagccaagaaacggtcaacagtaccagaaacatactatgatgagctaattcgtgctactgaggggaagaccacgccagccacaaggcaaattgatcatgatcttcctcgcactttcccttgtcatccttggttgaacagtgacaagggtcaggcatctctgcgacgggtacttgtggggtactcattccgtgattcagaagttggatactgccagggtctaaactacgtagctgcactcttgttgcttgtgatgaagacagaggaggatgcattttggatgcttgctgtactccttgagaatgtacttgtcagtgattgctatactgacactctttctggatgccatgtcgagcagagggtattcaaagatctcctggctaagaagtgtccaaggattgctgctcatcttgaagcaatggggtttgatgtttcacttgttgctacagaatggtttttgtgcctcttctcaaagagcctgccttcagagacaacacttcgggtatgggatgttttattcaatgaaggagccaaggttttgttccatgttgctcttgcaattttcaagatgcgagaagatgatctactacgcatccaacatatcggtgatgtgattgatattttgcaaacaaccacacatcatctatatgaccctgatgaactcctgacatttgcatttgacaagattggttcaatgacaacaaacacaatcacaaaggaaaggaaaaagcaggagactgttgtcatggctgagcttgatcaaagaacaagacggctgagttcactcaagatggatgaatag

SEQ ID NO: 2280 - protein, 414 aa, Sorghum bicolor
  misc_feature: Ceres ANNOT ID no. 6022684
  misc_feature (130)..(346): Pfam Id: TBC Pfam Desc: TBC domain
  misc_feature (1)..(413): NCBI GI: 38637138 NCBI Desc: gtpase activator protein-like [oryza sativa (japonica cultivar-group)]
  misc_feature (117)..(413): NCBI GI: 20810373 NCBI Desc: tbc1d2 protein [homo sapiens]
  misc_feature (117)..(413): NCBI GI: 47940631 NCBI Desc: tbc1d2 protein [homo sapiens]
  misc_feature (117)..(413): NCBI GI: 123980804 NCBI Desc: tbc1 domain family, member 2 [synthetic construct]
  misc_feature (117)..(413): NCBI GI: 55663618 NCBI Desc: tbc1 domain family, member 2 [homo sapiens]
MFGIQTRDVADDFNSRRRTLWNTPTASMPTNTHTIRYNTAKKSLFNVHLMSVKFEDLYGFMVKGNVDDVNVLNEVRERIREQGRVWWALEASKGANWYLQPKISSNEGVISVTSLKLSVLTNTITLRRLIRKGVPPVLRPKVWLSVSGAAKKRSTVPETYYDELIRATEGKTTPATRQIDHDLPRTFPCHPWLNSDKGQASLRRVLVGYSFRDSEVGYCQGLNYVAALLLLVMKTEEDAFWMLAVLLENVLVSDCYTDTLSGCHVEQRVFKDLLAKKCPRIAAHLEAMGFDVSLVATEWFLCLFSKSLPSETTLRVWDVLFNEGAKVLFHVALAIFKMREDDLLRIQHIGDVIDILQTTTHHLYDPDELLTFAFDKIGSMTTNTITKERKKQETVVMAELDQRTRRLSSLKMDE

SEQ ID NO: 2281 - DNA, 1392 bp, Sorghum bicolor
  misc_feature: Ceres ANNOT ID no. 6022780
  misc_feature: Encodes the peptide sequence at SEQ ID NO 2282
atggaggaggacgaggcgggggcgtcgacgtcgtcgtcgtcgccgccgccgcccatcgcgcagctgggctacgaccaggtcctctccatcctccgtctgctcccgcccgaggccgtgctctccttcgccgccacctgccgcgcgttccgggcctgggcctccacggacgcgctctgggaggcgctgtgccgccgcgactggggcgcccgcgccaccgccgcgctcgccgagcgccggcacgaccgccacggcggcggcctgcaggcgccgtggcgaagggtctacgccgaggtcgccaggctcggcgccctgtccgcgcgccgcgtccccgtcaggggcgcctcgccgcggccccgcgcgtcgcactcgcttaacctcgtcgcaggctggctcgtgctcttcggcggcggctgcgagggaggtcaccatcttgatgatacttgggtggcttatgctggaactggagctggaaatagaccacctgctatacttagctggcagcaattagcctctggcactccaggtggtcgattcagtcattcatgcactctagttggtgacacattagttttgtttggtggaatcacagatcaggggcagcgcttgaatgatacatggataggtcaaattttctctgaagagcatcgaaggatgcggatctcatggagactgctggaggtaggtccgcttgcaccacctcctcgtggagctcatgcagcctgctgcgtggatgaaaagtttattgtaattcatggtggggtagggctctatggcagccggcttggtgatacgtggcttcttgatctctcaaatggcttccaatctgccagttggcaccaagtaggcaacacatggcctttgcctccacctcgttctggtcactctttaacttggattggtggtacacgcatggtattatttggtggtagaggatcagaatttgaggttcttaatgatgtgtggctgtttgatattagtgatcaatacccgaaatggaaggagctaaagtatgacttgtctagtgctctcggtgaacttccttttccacgggttgggcattcagcaatacttgccttgggtggcaaggtccttgtgtatggcggggaggactcacaaatgcgacgaaaggatgacttttggatcttggatacaccagctctacttcagtatgagtcaggttccaagaaaatgaccaaaaagatgtggaaaaaactaagaattgatggtcagtgcccaaattaccgatcctttcatggggcatgtgtagatacttctggttgctgtgtgtatatttttggtggaatggttgatggccttgtacaccctgcagaagcctggggtttgagatttgatgggcatctgtatcaagtggagcttctgctacatctctag

SEQ ID NO: 2282 - protein, 463 aa, Sorghum bicolor
  misc_feature: Ceres ANNOT ID no. 6022780
  misc_feature (4)..(414): NCBI GI: 115475403 NCBI Desc: os08g0230300 [oryza sativa (japonica cultivar-group)]
  misc_feature (6)..(461): NCBI GI: 21593470 NCBI Desc: f-box protein zeitlupe/fkf/lkp/adagio family [arabidopsis thaliana]
  misc_feature (25)..(434): NCBI GI: 81170304 NCBI Desc: adagio protein 1 (protein zeitlupe) (lov kelch protein 1) (flavin-binding kelch repeat f-box protein 1-like protein 2) (fkf1-like protein 2) (f-box only protein 2b) (fbx2b)
  misc_feature (25)..(434): NCBI GI: 81170304 (continued) (clock-associated pas protein ztl)
  misc_feature (19)..(434): NCBI GI: 111481711 NCBI Desc: ztl [ipomoea nil]
  misc_feature (19)..(434): NCBI GI: 124359373 NCBI Desc: speract/scavenger receptor; cyclin-like f-box; galactose oxidase, central [medicago truncatula]
  misc_feature: The sequence is a functional homolog of SEQ ID NO. 354 in the 11/188,298 US application
MEEDEAGASTSSSSPPPPIAQLGYDQVLSILRLLPPEAVLSFAATCRAFRAWASTDALWEALCRRDWGARATAALAERRHDRHGGGLQAPWRRVYAEVARLGALSARRVPVRGASPRPRASHSLNLVAGWLVLFGGGCEGGHHLDDTWVAYAGTGAGNRPPAILSWQQLASGTPGGRFSHSCTLVGDTLVLFGGITDQGQRLNDTWIGQIFSEEHRRMRISWRLLEVGPLAPPPRGAHAACCVDEKFIVIHGGVGLYGSRLGDTWLLDLSNGFQSASWHQVGNTWPLPPPRSGHSLTWIGGTRMVLFGGRGSEFEVLNDVWLFDISDQYPKWKELKYDLSSALGELPFPRVGHSAILALGGKVLVYGGEDSQMRRKDDFWILDTPALLQYESGSKKMTKKMWKKLRIDGQCPNYRSFHGACVDTSGCCVYIFGGMVDGLVHPAEAWGLRFDGHLYQVELLLHL

SEQ ID NO: 2283 - DNA, 3078 bp, Sorghum bicolor
  misc_feature: Ceres ANNOT ID no. 6022971
  misc_feature: Encodes the peptide sequence at SEQ ID NO 2284
atggggctgttccgggcggcgtccggcctggcccgtgtggcgctgcggcggaacctctcgcgcgccgcggcgagccccttcgccggcggcggtggcgccgtccctcgtgccgcgccggcgcgctacttccactccacccgcccgcgctggttcgctgcgcctgagccccgtgcggtgccgctctcgcgtctcaccgacagcttcctcgatgggaccagcagcgtctaccttgaggagctgcagcgggcctgggaggccgaccccaactccgtcgacgagtcctgggacaacttcttccgcaacttcgtcggccaggctgcggccacctcaccgggcctctccggccagaccatccaggagagcatgaggctgctgctgcttgtcagggcgtatcaggtgagtggccacctgaaagccaagctcgacccgctcgggctggaggagcgcccggtcccagacgtgctggacccagcgttctatgggttctctgaggctgacttggaccgcgagttcttccttggggtgtggaggatggctgggttccttgaggagaaccggccagtgcagacgctgcgttccgtgctggagcggctcgagcaggcctactgcggcaccattgggtatgagtacatgcacatacctgacagggagaagtgcaactggctcagggataggatcgagacagttaacccaagggagtactcttatgatcgtcgtcaggtcatgctggataggcttatctggagcacacagtttgagaatttcttggctaccaagtggacgactgcaaaacggttcggtcttgaaggcgctgagactctgatccctggcatgaaggagatgtttgacagggcagctgatcttggtgtagagagtattgtcattgggatgccacatagaggcaggttaaatgtcttgggaaacgttgtgaggaagcccttgcgacagatattcagcgagtttagtggtggtaccaagcctgtcaatgaaggggaggggttgtatacagggactggtgatgtcaagtaccatcttggaacttcatatgataggcctaccagaggtgggaaacaaatccatctgtcactggttgcaaacccgagtcatttggaagcagttgatccagttgttgctgggaagacaagagcgaagcagtactattctaatgaccgcgacaggaccaagaatttgggagtgttgctgcatggtgatggtagtttctcagggcagggagttgtgtatgagacactgcatctcagtgcccttgaaaattacaccactggtgggacaatacatattgtggtcaataatcaggttgctttcactactgatccaaagtcagggagatcctcgcagtattgcacagacgtagcaaaagcattggatgctcctattttccatgttaacggtgatgatttggaggccgttgttcatgtctgtgagctcgctgcagaatggcgacagacatttcattcagatgtagtggtggacattgtatgctaccggcgatttggccataatgaaattgatgagccgtccttcacccaacctaagatgtacaaggtgattaggaaccatccaagtgcgcttgagatttatcaaagaaagttgttggagtctgggaagatctcaaaggaagatattgataagttaaacaagaaggtcagcactatacttaacgaggaattccagaatagcaaagactatgttcccaacaagagggactggctttcagcttactggactgggttcaagtcaccagagcagatttcgcgtatccgaaacaccggtgtcaagccagagattctaaaacgtgttggagaagccatgactactctgccagaaaattttaagcctcacagggctgtgaagaagatttttgatctgcggcgtcagatgattgagactggagaaggcattgattgggcagttggtgaagcactcgcttttgctactcttataattgaggggaaccatgtcaggttaagtggacaggatgttgagaggggtacattcagccaccgtcattctgtcatccatgaccaagaaactggagagcagtactaccctctggatcatcttgttatgaatcaagatgaggagctttttactgtgagcaacagttccctgtcagaatttgctgttttgggctttgaattgggttactccatggagaacccgaactcattggtcatatgggaagctcagtttggtgattttgcaaatggagctcaagtgatatttgatcagttcctgagtagtggggagtcaaaatggctccgccagactggccttgtcgtttgccttcctcatggatatgatggtcaggggcctgaacattctagtgcaagattggagcgctttcttcagatgagtgatgacaacccttatgttatacctgagatggatccaacactgcggaagcaaatccaggagtgcaattggcaggtcgttaatgtaacgactcctgcgaattatttccatgttctgcgtcgccagatacaccgggacttcaggaagcctttgattgtgatgtccccaaagaacctccttcgccacaaggactgcaagtcaaacctatctgaatttgatgatcttgcgggccaccctggattcgacaagcaagggacacgcttcaagcggctcattaaggaccagaataatcacaaggaccttgaggagggaatcaaccgtctagttctttgctctgggaaggtgtattatgaactggatgaagaaagaaggaaggcagagcgcactgatgttgctatatgtagagttgagcagctctgcccgttcccctatgacctcattcagcgcgagttgaagagatatccaaatgctgagatcgtgtggtgccaggaggagccgatgaacatgggagcgtacagctacatcaacccgcggctgctgacggcgatgaaggctcttggccgtggtggcatcgaggacatcaagtacgtcggcagggccccttcggctgctaccgcgacgggcttctactctgtgcacgtgcaggagcagacggagctggtgaagaaggcgctgcagcgcgaccccatcaactacccgttctga

SEQ ID NO: 2284 - protein, 1025 aa, Sorghum bicolor
  misc_feature: Ceres ANNOT ID no. 6022971
  misc_feature (244)..(575): Pfam Id: E1_dh Pfam Desc: Dehydrogenase E1 component
  misc_feature (638)..(854): Pfam Id: Transket_pyr Pfam Desc: Transketolase, pyrimidine binding domain
  misc_feature (1)..(1025): NCBI GI: 115458076 NCBI Desc: os04g0390000 [oryza sativa (japonica cultivar-group)]
  misc_feature (1)..(1025): NCBI GI: 116309350 NCBI Desc: osigba0096p03.7 [oryza sativa (indica cultivar-group)]
  misc_feature (4)..(1021): NCBI GI: 4210330 NCBI Desc: 2-oxoglutarate dehydrogenase, e1 subunit [arabidopsis thaliana]
  misc_feature (1)..(1025): NCBI GI: 140060312 NCBI Desc: 2-oxoglutarate dehydrogenase, e1 component [medicago truncatula]
  misc_feature (4)..(1022): NCBI GI: 28416717 NCBI Desc: at3g55410 [arabidopsis thaliana]
  misc_feature (114)..(1014): SWISSPROT Homolog: EC 1.2.4.2 2-oxoglutarate dehydrogenase E1 component, mitochondrial precursor
  misc_feature: The sequence is a functional homolog of SEQ ID NO. 476 in the 11/188,298 US application
  misc_feature: The sequence is a functional homolog of SEQ ID NO. 531 in the 11/188,298 US application
MGLFRAASGLARVALRRNLSRAAASPFAGGGGAVPRAAPARYFHSTRPRWFAAPEPRAVPLSRLTDSFLDGTSSVYLEELQRAWEADPNSVDESWDNFFRNFVGQAAATSPGLSGQTIQESMRLLLLVRAYQVSGHLKAKLDPLGLEERPVPDVLDPAFYGFSEADLDREFFLGVWRMAGFLEENRPVQTLRSVLERLEQAYCGTIGYEYMHIPDREKCNWLRDRIETVNPREYSYDRRQVMLDRLIWSTQFENFLATKWTTAKRFGLEGAETLIPGMKEMFDRAADLGVESIVIGMPHRGRLNVLGNVVRKPLRQIFSEFSGGTKPVNEGEGLYTGTGDVKYHLGTSYDRPTRGGKQIHLSLVANPSHLEAVDPVVAGKTRAKQYYSNDRDRTKNLGVLLHGDGSFSGQGVVYETLHLSALENYTTGGTIHIVVNNQVAFTTDPKSGRSSQYCTDVAKALDAPIFHVNGDDLEAVVHVCELAAEWRQTFHSDVVVDIVCYRRFGHNEIDEPSFTQPKMYKVIRNHPSALEIYQRKLLESGKISKEDIDKLNKKVSTILNEEFQNSKDYVPNKRDWLSAYWTGFKSPEQISRIRNTGVKPEILKRVGEAMTTLPENFKPHRAVKKIFDLRRQMIETGEGIDWAVGEALAFATLIIEGNHVRLSGQDVERGTFSHRHSVIHDQETGEQYYPLDHLVMNQDEELFTVSNSSLSEFAVLGFELGYSMENPNSLVIWEAQFGDFANGAQVIFDQFLSSGESKWLRQTGLVVCLPHGYDGQGPEHSSARLERFLQMSDDNPYVIPEMDPTLRKQIQECNWQVVNVTTPANYFHVLRRQIHRDFRKPLIVMSPKNLLRHKDCKSNLSEFDDLAGHPGFDKQGTRFKRLIKDQNNHKDLEEGINRLVLCSGKVYYELDEERRKAERTDVAICRVEQLCPFPYDLIQRELKRYPNAEIVWCQEEPMNMGAYSYINPRLLTAMKALGRGGIEDIKYVGRAPSAATATGFYSVHVQEQTELVKKALQRDPINYPF

SEQ ID NO: 2285 - DNA, 2190 bp, Sorghum bicolor
  misc_feature: Ceres ANNOT ID no. 6022975
  misc_feature: Encodes the peptide sequence at SEQ ID NO 2286
atggatgaggccctgaaagccaaaaatgttgctgagaccaaattccatgcccgtgacatcaggggtgctcggaagtacgcactcaaggcccagaatctctgcccgacacttgaaggcatattgcagatggtctcaacacttgaagttcatcttgcagctgagtccaagattgatggagagagtgactggtaccggatattgtctttaggcgcctttgcagatgaagaggaggtgaagaagcaatataggaagctagctttgctgctacacccagacaagaacaagtcagttggtgctgaggaggccttcaaactgatctctgaggcatggagtgtgttgtcagatactagcaggaaggttgtttatgatgagaagcgaagaaaccattctgctgtgaacgtaaccaatggcatctatacttatgataaaaaggcaaacaagagggctcgaaagaatgccgctgctgcagctgctgccgctgccgctgccgccgccgcagcagcagcagctgaggctactactcgtcctgttggggttgatacattctggacatcttgcaaccgctgtcggatgcagtatgagtacctaagaatttatcttaatcataacctgctgtgcccaaattgccatcatgcattcttggcagtggagactgggttcccttgcaatggaagcagttcatcattctcttggtcaaccaagcagcatccgcagcagaaccacaattcgaccaagcattcatatgtctcaacaagcaggacttctagcatccctgggacagggaatggggggtaccagcaagataatacttatgattcctacaacaatcaaggcttccagtggaatcagtactccaagacaacacctgcagctggtactaatgcttatagtacacaggccttggagaaacagagaaggaagcatgatgagagctacagctacaactattctgaaagcggcaacacatatgtccatgagaaaactgcttcaaggcgtggtcgcttctcaaagcggagaaggcataattatgatgcttacactactgtggattatggtggcgataacaaagaaacagttgccgcaagcacagaaccaactgctgttttcactgatgtgggacgggtcaatggtacttcagtggaacggtttagatctgcagtgagtggaagaagagcaaatattctgggtgagattacccagattgatacacgaagtctacttcttgagaaagccaaggcaactgtctgtgaaaaattgcaggagttaaacatcacatcatttgcagaaagaaaatgttctgaaggaaagctatatccttgtgacaacaacataaaggtcaatggtgtcccctctgacaaacctggcaagggagtcaagctatgcaactcaagaagcatggaaatccaagtgcctgctactgatgataagaatccagagcagcgccgtgtacctgtgtcaattgatgtcccagaccctgacttccatgattttgataaagatcgaacggagaagactttcgatagtgatcaagtatgggctacatatgacagtgaggatggcatgcctcgcctatatgtaatggttcagaaagttctttcagtgaggcctttccggatccgcatgagttttctcaactcaaagtcaaatattgaactggcacctataaactgggttgcctctggtttccagaagacatgtggcgatttcagggtcgggagatatcaggtcagcgaaacggtcaacatattttcacacaaagtgaactggactaaaggtccccgtggcatcatcagaattgttccccagaaaggggatacatgggccttgtaccgtaactggtctcctgattggaatgagctgacacctgatgatgtgatatacaagtatgagatagtagaagttattgatgatttcaccgaggagcaagggctgactgtcattccattgctgaaggttgccggattcaaagctgtcttccacagacacatggatcccaaggaggtcaggaggataccaaaggaagagctgttccggttctcgcatcgagttccttctcgtcttctgactggtgaagaaggcaacaatgccccgaaaggttgccatgagctggaccctgctgcaactccagtggaccttcttaaggttatcacggagctcaaggaagacacgatgacacagactgctaaatag

SEQ ID NO: 2286 - protein, 729 aa, Sorghum bicolor
  misc_feature: Ceres ANNOT ID no. 6022975
  misc_feature (62)..(123): Pfam Id: DnaJ Pfam Desc: DnaJ domain
  misc_feature (1)..(729): NCBI GI: 38344577 NCBI Desc: osjnba0053b21.9 [oryza sativa (japonica cultivar-group)]
  misc_feature (1)..(729): NCBI GI: 116309347 NCBI Desc: osigba0096p03.4 [oryza sativa (indica cultivar-group)]
  misc_feature (132)..(729): NCBI GI: 115458066 NCBI Desc: os04g0388800 [oryza sativa (japonica cultivar-group)]
  misc_feature (337)..(724): NCBI GI: 92868728 NCBI Desc: aminotransferase, class-ii; heat shock protein dnaj [medicago truncatula]
  misc_feature (304)..(709): NCBI GI: 79536755 NCBI Desc: heat shock protein binding / unfolded protein binding [arabidopsis thaliana]
MDEALKAKNVAETKFHARDIRGARKYALKAQNLCPTLEGILQMVSTLEVHLAAESKIDGESDWYRILSLGAFADEEEVKKQYRKLALLLHPDKNKSVGAEEAFKLISEAWSVLSDTSRKVVYDEKRRNHSAVNVTNGIYTYDKKANKRARKNAAAAAAAAAAAAAAAAAAEATTRPVGVDTFWTSCNRCRMQYEYLRIYLNHNLLCPNCHHAFLAVETGFPCNGSSSSFSWSTKQHPQQNHNSTKHSYVSTSRTSSIPGTGNGGYQQDNTYDSYNNQGFQWNQYSKTTPAAGTNAYSTQALEKQRRKHDESYSYNYSESGNTYVHEKTASRRGRFSKRRRHNYDAYTTVDYGGDNKETVAASTEPTAVFTDVGRVNGTSVERFRSAVSGRRANILGEITQIDTRSLLLEKAKATVCEKLQELNITSFAERKCSEGKLYPCDNNIKVNGVPSDKPGKGVKLCNSRSMEIQVPATDDKNPEQRRVPVSIDVPDPDFHDFDKDRTEKTFDSDQVWATYDSEDGMPRLYVMVQKVLSVRPFRIRMSFLNSKSNIELAPINWVASGFQKTCGDFRVGRYQVSETVNIFSHKVNWTKGPRGIIRIVPQKGDTWALYRNWSPDWNELTPDDVIYKYEIVEVIDDFTEEQGLTVIPLLKVAGFKAVFHRHMDPKEVRRIPKEELFRFSHRVPSRLLTGEEGNNAPKGCHELDPAATPVDLLKVITELKEDTMTQTAK

SEQ ID NO: 2287 - DNA, 1779 bp, Sorghum bicolor
  misc_feature: Ceres ANNOT ID no. 6022977
  misc_feature: Encodes the peptide sequence at SEQ ID NO 2288
atggggacgctcggggacaggctgcgggccttctccacgaaccggtggctggtgttcgtcgccgcaatgtggctgcagtccatggccggcatcgggtacctcttcggcagcatctcgccggtcatcaaggccgcgctgggctacaaccagcgccaggtggccgcgctcggcgtcgccaaggacctcggcgactgcgtcggcttcctcgccggctccctctcggccgtgctgccgtcgtgggcgatgctgctcatcggctccgcgcagaacttcctcggctacggctggctctggctcatcatcaccaggcaggcgccggcgctgcccctctggatgatgtgtgttcttatctatgttgggaccaacggcgagacattcttcaacacaactgcacttgttacatgtatccagaacttccccaagagcagaggtccaacagtgggtattatgaaaggatttgcgggccttagcagtgcaatcttgacacaactgtatgcagtaatgcacacacctgaccatgcaacacttgtattcatggttgcagtcggtccatcattggttgccattggcctgatgtttattattaggcccgttggaggtcaccgccaggtgcgtccatccgacaagaacagcttcttgttcatctacaccatctgtttgctcctcgcctcatatcttgtcggcgttatgctagtccaagatttcatgcaactgagtgacaatgtggttttttttctcactgtggttctattcatacttcttgttttaccaatcgtgatccctgtgaccttgacactatcatccaaaacacaacatctaattgaagaggctctcctttctgaaccatcaaaaggagagacaagcacttcacaagagaaagaggatcaaccagaggtctttctaagtgaggtggaagaggagaagcctaaggacattgattcattacctccatctgaaaggagaaagaggatcgcagagttgcagaccaagttagtgcaagctgcagcaaggggtggggttagaatccggaggcgaccacgccgaggggaaaacttcaccctgatgcaggcaatggtgaaggctgatttttggcttatttggtggtcgctcctacttggatcaggatcgggtttgacagtgatcgacaatctgggtcagatgagccaggctgtggggtttaaagatgcgcatatttttgtgtcattgacgagcatatggaatttccttggtcgtgttggaggtggctacttctctgagattattgtcagggaacacacatacccaaggcacatagcgctggtaattgctcagatcctgatggctgttgggcatttcctctttgcaatggcttggcctggaactatgtacatcggaaccttcctggttggactcggatatggagctcattgggctattgtaccagctgctgtttctgaactttttggtgtaaaacacttcggtgcaatgtacaacttcctcacagttgcaaaccccacagggtcactcatcttctcaggccttattgctagtaatttgtatgactatgaagctgagaaacaagcacagcgccatcagataacagcattgacatctccaagattgcttcacaacatgggttttcttgcagatggaccactgacgtgtgaaggagctgtctgcttttttgtcagttcactgattatgtcagtgttctgtgttgttggagctggcttaagcctcatggttatttacagaaccaaaagggtttatactcacctctacagttcaaaccgcacatga

SEQ ID NO: 2288 - protein, 592 aa, Sorghum bicolor
  misc_feature: Ceres ANNOT ID no. 6022977
  misc_feature (15)..(262): Pfam Id: Nodulin-like Pfam Desc: Nodulin-like
  misc_feature (1)..(591): NCBI GI: 115458064 NCBI Desc: os04g0388700 [oryza sativa (japonica cultivar-group)]
  misc_feature (1)..(591): NCBI GI: 116309346 NCBI Desc: osigba0096p03.3 [oryza sativa (indica cultivar-group)]
  misc_feature (3)..(592): NCBI GI: 9757793 NCBI Desc: nodulin-like protein [arabidopsis thaliana]
  misc_feature (3)..(567): NCBI GI: 3329368 NCBI Desc: nodulin-like protein [arabidopsis thaliana]
  misc_feature (113)..(591): NCBI GI: 30678455 NCBI Desc: nodulin family protein [arabidopsis thaliana]
  misc_feature: The sequence is a functional homolog of SEQ ID NO. 454 in the 11/188,298 US application
MGTLGDRLRAFSTNRWLVFVAAMWLQSMAGIGYLFGSISPVIKAALGYNQRQVAALGVAKDLGDCVGFLAGSLSAVLPSWAMLLIGSAQNFLGYGWLWLIITRQAPALPLWMMCVLIYVGTNGETFFNTTALVTCIQNFPKSRGPTVGIMKGFAGLSSAILTQLYAVMHTPDHATLVFMVAVGPSLVAIGLMFIIRPVGGHRQVRPSDKNSFLFIYTICLLLASYLVGVMLVQDFMQLSDNVVFFLTVVLFILLVLPIVIPVTLTLSSKTQHLIEEALLSEPSKGETSTSQEKEDQPEVFLSEVEEEKPKDIDSLPPSERRKRIAELQTKLVQAAARGGVRIRRRPRRGENFTLMQAMVKADFWLIWWSLLLGSGSGLTVIDNLGQMSQAVGFKDAHIFVSLTSIWNFLGRVGGGYFSEIIVREHTYPRHIALVIAQILMAVGHFLFAMAWPGTMYIGTFLVGLGYGAHWAIVPAAVSELFGVKHFGAMYNFLTVANPTGSLIFSGLIASNLYDYEAEKQAQRHQITALTSPRLLHNMGFLADGPLTCEGAVCFFVSSLIMSVFCVVGAGLSLMVIYRTKRVYTHLYSSNRT

SEQ ID NO: 2289 - DNA, 1782 bp, Sorghum bicolor
  misc_feature: Ceres ANNOT ID no. 6022983
  misc_feature: Encodes the peptide sequence at SEQ ID NO 2290
atgggcaagctcggggagaaggtgagggcgttctggaggaaccgatggctggtgttcgtgggcgccatgtggatgcagtccatggccgggacgacgtacatcttcggcgccatctcgccggtggtcaaggccaggctgggctacgaccagcggcaggtagcggcgctgggcgtcgccaagaacctcgggggctgcctcggcctcctcgccggcacgctctcggcgacgtggccgccgtgggcgctgctcgccatcggcgccgcgcagaacttcgccggctacggatggctctggctcgtcgtcgacgggaaggcgccggcactgcccctctggctgatgtgtgttgttatctttattggaacaaatggccagacgtatatgatcacggcttcactcgttacaagcatccagaatttccccaagagcaggggcccaacagtgggtatcctcaagggatttatgggcctaacaagcgccattctgacacaagtttatacagtattgaacacaccagaccatgctgcgcttatattcatggttgctgttggtccatcgctggttgccgttggcttgatgtttgttattaggcctgttggaggtcacaggcaggtacggccatctgacaagaacagcttcatgttcatctacaccgtatgcttgctcatcgcctcataccttgtcggtgccatgcttgttcaagatttcctgcaaccgagctatgatgtgattgtttttctcactgtgattctgttcgtcctccttatttcaccaatcacaatccctgtgatcctgtcgttaacaccggaaaaagctcaacatctcatggaagatggtctcctgtctgaaccattgacaggagaggcgagcacttcacaacaaaaggaggatcaaccagaggtcattttaagtgaggtagaagaggagaagtctaaggaaactgattcattaccaccatctgaaaggaggaagaggattgcagaattgcaggccaagcttgtggaagcagcagcaagaggtggggttagaatcaaaagaaggccacaccgaggggacaacttcaccctgatgcaggcatttgtgaaggctgatttttggcttatttggctatcacttttgcttgggtcgggatcagggctgacagtgatggacaacctgggtcagatgagccaggctattggttacaaaaacgcacatatctttgtgtcactgatgagcatatggaacttccttggtcgtgttggaggtggctacttctctgagatcattgtcagggagcataaatacccaaggcacatagcattgacagtttgtcagatcgtgatggctgttgggcatgtactatttgctatggcttggcctggaactatgtacattgcgagcttgctggttggacttggatatggagctcactgggctattgtgccagctgctgtctctgagctttttggtgtacaacactttggtgcgatgtacaattttctcatactagcaaaccctgcaggatcgttcatcttctcagagctaattgtcagtaacttctatgaacatgaagctgagaaacaagctcaccaacatcagatgtcagcattgctgtctccacgattgcttcgcaacacgggctttcttgccgatggaccactgaagtgtgaagggcctgcttgcttctttttcagctctctgattatgtcagtgttctgtgctgttgctgctggcttgagcctcctcgttgtccacaggaccaaacaagtttatcctcgcctctatagttctgtccggacttga

SEQ ID NO: 2290 - protein, 593 aa, Sorghum bicolor
  misc_feature: Ceres ANNOT ID no. 6022983
  misc_feature (15)..(262): Pfam Id: Nodulin-like Pfam Desc: Nodulin-like
  misc_feature: The sequence is a functional homolog of SEQ ID NO. 454 in the 11/188,298 US application
MGKLGEKVRAFWRNRWLVFVGAMWMQSMAGTTYIFGAISPVVKARLGYDQRQVAALGVAKNLGGCLGLLAGTLSATWPPWALLAIGAAQNFAGYGWLWLVVDGKAPALPLWLMCVVIFIGTNGQTYMITASLVTSIQNFPKSRGPTVGILKGFMGLTSAILTQVYTVLNTPDHAALIFMVAVGPSLVAVGLMFVIRPVGGHRQVRPSDKNSFMFIYTVCLLIASYLVGAMLVQDFLQPSYDVIVFLTVILFVLLISPITIPVILSLTPEKAQHLMEDGLLSEPLTGEASTSQQKEDQPEVILSEVEEEKSKETDSLPPSERRKRIAELQAKLVEAAARGGVRIKRRPHRGDNFTLMQAFVKADFWLIWLSLLLGSGSGLTVMDNLGQMSQAIGYKNAHIFVSLMSIWNFLGRVGGGYFSEIIVREHKYPRHIALTVCQIVMAVGHVLFAMAWPGTMYIASLLVGLGYGAHWAIVPAAVSELFGVQHFGAMYNFLILANPAGSFIFSELIVSNFYEHEAEKQAHQHQMSALLSPRLLRNTGFLADGPLKCEGPACFFFSSLIMSVFCAVAAGLSLLVVHRTKQVYPRLYSSVRT

SEQ ID NO: 2291 - DNA, 213 bp, Sorghum bicolor
  misc_feature: Ceres ANNOT ID no. 6023019
  misc_feature: Encodes the peptide sequence at SEQ ID NO 2292
atgctggactgggcgccggtggtggtgggcgtcgtgctcttcgtgctgctctcgccgggcctgctcatcgagttccccggcctgcaccgctgggtcgacttcggcagcctccgcgtcaccggcaaggccgccaccgtccacaccatcctcttcttcgccatcttcctcatcgtcaccatggcgtgcaacctccacatctacaccggcgcctag

SEQ ID NO: 2292 - protein, 70 aa, Sorghum bicolor
  misc_feature: Ceres ANNOT ID no. 6023019
  misc_feature (1)..(69): NCBI GI: 115485585 NCBI Desc: os11g0496500 [oryza sativa (japonica cultivar-group)]
  misc_feature (2)..(67): NCBI GI: 1532167 NCBI Desc: localized according to blastn similarity to est sequences; therefore, the coding span corresponds only to an area of similarity since the initation codon and stop codon could not
  misc_feature (2)..(67): NCBI GI: 1532167 (continued) be precisely determined [arabidopsis thaliana]
  misc_feature (3)..(67): NCBI GI: 1532168 NCBI Desc: localized according to blastn similarity to est sequences; therefore, the coding span corresponds only to an area of similarity since the initation codon and stop codon could not
  misc_feature (3)..(67): NCBI GI: 1532168 (continued) be precisely determined [arabidopsis thaliana]
  misc_feature (1)..(42): NCBI GI: 10178281 NCBI Desc: katanin p80 subunit-like protein [arabidopsis thaliana]
MLDWAPVVVGVVLFVLLSPGLLIEFPGLHRWVDFGSLRVTGKAATVHTILFFAIFLIVTMACNLHIYTGA

SEQ ID NO: 2293 - DNA, 210 bp, Sorghum bicolor
  misc_feature: Ceres ANNOT ID no. 6023020
  misc_feature: Encodes the peptide sequence at SEQ ID NO 2294
atggcggactggggccccgtgatcgtggcgacggtgctgttcgtggtcctcacgccggggctgctctgcacgctgccgggccggggcagggtggcggagttcggcagcatgcacaccagcggcctcgccatcctcgtccacgccgtcctctacttcgcgctcatcaccatcttcctcatcgccgtcggcatccacgtctacgcgggctag

SEQ ID NO: 2294 - protein, 69 aa, Sorghum bicolor
  misc_feature: Ceres ANNOT ID no. 6023020
  misc_feature (1)..(69): NCBI GI: 115485585 NCBI Desc: os11g0496500 [oryza sativa (japonica cultivar-group)]
  misc_feature (2)..(67): NCBI GI: 1532168 NCBI Desc: localized according to blastn similarity to est sequences; therefore, the coding span corresponds only to an area of similarity since the initation codon and stop codon could not
  misc_feature (2)..(67): NCBI GI: 1532168 (continued) be precisely determined [arabidopsis thaliana]
  misc_feature (3)..(67): NCBI GI: 1532167 NCBI Desc: localized according to blastn similarity to est sequences; therefore, the coding span corresponds only to an area of similarity since the initation codon and stop codon could not
  misc_feature (3)..(67): NCBI GI: 1532167 (continued) be precisely determined [arabidopsis thaliana]
  misc_feature (1)..(61): NCBI GI: 10178281 NCBI Desc: katanin p80 subunit-like protein [arabidopsis thaliana]
  misc_feature: Useful for making plants with altered cell wall content and/or composition
  misc_feature: Functional homolog of the protein sequence encoded by LOCUS at5g63500
  misc_feature: Useful for making plants with altered cell wall content and/or composition
  misc_feature: Functional homolog of the protein sequence given in SEQ ID NO 13690
MADWGPVIVATVLFVVLTPGLLCTLPGRGRVAEFGSMHTSGLAILVHAVLYFALITIFLIAVGIHVYAG

SEQ ID NO: 2295 - DNA, 1398 bp, Sorghum bicolor
  misc_feature: Ceres ANNOT ID no. 6023030
  misc_feature: Encodes the peptide sequence at SEQ ID NO 2296
atggagatcgtgcgctcacaccggcaggtcgccgccgcagctgccgcagccggcggcgacggcggcggcgcgggggcgctgccgacctacaaggcggcgccgcagctcgaggtgcggctggaggagttcgagctcttcgccatcgaccgcctccgagttctcaaggggatttcggatggactctcgcgggggaagaggcccgaggagatggagaaactggtcagtgaattgtggaagacatacatgaggcaccaggatcctgcagagactttgaacaaggatataatatcacactttgtgctccgcctagtctactgcagaacggaagaattgcgaaagtggtttctctccatggagactgcactttttcggtatcgctttcggcttgagagtcctgaatcacagaggatgcttatgactgagtttcaactgccatacaaagcactgccacactcagagtttgaggctgtgaaagacaagttgagccaagttgcgcgttccatcggtcaatctgcaaatgtggagcatgtgttcttcaaggtaccttttgaagaagttcctgatcttgttgccagccgccgggtatttctttcaaaaggctatgcttatgtggcgatgagccaggtggtttcgctagtggttactcaattccgctgcaatatctcaaaggcacttgctttaacaaacagaaaatggacagcaaccattaaagaacaagaaaaaggcaggttgactcctattgtcgaagcattaagtaatgcatattttggtcctgattactctcagccaaaggatactgttgacatatctctaaaggatattgaccaactggctaaaagttctttccctctttgtatgcggcatatgctagataagttgagagaaaatcaccatctgaagcatgggggtagaatgcagtttggtctttttcttaagggtgctggactaaagttggaagatgctcttgcattttggagggcggaattttctcagaaggttggttctgagcggtttgacaaggaatatgcctataccatcagacataattatggaaaagaaggaaaacggacagattacacaccatattcatgtcaaaagatcatttctgcaacacctggtgttggagatcaccatggatgcccgtttcgacatttcggcgaagaaaatttgcgggcagcactcaacaaaatgggcgttggtgggcatgcattggaagagataatggataaagtgaagaacaggcattaccagctagcttgcacattaacctttgagaccacacacggtgtctcctgtgattctggaatcaaccatccaaatcaatatttcagtgaaagccagaaaattctgcgagccaaaaaccaaacaatggagagccaatcacaatcagcaacctaa

SEQ ID NO: 2296 - protein, 465 aa, Sorghum bicolor
  misc_feature: Ceres ANNOT ID no. 6023030
  misc_feature (177)..(443): Pfam Id: DNA_primase_lrg Pfam Desc: Eukaryotic and archaeal DNA primase, large subunit
  misc_feature (1)..(456): NCBI GI: 140055862 NCBI Desc: eukaryotic-type dna primase, large subunit [medicago truncatula]
  misc_feature (1)..(453): NCBI GI: 42563014 NCBI Desc: dna primase, large subunit family [arabidopsis thaliana]
  misc_feature (309)..(453): NCBI GI: 9828626 NCBI Desc: f1n21.14 [arabidopsis thaliana]
  misc_feature (26)..(465): NCBI GI: 118601788 NCBI Desc: primase, polypeptide 2a, 58kda [bos taurus]
  misc_feature (26)..(465): NCBI GI: 442472 NCBI Desc: dna primase large subunit p58 [mus musculus]
MEIVRSHRQVAAAAAAAGGDGGGAGALPTYKAAPQLEVRLEEFELFAIDRLRVLKGISDGLSRGKRPEEMEKLVSELWKTYMRHQDPAETLNKDIISHFVLRLVYCRTEELRKWFLSMETALFRYRFRLESPESQRMLMTEFQLPYKALPHSEFEAVKDKLSQVARSIGQSANVEHVFFKVPFEEVPDLVASRRVFLSKGYAYVAMSQVVSLVVTQFRCNISKALALTNRKWTATIKEQEKGRLTPIVEALSNAYFGPDYSQPKDTVDISLKDIDQLAKSSFPLCMRHMLDKLRENHHLKHGGRMQFGLFLKGAGLKLEDALAFWRAEFSQKVGSERFDKEYAYTIRHNYGKEGKRTDYTPYSCQKIISATPGVGDHHGCPFRHFGEENLRAALNKMGVGGHALEEIMDKVKNRHYQLACTLTFETTHGVSCDSGINHPNQYFSESQKILRAKNQTMESQSQSAT

SEQ ID NO: 2297 - DNA, 549 bp, Sorghum bicolor
  misc_feature: Ceres ANNOT ID no. 6023074
  misc_feature: Encodes the peptide sequence at SEQ ID NO 2298
atggcgtgccgcgcactggccctccgctccctgctcctccccgaaccgctccaccgcctcccggccgcggtgccgcctgttgggagggcgccccgtggcggccgccgtccgcatctccgctgctgctccggcggcggcggcggggaccccgggcagccgccgcaagaagctgtgctcgaggccatatccaagatcgcaaggtctaaaggaagggttgcactcacaacaaatatggtcatgggtggtactgtgacggatgatgcaagtgatgaatggcttgttctggatcagaaggtaaattcctaccccacagatagaggatttacggcaattggcactggaggtgatgattttgtccagtcaatggtagttgctgttgaatctgttcttcaagaatccattcccaagggccgggtatctcagaaattatcttcaagaggaaaatatgtttctgtaaacattgggccaattcgtgttgtttctagtgagcaggtccaagctgtgtatcgtgccatgagaagagataacaggatgaaatacttcttatga

SEQ ID NO: 2298 - protein, 182 aa, Sorghum bicolor
  misc_feature: Ceres ANNOT ID no. 6023074
  misc_feature (3)..(139): NCBI GI: 38347226 NCBI Desc: osjnba0044m19.8 [oryza sativa (japonica cultivar-group)]
  misc_feature (20)..(142): NCBI GI: 115458042 NCBI Desc: os04g0386500 [oryza sativa (japonica cultivar-group)]
  misc_feature: The plant produces a reduced number of seeds.
  misc_feature: Useful for biocontainment applications
  misc_feature: GREAT-hit functional homolog of the protein sequence given in SEQ ID NO 13158
  misc_feature: Useful for biocontainment applications
  misc_feature: Functional homolog of the protein sequence given in SEQ ID NO 13158
MACRALALRSLLLPEPLHRLPAAVPPVGRAPRGGRRPHLRCCSGGGGGDPGQPPQEAVLEAISKIARSKGRVALTTNMVMGGTVTDDASDEWLVLDQKVNSYPTDRGFTAIGTGGDDFVQSMVVAVESVLQESIPKGRVSQKLSSRGKYVSVNIGPIRVVSSEQVQAVYRAMRRDNRMKYFL

SEQ ID NO: 2299 - DNA, 810 bp, Sorghum bicolor
  misc_feature: Ceres ANNOT ID no. 6023183
  misc_feature: Encodes the peptide sequence at SEQ ID NO 2300
atggctgacgagtacggccgcagcggctacggcaggtccggcgccggcgacgactacgacagcggctacaacagcaagtccaggactgatgactacggccgtggcgaaggtggctacaacgagtccggcggcgacgactacggccgccgcagtggcggcgatgggtacgacaggtccggcggcgacgactacggccgtggcaccggcggcggtgggtacaacaagtccggcaaggacgactacgacggtgggtacaacaaatcgggcaccaacgacgacgagtacggccgccgtggcaccggcggcgggtacaacagcaagtcctctggcgatgacgcgtacaccggcggcgccgggtacaacagcaagtcctctggcgacgacgacgcatacaccggcgtcgggtacaacagcaagtcctctggcgacgacgcatacaccggcggcgggtacaacagaaagtccggtggcgcggacgacggcgagtacggttcctcccgggacgacgacgactcggagatgtacaggaaggaggagaaagagcacaagcacaaggagcacctcggcgagatgggcgccctcgccgccggcgccttcgccctgtacgagaggcacgaggcgaagaaggacccggagcacgcgcagcggcacaagatcgaggagggcgtggcggcggtggcggcgctgggcagcggcggcttcgcgttccacgagcaccacgacaagaaggaggccaaggacgcggcggaggacgccgaggaggagtccggacgcggcgaggggaagaagaagcaccacttcttcggctga

SEQ ID NO: 2300 - protein, 269 aa, Sorghum bicolor
  misc_feature: Ceres ANNOT ID no. 6023183
  misc_feature (173)..(252): Pfam Id: ABA_WDS Pfam Desc: ABA/WDS induced protein
  misc_feature (30)..(269): NCBI GI: 116309406 NCBI Desc: osigba0076i14.3 [oryza sativa (indica cultivar-group)]
  misc_feature (18)..(269): NCBI GI: 92876282 NCBI Desc: aba/wds induced protein [medicago truncatula]
  misc_feature (108)..(269): NCBI GI: 115458392 NCBI Desc: os04g0423400 [oryza sativa (japonica cultivar-group)]
  misc_feature (55)..(269): NCBI GI: 38679405 NCBI Desc: abscisic stress ripening-like protein [glycine max]
  misc_feature (20)..(268): NCBI GI: 607905 NCBI Desc: abscisic stress ripening protein
MADEYGRSGYGRSGAGDDYDSGYNSKSRTDDYGRGEGGYNESGGDDYGRRSGGDGYDRSGGDDYGRGTGGGGYNKSGKDDYDGGYNKSGTNDDEYGRRGTGGGYNSKSSGDDAYTGGAGYNSKSSGDDDAYTGVGYNSKSSGDDAYTGGGYNRKSGGADDGEYGSSRDDDDSEMYRKEEKEHKHKEHLGEMGALAAGAFALYERHEAKKDPEHAQRHKIEEGVAAVAALGSGGFAFHEHHDKKEAKDAAEDAEEESGRGEGKKKHHFFG

SEQ ID NO: 2301 - DNA, 306 bp, Sorghum bicolor
  misc_feature: Ceres ANNOT ID no. 6023185
  misc_feature: Encodes the peptide sequence at SEQ ID NO 2302
atggccgaggagaagcaccaccatcacctgttccaccaccgcaaggaggaggagagctccggcgaggtcgactacgaaaagaaggagaagcaccacaagcacttggagcagctcggcgagctcggcaccattgccgccggcgcatatgctctgcatgagaagcacaaggccaagaaggacccggagaacgagcacggccaccggatcaaggaggaggtggccgccgtcgccgccgtgggctccgctgggttcgccttccacgagcaccacgagaagaaggacgccaagaagcatggccacaactga

SEQ ID NO: 2302 - protein, 101 aa, Sorghum bicolor
  misc_feature: Ceres ANNOT ID no. 6023185
  misc_feature (23)..(102): Pfam Id: ABA_WDS Pfam Desc: ABA/WDS induced protein
  misc_feature (1)..(97): NCBI GI: 4098250 NCBI Desc: similar to solanum tuberosum ci21a gene product encoded by the sequence presented in genbank accession number u76610
  misc_feature (1)..(97): NCBI GI: 32395657 NCBI Desc: asr2 [lycopersicon hirsutum]
  misc_feature (1)..(97): NCBI GI: 4098248 NCBI Desc: cold inducible; similar to other osmotic stress induced gene products including: tomato abscisic stress ripening protein 1 encoded by genbank accession number l08255, solanum
  misc_feature (1)..(97): NCBI GI: 4098248 (continued) lycopersicum aba- and ripening-induced protein encoded by genbank accession number l20756 and to solanum chacoense abscisic stress ripening protein encoded by genbank accession number u12439
  misc_feature (1)..(97): NCBI GI: 4098248 (continued) [solanum tuberosum]
  misc_feature (1)..(99): NCBI GI: 32395659 NCBI Desc: asr2 [lycopersicon peruvianum var. humifusum]
  misc_feature (1)..(97): NCBI GI: 81075517 NCBI Desc: fruit-ripening protein-like [solanum tuberosum]
MAEEKHHHHLFHHRKEEESSGEVDYEKKEKHHKHLEQLGELGTIAAGAYALHEKHKAKKDPENEHGHRIKEEVAAVAAVGSAGFAFHEHHEKKDAKKHGHN

SEQ ID NO: 2303 - DNA, 2016 bp, Sorghum bicolor
  misc_feature: Ceres ANNOT ID no. 6023255
  misc_feature: Encodes the peptide sequence at SEQ ID NO 2304
atgccaaggtctgaatcagacagtgatgatgttttcttcgatgcatttgaagatgttagatctccaggggaaccttcatgttcagaggattgcagcacaagtcatgaagtttcaccagtgccaatgaagtttgagtatgagatttgggcaaacgagccaatgagtgttcaagaaaggcggcaaaggttccttaagggaatgggattcgatgattttttgtctgccagaacagattcttttcaatgccatggtgaaatcacagccgttgagtcttccactgacatggaggagagaagtgtcagtgtccattcttccctggattcatctgtttgtgacaatgaatcggagtttgacggtgcctgttgcataagggatatggatagtggaaagagatatattgtcaacagtggtgcacatagcagtataacggacatgctcaaggaggttggatcagataaggtgatgtctcttctggagtttgagagtttgcttggcctctctcggtctgttcagaaattgttgcggaggggatgtggtaacagtcctgcaaaagaaacaaaaagttctaagaaaaaggatgtcaaaagcttgtggaagaaattcacgacaaagagaagctttggtagcatttgcaagtatgatgtccatgtgaaaaattgcacaaatagtataccaaccagaacaagagttcaaaatcggaagaaaaattttcttgaattctctgctgtctacatggatcaagaaatcagagctcacaagggttcaattagggtcatgaaattcagcccatctggatggtatttagcaagtggtggtgaggattgtgttgtacggatatggcaaatcatagaagtagaagcatctcctaagttgtataggggagaggattcctatgaaaaggtggagaaagttccggtctttaagtcaaatatagaaaagaggcagcaccagacacttgcagttatacccaagaaggtttttcgtatatcagagactccattacatgaattccgcggccatacaaatgatatccttgatatggcatggtccaaatcagattatctcttaacttcatctaaagataagacagtgcgcttatggaaacctggctgtgatggttgtcttgcagttttcaaacacaaagactatgtaacatgtgttcaattcaaccctattgatgagaaatacttcatcagcggttcattagatggtaaagtgcgcatttgggatgtgttggacaagcgagtaacggactgggctgatacacggaatatcataactgctttgagctaccaaccagatggaaagggttttattgttggcacgattgcaggcacatgtcgcttctatgatcaatcaggtgaaaacatccagctagagaaagaattgtttgtgcaagggaagaaaaagtcagctgccagtcggatcaacagtctacagttatgtacaagtgattccaatgggattataattacatcaggagattccaaaatccgagtcgccgatggtgataccatccaaaagtttgaagggccttggaagtcgaaagctctatcatcaccgtctttaacatcagacggcaaatatcttatatctgccggcaaagattccaatgtctatatttggaactttgcgaattctggagatgcaaaatcagttcattcatgtgagctgttcttctccaaagatgtgactaccgcagtaccatggccaggagtgcaccaagatgggcacacgaaaccttcctgcttgactgagaaaccctccagcgcgcccattttgcgccaccacgaggagtgccagtcccctgggccgtggtcgttcatggactgcagcaagggaacggcaacatggcctgaagagaacttgccttctacagcaaagtctgaaagcagcccgaaggtgggtgactgcctctccctggtatccgctgcgtggagcacggtcatagtgaccgccagccgcgatggcgtgatccgatcttttcccaactacggcttgcccgttagattgtga

SEQ ID NO: 2304 - protein, 671 aa, Sorghum bicolor
  misc_feature: Ceres ANNOT ID no. 6023255
  misc_feature (243)..(281): Pfam Id: WD40 Pfam Desc: WD domain, G-beta repeat
  misc_feature (331)..(368): Pfam Id: WD40 Pfam Desc: WD domain, G-beta repeat
  misc_feature (372)..(410): Pfam Id: WD40 Pfam Desc: WD domain, G-beta repeat
  misc_feature (1)..(671): NCBI GI: 116310811 NCBI Desc: osigba0092m08.13 [oryza sativa (indica cultivar-group)]
  misc_feature (1)..(671): NCBI GI: 115458340 NCBI Desc: os04g0417800 [oryza sativa (japonica cultivar-group)]
  misc_feature (1)..(661): NCBI GI: 32488162 NCBI Desc: osjnba0033g16.13 [oryza sativa (japonica cultivar-group)]
  misc_feature (166)..(625): NCBI GI: 92897856 NCBI Desc: wd40-like [medicago truncatula]
  misc_feature (87)..(671): NCBI GI: 92898868 NCBI Desc: wd-40 repeat [medicago truncatula]
  misc_feature: The sequence is a functional homolog of SEQ ID NO. 502 in the 11/188,298 US application
  misc_feature: The sequence is a functional homolog of SEQ ID NO. 485 in the 11/188,298 US application
MPRSESDSDDVFFDAFEDVRSPGEPSCSEDCSTSHEVSPVPMKFEYEIWANEPMSVQERRQRFLKGMGFDDFLSARTDSFQCHGEITAVESSTDMEERSVSVHSSLDSSVCDNESEFDGACCIRDMDSGKRYIVNSGAHSSITDMLKEVGSDKVMSLLEFESLLGLSRSVQKLLRRGCGNSPAKETKSSKKKDVKSLWKKFTTKRSFGSICKYDVHVKNCTNSIPTRTRVQNRKKNFLEFSAVYMDQEIRAHKGSIRVMKFSPSGWYLASGGEDCVVRIWQIIEVEASPKLYRGEDSYEKVEKVPVFKSNIEKRQHQTLAVIPKKVFRISETPLHEFRGHTNDILDMAWSKSDYLLTSSKDKTVRLWKPGCDGCLAVFKHKDYVTCVQFNPIDEKYFISGSLDGKVRIWDVLDKRVTDWADTRNIITALSYQPDGKGFIVGTIAGTCRFYDQSGENIQLEKELFVQGKKKSAASRINSLQLCTSDSNGIIITSGDSKIRVADGDTIQKFEGPWKSKALSSPSLTSDGKYLISAGKDSNVYIWNFANSGDAKSVHSCELFFSKDVTTAVPWPGVHQDGHTKPSCLTEKPSSAPILRHHEECQSPGPWSFMDCSKGTATWPEENLPSTAKSESSPKVGDCLSLVSAAWSTVIVTASRDGVIRSFPNYGLPVRL

SEQ ID NO: 2305 - DNA, 2367 bp, Sorghum bicolor
  misc_feature: Ceres ANNOT ID no. 6023284
  misc_feature: Encodes the peptide sequence at SEQ ID NO 2306
  misc_feature: Up-regulated in shoot tissues in response to salicylic acid treatment
  misc_feature: Up-regulated in root tissues in response to salicylic acid treatment
atgggtagtaataaggaagagacgccgccggccgacggaggcggcgccttcgccttcatctccaaggggtggcgcgaggtgcgggactcggcgtccgcggacctgcgcctcatgcgggcccgcgcggactccgtgcgcgcccgcgccgaccgcgagctcgagcacctcctcgcgtccgcgtcggcgctcgcggcggggcccgcgcccccgctgctgccgcccgtggccacgggggcgcccatcgcggaggtcgagttcgtgcgcaagcggatccagcccaagattcaggagctccggtcgcgggcgctcgacgcccggtggccgaccggggccgctggcgccggcgccggcgccagagccagcagcctccgcatcgacctctcggcgattacggccattcgcaacgccgttgtggcagaaggggaaggcggcgataggtggaggaggatcgcgcggcggaagggggaccaggatgaggatgaggaggaggggaggaaggagtgggaggtggtccggatgatacagcgcgggctcaaggagttcgagcgccggagcctgtccagcgacatgtttgctggattccgtgcccgtggcgagtttgtggagaaatttaagttgagcacgaaatcactgaacaaagactatcaggaatccaaggaagttccaccactgcatctaactgaaattctggcatatctggttcggcaatctgggccatttttagatcaactttgcatacggagagacctttgtgacaaactagtggagatgttatacagtaaacgaaatggtcggctcatgtatcattctctttcacaggatagacccttagctgagaacatgactgatgagcttgatctaagaatagctagggtattagaaagtactggttatcacacagatgaaggtttttggaatgaccctgcaaagtacaagatctcagacaacagacggcatgttgctattgtcaccacagcaagccttccatggatgacaggaacagcaatcaatccattatttcgtgctgcatatctggcaagaagtgcaaagcaaaaggtgacattggtggttccatggctctctaagtcagatcaagaattggtttacccaaataacatcaccttcagttcgccagaagagcaagaaacttatataaggaactggctgcaggaaagaattggctttgaagcaatttttaagatatccttttatcctggcaagttctcaaaagagcgccgcagcattattcctgctggcgatacttcacagttcatctcctcaaaagaagctgatatagcgattttagaagaaccagagcatctcaattggtatcatcatggaaagcgttggactgacaagttcaatcatgtcatcggtgtagttcatacaaattatctggaatatatcaagagagagaaaaatggtgctattcaatcttttcttgttaaacatatcaataactgggtgactagagcatactgccataaggttttacgtctttctgctgcaactcaagatctaccgaggtctgttgtttgtaacgtacatggtgtaaatccaaagtttcttaatgttggtgcgaaaatagcagctgatagggagtgtggacagaaggtcttttctaagggagcatatttccttggtaagatggtgtgggctaaaggttatagagagctgatcgatttattatccaaacacaaaaacgacctggaaggattcatgatagatgtatatggaaatggggaggattctgaagctgtccagaatgctgctaggaaatttgatttgagcatcaattttttcaagggaaaggaccatgcagatgattcactccatgggtataaggttttcgtcaatccaagtgttagtgatgtgctatgcacagcaacagctgaggcccttgcaatggggaaatttgtagtctgtgcagatcatccatcaaacgatttttttaagtcattccctaactgcttaacatatagaacttcagaggaatttgttgctcgtgtcaaagaagctatgactactgaacctcaacctctgaccccagagcaacgatacaatttgtcatgggaggcagcaactgagaggtttatggagtactcagagcttgacaaagttctgaacagaaatggccaccctggaagaaatgggaagattaacaaagcaagaaagataccgttacttcctaaattgtcagatgtggtggatgggggactggcatttgctcatcactgcctgactggtaacgaaatcctcaggttagcgacgggagcaattcctggtacacgtgactatgataaacagcagtgcatggatctgaacctcctgcctcctcaagttcaacaccctgtatatggctggtga

SEQ ID NO: 2306 - protein, 788 aa, Sorghum bicolor
  misc_feature: Ceres ANNOT ID no. 6023284
  misc_feature (531)..(691): Pfam Id: Glycos_transf_1 Pfam Desc: Glycosyl transferases group 1
  misc_feature (6)..(788): NCBI GI: 116310807 NCBI Desc: osigba0092m08.9 [oryza sativa (indica cultivar-group)]
  misc_feature (1)..(788): NCBI GI: 49617333 NCBI Desc: digalactosyldiacylglycerol synthase 1 [lotus corniculatus var. japonicus]
  misc_feature (7)..(788): NCBI GI: 49617329 NCBI Desc: digalactosyldiacylglycerol synthase 1 [glycine max]
  misc_feature (8)..(788): NCBI GI: 76800640 NCBI Desc: digalactosyldiacylglycerol synthase 1 [vigna unguiculata]
  misc_feature (16)..(788): NCBI GI: 6041825 NCBI Desc: digalactosyldiacylglycerol synthase [arabidopsis thaliana]
  misc_feature (1)..(788): SWISSPROT Homolog: EC 2.4.1.241 Digalactosyldiacylglycerol synthase 1, chloroplast precursor
  misc_feature: Up-regulated in shoot tissues in response to salicylic acid treatment
  misc_feature: Up-regulated in root tissues in response to salicylic acid treatment
MGSNKEETPPADGGGAFAFISKGWREVRDSASADLRLMRARADSVRARADRELEHLLASASALAAGPAPPLLPPVATGAPIAEVEFVRKRIQPKIQELRSRALDARWPTGAAGAGAGARASSLRIDLSAITAIRNAVVAEGEGGDRWRRIARRKGDQDEDEEEGRKEWEVVRMIQRGLKEFERRSLSSDMFAGFRARGEFVEKFKLSTKSLNKDYQESKEVPPLHLTEILAYLVRQSGPFLDQLCIRRDLCDKLVEMLYSKRNGRLMYHSLSQDRPLAENMTDELDLRIARVLESTGYHTDEGFWNDPAKYKISDNRRHVAIVTTASLPWMTGTAINPLFRAAYLARSAKQKVTLVVPWLSKSDQELVYPNNITFSSPEEQETYIRNWLQERIGFEAIFKISFYPGKFSKERRSIIPAGDTSQFISSKEADIAILEEPEHLNWYHHGKRWTDKFNHVIGVVHTNYLEYIKREKNGAIQSFLVKHINNWVTRAYCHKVLRLSAATQDLPRSVVCNVHGVNPKFLNVGAKIAADRECGQKVFSKGAYFLGKMVWAKGYRELIDLLSKHKNDLEGFMIDVYGNGEDSEAVQNAARKFDLSINFFKGKDHADDSLHGYKVFVNPSVSDVLCTATAEALAMGKFVVCADHPSNDFFKSFPNCLTYRTSEEFVARVKEAMTTEPQPLTPEQRYNLSWEAATERFMEYSELDKVLNRNGHPGRNGKINKARKIPLLPKLSDVVDGGLAFAHHCLTGNEILRLATGAIPGTRDYDKQQCMDLNLLPPQVQHPVYGW

SEQ ID NO: 2307 - DNA, 1278 bp, Sorghum bicolor
  misc_feature: Ceres ANNOT ID no. 6023303
  misc_feature: Encodes the peptide sequence at SEQ ID NO 2308
atgtcggaaggcgcccggccggcggccgccgcgcggcagatcgtgaagtcgctacagcgatgcggacggctctctctggagcgtccgcccttcggcgctgctctcggcgactatcaccagttcccccggccgtcgccgtcacctgctgctgcagcggcagcggcagcgacccccggcggtcgcgaagaatttgatgagggtatcgtcatcaggacgccgataaaaagaaaagctccctatggagaatgtgatactgctgagtcaaccggattgagtatggccagttctgggttcattcaaggagttggcagtccacgaatgaccccaatttctggaaatactgctaggaaatacaagtcatcaaagtctgaatacaccaaagctggacctcagacacccacattaaatgctgcaggttcacctggcaacccacctactcctgctgcactgttgacaaaaaagttcatcaatctgctcaaggaggctgaagatggaattttagatttgaacagcacagttaaaaagaggcgcatttatgacattacaaatgtccttgaaggaagtggtctgatagaaaagaagttgaagaacagaatctgttggaagggtttggataaattgggacctaacttggatgatgatctttcagttctgaagacagattttggaaatcttaatctacaggagcaagcattagatgaacatataagtaaaatacaggaaaagctgaaggacttaactgaagatgaaagcaacaaggggtggctatttcatactgaagatgacatcatgggggtgcgctgctttcagaaccaaacactaattgcaataaaagcacctcaagggtcttctttggaagtgcccaatcctgatgtgatgattggcgatagccttcaaaggagatatagactagtaatacggagtacaatgggtccaattgatctttacttggttagtaaaactgaagaaaaaatggagggaaagctgggtgatgctgcagaaccagcagggcacacagatgtggcgaagcatggctccatagaacgccccagtgcaaaaagagcttgggaaaggagtagaaaggaggaggtggcgcttaaggctcagaagactcagaaaactccagatctaaatcccccatgtcattctgaaggagtgctgaggaggattaatccttcagatgttgacagtggagcagactacttgctgcttacagactatgatgttagcatcactgatatgtggagaacagaggaggtgcatgcctccaacttgtag

SEQ ID NO: 2308 - protein, 425 aa, Sorghum bicolor
  misc_feature: Ceres ANNOT ID no. 6023303
  misc_feature (150)..(203): Pfam Id: E2F_TDP Pfam Desc: E2F/DP family winged-helix DNA-binding domain
  misc_feature (2)..(417): NCBI GI: 116310803 NCBI Desc: osigba0092m08.5 [oryza sativa (indica cultivar-group)]
  misc_feature (2)..(417): NCBI GI: 38344033 NCBI Desc: oj991214_12.14 [oryza sativa (japonica cultivar-group)]
  misc_feature (1)..(417): NCBI GI: 5763821 NCBI Desc: e2f protein [triticum sp.]
  misc_feature (69)..(417): NCBI GI: 50251979 NCBI Desc: e2f homolog [oryza sativa (japonica cultivar-group)]
  misc_feature (69)..(417): NCBI GI: 12225043 NCBI Desc: e2f homolog [oryza sativa]
  misc_feature: The sequence is a functional homolog of SEQ ID NO. 416 in the 11/188,298 US application
MSEGARPAAAARQIVKSLQRCGRLSLERPPFGAALGDYHQFPRPSPSPAAAAAAAATPGGREEFDEGIVIRTPIKRKAPYGECDTAESTGLSMASSGFIQGVGSPRMTPISGNTARKYKSSKSEYTKAGPQTPTLNAAGSPGNPPTPAALLTKKFINLLKEAEDGILDLNSTVKKRRIYDITNVLEGSGLIEKKLKNRICWKGLDKLGPNLDDDLSVLKTDFGNLNLQEQALDEHISKIQEKLKDLTEDESNKGWLFHTEDDIMGVRCFQNQTLIAIKAPQGSSLEVPNPDVMIGDSLQRRYRLVIRSTMGPIDLYLVSKTEEKMEGKLGDAAEPAGHTDVAKHGSIERPSAKRAWERSRKEEVALKAQKTQKTPDLNPPCHSEGVLRRINPSDVDSGADYLLLTDYDVSITDMWRTEEVHASNL

SEQ ID NO: 2309 - DNA, 354 bp, Sorghum bicolor
  misc_feature: Ceres ANNOT ID no. 6023308
  misc_feature: Encodes the peptide sequence at SEQ ID NO 2310
atgaggagtctctttgtggtcgctctgatgatcgtggccgcggcctgcatcgccgcgccgcggggtgccgacggcgcgggcgagtgcggggcgacgccgccggacatgatggcgctgaagctggcgccgtgcgcgtcggcggcggaggaccccagctccgcgccgtctagctcctgctgcggcgcggtgcacagcatcgggaagcagagccccaagtgcctctgcgccgtcatgctgtccaacactgccaagagcgccgggatcaaggctgaggtcgccatcaccatccccaaacgctgcaacctcgtcgaccgccccgtcggctacaagtgcggagattacactctgccatga

SEQ ID NO: 2310 - protein, 117 aa, Sorghum bicolor
  misc_feature: Ceres ANNOT ID no. 6023308
  misc_feature (29)..(111): Pfam Id: Tryp_alpha_amyl Pfam Desc: Protease inhibitor/seed storage/LTP family
  misc_feature (1)..(117): NCBI GI: 38344032 NCBI Desc: oj991214_12.12 [oryza sativa (japonica cultivar-group)]
  misc_feature (1)..(112): NCBI GI: 116310801 NCBI Desc: osigba0092m08.3 [oryza sativa (indica cultivar-group)]
  misc_feature (7)..(117): NCBI GI: 50509338 NCBI Desc: protease inhibitor-like protein [oryza sativa (japonica cultivar-group)]
  misc_feature (6)..(102): NCBI GI: 115469910 NCBI Desc: os06g0711900 [oryza sativa (japonica cultivar-group)]
  misc_feature (7)..(107): NCBI GI: 25553602 NCBI Desc: protease inhibitor-like protein [oryza sativa (japonica cultivar-group)]
MRSLFVVALMIVAAACIAAPRGADGAGECGATPPDMMALKLAPCASAAEDPSSAPSSSCCGAVHSIGKQSPKCLCAVMLSNTAKSAGIKAEVAITIPKRCNLVDRPVGYKCGDYTLP

SEQ ID NO: 2311 - DNA, 351 bp, Sorghum bicolor
  misc_feature: Ceres ANNOT ID no. 6023309
  misc_feature: Encodes the peptide sequence at SEQ ID NO 2312
atgagaggactcctggtgctcgccctgctggtcgcggccgccgcgtgcctcgtggcggtgcgcggcgcggacggcgcgggcgagtgcggggcgacgccgccggacaggatggcgctgaagctggcgccgtgcgcgtcggcggcgcagaacccgagctccgcgccatccagctcctgctgcagcgcggtgcacagcatcgggaagcagagccccaagtgcctctgcgccgtcatgctgtccaagaccgccaagagcgccgggatcaaggccgaggtcgccatcaccatccccaaacgctgcaacctcgtcgaccgccccatcggctacaagtgcggaggatggagggagtag

SEQ ID NO: 2312 - protein, 116 aa, Sorghum bicolor
  misc_feature: Ceres ANNOT ID no. 6023309
  misc_feature (29)..(111): Pfam Id: Tryp_alpha_amyl Pfam Desc: Protease inhibitor/seed storage/LTP family
  misc_feature (1)..(113): NCBI GI: 116310801 NCBI Desc: osigba0092m08.3 [oryza sativa (indica cultivar-group)]
  misc_feature (1)..(114): NCBI GI: 38344032 NCBI Desc: oj991214_12.12 [oryza sativa (japonica cultivar-group)]
  misc_feature (2)..(111): NCBI GI: 50509338 NCBI Desc: protease inhibitor-like protein [oryza sativa (japonica cultivar-group)]
  misc_feature (4)..(102): NCBI GI: 115469910 NCBI Desc: os06g0711900 [oryza sativa (japonica cultivar-group)]
  misc_feature (41)..(113): NCBI GI: 92883937 NCBI Desc: plant lipid transfer protein/par allergen [medicago truncatula]
MRGLLVLALLVAAAACLVAVRGADGAGECGATPPDRMALKLAPCASAAQNPSSAPSSSCCSAVHSIGKQSPKCLCAVMLSKTAKSAGIKAEVAITIPKRCNLVDRPIGYKCGGWRE

SEQ ID NO: 2313 - DNA, 408 bp, Sorghum bicolor
  misc_feature: Ceres ANNOT ID no. 6023322
  misc_feature: Encodes the peptide sequence at SEQ ID NO 2314
atggccatggcggcgctgcgggaggcctcccgctgcctggcgtccagggggagccctgcggccgcgcgatccatgctcctcgcgcagtcgcgcggcatcacttacaagctcttcgtcggaggtttatcacaatttgcaacggaggaaagcctagcagaagcattctcacgttacggacaagtaatagaagctaccgtcgtcagggataaggtgaccgacataccaaaaggattcggcttcgtgaaatttgcctccccggaagaagccaataacgcgagggaagagatgaacggcaaggcattgaacggccgggtcatatacgtggacatcgcaaaggccaaaccggaccgtgctacagatgctctcccaatagcgagaggtcctcctaagccaattagcaacggctga

SEQ ID NO: 2314 - protein, 135 aa, Sorghum bicolor
  misc_feature: Ceres ANNOT ID no. 6023322
  misc_feature (37)..(108): Pfam Id: RRM_1 Pfam Desc: RNA recognition motif. (a.k.a. RRM, RBD, or RNP domain)
  misc_feature (1)..(131): NCBI GI: 38346331 NCBI Desc: oj000126_13.13 [oryza sativa (japonica cultivar-group)]
  misc_feature (1)..(131): NCBI GI: 116309334 NCBI Desc: h0622f05.1 [oryza sativa (indica cultivar-group)]
  misc_feature (14)..(100): NCBI GI: 115458306 NCBI Desc: os04g0414300 [oryza sativa (japonica cultivar-group)]
  misc_feature (3)..(110): NCBI GI: 92877177 NCBI Desc: rna-binding region rnp-1 (rna recognition motif) [medicago truncatula]
  misc_feature (36)..(111): NCBI GI: 45544646 NCBI Desc: cold inducible rna binding protein [danio rerio]
  misc_feature: Useful for making plants with modulated cold sensitivity
  misc_feature: GREAT-hit functional homolog of the protein sequence given in SEQ ID NO 13130
  misc_feature: Useful for making plants with modulated cold sensitivity
  misc_feature: Functional homolog of the protein sequence given in SEQ ID NO 13130
  misc_feature: The sequence is a functional homolog of SEQ ID NO. 339 in the 11/188,298 US application
  misc_feature: The sequence is a functional homolog of SEQ ID NO. 458 in the 11/188,298 US application
MAMAALREASRCLASRGSPAAARSMLLAQSRGITYKLFVGGLSQFATEESLAEAFSRYGQVIEATVVRDKVTDIPKGFGFVKFASPEEANNAREEMNGKALNGRVIYVDIAKAKPDRATDALPIARGPPKPISNG

SEQ ID NO: 2315 - DNA, 750 bp, Sorghum bicolor
  misc_feature: Ceres ANNOT ID no. 6023587
  misc_feature: Encodes the peptide sequence at SEQ ID NO 2316
atggagatggtgaaaggtaagtcgaccaaaggtaggcaaaggattgagatgaagaccatcaaaggtgaggaggcacggcaggtatccttctccaagcgccgcccaagcttattcaagaaggccagtgagctttccaccctatgcggtgcggaggttgctattgtcaccttctcccctgggggcaggtgcttctcatttggccatccgtctactttgtctgttgctgaccgcttccttgtcgagcacactttggatggcctcaccataggaagtgggagccatggtactcaaggattgacaggtacaagccatgagatgaatcatcaggttatggagttgcaacaattaatggagaccgagaagaggagtaaggagagggcagtagaggctatgaagagggagagtcaggggcccgtaatgcaattgttgaatgccaatgttggtgcattagggttacaagagttggaggtgttgagaaaggacctttatatggtacacgacatggtcaaggagaggtcccatgaggtgctggaagatgccatgcgagtgagaaggccaccaccacaacctcgtatgcatatggtggcaatgccctcccaggttttttttggtggacagagtgcaggaaccatgtataccacttttcccagtttgagcaatggaccgcgtaaaggcgttcatgtcaactctctgctgcatggttcccttggaggccttggcaattacttcaatggtcaatttggaggctga

SEQ ID NO: 2316 - protein, 249 aa, Sorghum bicolor
  misc_feature: Ceres ANNOT ID no. 6023587
  misc_feature (18)..(68): Pfam Id: SRF-TF Pfam Desc: SRF-type transcription factor (DNA-binding and dimerisationdomain)
  misc_feature (11)..(186): NCBI GI: 46806648 NCBI Desc: mads-box protein-like [oryza sativa (japonica cultivar-group)]
  misc_feature (3)..(135): NCBI GI: 67633540 NCBI Desc: mads-box family protein [arabidopsis thaliana]
  misc_feature (3)..(180): NCBI GI: 92893075 NCBI Desc: transcription factor, mads-box [medicago truncatula]
  misc_feature (3)..(160): NCBI GI: 140062386 NCBI Desc: transcription factor, mads-box [medicago truncatula]
  misc_feature (7)..(162): NCBI GI: 9757746 NCBI Desc: mads-box protein-like [arabidopsis thaliana]
  misc_feature: The plant is abnormally small.
  misc_feature: The sequence is a functional homolog of SEQ ID NO 2822 in the 10/374,780US patent application
  misc_feature: The sequence is a functional homolog of SEQ ID NO 82 in the 11/375,241US patent application
  misc_feature: Useful for making plants with modulated biomass
  misc_feature: Useful for making plants with modulated growth and phenotype characteristics
  misc_feature: Functional homolog of the protein sequence given in SEQ ID NO 12997
  misc_feature: The sequence is a functional homolog of SEQ ID NO 2822 in the 20060162006 US patent application
  misc_feature: The sequence is a functional homolog of SEQ ID NO. 377 in the 11/188,298 US application
  misc_feature: The sequence is a functional homolog of SEQ ID NO. 273 in the 11/188,298 US application
  misc_feature: The sequence is a functional homolog of SEQ ID NO. 361 in the 11/188,298 US application
  misc_feature: The sequence is a functional homolog of SEQ ID NO. 420 in the 11/188,298 US application
  misc_feature: The sequence is a functional homolog of SEQ ID NO. 518 in the 11/188,298 US application
  misc_feature: The sequence is a functional homolog of SEQ ID NO. 359 in the 11/188,298 US application
  misc_feature: The sequence is a functional homolog of SEQ ID NO. 491 in the 11/188,298 US application
MEMVKGKSTKGRQRIEMKTIKGEEARQVSFSKRRPSLFKKASELSTLCGAEVAIVTFSPGGRCFSFGHPSTLSVADRFLVEHTLDGLTIGSGSHGTQGLTGTSHEMNHQVMELQQLMETEKRSKERAVEAMKRESQGPVMQLLNANVGALGLQELEVLRKDLYMVHDMVKERSHEVLEDAMRVRRPPPQPRMHMVAMPSQVFFGGQSAGTMYTTFPSLSNGPRKGVHVNSLLHGSLGGLGNYFNGQFGG

SEQ ID NO: 2317 - DNA, 1176 bp, Sorghum bicolor
  misc_feature: Ceres ANNOT ID no. 6023590
  misc_feature: Encodes the peptide sequence at SEQ ID NO 2318
atgaggtcgtcggagccgtcgtcgcggttcgtgcaggagctcgtgctgtacgccgccagcgccgcgctaagctgcctcgtcctcttcgcgggcctccgccacctcgaccccaaccgcgccgcctcccagaaggcgcagcagcagaagaaggagatcgccaagcgactcggccggcccctcgtctccaccacgccctacgaggacgtgattgcgtgcgacgtcatcaaccccgacagcatcgacgtcgagttcgactccattggcggcctcgaccaggtgaagcaggcgctctacgagctcgtcatcctgcccctgcgccgcccggagctcttcgccttcggcaagctcctcagcccccagaagggcgtcctcctctatggcccgcccggcacgggcaagaccatgctcgccaaggccatcgccagggagtccggcgccgtcttcatcaatgtcaggatctccaatctcatgagcaagtggttcggggacgcgcagaagctcgtggctgctgtatttagtctcgctcacaagctccagcctgctattattttcattgacgaggttgatagtttcttggggcaacgacggacaaccgaccatgaagccatgactaatatgaagacagagttcatgtccctctgggatggcttcaccactgatcagaatgctcgtgtaatggtcctggctgctacaaataggccttctgagttagatgaggccatcctaaggcgctttactcagatatttgagattggaattcctgttcagagtgaaaggagcaagatacttcaggttgtgttgaagggagaaaatgtcgagcctaatattgattacgatcacattgcaagattgtgcgagggctttactggatcagacatcctcgagctgtgcaagcaggcagcattctaccctattagggagctattggacaatgagaaaaatgggaggcaattagataaacctagacctttgagacaatcagacttggagagagccctatcaacgtctagaaagggcaagaaggctgcaagttcaggactgcagtcacccttgtgggttcagccgacagattcagaagacgatcaggtacagaacgcgatctttgagatatctaagctgatgtctcgaatagttcagaacagtcagtcagaaccgcaagagccttcttcaccttaa

SEQ ID NO: 2318 - protein, 391 aa, Sorghum bicolor
  misc_feature: Ceres ANNOT ID no. 6023590
  misc_feature (122)..(306): Pfam Id: AAA Pfam Desc: ATPase family associated with various cellular activities(AAA)
  misc_feature (35)..(343): NCBI GI: 39794661 NCBI Desc: atad1 protein [homo sapiens]
  misc_feature (35)..(343): NCBI GI: 119570562 NCBI Desc: atpase family, aaa domain containing 1, isoform cra_a [homo sapiens]
  misc_feature (35)..(351): NCBI GI: 85701297 NCBI Desc: atpase family aaa domain-containing protein 1-b
  misc_feature (35)..(343): NCBI GI: 18033709 NCBI Desc: fnp001 [homo sapiens]
  misc_feature (46)..(313): NCBI GI: 7269007 NCBI Desc: at4g02470 [arabidopsis thaliana]
  misc_feature: The sequence is a functional homolog of SEQ ID NO. 471 in the 11/188,298 US application
  misc_feature: The sequence is a functional homolog of SEQ ID NO. 462 in the 11/188,298 US application
MRSSEPSSRFVQELVLYAASAALSCLVLFAGLRHLDPNRAASQKAQQQKKEIAKRLGRPLVSTTPYEDVIACDVINPDSIDVEFDSIGGLDQVKQALYELVILPLRRPELFAFGKLLSPQKGVLLYGPPGTGKTMLAKAIARESGAVFINVRISNLMSKWFGDAQKLVAAVFSLAHKLQPAIIFIDEVDSFLGQRRTTDHEAMTNMKTEFMSLWDGFTTDQNARVMVLAATNRPSELDEAILRRFTQIFEIGIPVQSERSKILQVVLKGENVEPNIDYDHIARLCEGFTGSDILELCKQAAFYPIRELLDNEKNGRQLDKPRPLRQSDLERALSTSRKGKKAASSGLQSPLWVQPTDSEDDQVQNAIFEISKLMSRIVQNSQSEPQEPSSP

SEQ ID NO: 2319 - DNA, 1128 bp, Sorghum bicolor
  misc_feature: Ceres ANNOT ID no. 6023602
  misc_feature: Encodes the peptide sequence at SEQ ID NO 2320
atgtctccgtccgccgacgccgccgggccggcttcctttgcctcggcgcccccgctcgcacccctcatcgccgcgcagctcaactacctcctctcgcactccaagcttcccatcagggtggggcagatctggtccggctgccgcaacggcagccccgccgatcggttcacgctcgccatccctttctgcctcgactacgtccactgggatttcgtgtacaatgcgctgtctcccaaggtggcgccagacgtggtgttcgggccggaggacgagaggttccagccgctggtcgattacgctgtggctggaaatggcgataagagctgcttggcgcgttgggattgccgcgcccccgagggactccttgccctcgtacaggagctccgagaattgtacattgaataccaaaagaagcgggttcacatggtggatgatgcaagagtggcgtttgaactaagcactgttctctctaaggagggaatcgaagtctgcatggtaccttctgctgataggccagatgaggtgaaatttgctgtaccacttctggaccctgactttgacttcgcaaaactggtgccaggatgtccttggagattacctcaaaagatccatctccaggtcatttttccaatcagtagaagctcaagctactcttctatgccttctgctccacgactcaaactaatctcaacaccagatttgaagtcacttctctcagttgaggatgtgaaactccttccatggtcaaatgggatgtgcttggcagagtatcttcctgctttagaagatagtcttaacggtctgcttgtagaggcatcagcttcaattggttccagaagacgttttattgaggcactagctcctacctttgggagaccattagaggctgatccggttcactttgccatcccccttcaattcccaaagcaacaacctgttctcacattgcagagttctcagcactgtaatgccgatgggacgcctattatgtcgccccccataaatgactatccctggagtcctagatgggatcaggcagaaatggttgaacgtatctacgacttcctgactgacgagtgtcaaaatttcaagaagttctgcagcgatgctatcactcagcagaagtag

SEQ ID NO: 2320 - protein, 375 aa, Sorghum bicolor
  misc_feature: Ceres ANNOT ID no. 6023602
  misc_feature (1)..(322): Pfam Id: BRE Pfam Desc: Brain and reproductive organ-expressed protein (BRE)
  misc_feature (38)..(351): NCBI GI: 16326580 NCBI Desc: bre alpha a' isoform [homo sapiens]
  misc_feature (16)..(351): NCBI GI: 49117024 NCBI Desc: mgc83547 protein [xenopus laevis]
  misc_feature (299)..(368): NCBI GI: 726036 NCBI Desc: hin-3 [homo sapiens]
  misc_feature (299)..(351): NCBI GI: 72679888 NCBI Desc: bre protein [mus musculus]
MSPSADAAGPASFASAPPLAPLIAAQLNYLLSHSKLPIRVGQIWSGCRNGSPADRFTLAIPFCLDYVHWDFVYNALSPKVAPDVVFGPEDERFQPLVDYAVAGNGDKSCLARWDCRAPEGLLALVQELRELYIEYQKKRVHMVDDARVAFELSTVLSKEGIEVCMVPSADRPDEVKFAVPLLDPDFDFAKLVPGCPWRLPQKIHLQVIFPISRSSSYSSMPSAPRLKLISTPDLKSLLSVEDVKLLPWSNGMCLAEYLPALEDSLNGLLVEASASIGSRRRFIEALAPTFGRPLEADPVHFAIPLQFPKQQPVLTLQSSQHCNADGTPIMSPPINDYPWSPRWDQAEMVERIYDFLTDECQNFKKFCSDAITQQK

SEQ ID NO: 2321 - DNA, 2424 bp, Sorghum bicolor
  misc_feature: Ceres ANNOT ID no. 6023613
  misc_feature: Encodes the peptide sequence at SEQ ID NO 2322
atgcgcaagtgggcgctctcctccgcgctgctcctcctcttcctcctcaccaccctccccgacccagctaagaagctacaggtgaatgccgaggagagcagcgatgacttagctaacccaccgaaggtagaggagaagcttggtgctgtccctcatggtctgtctaccgactctgatgttgcccagagggaagccgagtctatctctaggaagactctcaggagctcagccgagaagtttgagttccaagctgaggtgtccagactcatggacatcatcatcaactcactctacagcaacaaggatatctatttgagggagctcatctccaatgcctctgatgctttggataagattaggttcctttcccttactgataaggaggttctgggcgaaggtgacactgcaaagcttgagattcagattaagttggacaaagagaagaagatcctctccattcgggataggggtattggtatgaccaaggaagatcttattaagaaccttggaaccattgctaagtctggaacttcagcttttgtggaaaagatgcagtccggaggtgacctcaatcttattggacagtttggtgttggtttctactctgtgtacttgcttgctgactatgtcgaagtggtcagcaagcacaatgatgataaacaatatgtctgggaatcaaaagctgatggatcatttgctatctctgaggatacatggaatgagccccttggccgtggaactgagataagattacatctgcgagatgaggccaaggagtacttggaagaggataagctaaaggatttggtgaagaagtactctgagttcatcaacttccctatctatttgtggtcgacgaaggaggttgatgttgaagtgccagctgatgagggtgagacaagtgatgaagaggattcaaccccagaaactacagaggaagagacagaagaagatgaagagaaagagaaaaagcccaagacgaagacaataaaggagactacttctgaatgggaacttctgaatgatgtgaaggctgtatggcttcgcagcccaaaggaggttactgatgaagagtactcaaagttttaccactcactagcaaaggacttcggtgatgacaagcctatgggttggagccacttcactgctgaaggagatgttgagttcaaagctttgctcttcattcctccgaaggctccacatgatctctatgagagttactacaacagtaacaagtcaaacctcaagctgtatgttagaagagttttcatctctgatgaattcgatgaccttcttccgaagtatctcagctttttgaggggtattgttgactcagacacactgcccctgaatgtgtcacgagaaatgcttcagcaacatagcagtctcaagaccatcaagaagaagctgatccgtaaagctcttgatatgattaggaaacttgctgaagaagaccctgatgagtacagcaacaaggataagacagatgaagagaaaagtgaggtggaagagaagaagggccagtacgccaagttctggaacgagtttggcaaatcaatcaagctgggtatcattgaagacgcaactaacaggaaccgccttgcaaagcttcttagatttgagagttccaagtcagatggcaaacttgcctcccttgatgagtacatttcaaggatgaagccagggcagaaagacatcttctacatcacgggaagcagcaaagaacagctggagaagtctccattccttgagaggctaaccaagaagaattacgaggttatcttcttcactgaccctgtggacgagtacctgatgcaatacctgatggactacgaggacaagaagttccagaacgtgtcaaaggagggcctcaagctgggcaaggactcgaagctcaaggagctcaaggaatcgttcaaggagctatccgactggtggaagaaggctctggagagcgagaacgtggactcggttaagattagcaaccggctgcacaacaccccctgcgtcgtcgtcacctccaagtatgggtggagcgccaacatggagaagatcatgcaggcgcagaccctgtcggactcgagcaagcaggcgtacatgcgtggcaagagggtgctcgagatcaaccccaggcaccccatcatcaaggagcttcgtgacaaggtcgcccaggacaacgagagcgaagagctgaagcacacggcgaggctggtgtaccagacggccctgatggagagcgggttcaacctccccgaccccaaggagttcgcgtccagcatctacaagtcggtgcagaagagcctggacctgagccccgacgctaccgtggaggaggaagacgaggccgaggagcagcccgagatcgaagagaaggagtccaccaaggaggagtcggagccgtcctacgacaaggacgagctgtag

SEQ ID NO: 2322 - protein, 807 aa, Sorghum bicolor
  misc_feature: Ceres ANNOT ID no. 6023613
  misc_feature (259)..(803): Pfam Id: HSP90 Pfam Desc: Hsp90 protein
  misc_feature (100)..(256): Pfam Id: HATPase_c Pfam Desc: Histidine kinase-, DNA gyrase B-, and HSP90-like ATPase
  misc_feature (1)..(807): NCBI GI: 18855040 NCBI Desc: heat shock protein 90 [oryza sativa]
  misc_feature (1)..(807): NCBI GI: 115469982 NCBI Desc: os06g0716700 [oryza sativa (japonica cultivar-group)]
  misc_feature (1)..(807): NCBI GI: 22652 NCBI Desc: grp94 homologue [hordeum vulgare]
  misc_feature (1)..(807): NCBI GI: 6863054 NCBI Desc: heat shock protein 90 [oryza sativa]
  misc_feature (1)..(807): NCBI GI: 23477636 NCBI Desc: grp94 [xerophyta viscosa]
MRKWALSSALLLLFLLTTLPDPAKKLQVNAEESSDDLANPPKVEEKLGAVPHGLSTDSDVAQREAESISRKTLRSSAEKFEFQAEVSRLMDIIINSLYSNKDIYLRELISNASDALDKIRFLSLTDKEVLGEGDTAKLEIQIKLDKEKKILSIRDRGIGMTKEDLIKNLGTIAKSGTSAFVEKMQSGGDLNLIGQFGVGFYSVYLLADYVEVVSKHNDDKQYVWESKADGSFAISEDTWNEPLGRGTEIRLHLRDEAKEYLEEDKLKDLVKKYSEFINFPIYLWSTKEVDVEVPADEGETSDEEDSTPETTEEETEEDEEKEKKPKTKTIKETTSEWELLNDVKAVWLRSPKEVTDEEYSKFYHSLAKDFGDDKPMGWSHFTAEGDVEFKALLFIPPKAPHDLYESYYNSNKSNLKLYVRRVFISDEFDDLLPKYLSFLRGIVDSDTLPLNVSREMLQQHSSLKTIKKKLIRKALDMIRKLAEEDPDEYSNKDKTDEEKSEVEEKKGQYAKFWNEFGKSIKLGIIEDATNRNRLAKLLRFESSKSDGKLASLDEYISRMKPGQKDIFYITGSSKEQLEKSPFLERLTKKNYEVIFFTDPVDEYLMQYLMDYEDKKFQNVSKEGLKLGKDSKLKELKESFKELSDWWKKALESENVDSVKISNRLHNTPCVVVTSKYGWSANMEKIMQAQTLSDSSKQAYMRGKRVLEINPRHPIIKELRDKVAQDNESEELKHTARLVYQTALMESGFNLPDPKEFASSIYKSVQKSLDLSPDATVEEEDEAEEQPEIEEKESTKEESEPSYDKDEL

SEQ ID NO: 2323 - DNA, 1326 bp, Sorghum bicolor
  misc_feature: Ceres ANNOT ID no. 6023628
  misc_feature: Encodes the peptide sequence at SEQ ID NO 2324
atggcagctgcgacggcgccaccgccggcggcggttgccgccaccctctcggccctcatacgctgccagaagttccgtagaagcagccctagagctatctacgcgagatgcgtctcctccaacgcgagcgcggaggcggcggagccggcagagagccggaagggaggccacggcgggatgcgcctggaggaggccgtgcccgtcggcgaggggcgctcgcggatagacgcctggatatcggcgcgtctcggcggcgggggcgtcagccgcgcgcgcgtgcaggccagcatccgcgcggggctcgtcgccgtcaatggccgcccggtctccaaggtttcacatactgtgaagggaggggacctggtcagctgcacggtgtcggagctacaaccgctgagggcagaggcggaggacatcccgctagacattgtttacgaggatgaccatgttcttgttgtcaacaagccggctcatatggttgttcacccggcaccaggaaatgccaacggcacattagtcaatgctatacttcatcactgcaagatctccacatttacttgcttagcacgcagttcaactggtgatgaatgcctggattcttcagatgacgacattgatgtatttaatgtggatcaatttgctactgaagacgcaagttcagaagtccggaatgctcttgtgcgccctggtattgtgcacaggctggataaggggacaagcggacttcttgttgttgctaaggatgagcattctcatgctcaattagcagaacagttcaagctgcatacaattcgtagagtatacatcagtcttacttgtggcgtgcctaatccaaattctggcaggattgaggcatctattgcacgtgatcctaacaataggattcgtatgattgctattgctggatcaggccacagatatgcacggcatgctgctagtaggtacaaagtaagagaggtctttgttggtggtggatctgcactagttgagtggagactagagacaggacgcactcatcagatcagggcgcatgcaaagtatatagggatccctcttcttggtgatgaaacttatggaggtaccaaaagcatggcattatcgcttttgagaccaaggactccttcgaaatatcatagtgatctttcaaatctgatatctaaagtagacagaccatgtcttcatgctgcattgcttgggttcaagcatccacattctggaaagatccttgaattctcatgccccccaccagatgatttttcggaggtgcttgatgaattacggaaagttacatcaagtgatgcccaaaatggtgatggtgttgtctga

SEQ ID NO: 2324 - protein, 441 aa, Sorghum bicolor
  misc_feature: Ceres ANNOT ID no. 6023628
  misc_feature (149)..(347): Pfam Id: PseudoU_synth_2 Pfam Desc: RNA pseudouridylate synthase
  misc_feature (73)..(122): Pfam Id: S4 Pfam Desc: S4 domain
  misc_feature (1)..(440): NCBI GI: 54291043 NCBI Desc: ribosomal large subunit pseudouridine synthase-like [oryza sativa (japonica cultivar-group)]
  misc_feature (34)..(428): NCBI GI: 42572121 NCBI Desc: pseudouridine synthase family protein [arabidopsis thaliana]
  misc_feature (24)..(431): NCBI GI: 92873432 NCBI Desc: pseudouridine synthase, rlud [medicago truncatula]
  misc_feature (57)..(428): NCBI GI: 6721111 NCBI Desc: t4o12.25 [arabidopsis thaliana]
  misc_feature (34)..(314): NCBI GI: 42563248 NCBI Desc: pseudouridine synthase family protein [arabidopsis thaliana]
MAAATAPPPAAVAATLSALIRCQKFRRSSPRAIYARCVSSNASAEAAEPAESRKGGHGGMRLEEAVPVGEGRSRIDAWISARLGGGGVSRARVQASIRAGLVAVNGRPVSKVSHTVKGGDLVSCTVSELQPLRAEAEDIPLDIVYEDDHVLVVNKPAHMVVHPAPGNANGTLVNAILHHCKISTFTCLARSSTGDECLDSSDDDIDVFNVDQFATEDASSEVRNALVRPGIVHRLDKGTSGLLVVAKDEHSHAQLAEQFKLHTIRRVYISLTCGVPNPNSGRIEASIARDPNNRIRMIAIAGSGHRYARHAASRYKVREVFVGGGSALVEWRLETGRTHQIRAHAKYIGIPLLGDETYGGTKSMALSLLRPRTPSKYHSDLSNLISKVDRPCLHAALLGFKHPHSGKILEFSCPPPDDFSEVLDELRKVTSSDAQNGDGVV

SEQ ID NO: 2325 - DNA, 1170 bp, Sorghum bicolor
  misc_feature: Ceres ANNOT ID no. 6023631
  misc_feature: Encodes the peptide sequence at SEQ ID NO 2326
  misc_feature: Up-regulated in shoot tissues in response to salicylic acid treatment
atgctagtgacattgatgaacttgttgcgggcgtgctggcgaccatcgaaccggcatgcccgaacaggctcagatgttaccggtaggcaggatggacttctatggtacaaggacgccgggcagcatgtcaatggggagttctccatggctgttgttcaggccaataacttacttgaggaccagtgtcagatcgagtcgggcccactgagttttctagattctggaccatatggcactttcgttggcgtttacgatggacatggtggtccagagacggcctgctatatcaatgagcatctcttccagaatctgaaaagatttgcatctgagcagaatgcaatgtctgctgatgtactgaagaaggcgtatgaagctacagaagatggattcttctctgttgttaccaaacaatggcctataaagcctcagatagcagctgtcggctcatgctgcctggtcggtgtaatttgtggcggcgtgctttatgttgccaatgttggggattcccgtgccgttttaggaagacatgttaaggccactggagaagttttggctgtccaactgtcagcagagcataatgtaagtattgagtcagtcagaaaagaactgcagtcaatgcacccagaagataggcacattgttgttctcaagcacaatgtttggcgtgtaaaaggattgattcaggtttgtagatcaattggtgatgcttatctcaaaaagcaagagttcaacagggaacccctatatgcaaaattccgcctccgtgaaccttttaacaagccaatactaagttcagaaccatcaatatgtgtgcaaccactacaaccacacgaccagtttctcatatttgcatctgatggactttgggagcacttaaccaaccaagaggctgttgatattgttcacagtagcccccgcagtggctgtgctaggaggctgataagagccgcactgcaagaggcagccaagaaaagagagatgagatactcggacctcaagaagatcgatcgcggtgttcgccgtcacttccacgacgacataacagtcatagtagtgttccttgactccagcctcgtaagtagggcgagcacgcaccgaggtcccactctttccctgcgaggtggtggcgccagcgctggcctgcgcagcaacacgcttgcacctacgtga

SEQ ID NO: 2326 - protein, 389 aa, Sorghum bicolor
  misc_feature: Ceres ANNOT ID no. 6023631
  misc_feature (48)..(326): Pfam Id: PP2C Pfam Desc: Protein phosphatase 2C
  misc_feature (1)..(388): NCBI GI: 4206122 NCBI Desc: protein phosphatase 2c homolog [mesembryanthemum crystallinum]
  misc_feature (1)..(388): NCBI GI: 7768153 NCBI Desc: protein phosphatase 2c (pp2c) [fagus sylvatica]
  misc_feature (1)..(376): NCBI GI: 20340237 NCBI Desc: protein phosphatase 2c-like protein [thellungiella halophila]
  misc_feature (1)..(376): NCBI GI: 10177123 NCBI Desc: protein phosphatase 2c-like protein [arabidopsis thaliana]
  misc_feature (1)..(388): NCBI GI: 59958308 NCBI Desc: at4g38520 [arabidopsis thaliana]
  misc_feature: Useful for making plants with modulated biomass
  misc_feature: Useful for making plants with modulated low light sensitivity
  misc_feature: Functional homolog of the protein sequence given in SEQ ID NO 13347
  misc_feature: Up-regulated in shoot tissues in response to salicylic acid treatment
  misc_feature: The sequence is a functional homolog of SEQ ID NO. 386 in the 11/188,298 US application
  misc_feature: The sequence is a functional homolog of SEQ ID NO. 406 in the 11/188,298 US application
  misc_feature: The sequence is a functional homolog of SEQ ID NO. 448 in the 11/188,298 US application
  misc_feature: The sequence is a functional homolog of SEQ ID NO. 363 in the 11/188,298 US application
MLVTLMNLLRACWRPSNRHARTGSDVTGRQDGLLWYKDAGQHVNGEFSMAVVQANNLLEDQCQIESGPLSFLDSGPYGTFVGVYDGHGGPETACYINEHLFQNLKRFASEQNAMSADVLKKAYEATEDGFFSVVTKQWPIKPQIAAVGSCCLVGVICGGVLYVANVGDSRAVLGRHVKATGEVLAVQLSAEHNVSIESVRKELQSMHPEDRHIVVLKHNVWRVKGLIQVCRSIGDAYLKKQEFNREPLYAKFRLREPFNKPILSSEPSICVQPLQPHDQFLIFASDGLWEHLTNQEAVDIVHSSPRSGCARRLIRAALQEAAKKREMRYSDLKKIDRGVRRHFHDDITVIVVFLDSSLVSRASTHRGPTLSLRGGGASAGLRSNTLAPT

SEQ ID NO: 2327 - DNA, 1170 bp, Sorghum bicolor; identical to SEQ ID NO: 2325
  misc_feature: Ceres ANNOT ID no. 6023634
  misc_feature: Encodes the peptide sequence at SEQ ID NO 2328
  misc_feature: Up-regulated in shoot tissues in response to salicylic acid treatment

SEQ ID NO: 2328 - protein, 389 aa, Sorghum bicolor; identical to SEQ ID NO: 2326
  misc_feature: Ceres ANNOT ID no. 6023634
  misc_feature (48)..(326): Pfam Id: PP2C Pfam Desc: Protein phosphatase 2C
  misc_feature (1)..(388): NCBI GI: 4206122 NCBI Desc: protein phosphatase 2c homolog [mesembryanthemum crystallinum]
  misc_feature (1)..(388): NCBI GI: 7768153 NCBI Desc: protein phosphatase 2c (pp2c) [fagus sylvatica]
  misc_feature (1)..(376): NCBI GI: 20340237 NCBI Desc: protein phosphatase 2c-like protein [thellungiella halophila]
  misc_feature (1)..(376): NCBI GI: 10177123 NCBI Desc: protein phosphatase 2c-like protein [arabidopsis thaliana]
  misc_feature (1)..(388): NCBI GI: 59958308 NCBI Desc: at4g38520 [arabidopsis thaliana]
  misc_feature: Useful for making plants with modulated biomass
  misc_feature: Useful for making plants with modulated low light sensitivity
  misc_feature: Functional homolog of the protein sequence given in SEQ ID NO 13347
  misc_feature: Up-regulated in shoot tissues in response to salicylic acid treatment
  misc_feature: The sequence is a functional homolog of SEQ ID NO. 386 in the 11/188,298 US application
  misc_feature: The sequence is a functional homolog of SEQ ID NO. 406 in the 11/188,298 US application
  misc_feature: The sequence is a functional homolog of SEQ ID NO. 448 in the 11/188,298 US application
  misc_feature: The sequence is a functional homolog of SEQ ID NO. 363 in the 11/188,298 US application

SEQ ID NO: 2329 - DNA, 1626 bp, Sorghum bicolor
  misc_feature: Ceres ANNOT ID no. 6023636
  misc_feature: Encodes the peptide sequence at SEQ ID NO 2330
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
atggctcaggctaactccaaccaccgctgcacgggcctcctcgtggccgtcgccatcgtcgcagtgtcgttccttgtcgccgccggggacgcgtccagcgtcgggttcgacctccaccaccgcttctctccggtggtccggcagtgggcggaggctcggggacaccccttcgccgcgcaggactggccagcccgaggctcgccggagtactactccgcgctgtcccgccacgaccgcgccgtcctctcccgccgcgccctcgccgacggcgccgacgggctcgtcaccttcgccgccggcaacgacaccttacaatacatcggatcgctgtactacgcggtggtggaggtgggcacgccgaacgcgacgttcctggtggcgctggacaccggcagcgacctcttctgggtgccctgcgactgcaagcagtgcgcgtccatcgccaacgtcaccgggcagcccgcgacggcgctccgcccctacagcccgcgggagtcgtcgacgagcaagcaggtgacgtgcgacaacgcgctgtgcgaccgtcccaacggctgctccgccgccaccaacggcagctgcccgtacgaggtccagtacctgtcggccaacacctccacctccggggtgctggtgcaggacgtgctccacctcacccgggagcgcccaggcgccgccgccgaggccggggaagccctgcaggcgcccgtcgtgttcgggtgcgggcaggtgcagacgggcacgttcctggacggcgccgccttcgacggcctgatggggctcggcagggagaacgtgtccgtgcccagcgtgctcgcctcaagcggcctcgtcgcgtccgacagcttctccatgtgcttcggcgacgacggcgtcggccgcatcaacttcggcgactccggcagcagcggccagggcgagacgcccttcaccggccggagaacgctgtacaacgtgagcttcacggccgtcaacgtcgagaccaagtcggtggcggcggagttcgccgccgtcatagactctggcacgtccttcacctacctcgccgacccggagtacacggagctcgccaccaatttcaactcgctggtccgcgagaggagaaccaatttcagcagcggctctgcagatccttttcccttcgaatactgctacgcactcggcccgaaccagacagaggcgctgatcccggacgtgagcctgacgaccaaggggggagcccggttcccggtcacccagccggtcatcggcgtcgcctccggccgtaccgtggtcggttactgcctggcgatcatgaagaatgacctcggcgtcaatttcaacatcatcggccagaacttcatgacggggctcaaagtcgtcttcgaccgggagaaatccgtcctgggctgggagaagttcgactgctacaagaacgccagggtggcggacgcgccggacgggagcccaagcccagccccggcggcggacccgaccaagatcacgccgcggcagaacgacggcagcagcaacgggttccccgccgcggcgcccctgccgaggtcggccggctcgcgcaacgccgctgccagcgcgctgggggcgggaggcctctcgctgctgatgctggtagctgcaacgctcgtctga

SEQ ID NO: 2330 - protein, 541 aa, Sorghum bicolor
  misc_feature: Ceres ANNOT ID no. 6023636
  misc_feature (110)..(466): Pfam Id: Asp Pfam Desc: Eukaryotic aspartyl protease
  misc_feature (12)..(504): NCBI GI: 32526671 NCBI Desc: chloroplast nucleoid dna-binding protein -like protein [oryza sativa (japonica cultivar-group)]
  misc_feature (100)..(517): NCBI GI: 52076082 NCBI Desc: aspartic proteinase nepenthesin ii -like [oryza sativa (japonica cultivar-group)]
  misc_feature (10)..(541): NCBI GI: 42567433 NCBI Desc: aspartyl protease family protein [arabidopsis thaliana]
  misc_feature (15)..(526): NCBI GI: 140047292 NCBI Desc: peptidase aspartic, active site [medicago truncatula]
  misc_feature (98)..(517): NCBI GI: 115480451 NCBI Desc: os09g0542100 [oryza sativa (japonica cultivar-group)]
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
MAQANSNHRCTGLLVAVAIVAVSFLVAAGDASSVGFDLHHRFSPVVRQWAEARGHPFAAQDWPARGSPEYYSALSRHDRAVLSRRALADGADGLVTFAAGNDTLQYIGSLYYAVVEVGTPNATFLVALDTGSDLFWVPCDCKQCASIANVTGQPATALRPYSPRESSTSKQVTCDNALCDRPNGCSAATNGSCPYEVQYLSANTSTSGVLVQDVLHLTRERPGAAAEAGEALQAPVVFGCGQVQTGTFLDGAAFDGLMGLGRENVSVPSVLASSGLVASDSFSMCFGDDGVGRINFGDSGSSGQGETPFTGRRTLYNVSFTAVNVETKSVAAEFAAVIDSGTSFTYLADPEYTELATNFNSLVRERRTNFSSGSADPFPFEYCYALGPNQTEALIPDVSLTTKGGARFPVTQPVIGVASGRTVVGYCLAIMKNDLGVNFNIIGQNFMTGLKVVFDREKSVLGWEKFDCYKNARVADAPDGSPSPAPAADPTKITPRQNDGSSNGFPAAAPLPRSAGSRNAAASALGAGGLSLLMLVAATLV

SEQ ID NO: 2331 - DNA, 819 bp, Sorghum bicolor
  misc_feature: Ceres ANNOT ID no. 6023640
  misc_feature: Encodes the peptide sequence at SEQ ID NO 2332
atggcgatggcgcgcggttacgcttacggttacagccacatacagaccgccgcagccgcgctgctggtcggctgggcgctggccgccgccttgccggccgcggcgttcgcgccgtccgcctggagcaagggcagcgccacgttctacggcggcagcgacgcgtccggcaccatgggcggcgcgtgcggttacgggaacctgtacgcgcaggggtacgggacgcggacggcggcgctaagcacggcgctgttcaacgatggcgcgtcgtgcgggcagtgctacaggctggtctgcgacgcgtccacggacccgcggtggtgccgccgcggtggccggggcgcgtcggtgaccgtcacggcgaccaacttctgcccgcccaactacgcgctcgcctccaacggcggcgggtggtgcaacccgccgcggcagcacttcgacatggcgcagccggcgtgggagcggatcggcgtctaccagggcgggatcgtgccggtgctgttccgccgcgtgccctgcaggcgccgcggcggggtccggttcacggtcagcggcagggactacttcgagctcgtgctcgtcaccaacgtggccggcgccggcgccgtgcgcgccatggacgtcaggggcaccagctccgctggatggatgcccatgtccaggaactggggcgccaactggcagtccctggcgtacctcaacgggcaggggctctcgttccgggtcaccgccgacgatgggcagaccgtcgtgttcgccgacgtcgtgccgccgtcgtggacgttcgggcagacgtacgcgagcaggctgcagttcaagtag

SEQ ID NO: 2332 - protein, 272 aa, Sorghum bicolor
  misc_feature: Ceres ANNOT ID no. 6023640
  misc_feature (76)..(167): Pfam Id: DPBB_1 Pfam Desc: Rare lipoprotein A (RlpA)-like double-psi beta-barrel
  misc_feature (178)..(256): Pfam Id: Pollen_allerg_1 Pfam Desc: Pollen allergen
  misc_feature (18)..(271): NCBI GI: 115502188 NCBI Desc: expansin-a29 precursor (osexpa29) (alpha-expansin-29) (osexp29) (osaexpa1.14)
  misc_feature (35)..(267): NCBI GI: 67037416 NCBI Desc: alpha-expansin 29 [oryza sativa (japonica cultivar-group)]
  misc_feature (35)..(271): NCBI GI: 1040877 NCBI Desc: expansin s2 precursor [cucumis sativus]
  misc_feature (35)..(271): NCBI GI: 27464177 NCBI Desc: expansin [glycine max]
  misc_feature (34)..(271): NCBI GI: 68532881 NCBI Desc: expansin [sagittaria pygmaea]
  misc_feature: Useful for making plants with altered Lignin content
  misc_feature: Useful for making plants with altered cell wall content and/or composition
  misc_feature: Functional homolog of the protein sequence given in SEQ ID NO 12888
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Functional homolog of the protein sequence given in SEQ ID NO 13785
  misc_feature: Useful for making plants with altered lignin content
  misc_feature: Functional homolog of the protein sequence given in SEQ ID NO 12888
MAMARGYAYGYSHIQTAAAALLVGWALAAALPAAAFAPSAWSKGSATFYGGSDASGTMGGACGYGNLYAQGYGTRTAALSTALFNDGASCGQCYRLVCDASTDPRWCRRGGRGASVTVTATNFCPPNYALASNGGGWCNPPRQHFDMAQPAWERIGVYQGGIVPVLFRRVPCRRRGGVRFTVSGRDYFELVLVTNVAGAGAVRAMDVRGTSSAGWMPMSRNWGANWQSLAYLNGQGLSFRVTADDGQTVVFADVVPPSWTFGQTYASRLQFK

SEQ ID NO: 2333 - DNA, 1512 bp, Sorghum bicolor
  misc_feature: Ceres ANNOT ID no. 6023644
  misc_feature: Encodes the peptide sequence at SEQ ID NO 2334
atgcatccctcctccggcgcgggggactacgccccctactaccctccttacccctccccggcttccgcgccgcctcccgccgccgcctacccgtcggtgtccgccccggcttccgcgcccccgtactcgtcgtaccccgcggacttcgcccccgtgccgtcgtaccccgcgtacccgcccgccgacctctcccactacgcgccgccggccaccgcgcccgcgcccgcgccgccgcagccgtactacccctacgagccggcgccgccgctcccgcacaacccggtgcccccgtacccgtcgctggatcgggcggggacctacggctacggatccggccctggctccgggtacggccaggagctgtacccgcccaagccggcgggcgggggcgggggcgggtggtccgacgacggtgcgtacgcgtacgacggcggcgacgcgcccgagccctacggggccagaggcacagcaccgaggttgggctcgggatccgcgctgtttgatgactacgggaggtccattggctcagctgccgataggggtggtggccgcgggggtagtgcggccagccccaaggtagtgagggccgtgcccaaggcagagacgtcagaggacgtcaggggtggggtgcagaagttcagggtcaagctgctgccggagggggctgggagccccatggatgtgctctgccaggttggtttggatggaattcggatgcttgatcccaacactggtaggacactaagaatatatccccttgaaactgtaactagatgggatgtattagattcctctatctttgccttttggtccaagagttcagtggatgttgaagcaaaaagaataaggctgaaatcaaacagctatacatccaacaccattcttgacacagtcacagctgcgactgtgcagttcaaggagatgggtggaagcagcatttcaagaagtagagccattgctgatgcagccaagcctgctgagcagcaaaatgagaggaagaaaaatttccttgattggaggaatttaatgaagcctatgaatgaggagaaagatcactgggtcccagatgaagctgtcagcaaatgcacagcatgcgcagcagatttcagtgctttcaaccgcaggcatcactgtcgaaactgtggcgatattttctgcgataagtgcacccagggaagaactcctctgaatacggatgctgatgctcaaccagttcgagtttgtgacagatgcatggctgaagtaacgcaaagacttaacaatgcaagggaagtgacaaatcgacctattgttcagagccatgaggatcttgccaaaaagcttcaggaagccatggatataaataaaaggtcatcttcagggacgaggtcttcggatgcttctggcaagcgaatgcgggaggtcgcgtgcccaatctgcacagtccatcttcaggttgaagttccaacttctggttcggagacaatagagtgcggcgtatgtcagcaccctttccttgtcagcgcccgttga

SEQ ID NO: 2334 - protein, 503 aa, Sorghum bicolor
  misc_feature: Ceres ANNOT ID no. 6023644
  misc_feature (351)..(417): Pfam Id: FYVE Pfam Desc: FYVE zinc finger
  misc_feature (1)..(503): NCBI GI: 54291606 NCBI Desc: zinc finger protein-like [oryza sativa (japonica cultivar-group)]
  misc_feature (4)..(502): NCBI GI: 23506043 NCBI Desc: at1g20110/t20h2_10 [arabidopsis thaliana]
  misc_feature (239)..(502): NCBI GI: 115472935 NCBI Desc: os07g0573300 [oryza sativa (japonica cultivar-group)]
  misc_feature (2)..(107): NCBI GI: 41529812 NCBI Desc: pgyrp protein [chlamydomonas reinhardtii]
  misc_feature (353)..(421): NCBI GI: 55957526 NCBI Desc: run and fyve domain containing 2 [homo sapiens]
MHPSSGAGDYAPYYPPYPSPASAPPPAAAYPSVSAPASAPPYSSYPADFAPVPSYPAYPPADLSHYAPPATAPAPAPPQPYYPYEPAPPLPHNPVPPYPSLDRAGTYGYGSGPGSGYGQELYPPKPAGGGGGGWSDDGAYAYDGGDAPEPYGARGTAPRLGSGSALFDDYGRSIGSAADRGGGRGGSAASPKVVRAVPKAETSEDVRGGVQKFRVKLLPEGAGSPMDVLCQVGLDGIRMLDPNTGRTLRIYPLETVTRWDVLDSSIFAFWSKSSVDVEAKRIRLKSNSYTSNTILDTVTAATVQFKEMGGSSISRSRAIADAAKPAEQQNERKKNFLDWRNLMKPMNEEKDHWVPDEAVSKCTACAADFSAFNRRHHCRNCGDIFCDKCTQGRTPLNTDADAQPVRVCDRCMAEVTQRLNNAREVTNRPIVQSHEDLAKKLQEAMDINKRSSSGTRSSDASGKRMREVACPICTVHLQVEVPTSGSETIECGVCQHPFLVSAR

SEQ ID NO: 2335 - DNA, 840 bp, Sorghum bicolor
  misc_feature: Ceres ANNOT ID no. 6023650
  misc_feature: Encodes the peptide sequence at SEQ ID NO 2336
atggctgattccccgcgcaggaggtactcgaggtccccttcatacagcagggggcacccaaaagcgaggtcaagatcacaatctccagctcggtctcagtctaggtcgcctgtgcctgatcctagatctcaggccaggtcaaggtctagaagccatgagagggaggaggatgctgttaaccgtggaaatactctgtatgtgactgggctctcttccagggtgactgaaagggatgttaaagattatttctctaagcatggaaaggtggttggttgccatgttgttcttgaaccccatacacgtgtttcccgtggatttgcctttgtcaccatggacactgttgaagaagctgagcgttgcatcaagtatctcaatgattctgtaatggaaggtcgaaacatcacagttgagaagtcacgccgtggtcgcccaagaacaccaactcctggaagctatcttggccatcggtacgagcgcagagagcgcgggagattccgtagaggctatggtggtgggcgtgatgagtattacggtaatggcggtgggcatgggtaccgcaggtctccgccacccatgtactcttcctacagggagagtcgggattattacccctcctacagggacagcagggactaccctccctacagggacagccgggactactctcctccccacagggaccctcgggactactacgaaagcaggggtggccgtggctactcgccgcctccttacggcggtggtaggtcaaggagggagcgatcgatttcgccgtatcggatgccagaaaggggctatggtggaggccgccgggcgggcggcggtggctacgacaggtaa

SEQ ID NO: 2336 - protein, 279 aa, Sorghum bicolor
  misc_feature: Ceres ANNOT ID no. 6023650
  misc_feature (65)..(136): Pfam Id: RRM_1 Pfam Desc: RNA recognition motif. (a.k.a. RRM, RBD, or RNP domain)
  misc_feature (1)..(140): NCBI GI: 115470030 NCBI Desc: os06g0724600 [oryza sativa (japonica cultivar-group)]
  misc_feature (1)..(204): NCBI GI: 1781299 NCBI Desc: transformer-sr ribonucleoprotein [nicotiana tabacum]
  misc_feature (1)..(238): NCBI GI: 71143084 NCBI Desc: at4g35785 [arabidopsis thaliana]
  misc_feature (3)..(266): NCBI GI: 66846613 NCBI Desc: transformer-sr ribonucleoprotein [aspergillus fumigatus af293]
  misc_feature (57)..(261): NCBI GI: 8778550 NCBI Desc: f22g5.31 [arabidopsis thaliana]
  misc_feature: The sequence is a functional homolog of SEQ ID NO 1039 in the 10/374,780US patent application
  misc_feature: The sequence is a functional homolog of SEQ ID NO 1042 in the 10/374,780US patent application
  misc_feature: The sequence is a functional homolog of SEQ ID NO 849 in the 10/666,642US patent application
  misc_feature: The sequence is a functional homolog of SEQ ID NO 852 in the 10/666,642US patent application
  misc_feature: Useful for making plants with altered Lignin content
  misc_feature: Useful for making plants with modulated growth and phenotype characteristics
  misc_feature: GREAT-hit functional homolog of the protein sequence given in SEQ ID NO 13092
  misc_feature: The sequence is a functional homolog of SEQ ID NO 1039 in the 20060162006 US patent application
  misc_feature: The sequence is a functional homolog of SEQ ID NO 1042 in the 20060162006 US patent application
MADSPRRRYSRSPSYSRGHPKARSRSQSPARSQSRSPVPDPRSQARSRSRSHEREEDAVNRGNTLYVTGLSSRVTERDVKDYFSKHGKVVGCHVVLEPHTRVSRGFAFVTMDTVEEAERCIKYLNDSVMEGRNITVEKSRRGRPRTPTPGSYLGHRYERRERGRFRRGYGGGRDEYYGNGGGHGYRRSPPPMYSSYRESRDYYPSYRDSRDYPPYRDSRDYSPPHRDPRDYYESRGGRGYSPPPYGGGRSRRERSISPYRMPERGYGGGRRAGGGGYDR

SEQ ID NO: 2337 - DNA, 1479 bp, Sorghum bicolor
  misc_feature: Ceres ANNOT ID no. 6023729
  misc_feature: Encodes the peptide sequence at SEQ ID NO 2338
  misc_feature: Up-regulated in shoot tissues in response to methyl jasmonate treatment
  misc_feature: Up-regulated in shoot tissues in response to salicylic acid treatment
atggatccgtacaagcaccgcccttctagcgggagcaactccagcttctggaccaccaactccggcgcccccgtctggaacaacaactccgcccttaccgtcggacagcgaggacccatcctccttgaggattatcatctaatcgaaaagcttgctcagttcgacagggaacgtatccctgaacgtgttgtgcatgcacggggagccagtgccaagggtttctttgaggtcactcatgatatctctcaccttacatgtgctgattttctccgggctcctggggtccagacacctgttattgtccggttctctacagttgtgcatgagcgtggaagccccgagaccttgagggatccacgtggttttgctgtcaagttctacaccagagagggtaactttgaccttgtgggtaacaacatgcctgtgtttttcatacgagatgggatgaaattccctgatatggtccatgctttcaagccaaacccaaagaccaatttgcaggagaactggagaatagtagatttcttctctcaccacccagagagcctgcacatgttcaccttcctctttgatgatgttggcatcccactcaactacaggcacatggagggctttggtgtcaatacctacaccttgatcaacagggatggaaagcctcaccttgtgaaattccattggaagcctacttgtggcgtgaaatgcttgcttgatgatgaagctgtgactgttggaggtacctgccatagccatgcgacaaaggatctatatgattccattgcagctgggaattaccctgaatggaagctctacatccagactatcgatcttgaccatgaggataagtttgacttcgacccgcttgatgtcaccaagacctggcctgaggatatcatcccactgcaacctgttggacggatggtcctgaacaagaacattgataacttctttgcggagaatgaacaaattgctttctgcccagcgattattgtccctggaatccactattctgatgataagctgctccagacgagaatcttctcctatgctgatacccagaggcaccgccttggtccaaactatctgatgcttcctgtgaatgcaccaaaatgtgcccaccacaacaaccaccatgaagggttcatgaacttcatgcacagggatgaagaggtgaactacttcccttcaaggtttgatcctacccgtcatgctgagaaggtccctattccttcccgtgttctaacaggctgccgcgagaagtgcatcatcgagaaggagaacaacttcaagcaggctggtgagagatttcgatcctttgaccctgccaggcaagaccggtttatccaacgatgggttgacgcactgtcagaccctcgtgttacccatgaacaccatacgatttggatcaactactggtctcagtgtgatgcctctcttggccagaagctggcttctaggctgaacctgaagccgaacatgtaa

SEQ ID NO: 2338 - protein, 492 aa, Sorghum bicolor
  misc_feature: Ceres ANNOT ID no. 6023729
  misc_feature (18)..(401): Pfam Id: Catalase Pfam Desc: Catalase
  misc_feature (1)..(492): NCBI GI: 311239 NCBI Desc: catalase-1 [zea mays]
  misc_feature (1)..(492): NCBI GI: 22232 NCBI Desc: catalase-1 (aa 1-492) [zea mays]
  misc_feature (1)..(492): NCBI GI: 115679 NCBI Desc: catalase isozyme 1
  misc_feature (1)..(492): NCBI GI: 82654915 NCBI Desc: catalase isozyme b (cat-b)
  misc_feature (1)..(492): NCBI GI: 3868754 NCBI Desc: catalase [oryza sativa (japonica cultivar-group)]
  misc_feature (1)..(492): SWISSPROT Homolog: EC 1.11.1.6 Catalase isozyme 1
  misc_feature: Up-regulated in shoot tissues in response to methyl jasmonate treatment
  misc_feature: Up-regulated in shoot tissues in response to salicylic acid treatment
  misc_feature: The sequence is a functional homolog of SEQ ID NO. 439 in the 11/188,298 US application
  misc_feature: The sequence is a functional homolog of SEQ ID NO. 444 in the 11/188,298 US application
MDPYKHRPSSGSNSSFWTTNSGAPVWNNNSALTVGQRGPILLEDYHLIEKLAQFDRERIPERVVHARGASAKGFFEVTHDISHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFGVNTYTLINRDGKPHLVKFHWKPTCGVKCLLDDEAVTVGGTCHSHATKDLYDSIAAGNYPEWKLYIQTIDLDHEDKFDFDPLDVTKTWPEDIIPLQPVGRMVLNKNIDNFFAENEQIAFCPAIIVPGIHYSDDKLLQTRIFSYADTQRHRLGPNYLMLPVNAPKCAHHNNHHEGFMNFMHRDEEVNYFPSRFDPTRHAEKVPIPSRVLTGCREKCIIEKENNFKQAGERFRSFDPARQDRFIQRWVDALSDPRVTHEHHTIWINYWSQCDASLGQKLASRLNLKPNM

SEQ ID NO: 2339 - DNA, 2094 bp, Sorghum bicolor
  misc_feature: Ceres ANNOT ID no. 6023732
  misc_feature: Encodes the peptide sequence at SEQ ID NO 2340
atggcgtcctcctcctcctccgcctcgtcggcggcggccgcggccgcggcagcgtatcccagaaccacgctcccactgcggcggcgcccgggcctcctggtcctcctcctcatcctcctctgcttcctctccttccaggtcgtgatccatgtgcccgccgccagatcagcggtgtcgcagtggctcttctcgggtcaccgagcagaccgcgggactcgcgagaactgccctggctgcagcaagctacaggatgtggataaggctgaaaagacgatcgcgtacactgaccagcatggccggatcaagctgttcaaagtcaccgccagagaattcggttcgtcctctatctgggagaacccttggttgcccagagatagccagccagtagccggaacacaagttgctgccagggatcatctactcgccagtggatcaggaaccaccaatgtttcaagtgctgaaactctggcaactacaattgttgatccgattaaattaaggcgacaggtatttcgacgtagaagaaaggagcggagggttcaggagctgcttcagatggataagaaggttgaacttgagatgcgaaatgcagcaataaatagctcaatgaactttaacaataaagttagaggcagctacaacatatggaggcaggagttccgctttattaatacagattcaacactaaggctcatgaaagatcagataataatggccaagttatatgccactattgcactctcccagaaggaaccagacatgtatgccttgctcatgaagtgcataaaagaaagccaaacatctatcggggatgcacttattgacagtgaactcgattctagtgccttagagagagcaaaagcaatggggcatgtgctgtcttcggctagagatgttctgtacagctcgggtgaagtgtcaagaaaattgcgtgctatgttgcagtcaacggaactaaatattgatgcagtgaagaaacagaactcatttctggttcagcatgctgcgaagacagtacccatgcccttgcactgcctacatatgcagctgacaactgattattattttcgtgatgatgcgaccaaggaacattttcatgctgctgctttgaaggcagaacaagataaagaaaagcttgaggatcggtcactctaccactatgctatattttctgataatgtgcttgcagcctcagtagttgtcagatcaactgtgacaaatgccaatgaaccagagaagcacgtgttccatattgtcactgatagacttaattttgcagccatgaagatgtggttcattactcatcctcctcaactggcaactgttcatgtggagaacatagacaatttcaaatggctcaattcgtcatactgttctgttcttcggcaactggagtcagctcgcctcaaagaatattacttcaaagcacacgatccgtcatcactctctgatggaaacgagaatctgaaatacaggaatcccaaatatctgtccatgctcaaccatttgaggttctacatgccagaaattcatccgaagcttgagaagatactgtttcttgatgatgatgttgttgtacagaaggatttgacacccctttgggatattgatcttaaagggatggtaaatggcgctgtggaaacctgtaaagagagtttccatcgctttgacacttatctcaacttctcacacccaaagatctcagagaacttcgatccgcatgcttgtgggtgggctttcggaatgaacatgtttgacctcaaggagtggaagaagcgaaatatcactggaatataccattattggcaagatttgaatgaggatcgtaagctgtggaagctgggtacattgcctccaggtttaattactttctacaacctgacatacccgttgaatcgtacttggcatgtcttgggcctgggctatgatccagctgttgacattgctgagatcgataatgctgcagtagttcattacaatgggaattataagccctggcttgaccttgccatttccaagtacaagacatactggtccaagtatgtagatgttgacaactcgcatgttcagcattgctacgagggcaaacaatga

SEQ ID NO: 2340 - protein, 697 aa, Sorghum bicolor
  misc_feature: Ceres ANNOT ID no. 6023732
  misc_feature (345)..(670): Pfam Id: Glyco_transf_8 Pfam Desc: Glycosyl transferase family 8
  misc_feature (162)..(697): NCBI GI: 115470074 NCBI Desc: os06g0727300 [oryza sativa (japonica cultivar-group)]
  misc_feature (194)..(697): NCBI GI: 115481690 NCBI Desc: os10g0363100 [oryza sativa (japonica cultivar-group)]
  misc_feature (42)..(692): NCBI GI: 30691875 NCBI Desc: glycosyl transferase family 8 protein [arabidopsis thaliana]
  misc_feature (148)..(692): NCBI GI: 52077221 NCBI Desc: glycosyl transferase family 8 protein-like [oryza sativa (japonica cultivar-group)]
  misc_feature (163)..(692): NCBI GI: 7271113 NCBI Desc: 68 kda protein [cicer arietinum]
  misc_feature: Useful for making plants with altered cell wall content and/or composition
  misc_feature: GREAT-hit functional homolog of the protein sequence encoded by LOCUS at4g38270
  misc_feature: Useful for making plants with altered cell wall content and/or composition
  misc_feature: Functional homolog of the protein sequence given in SEQ ID NO 13786
  misc_feature: Useful for making plants with altered carbohydrate content
  misc_feature: Functional homolog of the protein sequence given in SEQ ID NO 13787
MASSSSSASSAAAAAAAAYPRTTLPLRRRPGLLVLLLILLCFLSFQVVIHVPAARSAVSQWLFSGHRADRGTRENCPGCSKLQDVDKAEKTIAYTDQHGRIKLFKVTAREFGSSSIWENPWLPRDSQPVAGTQVAARDHLLASGSGTTNVSSAETLATTIVDPIKLRRQVFRRRRKERRVQELLQMDKKVELEMRNAAINSSMNFNNKVRGSYNIWRQEFRFINTDSTLRLMKDQIIMAKLYATIALSQKEPDMYALLMKCIKESQTSIGDALIDSELDSSALERAKAMGHVLSSARDVLYSSGEVSRKLRAMLQSTELNIDAVKKQNSFLVQHAAKTVPMPLHCLHMQLTTDYYFRDDATKEHFHAAALKAEQDKEKLEDRSLYHYAIFSDNVLAASVVVRSTVTNANEPEKHVFHIVTDRLNFAAMKMWFITHPPQLATVHVENIDNFKWLNSSYCSVLRQLESARLKEYYFKAHDPSSLSDGNENLKYRNPKYLSMLNHLRFYMPEIHPKLEKILFLDDDVVVQKDLTPLWDIDLKGMVNGAVETCKESFHRFDTYLNFSHPKISENFDPHACGWAFGMNMFDLKEWKKRNITGIYHYWQDLNEDRKLWKLGTLPPGLITFYNLTYPLNRTWHVLGLGYDPAVDIAEIDNAAVVHYNGNYKPWLDLAISKYKTYWSKYVDVDNSHVQHCYEGKQ

SEQ ID NO: 2341 - DNA, 477 bp, Sorghum bicolor
  misc_feature: Ceres ANNOT ID no. 6023739
  misc_feature: Encodes the peptide sequence at SEQ ID NO 2342
atgaagggggccaaatccaagggcgccgccaaggccgatgccaagctggcggtgaagagcaagggtgcggagaagcccgccaagggcaggaaggggaaggccggcaaggaccccaacaagcccaagagggctcccagcgctttcttcgtcttcatggaggaattccgcaaggagttcaaggagaagaaccctaagaacaagtctgtcgctgcggtgggaaaagctgccggtgacaggtggaaatccctcagcgaatcggacaaggctccctatgtagccaaggctaataagctcaagctagagtataacaaggccattgctgcctacaacaagggcgagagcaccgctgctgctaagaaggctcctgccaaggaggaggaggaggaagacgaagaggagtctgacaagtccaagtcggaggtcaatgatgaggatgacgacgagggtagcgatgaggtatacaaatttctttcatga

SEQ ID NO: 2342 - protein, 158 aa, Sorghum bicolor
  misc_feature: Ceres ANNOT ID no. 6023739
  misc_feature (41)..(110): Pfam Id: HMG_box Pfam Desc: HMG (high mobility group) box
  misc_feature (1)..(152): NCBI GI: 397396 NCBI Desc: dna-binding protein [zea mays]
  misc_feature (1)..(152): NCBI GI: 22347617 NCBI Desc: nucleosome/chromatin assembly factor group d protein [zea mays]
  misc_feature (1)..(152): NCBI GI: 115470082 NCBI Desc: os06g0728000 [oryza sativa (japonica cultivar-group)]
  misc_feature (1)..(152): NCBI GI: 30267833 NCBI Desc: hmgb1 [oryza sativa (indica cultivar-group)]
  misc_feature (1)..(152): NCBI GI: 21803 NCBI Desc: high mobility group protein [triticum aestivum]
  misc_feature: The plant is abnormally small.
  misc_feature: Useful for making plants with altered Lignin content
  misc_feature: Useful for making plants with altered alkaloid content
  misc_feature: Useful for making plants with altered terpenoid content
  misc_feature: Useful for making plants with modulated biomass
  misc_feature: Useful for making plants with modulated nitrogen use efficiency
  misc_feature: GREAT-hit functional homolog of the protein sequence given in SEQ ID NO 12910
  misc_feature: Functional homolog of the protein sequence given in SEQ ID NO 13031
  misc_feature: Functional homolog of the protein sequence given in SEQ ID NO 13032
  misc_feature: Functional homolog of the protein sequence given in SEQ ID NO 13077
  misc_feature: Functional homolog of the protein sequence given in SEQ ID NO 13276
  misc_feature: Useful for making plants with altered alkaloid content
  misc_feature: Functional homolog of the protein sequence given in SEQ ID NO 12910
MKGAKSKGAAKADAKLAVKSKGAEKPAKGRKGKAGKDPNKPKRAPSAFFVFMEEFRKEFKEKNPKNKSVAAVGKAAGDRWKSLSESDKAPYVAKANKLKLEYNKAIAAYNKGESTAAAKKAPAKEEEEEDEEESDKSKSEVNDEDDDEGSDEVYKFLS

SEQ ID NO: 2343 - DNA, 1242 bp, Sorghum bicolor
  misc_feature: Ceres ANNOT ID no. 6023756
  misc_feature: Encodes the peptide sequence at SEQ ID NO 2344
atggccatcatactcgtacgagcagcgtcgccggcggggctctccgacgccgccggcatcatcagccaccatgggagtctccagtgctcctctctgcctctgctcaacaagaggccggccccggcccggcggtggatgctctgctcgctcaggtacgggtgccttggcctcgaccccggccgcccctccccgcccgccgtctactccagcctcgccgtcaacccggcgggagaggccgtcgtctcgtccgagcagaaggtctacgacgtcgtgctcaagcagtcggcattgctcaaacgccagctgcgcaagccggtcctcgacgtcgtcaggccccaggaggacctggcggagatgccacgcaacggcctcaaccaagcctacgaccgctgcggcgagatctgtgaggagtatgccaagacgttttacctcgaggagcggcgccgcgccatatgggccatctatgtgtggtgtaggaggacagatgagcttgtggatgggccaaacgccaactacattacaccaacagctttggaccggtgggagaagagacttgaggatctgttcgcgggacgtccttacgatatgctcgatgctgctctctctgataccatctcaaggttccccatagacattcagccattcagggacatgattgaagggatgaggagtgaccttaggaagacaaggtataacaactttgacgagctctacatgtactgctactatgttgctggaactgtcgggttaatgagcgtacctgtgatgggcatcgcacccgagtctaaggcaacaactgaaagtgtgtatagtgctgccttggctctcggaattgctaaccaactcacgaacatactccgggatgttggagaggatgctacaagagggaggatatatttaccacaagatgagctcgcacaggcagggctctctgatgaggacatcttcaagggggtcgtcacaaaccgatggagaaacttcatgaagaggcagatcaagagggcgaggatgttttttgaggaggcagagagaggggtaactgagctctcacaggctagcagatggccagtatgggcttccctgttgctgtacaggcaaatcctggatgagattgaagcgaacgactacaacaacttcacaaagagggcctatgttggtaaagggaaaaaattgctggcacttcctgtggcatatgggaaatcgctactgctaccgtgttcattgagaaatacccaaacctag

SEQ ID NO: 2344 - protein, 413 aa, Sorghum bicolor
  misc_feature: Ceres ANNOT ID no. 6023756
  misc_feature (135)..(403): Pfam Id: SQS_PSY Pfam Desc: Squalene/phytoene synthase
  misc_feature (1)..(413): NCBI GI: 38037628 NCBI Desc: chloroplast phytoene synthase 1 [zea mays]
  misc_feature (1)..(413): NCBI GI: 39842609 NCBI Desc: chloroplast phytoene synthase [zea mays]
  misc_feature (1)..(413): NCBI GI: 1098665 NCBI Desc: phytoene synthase
  misc_feature (2)..(412): NCBI GI: 47678187 NCBI Desc: phytoene synthase [oryza sativa]
  misc_feature (2)..(412): NCBI GI: 42521626 NCBI Desc: phytoene synthase 1; psy1 [oryza sativa (indica cultivar-group)]
MAIILVRAASPAGLSDAAGIISHHGSLQCSSLPLLNKRPAPARRWMLCSLRYGCLGLDPGRPSPPAVYSSLAVNPAGEAVVSSEQKVYDVVLKQSALLKRQLRKPVLDVVRPQEDLAEMPRNGLNQAYDRCGEICEEYAKTFYLEERRRAIWAIYVWCRRTDELVDGPNANYITPTALDRWEKRLEDLFAGRPYDMLDAALSDTISRFPIDIQPFRDMIEGMRSDLRKTRYNNFDELYMYCYYVAGTVGLMSVPVMGIAPESKATTESVYSAALALGIANQLTNILRDVGEDATRGRIYLPQDELAQAGLSDEDIFKGVVTNRWRNFMKRQIKRARMFFEEAERGVTELSQASRWPVWASLLLYRQILDEIEANDYNNFTKRAYVGKGKKLLALPVAYGKSLLLPCSLRNTQT

SEQ ID NO: 2345 - DNA, 3147 bp, Sorghum bicolor
  misc_feature: Ceres ANNOT ID no. 6023759
  misc_feature: Encodes the peptide sequence at SEQ ID NO 2346
atgggatcttggagaccgaaactgcctgggttgggcgagggctctcaggatgctgagcccggtggtggtgggagaggtcctggaagaggtttccgtggccgcggtggctcctaccatcaacaactcccacaaggtggtcgtggaactggttactaccagcatggacagggctccatgttacaacctcgtggagtgatgatgtcgcagcggtggcagcctgctggccctgctgcaggatatctgggccaaggtcaagcttacagagaagtgcaggcaccacagtactatggtggtggtagaggtggacgtggggcaggcccgtccgccatagctcccgagctgcgccaagcaatggaaacttcacatgaacctgataacatctcaccagaaacaggctctccagatctgtcaccaagagcttctactgtagaagttacggatcagctgaaagatttgtctgtacaggacgaatcaagcatgtgccaagacattgtgcaagcatttccagtgtcgagcaatgcatgtaagtttcctcatcgcccaggaagtggaagtattggcaccaggtgtttggtgaaggcaaatcacttctttgctgaattgcctgacaaggatcttcatcagtatgatgtttcaatcaccccggaagtcacatcgcgaattgtgaaccgatctgtcatggaagagctggtgaagctgcacaagatgtcatacttgggagggcggcttccagcctatgatggtagaaagagcctatacacggctggtccactgccattcatttcaaaagaatttcacatcactctacttgaggaagacgatggttctggagtagagaggcgtaagaaaacatacaaggtagtgattaaatttgctgcaagggctgatctctgtcgtctggagcaatttttagctggaaggcaggcagaggctcctcaagaagccttgcaagttcttgatattgttctgcgggagctgccaacaacaagatatgcaccatttgggcgatcatttttctctcctgacctggggaggaggcgatcccttggtgagggaatagaatgctggcgtgggttttaccagagcattcggcctactcaaatgggcctgtcattgaatattgatatgtcggcaacagctttctttgagccgttacctgtgatagattttgttgcacagcttttaaacaccgacatccactcaaggcctctctcagatgctgaacgtgtcaagataaagaaggccttaagaggagtgaaggtggaagttacccaccgtggtaacatgcgacggaagtatcgaatagctggtttaacatctctggcaactcgggagttaacttttcctgttgatcaaggcggcacattgaaatctgttgtacaatattttcaagagacctatggctttgccatccagcacacctacctgccctgtctgcaagtcggcaatcagcagcacccaaattaccttccaatggaggtctgcaaaatagtagagggacagaggtactctaagagattaaaccagggtcagataagagctcttttagaggagacatgccagcgcccacatgatcgggagcgtgacattattcagatggtgaatcataactcttaccatgaggatccttatgctaaagagtttggcattaagatcagtgagcgtttggcttcaattgaggcacggattttacctgctcctcggctcaagtataatgaaactggcagagagaaggactgcttgcctagagttgggcagtggaatatgatgaacaagaaaatggtaaacggtggtagagtgaggagctggatctgtgtcaattttgctcgaaacgtgcaagagagcgttgctgttgggttctgccgtgaacttgctcgcatgtgccaagcctcgggaatggactttgccttggagcctattcttccgcctatatatgcacatcctgataaagtggagagagctctgaaagccaggttccatgatgcaatgagcatgctcggaccacagcgcaaagaactcgatttgcttattgggatacttcctgataacaacggttctctttatggtgatttgaagcgtatctgtgaaattgaccttggattagtttcacagtgctgctgtgcaaagcaagtttttaagatgaacaaacagatactggcaaatctcgctctgaagataaatgtcaaggttggaggaaggaacacagtgctggctgatgcagtatcaagacgcattcctttggtgactgacaggcctaccatcatatttggtgctgatgtgacccatcctcatcctggtgaagatagcagcccttccattgctgctgttgtggcttcccaagattggcctgaggtgacaaagtatgcaggtttagtttctgctcaatctcataggcaagagttaatagaggatctgtataaggtcgtacatgatcctcagaaaggaaccatttgtggtggcatgatcagggagctccttatatccttcaaaagatcaactggtcaaaagcctcagaggatactattctacagggatggtgtgagtgaagggcagttctaccaagttctactgcatgaattggatgcaatccgaaaggcgtgtgcatcgctggaagcaaattaccaaccacaggtgactttcatcgtggtccagaaacggcaccacacgaggttgttcgcacacaaccacaatgatcagaattcagtcgacaggagtgggaacatacttcctggtactgttgtggactcgaagatctgccaccctacagagtttgacttcttcctgtgcagccatgctggcatcaagggcacgagccgtcctgctcactaccatgtcttgtgggatgaaaacaacttcacagctgatgcattgcagacccttaccaataacctttgctacacttacgcgaggtgcacacgttctgtatccattgtcccaccagcatactacgctcatctagctgcattccgcgcccggttctacatggagccggacagctcagacagtggatcactggcgagtggctctcgcggaggagcgccgtccagctcttctacatcccgcagtacccgtgccgccaccagtggagccgttaggccccttcctgtgctcaaggacagtgtcaagaacgtcatgttctactgctga

SEQ ID NO: 2346 - protein, 1048 aa, Sorghum bicolor
  misc_feature: Ceres ANNOT ID no. 6023759
  misc_feature (675)..(996): Pfam Id: Piwi Pfam Desc: Piwi domain
  misc_feature (385)..(522): Pfam Id: PAZ Pfam Desc: PAZ domain
  misc_feature (70)..(1048): NCBI GI: 48716397 NCBI Desc: ago1 homologous protein [oryza sativa (japonica cultivar-group)]
  misc_feature (169)..(1048): NCBI GI: 21280323 NCBI Desc: ago1 homologous protein [oryza sativa (japonica cultivar-group)]
  misc_feature (4)..(1048): NCBI GI: 38344266 NCBI Desc: osjnba0005n02.3 [oryza sativa (japonica cultivar-group)]
  misc_feature (5)..(1048): NCBI GI: 84688906 NCBI Desc: ago1-1 [nicotiana benthamiana]
  misc_feature (98)..(1048): NCBI GI: 84688908 NCBI Desc: ago1-2 [nicotiana benthamiana]
  misc_feature: The sequence is a functional homolog of SEQ ID NO 2086 in the 10/374,780US patent application
  misc_feature: Useful for making plants with modulated growth and phenotype characteristics
  misc_feature: The sequence is a functional homolog of SEQ ID NO 2086 in the 20060162006 US patent application
  misc_feature: The sequence is a functional homolog of SEQ ID NO 2086 in the 10/374,780 US patent application
  misc_feature: The sequence is a functional homolog of SEQ ID NO 152 in the 10/225,066 US patent application
  misc_feature: The sequence is a functional homolog of SEQ ID NO 238 in the 10/374,780 US patent application
MGSWRPKLPGLGEGSQDAEPGGGGRGPGRGFRGRGGSYHQQLPQGGRGTGYYQHGQGSMLQPRGVMMSQRWQPAGPAAGYLGQGQAYREVQAPQYYGGGRGGRGAGPSAIAPELRQAMETSHEPDNISPETGSPDLSPRASTVEVTDQLKDLSVQDESSMCQDIVQAFPVSSNACKFPHRPGSGSIGTRCLVKANHFFAELPDKDLHQYDVSITPEVTSRIVNRSVMEELVKLHKMSYLGGRLPAYDGRKSLYTAGPLPFISKEFHITLLEEDDGSGVERRKKTYKVVIKFAARADLCRLEQFLAGRQAEAPQEALQVLDIVLRELPTTRYAPFGRSFFSPDLGRRRSLGEGIECWRGFYQSIRPTQMGLSLNIDMSATAFFEPLPVIDFVAQLLNTDIHSRPLSDAERVKIKKALRGVKVEVTHRGNMRRKYRIAGLTSLATRELTFPVDQGGTLKSVVQYFQETYGFAIQHTYLPCLQVGNQQHPNYLPMEVCKIVEGQRYSKRLNQGQIRALLEETCQRPHDRERDIIQMVNHNSYHEDPYAKEFGIKISERLASIEARILPAPRLKYNETGREKDCLPRVGQWNMMNKKMVNGGRVRSWICVNFARNVQESVAVGFCRELARMCQASGMDFALEPILPPIYAHPDKVERALKARFHDAMSMLGPQRKELDLLIGILPDNNGSLYGDLKRICEIDLGLVSQCCCAKQVFKMNKQILANLALKINVKVGGRNTVLADAVSRRIPLVTDRPTIIFGADVTHPHPGEDSSPSIAAVVASQDWPEVTKYAGLVSAQSHRQELIEDLYKVVHDPQKGTICGGMIRELLISFKRSTGQKPQRILFYRDGVSEGQFYQVLLHELDAIRKACASLEANYQPQVTFIVVQKRHHTRLFAHNHNDQNSVDRSGNILPGTVVDSKICHPTEFDFFLCSHAGIKGTSRPAHYHVLWDENNFTADALQTLTNNLCYTYARCTRSVSIVPPAYYAHLAAFRARFYMEPDSSDSGSLASGSRGGAPSSSSTSRSTRAATSGAVRPLPVLKDSVKNVMFYC

SEQ ID NO: 2347 - DNA, 861 bp, Sorghum bicolor
  misc_feature: Ceres ANNOT ID no. 6023764
  misc_feature: Encodes the peptide sequence at SEQ ID NO 2348
atggtgggtctctctgaaggggagaagcacttcatctgcggcggcattgcgcaggacctccgcactgatggacgtaggcgactgcagttccgggccctctccgtccaaaccggagtcatcccacaggcgaatggctcagcgcgtgttagattgggggccactgaaataatcgctagtgtcaaggctgaacttggaaaaccaagcattcttcaccctgacaaaggaaaagtttccatttttgttgactgtagtccaaccgctgagcctatgttcgagggtagaggttctgaagaattgtctgctgagctctctgtttccctgcaaagatgcttgctgggtggtaaaagtggtgctggtgctgcaattgatctgtcgtccctaattgttgttgagggaaaggtctgctgggatctgtacattgatgggcttgtggtcagttctgatggtaatttgctagatgcgctagctgctgcaataaaggttgctttgagtgatacaggtataccaaaagttaatgtttctgttaatgctgcatctgacgaggagcctgaagttgatgtaagcgacgaggaatttctgcagtttgacacctccagtgtgcctgttattattacattaaccaaggtgggccggcactacatcgttgacgctacctcagaggaagaatcccagatgagttctgcagtgtcagtatcagttaacaggaatggccaaatatgtgggcttaccaagaggggaggtgcagggctggacccaagcgtcatcttcgatatgatatctgtcgccaagcatgtgagccagcagttcatctctctcttggattcagagattgccgccgctgaagctgaagaggctgagtga

SEQ ID NO: 2348 - protein, 286 aa, Sorghum bicolor
  misc_feature: Ceres ANNOT ID no. 6023764
  misc_feature (29)..(169): Pfam Id: RNase_PH Pfam Desc: 3' exoribonuclease family, domain 1
  misc_feature (2)..(267): NCBI GI: 30962875 NCBI Desc: exosc7 protein [mus musculus]
  misc_feature (2)..(282): NCBI GI: 119585135 NCBI Desc: exosome component 7, isoform cra_a [homo sapiens]
  misc_feature (2)..(282): NCBI GI: 122920911 NCBI Desc: chain e, structure of the human rna exosome composed of rrp41, rrp45, rrp46, rrp43, mtr3, rrp42, csl4, rrp4, and rrp40
  misc_feature (2)..(282): NCBI GI: 473949 NCBI Desc: kiaa0116 [homo sapiens]
  misc_feature (2)..(282): NCBI GI: 24307981 NCBI Desc: exosome component 7 [homo sapiens]
MVGLSEGEKHFICGGIAQDLRTDGRRRLQFRALSVQTGVIPQANGSARVRLGATEIIASVKAELGKPSILHPDKGKVSIFVDCSPTAEPMFEGRGSEELSAELSVSLQRCLLGGKSGAGAAIDLSSLIVVEGKVCWDLYIDGLVVSSDGNLLDALAAAIKVALSDTGIPKVNVSVNAASDEEPEVDVSDEEFLQFDTSSVPVIITLTKVGRHYIVDATSEEESQMSSAVSVSVNRNGQICGLTKRGGAGLDPSVIFDMISVAKHVSQQFISLLDSEIAAAEAEEAE

SEQ ID NO: 2349 - DNA, 507 bp, Sorghum bicolor
  misc_feature: Ceres ANNOT ID no. 6023765
  misc_feature: Encodes the peptide sequence at SEQ ID NO 2350
atggctgccttgccattggccaccgctgaagtatgtgatgctaatcctcatctgattatgaacggcgagctccgtgctctccagcccatcttccaaatctatggaaggcgccaagttttcgccggccctattgtcacactgaaggtctacgaggacaatgttctgatccgcgagttccttgaggagaaaggccacgggagagtccttgtggttgacggtggtgggagcatgcgctgtgccattcttggtggcaaccccgtccagcaggcacagaacaatgggtgggctggtattcttgtcaacggctgcatcagggatgtcgatgagatcaatggctgcgacattggtgtgcgagctctgagctcgcaccctatgaaggcaaacaagaaggggatgggggagaagcatgtccctgtcaacattgctggaaccaggatttgcgatggcgagtggctctacgccgatacggatggcattcttgtctcaaggactgaactgaccgtgtag

SEQ ID NO: 2350 - protein, 168 aa, Sorghum bicolor
  misc_feature: Ceres ANNOT ID no. 6023765
  misc_feature (4)..(161): Pfam Id: Methyltransf_6 Pfam Desc: Demethylmenaquinone methyltransferase
  misc_feature (1)..(168): NCBI GI: 46805895 NCBI Desc: s-adenosylmethionine:2-demethylmenaquinone methyltransferase-like [oryza sativa (japonica cultivar-group)]
  misc_feature (6)..(168): NCBI GI: 92889308 NCBI Desc: dimethylmenaquinone methyltransferase [medicago truncatula]
  misc_feature (1)..(148): NCBI GI: 115439647 NCBI Desc: os01g0722800 [oryza sativa (japonica cultivar-group)]
  misc_feature (6)..(168): NCBI GI: 21537415 NCBI Desc: s-adenosylmethionine:2-demethylmenaquinone methyltransferase-like protein [arabidopsis thaliana]
  misc_feature (1)..(168): NCBI GI: 46805897 NCBI Desc: s-adenosylmethionine:2-demethylmenaquinone methyltransferase-like [oryza sativa (japonica cultivar-group)]
MAALPLATAEVCDANPHLIMNGELRALQPIFQIYGRRQVFAGPIVTLKVYEDNVLIREFLEEKGHGRVLVVDGGGSMRCAILGGNPVQQAQNNGWAGILVNGCIRDVDEINGCDIGVRALSSHPMKANKKGMGEKHVPVNIAGTRICDGEWLYADTDGILVSRTELTV

SEQ ID NO: 2351 - DNA, 1143 bp, Sorghum bicolor
  misc_feature: Ceres ANNOT ID no. 6023782
  misc_feature: Encodes the peptide sequence at SEQ ID NO 2352
  misc_feature: Up-regulated in root tissues in response to salicylic acid treatment
atgaagcaccagccgccgccgccgccgcgccgctggggcgtcgtggcggcggtcgtcgcgctcgtcctcctcgcctgcctccagatccagtaccagcacctcaaggtggatctcggcaaggccggctttgcctctgccacgcaagagaataacgcgatccccagtcgcaatcgcattcgctgggggaccgccaggaccaggaaggcagccaccggcgctgactccttgccgcgcgggattgtccagcgccactccgacatgtccctccgaccgctctgggaggacgacgctgcttccacccacaagaataaaaatggtgaccacagtgctctcctcgccatggcagtcggcatctcccaaataaaaaacgttgacactatggctcgtaagtttctgaaggaaaactatgcagtcatgctcttccattatgatggaaatgtagatggatggcgtcatcttgagtggagtgataaggccatacacatccttgctcacaaccaaacaaaatggtggtttgctaagcgttttttgcatcctgatgtcatggctatctatgatttcatctttctatgggatgaagaccttggagtggagagcttcaacccaagaagatatcttgatataatggtttcagaaggcttggaaataacacaacctgctctggaccctgatctatcaaccgatatccaccatcggatcacaatccgcaataagatgacaaaagttcacaggagaatatatgacaatcggcctagtatgaattgttctgatgagagcaaaggacctccttgtacagggtgggtagagggcatggcaccagttttttctcgtgctgcttggaaatgtgtatggcatctgattcagaacgatctgattcatggatggggccttgacatgaagcttggctattgtgctcagggtgatcgaactgagaaagttggtgtaattgacagtgagtatgttgttcatcaagggataccatctttaggagggccatcgcttagcagcaagacacctcgaagatcattggatttgaggacccatatacgaaggcaatcatcggctgagctagagaagttcaaagagcggtggaacagggctgtaagggaagatgaaggatggaaggatcctttcgattcttga

SEQ ID NO: 2352 - protein, 380 aa, Sorghum bicolor
  misc_feature: Ceres ANNOT ID no. 6023782
  misc_feature (76)..(374): NCBI GI: 24636978 NCBI Desc: lysine ketoglutarate reductase trans-splicing related 1 [arabidopsis thaliana]
  misc_feature (71)..(378): NCBI GI: 57899847 NCBI Desc: lysine ketoglutarate reductase trans-splicing related 1-like [oryza sativa (japonica cultivar-group)]
  misc_feature (1)..(378): NCBI GI: 115471717 NCBI Desc: os07g0414700 [oryza sativa (japonica cultivar-group)]
  misc_feature (72)..(361): NCBI GI: 9743342 NCBI Desc: f21j9.23 [arabidopsis thaliana]
  misc_feature (44)..(367): NCBI GI: 23309021 NCBI Desc: at3g26440/f20c19_16 [arabidopsis thaliana]
  misc_feature: Useful for biocontainment applications
  misc_feature: Functional homolog of the protein sequence given in SEQ ID NO 12967
  misc_feature: Useful for biocontainment applications
  misc_feature: Functional homolog of the protein sequence given in SEQ ID NO 12967
  misc_feature: Up-regulated in root tissues in response to salicylic acid treatment
MKHQPPPPPRRWGVVAAVVALVLLACLQIQYQHLKVDLGKAGFASATQENNAIPSRNRIRWGTARTRKAATGADSLPRGIVQRHSDMSLRPLWEDDAASTHKNKNGDHSALLAMAVGISQIKNVDTMARKFLKENYAVMLFHYDGNVDGWRHLEWSDKAIHILAHNQTKWWFAKRFLHPDVMAIYDFIFLWDEDLGVESFNPRRYLDIMVSEGLEITQPALDPDLSTDIHHRITIRNKMTKVHRRIYDNRPSMNCSDESKGPPCTGWVEGMAPVFSRAAWKCVWHLIQNDLIHGWGLDMKLGYCAQGDRTEKVGVIDSEYVVHQGIPSLGGPSLSSKTPRRSLDLRTHIRRQSSAELEKFKERWNRAVREDEGWKDPFDS

SEQ ID NO: 2353 - DNA, 828 bp, Sorghum bicolor
  misc_feature: Ceres ANNOT ID no. 6023798
  misc_feature: Encodes the peptide sequence at SEQ ID NO 2354
atgtcggtcccggactactccacctccaccggcggcgccatcatcgtctcctgcgcctccgtcgccaagctgaagccgcagcgcaacagcaagcgacgtcgacaccactgctcgtcgcccgctgcttcatcttcctcctcacacagtagcagcaccaccacacagaaagaggaggaggaagacgaggacatggctagatgcctcatcctcctcgcccagggcccccccgccgccgccgccgttgagccagcaagagtaatgccggcaccggcaccccccagcaggccaaagagcacgagccgcagagccgccgctgaggccggaggtggcgtgtgcgtgtcgtacgagtgcaagacgtgcaacaagtgcttcccctccttccaggccctcggcggccaccgcaccagccacaacaatgataagaagcagcagccgccgccgccgcgacggccggaggaggcggctgctgctgctgtcaccaccacgcttagcctgcgcacagctgcagcggcgacgaggccggcgcacgagtgctcgtcatgcggcgcggtgttcgcgtccgggcaggcgctcggtgggcacatgaggcgccaccggccgctcaccaccagctcgtcggccgcggcggcgcccgagagcgtggtcaccgccacggggacgacgggggaccaagacagtagcaagctgctgcaggagggcaacatcaacctggagctggacctcaacctgctgccggcgccgtcgacggagcaggaggtgacatccccggcaaagccgccgtgccatgcaccagcagttcagctgatgcatgctttgactcgccactag

SEQ ID NO: 2354 - protein, 275 aa, Sorghum bicolor
  misc_feature: Ceres ANNOT ID no. 6023798
  misc_feature (28)..(252): NCBI GI: 63259075 NCBI Desc: cys2/his2 zinc-finger transcription factor [silene latifolia]
  misc_feature (28)..(141): NCBI GI: 20546 NCBI Desc: dna-binding protein [petunia x hybrida]
  misc_feature (176)..(250): NCBI GI: 2346972 NCBI Desc: zpt2-11 [petunia x hybrida]
  misc_feature (45)..(250): NCBI GI: 1418339 NCBI Desc: zinc finger protein [arabidopsis thaliana]
  misc_feature (55)..(256): NCBI GI: 55734108 NCBI Desc: zinc finger dna-binding protein [catharanthus roseus]
  misc_feature: The plant flowers significantly late compared to wild-type.
  misc_feature: The plant is abnormally large.
  misc_feature: The plant is abnormally small.
  misc_feature: The sequence is a functional homolog of SEQ ID NO 1092 in the 10/666,642US patent application
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1212 in the 10/412,699US patent application
  misc_feature: The sequence is a functional homolog of SEQ ID NO 1213 in the 10/412,699US patent application
  misc_feature: The sequence is a functional homolog of SEQ ID NO 1214 in the 10/412,699US patent application
  misc_feature: The sequence is a functional homolog of SEQ ID NO 1215 in the 10/412,699US patent application
  misc_feature: The sequence is a functional homolog of SEQ ID NO 1288 in the 10/666,642US patent application
  misc_feature: The sequence is a functional homolog of SEQ ID NO 1289 in the 10/666,642US patent application
  misc_feature: The sequence is a functional homolog of SEQ ID NO 1290 in the 10/666,642US patent application
  misc_feature: The sequence is a functional homolog of SEQ ID NO 1291 in the 10/666,642US patent application
  misc_feature: The sequence is a functional homolog of SEQ ID NO 1292 in the 10/666,642US patent application
  misc_feature: The sequence is a functional homolog of SEQ ID NO 2 in the 10/374,780US patent application
  misc_feature: The sequence is a functional homolog of SEQ ID NO 464 in the 11/435,388US patent application
  misc_feature: The sequence is a functional homolog of SEQ ID NO 622 in the 10/374,780US patent application
  misc_feature: The sequence is a functional homolog of SEQ ID NO 623 in the 10/374,780US patent application
  misc_feature: The sequence is a functional homolog of SEQ ID NO 624 in the 10/374,780US patent application
  misc_feature: The sequence is a functional homolog of SEQ ID NO 625 in the 10/374,780US patent application
  misc_feature: The sequence is a functional homolog of SEQ ID NO 626 in the 10/374,780US patent application
  misc_feature: The sequence is a functional homolog of SEQ ID NO 830 in the 10/666,642US patent application
  misc_feature: The sequence is a functional homolog of SEQ ID NO 831 in the 10/666,642US patent application
  misc_feature: The sequence is a functional homolog of SEQ ID NO 832 in the 10/666,642US patent application
  misc_feature: The sequence is a functional homolog of SEQ ID NO 903 in the 10/374,780US patent application
  misc_feature: The sequence is a functional homolog of SEQ ID NO 904 in the 10/374,780US patent application
  misc_feature: The sequence is a functional homolog of SEQ ID NO 905 in the 10/374,780US patent application
  misc_feature: The sequence is a functional homolog of SEQ ID NO 906 in the 10/374,780US patent application
  misc_feature: The sequence is a functional homolog of SEQ ID NO 907 in the 10/374,780US patent application
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated nitrogen use efficiency
  misc_feature: Useful for making plants with modulated drought sensitivity
  misc_feature: Functional homolog of the protein sequence given in SEQ ID NO 13265
  misc_feature: Functional homolog of the protein sequence given in SEQ ID NO 13271
  misc_feature: The sequence is a functional homolog of SEQ ID NO 12 in the 20040045049 US patent application
  misc_feature: The sequence is a functional homolog of SEQ ID NO 1212 in the 20040045049 US patent application
  misc_feature: The sequence is a functional homolog of SEQ ID NO 1213 in the 20040045049 US patent application
  misc_feature: The sequence is a functional homolog of SEQ ID NO 1214 in the 20040045049 US patent application
  misc_feature: The sequence is a functional homolog of SEQ ID NO 1215 in the 20040045049 US patent application
  misc_feature: The sequence is a functional homolog of SEQ ID NO 622 in the 20060162006 US patent application
  misc_feature: The sequence is a functional homolog of SEQ ID NO 623 in the 20060162006 US patent application
  misc_feature: The sequence is a functional homolog of SEQ ID NO 624 in the 20060162006 US patent application
  misc_feature: The sequence is a functional homolog of SEQ ID NO 625 in the 20060162006 US patent application
  misc_feature: The sequence is a functional homolog of SEQ ID NO 626 in the 20060162006 US patent application
  misc_feature: The sequence is a functional homolog of SEQ ID NO 907 in the 20060162006 US patent application
  misc_feature: The sequence is a functional homolog of SEQ ID NO 1092 in the 20070033671 US patent application
  misc_feature: The sequence is a functional homolog of SEQ ID NO 830 in the 20070033671 US patent application
  misc_feature: The sequence is a functional homolog of SEQ ID NO 831 in the 20070033671 US patent application
  misc_feature: The sequence is a functional homolog of SEQ ID NO 832 in the 20070033671 US patent application
  misc_feature: Functional homolog of the protein sequence given in SEQ ID NO 13580
  misc_feature: The sequence is a functional homolog of SEQ ID NO. 457 in the 11/188,298 US application
  misc_feature: The sequence is a functional homolog of SEQ ID NO. 351 in the 11/188,298 US application
MSVPDYSTSTGGAIIVSCASVAKLKPQRNSKRRRHHCSSPAASSSSSHSSSTTTQKEEEEDEDMARCLILLAQGPPAAAAVEPARVMPAPAPPSRPKSTSRRAAAEAGGGVCVSYECKTCNKCFPSFQALGGHRTSHNNDKKQQPPPPRRPEEAAAAAVTTTLSLRTAAAATRPAHECSSCGAVFASGQALGGHMRRHRPLTTSSSAAAAPESVVTATGTTGDQDSSKLLQEGNINLELDLNLLPAPSTEQEVTSPAKPPCHAPAVQLMHALTRH

SEQ ID NO: 2355 - DNA, 1611 bp, Sorghum bicolor
  misc_feature: Ceres ANNOT ID no. 6023799
  misc_feature: Encodes the peptide sequence at SEQ ID NO 2356
atggccgccgcggcggtcttggcgctgctcacggtgtcggttctggcgggggcagcggccggcggtgatatcgtccaccacgacgacgaggcacccaagatccctggatgcaacaacgatttcatcctggtaaaagtgcaaagctgggtcaatggcaaagaggatggcgagtttgttggtgtcggtgctcgctttggtccaaaaatcgtctccaaggagaagcacgcaaaccgaactaaactcacgctggctgaccctatggactgctgctcgcctccaaaacacaaggtttctggagatgttcttttagttcaaaggggcaagtgcaaattcacaaagaaagcaaagtttgctgaagctgctggtgcttctgctatagtaatcataaaccatgtccacgaattgtacaagatggtctgtgaaaagaatgaaaccgatcttgacataaatatacctgcagttctcctgccaaaagatgcgggttctgctttacatacacttcttacagatggtaacgcagtttctgtgcagctgtactctccagatcgtcctgtagttgacactgcagaggtgtttctatggcttatggctgttggcacagtgcttggtgcttcctactggtcagcatggagtgctagagaagcagttattgaacaagagaagctcctcaaggatggccatgaaagcctactgaatgttgaggccggaggttctagtggcatggtagatatcaacgtggcatcagcgataatgtttgtggtggttgcgtcatgcttcttaataatgctttacaaactgatgtcttactggtttgtggagctactggtggtaatcttctgcattggaggtgtagagggtctgcaaacatgtttggtggctctgttatcaagatggtttaaacctgctgcagaatcttttgtgaaagtaccgttccttggagctgtttcacatcttactcttgcagtttgcccattttgtgtcgcatttgctgttctgtgggctgtttttcgccagcttccctttgcttggattgggcaagacattctgggtattgcactgatagttacagtcatccaaattgtcagagtacctaacctcaaggtgggttcagttcttctcagctgtgccttcctgtatgacatcttctgggtgtttatctccaagaggtggtttcatgagagtgtgatgattgtggttgcacgtggcgacaagactgacgaggatggtgtgcccatgctgctaaaaatcccgcgaatgtttgatccatggggtggatacagcatcattggctttggtgatatccttcttcctggtcttttagttgctttcgcgctaagatacgatttttctgcaaagaagggcttccggtctggttactttttgtgggcaatggtggcctatggctctggacttttaatcacatatgttgcgctgaacctgatggatgggcatggccaacctgcccttctgtacatcgtgcctttcacgcttggcaccttgatcgcgcttggatggaagagaggggagctgccaaacctgtggacgaggggagagccggagagagtgtgcacacatatgcatatgccgctgttgccgacgaccccaaactaa

SEQ ID NO: 2356 - protein, 536 aa, Sorghum bicolor
  misc_feature: Ceres ANNOT ID no. 6023799
  misc_feature (236)..(518): Pfam Id: Peptidase_A22B Pfam Desc: Signal peptide peptidase
  misc_feature (72)..(168): Pfam Id: PA Pfam Desc: PA domain
  misc_feature (4)..(536): NCBI GI: 115449841 NCBI Desc: os02g0823000 [oryza sativa (japonica cultivar-group)]
  misc_feature (22)..(525): NCBI GI: 16118856 NCBI Desc: growth-on protein gro10 [euphorbia esula]
  misc_feature (8)..(530): NCBI GI: 42571983 NCBI Desc: protease-associated (pa) domain-containing protein [arabidopsis thaliana]
  misc_feature (8)..(530): NCBI GI: 21554548 NCBI Desc: growth-on protein gro10 [arabidopsis thaliana]
  misc_feature (5)..(536): NCBI GI: 144923914 NCBI Desc: protease-associated pa; peptidase a22b, minor histocompatibility antigen h13 [medicago truncatula]
MAAAAVLALLTVSVLAGAAAGGDIVHHDDEAPKIPGCNNDFILVKVQSWVNGKEDGEFVGVGARFGPKIVSKEKHANRTKLTLADPMDCCSPPKHKVSGDVLLVQRGKCKFTKKAKFAEAAGASAIVIINHVHELYKMVCEKNETDLDINIPAVLLPKDAGSALHTLLTDGNAVSVQLYSPDRPVVDTAEVFLWLMAVGTVLGASYWSAWSAREAVIEQEKLLKDGHESLLNVEAGGSSGMVDINVASAIMFVVVASCFLIMLYKLMSYWFVELLVVIFCIGGVEGLQTCLVALLSRWFKPAAESFVKVPFLGAVSHLTLAVCPFCVAFAVLWAVFRQLPFAWIGQDILGIALIVTVIQIVRVPNLKVGSVLLSCAFLYDIFWVFISKRWFHESVMIVVARGDKTDEDGVPMLLKIPRMFDPWGGYSIIGFGDILLPGLLVAFALRYDFSAKKGFRSGYFLWAMVAYGSGLLITYVALNLMDGHGQPALLYIVPFTLGTLIALGWKRGELPNLWTRGEPERVCTHMHMPLLPTTPN

SEQ ID NO: 2357 - DNA, 594 bp, Sorghum bicolor
  misc_feature: Ceres ANNOT ID no. 6023806
  misc_feature: Encodes the peptide sequence at SEQ ID NO 2358
atggcgcaagacgactacctgtccctgtgcctcgcggcgctggtggccgcgtgccagcaagccggcgccgaagacgacgacgcggcaccgttacgggcgagggcggcgtcgtccgagctcccgctcgcgctgcactaccgctgcccgatctgtggcaaggcgttcgcgtcgtaccaagcgctcggcggacacaaggcgagccaccgcaagcctgcagcggcggcatacgatggcagggcggcgccatcgtcgtcatcgtcccagcatcgtcagaagggggccgcggaagcgtcgtcgtcgtcgtccgggagcggcgccggcgccgggcggcacgtctgcacggtgtgccacaggtacttcgccaccgggcaggcgctcggcgggcacaagaggttccactacctccacggcccgtcggtgccggcgtcgctgccgcccagcactgcgggcgcgggctggcttgacctcaactcgacgccccttgcgcaagacgacgttccatttgccggcgtcagacgacggggcgaggatgaggaggttcagagatccttgcctttgcaagccaagaagcatcgggcgtcaaatgctgcgtga

SEQ ID NO: 2358 - protein, 197 aa, Sorghum bicolor
  misc_feature: Ceres ANNOT ID no. 6023806
  misc_feature (46)..(68): Pfam Id: zf-C2H2 Pfam Desc: Zinc finger, C2H2 type
  misc_feature (3)..(195): NCBI GI: 31580711 NCBI Desc: c2h2-type zinc finger protein zfp36 [oryza sativa (japonica cultivar-group)]
  misc_feature (5)..(192): NCBI GI: 115473107 NCBI Desc: os07g0590100 [oryza sativa (japonica cultivar-group)]
  misc_feature (2)..(192): NCBI GI: 28849865 NCBI Desc: zinc finger transcription factor zfp2 [oryza sativa (japonica cultivar-group)]
  misc_feature (3)..(194): NCBI GI: 71979887 NCBI Desc: cys2-his2 type zinc finger protein [nicotiana tabacum]
  misc_feature (3)..(194): NCBI GI: 33771374 NCBI Desc: zinc finger protein pif1 [nicotiana benthamiana]
  misc_feature: The sequence is a functional homolog of SEQ ID NO 1012 in the 10/666,642US patent application
  misc_feature: The sequence is a functional homolog of SEQ ID NO 1093 in the 10/666,642US patent application
  misc_feature: The sequence is a functional homolog of SEQ ID NO 1212 in the 10/412,699US patent application
  misc_feature: The sequence is a functional homolog of SEQ ID NO 1213 in the 10/412,699US patent application
  misc_feature: The sequence is a functional homolog of SEQ ID NO 1214 in the 10/412,699US patent application
  misc_feature: The sequence is a functional homolog of SEQ ID NO 1215 in the 10/412,699US patent application
  misc_feature: The sequence is a functional homolog of SEQ ID NO 1288 in the 10/666,642US patent application
  misc_feature: The sequence is a functional homolog of SEQ ID NO 1289 in the 10/666,642US patent application
  misc_feature: The sequence is a functional homolog of SEQ ID NO 1290 in the 10/666,642US patent application
  misc_feature: The sequence is a functional homolog of SEQ ID NO 1291 in the 10/666,642US patent application
  misc_feature: The sequence is a functional homolog of SEQ ID NO 1292 in the 10/666,642US patent application
  misc_feature: The sequence is a functional homolog of SEQ ID NO 1762 in the 10/412,699US patent application
  misc_feature: The sequence is a functional homolog of SEQ ID NO 1988 in the 10/374,780US patent application
  misc_feature: The sequence is a functional homolog of SEQ ID NO 32 in the 10/286,264US patent application
  misc_feature: The sequence is a functional homolog of SEQ ID NO 592 in the 11/435,388US patent application
  misc_feature: The sequence is a functional homolog of SEQ ID NO 622 in the 10/374,780US patent application
  misc_feature: The sequence is a functional homolog of SEQ ID NO 623 in the 10/374,780US patent application
  misc_feature: The sequence is a functional homolog of SEQ ID NO 624 in the 10/374,780US patent application
  misc_feature: The sequence is a functional homolog of SEQ ID NO 625 in the 10/374,780US patent application
  misc_feature: The sequence is a functional homolog of SEQ ID NO 626 in the 10/374,780US patent application
  misc_feature: The sequence is a functional homolog of SEQ ID NO 830 in the 10/666,642US patent application
  misc_feature: The sequence is a functional homolog of SEQ ID NO 831 in the 10/666,642US patent application
  misc_feature: The sequence is a functional homolog of SEQ ID NO 832 in the 10/666,642US patent application
  misc_feature: The sequence is a functional homolog of SEQ ID NO 903 in the 10/374,780US patent application
  misc_feature: The sequence is a functional homolog of SEQ ID NO 904 in the 10/374,780US patent application
  misc_feature: The sequence is a functional homolog of SEQ ID NO 905 in the 10/374,780US patent application
  misc_feature: The sequence is a functional homolog of SEQ ID NO 906 in the 10/374,780US patent application
  misc_feature: The sequence is a functional homolog of SEQ ID NO 907 in the 10/374,780US patent application
  misc_feature: Useful for making plants with modulated growth and phenotype characteristics
  misc_feature: The sequence is a functional homolog of SEQ ID NO 32 in the 20030093837 US patent application
  misc_feature: The sequence is a functional homolog of SEQ ID NO 1212 in the 20040045049 US patent application
  misc_feature: The sequence is a functional homolog of SEQ ID NO 1213 in the 20040045049 US patent application
  misc_feature: The sequence is a functional homolog of SEQ ID NO 1214 in the 20040045049 US patent application
  misc_feature: The sequence is a functional homolog of SEQ ID NO 1215 in the 20040045049 US patent application
  misc_feature: The sequence is a functional homolog of SEQ ID NO 622 in the 20060162006 US patent application
  misc_feature: The sequence is a functional homolog of SEQ ID NO 623 in the 20060162006 US patent application
  misc_feature: The sequence is a functional homolog of SEQ ID NO 624 in the 20060162006 US patent application
  misc_feature: The sequence is a functional homolog of SEQ ID NO 625 in the 20060162006 US patent application
  misc_feature: The sequence is a functional homolog of SEQ ID NO 626 in the 20060162006 US patent application
  misc_feature: The sequence is a functional homolog of SEQ ID NO 907 in the 20060162006 US patent application
  misc_feature: The sequence is a functional homolog of SEQ ID NO 1012 in the 20070033671 US patent application
  misc_feature: The sequence is a functional homolog of SEQ ID NO 1093 in the 20070033671 US patent application
  misc_feature: The sequence is a functional homolog of SEQ ID NO 830 in the 20070033671 US patent application
  misc_feature: The sequence is a functional homolog of SEQ ID NO 831 in the 20070033671 US patent application
  misc_feature: The sequence is a functional homolog of SEQ ID NO 832 in the 20070033671 US patent application
  misc_feature: The sequence is a functional homolog of SEQ ID NO. 457 in the 11/188,298 US application
  misc_feature: The sequence is a functional homolog of SEQ ID NO. 351 in the 11/188,298 US application
MAQDDYLSLCLAALVAACQQAGAEDDDAAPLRARAASSELPLALHYRCPICGKAFASYQALGGHKASHRKPAAAAYDGRAAPSSSSSQHRQKGAAEASSSSSGSGAGAGRHVCTVCHRYFATGQALGGHKRFHYLHGPSVPASLPPSTAGAGWLDLNSTPLAQDDVPFAGVRRRGEDEEVQRSLPLQAKKHRASNAA

SEQ ID NO: 2359 - DNA, 1320 bp, Sorghum bicolor
  misc_feature: Ceres ANNOT ID no. 6023809
  misc_feature: Encodes the peptide sequence at SEQ ID NO 2360
  misc_feature: Down-regulated in shoot tissues in response to aminocyclopropane carboxylic treatment
  misc_feature: Down-regulated in shoot tissues in response to salicylic acid treatment
atggcttcggcggcggcgactcaggtggggacttacttcctgcgaaactactacaacctgctgcaacaaaccccggatgtagtccaccagttctacagtgatgctagcaccatggtccgcgtcgacgacctcaccggcacgaccgcggccgccaacaacatgatggacatacactcgctcatcatgtccttgaacttcacccaaatcgagatcaagactgccaactttgtcaactcatggggcgatggggtgctagttatggtctccggtctcgtgcagaccaaggagtacagccaccaaaggaaatttatccagatgttcttccttgcccctcaagagaagggttactttgtcctcaacgattactttcactttgttgaccaagaacatgtgcagcctgcgccagtgattggtcaggaagactacgagagcaatttggcacccaacacagttgttgagactgctcctgagtacattcacgaggaagaaactcaacaaatagcaccagaaggacatgatttggtcgacaactatacttattctgagccacaacagcaagtagtgtcatctgacaactggggagaggagccccttcctgaagaaccgccttctttctcaaatgaaatgacagtcgctcctgaggagccggtgcaacctccacctgttccgcctcctcacgtcgaggagcctgttggtgaaccagtaaagaagacttatgcttccatcctaaaaaccgcaaaggctcctcctgcattcccggtagcgcagcaagtaccagtgagtaagccttctcaccctacaacagagtcaatccagacccaacattcagttatggcttcatcaacgggagctgagaaaccaaggtctgatgtctatggtgagggtgctgcccatgatgatgaagagagcaaatctgtttatgttggcaacgtgccagcaaatgtaaatgaggctgatcttgaaagtgagttcaaaaagtttggtcggcttattcctgacggtgttgctatcagaagccgaaaggagactggtggctattatgctttcgtggaattcgaggaactcagcggtgtacacaatgcgttaaaggcttcaccaattgaaataaatggacggcagatatatgttgaggagaggaagccaaatagcggaataagaggtggaaggaggggaggacgtggccgtttcagcggtggaggccgtggatatgcgagaggcggaggtgacgagtacaatggtaaccgcagtaggtcgaacggctacggtcgtgttcctcaccaagagaggggcatactcgggagccacaccgcaaggaactga

SEQ ID NO: 2360 - protein, 439 aa, Sorghum bicolor
  misc_feature: Ceres ANNOT ID no. 6023809
  misc_feature (9)..(125): Pfam Id: NTF2 Pfam Desc: Nuclear transport factor 2 (NTF2) domain
  misc_feature (306)..(376): Pfam Id: RRM_1 Pfam Desc: RNA recognition motif. (a.k.a. RRM, RBD, or RNP domain)
  misc_feature (2)..(415): NCBI GI: 115444027 NCBI Desc: os02g0131700 [oryza sativa (japonica cultivar-group)]
  misc_feature (3)..(421): NCBI GI: 92894023 NCBI Desc: rna-binding region rnp-1 (rna recognition motif); nuclear transport factor 2 [medicago truncatula]
  misc_feature (6)..(423): NCBI GI: 32488444 NCBI Desc: osjnba0004n05.1 [oryza sativa (japonica cultivar-group)]
  misc_feature (6)..(423): NCBI GI: 116311069 NCBI Desc: osigba0157k09-h0214g12.10 [oryza sativa (indica cultivar-group)]
  misc_feature (12)..(423): NCBI GI: 115459374 NCBI Desc: os04g0510500 [oryza sativa (japonica cultivar-group)]
  misc_feature: Down-regulated in shoot tissues in response to aminocyclopropane carboxylic treatment
  misc_feature: Down-regulated in shoot tissues in response to salicylic acid treatment
  misc_feature: The sequence is a functional homolog of SEQ ID NO. 458 in the 11/188,298 US application
  misc_feature: The sequence is a functional homolog of SEQ ID NO. 339 in the 11/188,298 US application
MASAAATQVGTYFLRNYYNLLQQTPDVVHQFYSDASTMVRVDDLTGTTAAANNMMDIHSLIMSLNFTQIEIKTANFVNSWGDGVLVMVSGLVQTKEYSHQRKFIQMFFLAPQEKGYFVLNDYFHFVDQEHVQPAPVIGQEDYESNLAPNTVVETAPEYIHEEETQQIAPEGHDLVDNYTYSEPQQQVVSSDNWGEEPLPEEPPSFSNEMTVAPEEPVQPPPVPPPHVEEPVGEPVKKTYASILKTAKAPPAFPVAQQVPVSKPSHPTTESIQTQHSVMASSTGAEKPRSDVYGEGAAHDDEESKSVYVGNVPANVNEADLESEFKKFGRLIPDGVAIRSRKETGGYYAFVEFEELSGVHNALKASPIEINGRQIYVEERKPNSGIRGGRRGGRGRFSGGGRGYARGGGDEYNGNRSRSNGYGRVPHQERGILGSHTARN

SEQ ID NO: 2361 - DNA, 1305 bp, Sorghum bicolor
  misc_feature: Ceres ANNOT ID no. 6023826
  misc_feature: Encodes the peptide sequence at SEQ ID NO 2362
atggggaagagcaagaagagcaaggcccgcggcggcggggacgacctgctcgacagcagcgacgccgacagcgtcggctcctcgtccaccgcgctgtcggatctctccatctcgtatgccaccgagcacgtcaactcgcaggagttcgtcctcgacaagtacatcgacgcgctctacgagaagagggggtctacaagagaggcagcattggttaaactggttgatgcctttgaaagttttatgctccatggccttgtggagaataggtatgccacactgctgagtcaattcaataattccatcaaaaagggatctactaaggaggtttttctggcatctcatgccattgggttattggctattacactcggtgctgggagcagttcacgtgaaataatggaggagtcgcatccccaactctgtaggatacttcaagcttggtctgatgcatcaaagatgatatctgcacttgattgtttggctatcatcacatttgttggcgcaactgatctggctgaaacagagttatctttgaaagccatgtgggatgtgattcatccaaagtctggttcaaatgtgggaactgttcggaaacctaagcctcctgtgttagcagctgctctatctgcatggacatttctcctgactactattggttcatggagaataaatactgatagctggaaagagcccattgcatttctctccactcttttggaagcagatgatcgtgctgttcgaatggctgctggtgaagcattggctttgtgctttgagttaaatctgcttgatgtttcttcttgtgaggatggcgatgttaacacgggaggaactggtggttctaagaacaagcttttcttggatatgcaagcattaaaagccaaaatatcaggtctggcctctaatctctctgctgaggctggggggaaaggtgcagacaagaaaaaccttactgaccaaagagacttgtttcaaaggatcttagattttgtcaagtatggtgactgccctgaagaatcgatcaagattgctggaaaacgtgatgttttaagggtgtcgtcatggtctgaattaatccagttgaatttcttaaagcggtttctggggaagggctttctgaagcatgttcaggagaatggacttcttcaggatatctttgacattaaggttgacaaagctgaaaccctgtcgtccactgataagaaaatctttaggtctgaagaggaaaaagaaagagctctgaaattaaacaaggaacgtcgtctagcccaggtaaggaagaatgccgtcatgttggacgactaa

SEQ ID NO: 2362 - protein, 434 aa, Sorghum bicolor
  misc_feature: Ceres ANNOT ID no. 6023826
  misc_feature (20)..(332): Pfam Id: IFRD Pfam Desc: Interferon-related developmental regulator (IFRD)
  misc_feature (5)..(424): NCBI GI: 42571665 NCBI Desc: interferon-related developmental regulator family protein / ifrd protein family [arabidopsis thaliana]
  misc_feature (5)..(424): NCBI GI: 18700286 NCBI Desc: at1g27760/t22c5_5 [arabidopsis thaliana]
  misc_feature (16)..(424): NCBI GI: 42570214 NCBI Desc: interferon-related developmental regulator family protein / ifrd protein family [arabidopsis thaliana]
  misc_feature (16)..(386): NCBI GI: 6693024 NCBI Desc: t22c5.21 [arabidopsis thaliana]
  misc_feature (6)..(428): NCBI GI: 42408764 NCBI Desc: interferon-related protein-like [oryza sativa (japonica cultivar-group)]
MGKSKKSKARGGGDDLLDSSDADSVGSSSTALSDLSISYATEHVNSQEFVLDKYIDALYEKRGSTREAALVKLVDAFESFMLHGLVENRYATLLSQFNNSIKKGSTKEVFLASHAIGLLAITLGAGSSSREIMEESHPQLCRILQAWSDASKMISALDCLAIITFVGATDLAETELSLKAMWDVIHPKSGSNVGTVRKPKPPVLAAALSAWTFLLTTIGSWRINTDSWKEPIAFLSTLLEADDRAVRMAAGEALALCFELNLLDVSSCEDGDVNTGGTGGSKNKLFLDMQALKAKISGLASNLSAEAGGKGADKKNLTDQRDLFQRILDFVKYGDCPEESIKIAGKRDVLRVSSWSELIQLNFLKRFLGKGFLKHVQENGLLQDIFDIKVDKAETLSSTDKKIFRSEEEKERALKLNKERRLAQVRKNAVMLDD

SEQ ID NO: 2363 - DNA, 1089 bp, Sorghum bicolor
  misc_feature: Ceres ANNOT ID no. 6023828
  misc_feature: Encodes the peptide sequence at SEQ ID NO 2364
atggagtcggacgcgtccacctccccgcggcggcgcagcacgagctgctacagcgacagcggcgactcctcctgctccgagcccttcagcgagtgcggcagcgacgacctctccttcacgcccgccgccgccgcgggcatccaccgcctgctgctctcctgcgcggccgaggcgtcggaggacgcaatctcctcgctcgtggccgagctggagtgcccgtcgccgtcgctggactcgctccgccgcgcggccatggagctccggctgctggccaagcacaacccggacaaccgtgtccgcatcgccgcggcgggcggcgtccggccgctcgtcaagctgctgtcgcacgcggacccgctgctgcaggagcacggcgtcacggcgctgctcaacctctccatctgcgacgagaacaaggcgatcatcgtcgaggcgggagcgatacggccgctggtgcacgcgctcaagtccgccgcgtcgcccgccgcgcgggagaacgccgcttgcgcgctgctccggctgtcccagctcgacggcgcctccgcggccgccatcggccgcgcgggcgcggtcccgctgctggtctccctcctcgagaccgggggcgcgcgcgggaagaaggacgccgccacggcgctgtacgcgctctgcagcggcgcgcgcgagaaccggcagcgcgccgtggaggccggcgccgtgcggccgctgctggacctcatggccgacccggagtccggcatggtggacaaggccgcgtacgtcctccactccctggtgagctccgccgagggccgtgccgccgccgtcgaggaaggcggcatccccgtcctggtcgagatggtggaggtcggcacctcgcggcagaaggagatcgccaccctttccctcctgcagatctgcgaggacaacaccgtgtaccggaccatggtcgcccgcgagggcgccatccctcccctcgtcgccctctcccaatcctcatccgctcgccccaagctcaaaacaaaggcggagtcgttgatcgagatgctgcggcagccgcggagcccgagcctccgcgcgcgaccagcggcggtcgttgcggcagagtaa

SEQ ID NO: 2364 - protein, 362 aa, Sorghum bicolor
  misc_feature: Ceres ANNOT ID no. 6023828
  misc_feature (94)..(134): Pfam Id: Arm Pfam Desc: Armadillo/beta-catenin-like repeat
  misc_feature (135)..(176): Pfam Id: Arm Pfam Desc: Armadillo/beta-catenin-like repeat
  misc_feature (178)..(218): Pfam Id: Arm Pfam Desc: Armadillo/beta-catenin-like repeat
  misc_feature (220)..(260): Pfam Id: Arm Pfam Desc: Armadillo/beta-catenin-like repeat
  misc_feature (17)..(350): NCBI GI: 21928049 NCBI Desc: at3g01400/t13o15_4 [arabidopsis thaliana]
  misc_feature (31)..(347): NCBI GI: 8843789 NCBI Desc: phosphoinositide-specific phospholipase c-line [arabidopsis thaliana]
  misc_feature (73)..(357): NCBI GI: 34393717 NCBI Desc: arm repeat containing protein homolog-like [oryza sativa (japonica cultivar-group)]
  misc_feature (50)..(347): NCBI GI: 92886249 NCBI Desc: imp dehydrogenase/gmp reductase [medicago truncatula]
  misc_feature (60)..(347): NCBI GI: 28974687 NCBI Desc: arm repeat-containing protein [nicotiana tabacum]
  misc_feature: The sequence is a functional homolog of SEQ ID NO. 309 in the 11/188,298 US application
  misc_feature: The sequence is a functional homolog of SEQ ID NO. 528 in the 11/188,298 US application
MESDASTSPRRRSTSCYSDSGDSSCSEPFSECGSDDLSFTPAAAAGIHRLLLSCAAEASEDAISSLVAELECPSPSLDSLRRAAMELRLLAKHNPDNRVRIAAAGGVRPLVKLLSHADPLLQEHGVTALLNLSICDENKAIIVEAGAIRPLVHALKSAASPAARENAACALLRLSQLDGASAAAIGRAGAVPLLVSLLETGGARGKKDAATALYALCSGARENRQRAVEAGAVRPLLDLMADPESGMVDKAAYVLHSLVSSAEGRAAAVEEGGIPVLVEMVEVGTSRQKEIATLSLLQICEDNTVYRTMVAREGAIPPLVALSQSSSARPKLKTKAESLIEMLRQPRSPSLRARPAAVVAAE

SEQ ID NO: 2365 - DNA, 1197 bp, Sorghum bicolor
  misc_feature: Ceres ANNOT ID no. 6023856
  misc_feature: Encodes the peptide sequence at SEQ ID NO 2366
atggccacggccgcgactgccaccggcaccgcggggagcagagcagccgcgctgccgctgctgctgctgcttctctcgttggcgctgccgctgcgggcctacggcgcgggcggcgactgccacttcccggccgtgttcaacttcggcgactccaactcggacacgggcgggctgtcgtcgctcttcggcgccgcgccgccgcccaacggcaggaccttcttcggcatgcccgccggccgctactgcgacggtcgcctcgtcatcgacttcatcgctgaaagcctgggactaactcacctcagcgcgtacctgaactcaattggaagcaacttcacacagggagccaattttgcaacagctggttcgtcaatcagaagacagaatacatctctgttcgtctcaggcttcagccccatttccttggacgtgcagttctgggagtttgaacaattcatcaacagaagccaactcgtctacaacaacaaaggcggtatctacaggcagatcctaccaagggcagagtacttctcccaggcactttacaccttcgacatcggtcaaaatgacatcacctcgggctactttgttaacaatagcactgaagaagtcgaagccataatccctgatctcatggagaggctcacatctataatccagagcgtgtacgcgcgtggaggaaggtatttctggatccacaacacagggccgctcggctgcctgccctacgcgctgctgcaccgccctgacctcgccactccagcggacggcaccggctgctccgtcacgtacaacaaggtcgcgcagctcttcaacctcaggctcaaggagaccgtggcgagcctccggaagacgcaccctgacgccgcgttcacctacgtcgacgtctacaccgccaagtacaagctcatcagccaagccaagaagctcggcttcgatgaccctctgctgacctgctgcgggtacggcggcggccggtacaacttagacctgagcatcggctgcggcgggaagatgcaggtgaacgggacgtcggtggtggtggggaactcgtgcgaggacccctccaagagggtgagctgggacggcgtgcacttcaccgaggccgccaacaagttcgtgttcgaccagatcgtcgccggcgtgctctctgacccgcccgtggcgctgaggcaggcgtgccatagcagagggcaatga

SEQ ID NO: 2366 - protein, 398 aa, Sorghum bicolor
  misc_feature: Ceres ANNOT ID no. 6023856
  misc_feature (45)..(377): Pfam Id: Lipase_GDSL Pfam Desc: GDSL-like Lipase/Acylhydrolase
  misc_feature (19)..(381): NCBI GI: 11072007 NCBI Desc: f12a21.4 [arabidopsis thaliana]
  misc_feature (23)..(381): NCBI GI: 51969146 NCBI Desc: enod8-like protein [arabidopsis thaliana]
  misc_feature (36)..(394): NCBI GI: 140052271 NCBI Desc: lipolytic enzyme, g-d-s-l [medicago truncatula]
  misc_feature (19)..(394): NCBI GI: 30909057 NCBI Desc: ensp-like protein [hevea brasiliensis]
  misc_feature (18)..(396): NCBI GI: 304037 NCBI Desc: early nodulin [medicago sativa]
  misc_feature (19)..(381): SWISSPROT Homolog: EC 3.2.1.51 Alpha-L-fucosidase 2 precursor
MATAATATGTAGSRAAALPLLLLLLSLALPLRAYGAGGDCHFPAVFNFGDSNSDTGGLSSLFGAAPPPNGRTFFGMPAGRYCDGRLVIDFIAESLGLTHLSAYLNSIGSNFTQGANFATAGSSIRRQNTSLFVSGFSPISLDVQFWEFEQFINRSQLVYNNKGGIYRQILPRAEYFSQALYTFDIGQNDITSGYFVNNSTEEVEAIIPDLMERLTSIIQSVYARGGRYFWIHNTGPLGCLPYALLHRPDLATPADGTGCSVTYNKVAQLFNLRLKETVASLRKTHPDAAFTYVDVYTAKYKLISQAKKLGFDDPLLTCCGYGGGRYNLDLSIGCGGKMQVNGTSVVVGNSCEDPSKRVSWDGVHFTEAANKFVFDQIVAGVLSDPPVALRQACHSRGQ

SEQ ID NO: 2367 - DNA, 474 bp, Sorghum bicolor
  misc_feature: Ceres ANNOT ID no. 6023860
  misc_feature: Encodes the peptide sequence at SEQ ID NO 2368
atggccgccccgctccggcggagcctcccctcccttggccgcgcgcttctcacgccggctccggcgcggatgctctccgcggaggcctccgatgccctcgtcgagatcaagcctggggagatcgggatggtctccggcatccctgaggagcacctccgccgcaaggttttaatttattcaccagctaggactgcatcccagcaaggttcaggcaaagtcgggaggtggaaaattaactttttgtcaacccaaaagtgggagaacccgttgatgggatggacatctactggggacccatatgctaatgtcggtgaagcaggacttacattcgacagtgcggagtcagcaaaggcgtttgctgaaaaacatggatggaattatgtggttcggaaacgccatacacctcttctgaagcctaaggcttacgctgagaacttcaagtggagaggccctccgaaggcggagcaagcatga

SEQ ID NO: 2368 - protein, 157 aa, Sorghum bicolor
  misc_feature: Ceres ANNOT ID no. 6023860
  misc_feature (54)..(156): Pfam Id: ETC_C1_NDUFA4 Pfam Desc: ETC complex I subunit conserved region
  misc_feature (1)..(157): NCBI GI: 50509945 NCBI Desc: nadh-ubiquinone oxidoreductase-related-like protein [oryza sativa (japonica cultivar-group)]
  misc_feature (22)..(157): NCBI GI: 92873913 NCBI Desc: etc complex i subunit conserved region [medicago truncatula]
  misc_feature (56)..(157): NCBI GI: 92880834 NCBI Desc: etc complex i subunit conserved region [medicago truncatula]
  misc_feature (29)..(155): NCBI GI: 118197450 NCBI Desc: nadh-ubiquinone oxidoreductase related-like protein [brassica rapa]
  misc_feature (17)..(148): NCBI GI: 51593213 NCBI Desc: mgc85528 protein [xenopus laevis]
MAAPLRRSLPSLGRALLTPAPARMLSAEASDALVEIKPGEIGMVSGIPEEHLRRKVLIYSPARTASQQGSGKVGRWKINFLSTQKWENPLMGWTSTGDPYANVGEAGLTFDSAESAKAFAEKHGWNYVVRKRHTPLLKPKAYAENFKWRGPPKAEQA

SEQ ID NO: 2369 - DNA, 420 bp, Sorghum bicolor
  misc_feature: Ceres ANNOT ID no. 6023869
  misc_feature: Encodes the peptide sequence at SEQ ID NO 2370
atggctcgtactaagtgttgggctcgtaggtccaccggaggaaagacaccaaggaagcaactagttcgaacgatctttgctgctgctcgcaagacagcgccagtaacgggaggagtgaagaagcctcgtcgttaccgccctggaaccgtagctcttcgtgaaattcgcaagtatcagaagggcgccgagctgctcatcaggaagatgcccttccagaggctcgtcagggagatcgcccagcttcacaagagtgacctgcgtttccagagccatgcgatccttgctctgcaggaggcggcagaggcgtacctcgtgggtctcttcgaggacaccaacctgtgtgccatccatgccaagcgagtgaccatcatgcccaaagatgttcatctggctaccaggatccgtggcgagaggcactaa

SEQ ID NO: 2370 - protein, 139 aa, Sorghum bicolor
  misc_feature: Ceres ANNOT ID no. 6023869
  misc_feature (61)..(135): Pfam Id: Histone Pfam Desc: Core histone H2A/H2B/H3/H4
  misc_feature (1)..(138): NCBI GI: 71027053 NCBI Desc: histone h3 [theileria parva]
  misc_feature (1)..(138): NCBI GI: 85000267 NCBI Desc: histone h3 [theileria annulata strain ankara]
  misc_feature (1)..(138): NCBI GI: 84996541 NCBI Desc: histone h3 [theileria annulata strain ankara]
  misc_feature (1)..(138): NCBI GI: 71028626 NCBI Desc: histone h3 [theileria parva]
  misc_feature (1)..(138): NCBI GI: 82568469 NCBI Desc: histone soh3-2 [lilium longiflorum]
MARTKCWARRSTGGKTPRKQLVRTIFAAARKTAPVTGGVKKPRRYRPGTVALREIRKYQKGAELLIRKMPFQRLVREIAQLHKSDLRFQSHAILALQEAAEAYLVGLFEDTNLCAIHAKRVTIMPKDVHLATRIRGERH

SEQ ID NO: 2371 - DNA, 1356 bp, Sorghum bicolor
  misc_feature: Ceres ANNOT ID no. 6023870
  misc_feature: Encodes the peptide sequence at SEQ ID NO 2372
atggagcagccgcagccgcagcagcagaagggaggagcggcgtctgcgcaggcggcggccgcgaacgggaccgggggcgccgagctgatcggctacgtcgacgtgcacgtgcggagcgcgcgggacattcagaacatctgcatctaccacaagcaggacgtgtacgcgcggctctcgctgccgggggacggcgcgccggcggcgtccacgcaggtggtcaacggagggggccgcaacccggtgttcgaccagtcgctgcgcctgggcgtgcgcgcgggggacgtcgacgccgcgctccgctgcgaggtgtggatgctcagccgcgtcaagaactacctgcaggaccagctactggggttcgcgctcgtgccgctcccggaggtcgtcgccgccgacggcggcacgctcgcccgcgagttcccgctcaccaccagcgacctcttccagaccccctcggggttcctacagctcgagctctcctacatcggggtcgtgccagaggtcgtgcccatctcgcccacgcccaagccggcgctggccgacgacctggaggaggaggagccggagaacaacgccgctgacggcgtcgggaacgggaaggagtacgagaagatcgagttccccgacctgaatctcgtggaggagaaccagatcatggtctccgagtacaccaggctgccgtgcgcggccgtggaaacgcagagctccgacagcctcctcacctcggagcacggggacggcgccacgaccatgagccacgacgacggcgtgcgcctcgtggagagcttctcgacggacaacagcaccgctgactcggtgggcgccggcttccggagcgacacgccggtcagcagcgtgtccaccacggagtcccccgccgccgcggcgttcccggccacccctcagtccaactccagctcggagccgtccgggaacgcccactcgtcggctgaccacaaggagaaggcggcgtcggagaccgctgacgcggaggtcgactcgtcccgcaccgtccaggaggtcccggcggcgaactcgcccggcgccgcgtcggaggctgcagtggacaagccagtgatcagcgtcagcatcgagcaggaggtgaaggtggacgggaaccagatcatggacatgtacatgaagagcatgcagcaattcacggattccctggccaaaatgaagctccctgccctggacatagacaacggtagcagcgggaagagcagtcccgcagcagccacacctgactcaaactccactgctgccgactcgagtgcggtgaagaagccggccgccgcagggcagcaggagaagccgtctcccaaggtgttctatggcagccgggcgttcttctga

SEQ ID NO: 2372 - protein, 451 aa, Sorghum bicolor
  misc_feature: Ceres ANNOT ID no. 6023870
  misc_feature (33)..(122): Pfam Id: C2 Pfam Desc: C2 domain
  misc_feature (5)..(341): NCBI GI: 59958302 NCBI Desc: at5g55530 [arabidopsis thaliana]
  misc_feature (28)..(334): NCBI GI: 92872936 NCBI Desc: c2 [medicago truncatula]
  misc_feature (32)..(326): NCBI GI: 15528811 NCBI Desc: p0431g06.18 [oryza sativa (japonica cultivar-group)]
  misc_feature (32)..(326): NCBI GI: 115442297 NCBI Desc: os01g0953500 [oryza sativa (japonica cultivar-group)]
  misc_feature (33)..(195): NCBI GI: 102139812 NCBI Desc: c2 domain-containing protein / xyppx domain-containing protein [musa acuminata]
MEQPQPQQQKGGAASAQAAAANGTGGAELIGYVDVHVRSARDIQNICIYHKQDVYARLSLPGDGAPAASTQVVNGGGRNPVFDQSLRLGVRAGDVDAALRCEVWMLSRVKNYLQDQLLGFALVPLPEVVAADGGTLAREFPLTTSDLFQTPSGFLQLELSYIGVVPEVVPISPTPKPALADDLEEEEPENNAADGVGNGKEYEKIEFPDLNLVEENQIMVSEYTRLPCAAVETQSSDSLLTSEHGDGATTMSHDDGVRLVESFSTDNSTADSVGAGFRSDTPVSSVSTTESPAAAAFPATPQSNSSSEPSGNAHSSADHKEKAASETADAEVDSSRTVQEVPAANSPGAASEAAVDKPVISVSIEQEVKVDGNQIMDMYMKSMQQFTDSLAKMKLPALDIDNGSSGKSSPAAATPDSNSTAADSSAVKKPAAAGQQEKPSPKVFYGSRAFF

SEQ ID NO: 2373 - DNA, 1434 bp, Sorghum bicolor
  misc_feature: Ceres ANNOT ID no. 6023872
  misc_feature: Encodes the peptide sequence at SEQ ID NO 2374
atggaggccgactccgggaagctcttcgtcggcggcatctcctgggagacggacgaggaccgcctccgcgagtacttcggtcgcttcggggaggtcaccgaagccgttatcatgcgggaccgcaacaccggccgcgcccgtgggttcggcttcgtcgtcttcgccgactccgggatcgccgagcgcgtcaccatggacaagcacatgatcgacgggcgcatggtggaagcaaagaaggccgttcccagggacgaccagagtattgcgagcaagaacaatggcagcagcatagggtcacctggaccaggacgtactaggaagatctttgttggaggtctggcttcaaatgttaccgaggtcgaattcagaaggtactttgagcaattcggtgtgataaccgatgtggtagtgatgtatgaccacaacacgcagaggcctaggggctttggtttcatcacttatgactcagaagacgcagtggataaggcactgcacaagaacttccatgagctgaatggtaaaatggttgaggtcaagagggctgtaccaaaggagcagtctcctggacctattgcacgttcacctgtgggagggcagaactatgctatgagcagggttcataacttcctaaatggcttcaaccagggttacaacccgaacccccttggtggttatgggatgagggtggatggaaggtatggtctccttacaggtgcacggaatgggttctcttcgtttggtccaggttatggaatgggcatgaatgttgaaggtggaatgagtggatactttggtgcaagttctggttttgtcaatagttccaatgggcggcaaataggttcttacttcaatggtagttcaaacagattaggtagtccaattgggtatgttggccttaatgatgattcaggatcaatactaagttcaatgtctagaaatgtctggggtaatggaaatctgaactacacaggcaaccctacaaacacgaattcttttgctccacctggaagtggtgggggcattcctggtgatgaaattagttggggaagccttacttctgctcatgggatgggcaacatttcaagccttggatcgggaaaccttggccgtggaaccggagatcacaactttggtttgccttctggaaactatgtgaggagcaactcaactggtacaattggtgagccattttctgcatcaaccaatgcatatgaatcgaacaatccaggtgcatatggcagcagctctatttatggtgactcaacctggaggtttaactcatctgaggttgatatgcctccttttggtcatgatcttggaaatgttgatccggatatcaaatcagaaatatcagcaagctacatgggcaactatactgttaataataatcagacaagcagaggacaactacaatgcacaggacttatgttgtga

SEQ ID NO: 2374 - protein, 477 aa, Sorghum bicolor
  misc_feature: Ceres ANNOT ID no. 6023872
  misc_feature (8)..(77): Pfam Id: RRM_1 Pfam Desc: RNA recognition motif. (a.k.a. RRM, RBD, or RNP domain)
  misc_feature (108)..(178): Pfam Id: RRM_1 Pfam Desc: RNA recognition motif. (a.k.a. RRM, RBD, or RNP domain)
  misc_feature (1)..(385): NCBI GI: 21553963 NCBI Desc: rna-binding protein-like [arabidopsis thaliana]
  misc_feature (1)..(354): NCBI GI: 9758790 NCBI Desc: rna-binding protein-like [arabidopsis thaliana]
  misc_feature (1)..(369): NCBI GI: 89257506 NCBI Desc: rna recognition motif. (a.k.a. rrm, rbd, or rnp domain) containing protein [brassica oleracea]
  misc_feature (3)..(429): NCBI GI: 7269517 NCBI Desc: hnrnp-like protein [arabidopsis thaliana]
  misc_feature (3)..(429): NCBI GI: 20453245 NCBI Desc: at4g26650/t15n24_100 [arabidopsis thaliana]
  misc_feature: The sequence is a functional homolog of SEQ ID NO 1039 in the 10/374,780US patent application
  misc_feature: The sequence is a functional homolog of SEQ ID NO 849 in the 10/666,642US patent application
  misc_feature: Useful for making plants with modulated growth and phenotype characteristics
  misc_feature: The sequence is a functional homolog of SEQ ID NO 1039 in the 20060162006 US patent application
  misc_feature: The sequence is a functional homolog of SEQ ID NO. 339 in the 11/188,298 US application
  misc_feature: The sequence is a functional homolog of SEQ ID NO. 458 in the 11/188,298 US application
MEADSGKLFVGGISWETDEDRLREYFGRFGEVTEAVIMRDRNTGRARGFGFVVFADSGIAERVTMDKHMIDGRMVEAKKAVPRDDQSIASKNNGSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPIARSPVGGQNYAMSRVHNFLNGFNQGYNPNPLGGYGMRVDGRYGLLTGARNGFSSFGPGYGMGMNVEGGMSGYFGASSGFVNSSNGRQIGSYFNGSSNRLGSPIGYVGLNDDSGSILSSMSRNVWGNGNLNYTGNPTNTNSFAPPGSGGGIPGDEISWGSLTSAHGMGNISSLGSGNLGRGTGDHNFGLPSGNYVRSNSTGTIGEPFSASTNAYESNNPGAYGSSSIYGDSTWRFNSSEVDMPPFGHDLGNVDPDIKSEISASYMGNYTVNNNQTSRGQLQCTGLML

SEQ ID NO: 2375 - DNA, 1644 bp, Sorghum bicolor
  misc_feature: Ceres ANNOT ID no. 6023879
  misc_feature: Encodes the peptide sequence at SEQ ID NO 2376
atggctgacactccaacttcccgcatggtgcacccctttggcgacgtcccaaggcagactcccaagcagttcctgtattctggtaactcacagcacctctgttatccataccagtcagcttcggacacccatgtcgtgccgcagcgtcattgcaccatgaggtctcattcaccagatgctggctctgaagaccatgataatcacaagcagtacacactggactcctcagcaacttctggttgttcaaggcatgattctccctccagtcaaagtgtccatgctgggagtggcagccctgtatctcttgaagacagccactctggctctacaaatggcaatggatcacctgtgagtgcatcgtgtgtcactgaggaccctactgatctcaagcagaaactgaaggatcttgaggctgcaatgctgggtacagacccagagatcgtcaacagtctcgagatctccatagcagaccaactttcgttggagcccgaggagtggaagcacatgatgagcatgcccggagggaacctgaaggagctgctgattgcctgcgctagagcggtggaatataacaacagctacgccattgatctgatgatcccagagctgaggaagaaggtttcagtgtctggtgaaccacttgagaggctgggagcctacatggtggaaggtcttgttgccaggctcgccgcctctggcagctcaatctacaaagctttgaagtgtaaggagcccaggagttctgatctcctctcctacatgcacttcctgtatgaggcctgcccctacttcaagttcggctacatgtcagcgaacggcgcaatcgcagaggctgtcaagggagaagacaggatccatatcattgacttccacatcgctcaaggggctcagtggatctctctccttcaagcccttgcagccaggcctggcgggccaccgttcgtgaggatcaccggcattgatgattcagtctcagcttacgcccgaggcggtggtctggagttggttggcaggaggctgtcacacattgctggcctctacaaggtgccatttcagttcgacgcagtcgctatctccagcagcgaagtggaggaggggcatctcggcatcgtccctggcgaagccgtcgctgtcaacttcaccctggagctgcaccacatccccgacgagaccgtgagcacggcgaaccaccgagatcggatcctgaggctggtgaagggcctgtcgcccaaggtgctcacgctggtggagcaggagtccaacaccaacacggcccccttcgcgcagcggttcgcggagacgctggactactatactgccatcttcgagtccatcgacctggcgctgccgagggacgacagggagcggatcaacatcgagcagcactgcttggctcgggagatcgtgaacctggtggcctgcgagggcgaggaacgggtggaacggcacgaggtgttcggcaagtggaaggcgcggctgatgatggccgggttcaggccgtccccgctcagcgcgctggtcaacgccaccatcaagacgctgctgcagagctactcgccggactacaagctcgccgagagggacggcgtgctctacctcgggtggaagaacaggcccctgattgtctcgtcggcatggcactag

SEQ ID NO: 2376 - protein, 547 aa, Sorghum bicolor
  misc_feature: Ceres ANNOT ID no. 6023879
  misc_feature (155)..(457): Pfam Id: GRAS Pfam Desc: GRAS family transcription factor
  misc_feature (1)..(547): NCBI GI: 73620052 NCBI Desc: chitin-inducible gibberellin-responsive protein 2
  misc_feature (20)..(546): NCBI GI: 14517552 NCBI Desc: f17j6.12/f17j6.12 [arabidopsis thaliana]
  misc_feature (120)..(546): NCBI GI: 8777405 NCBI Desc: scarecrow gene regulator-like [arabidopsis thaliana]
  misc_feature (71)..(546): NCBI GI: 89474462 NCBI Desc: gras1 [solanum lycopersicum]
  misc_feature (50)..(546): NCBI GI: 92872928 NCBI Desc: gras transcription factor [medicago truncatula]
  misc_feature: The sequence is a functional homolog of SEQ ID NO 10 in the 10/225,066US patent application
  misc_feature: The sequence is a functional homolog of SEQ ID NO 1018 in the 10/225,066US patent application
  misc_feature: The sequence is a functional homolog of SEQ ID NO 1327 in the 10/374,780US patent application
  misc_feature: The sequence is a functional homolog of SEQ ID NO 136 in the 11/375,241US patent application
  misc_feature: The sequence is a functional homolog of SEQ ID NO 1873 in the 11/479,226US patent application
  misc_feature: The sequence is a functional homolog of SEQ ID NO 2712 in the 10/374,780US patent application
  misc_feature: The sequence is a functional homolog of SEQ ID NO 304 in the 10/374,780US patent application
  misc_feature: The sequence is a functional homolog of SEQ ID NO 474 in the 10/666,642US patent application
  misc_feature: The sequence is a functional homolog of SEQ ID NO 838 in the 10/225,066US patent application
  misc_feature: Useful for making plants with modulated growth and phenotype characteristics
  misc_feature: Useful for making plants with modulated low light sensitivity
  misc_feature: Functional homolog of the protein sequence given in SEQ ID NO 13378
  misc_feature: The sequence is a functional homolog of SEQ ID NO 10 in the 20050160493 US patent application
  misc_feature: The sequence is a functional homolog of SEQ ID NO 1018 in the 20050160493 US patent application
  misc_feature: The sequence is a functional homolog of SEQ ID NO 1327 in the 20060162006 US patent application
  misc_feature: The sequence is a functional homolog of SEQ ID NO 474 in the 20070033671 US patent application
  misc_feature: Useful for making plants with modulated low light sensitivity
  misc_feature: Functional homolog of the protein sequence given in SEQ ID NO 13378
  misc_feature: The sequence is a functional homolog of SEQ ID NO 474 in the 10/666,642 US patent application
  misc_feature: Useful for making plants with modulated light quality sensitivity
  misc_feature: The sequence is a functional homolog of SEQ ID NO 1018 in the 10/225,066 US patent application
  misc_feature: The sequence is a functional homolog of SEQ ID NO 2712 in the 10/374,780 US patent application
  misc_feature: Useful for making plants with altered alkaloid content
  misc_feature: Useful for making plants with altered lignin content
  misc_feature: Functional homolog of the protein sequence given in SEQ ID NO 12889
  misc_feature: The sequence is a functional homolog of SEQ ID NO 220 in the 10/412,699 US patent application
  misc_feature: The sequence is a functional homolog of SEQ ID NO 443 in the 11/479,226 US patent application
MADTPTSRMVHPFGDVPRQTPKQFLYSGNSQHLCYPYQSASDTHVVPQRHCTMRSHSPDAGSEDHDNHKQYTLDSSATSGCSRHDSPSSQSVHAGSGSPVSLEDSHSGSTNGNGSPVSASCVTEDPTDLKQKLKDLEAAMLGTDPEIVNSLEISIADQLSLEPEEWKHMMSMPGGNLKELLIACARAVEYNNSYAIDLMIPELRKKVSVSGEPLERLGAYMVEGLVARLAASGSSIYKALKCKEPRSSDLLSYMHFLYEACPYFKFGYMSANGAIAEAVKGEDRIHIIDFHIAQGAQWISLLQALAARPGGPPFVRITGIDDSVSAYARGGGLELVGRRLSHIAGLYKVPFQFDAVAISSSEVEEGHLGIVPGEAVAVNFTLELHHIPDETVSTANHRDRILRLVKGLSPKVLTLVEQESNTNTAPFAQRFAETLDYYTAIFESIDLALPRDDRERINIEQHCLAREIVNLVACEGEERVERHEVFGKWKARLMMAGFRPSPLSALVNATIKTLLQSYSPDYKLAERDGVLYLGWKNRPLIVSSAWH

SEQ ID NO: 2377 - DNA, 1521 bp, Sorghum bicolor
  misc_feature: Ceres ANNOT ID no. 6023883
  misc_feature: Encodes the peptide sequence at SEQ ID NO 2378
atggcgctgcagctccagctgccgcggccgctcgccgccgcccggccctccgccctcctcccttcccgggaccatggcgcctccgcttccgcgaccgcccttcacgctcgcgccggcggcgtcgcgttctcgctccagaccaacgtgcgcctcctcaagcccaaccgccgcgtccgccgctcccgggacccctactacgacctagacgaggacgatgaggaggaggcggagttcgacgaagaggatgacgacgaaggttacgagagcgatgatgacatgtcgggtttggaatatcctggtgtactttattcaaacagccctcgtgcttcaagcaagagacaagaattggaacctccactggtaaaagaaaactgggaaggaagacaacccaaaactcgtgataactacggcagtccaggaaaaagtaagtccctgtatcctaggagtaaagtgggacgatcatcaatggatcttaagaacatggatagtgaagttgagttgaaaaatgcaagtatctctcgaagtctgttccagaaactacaagaagattatgactttgatgacaaatggttaccgctgattgattacttgtgcacatttggactaaaggagtctcattttacttacatctatgagagacacatggcctgctttcaaatcagtcaggcttcagcagaagaaaggttggatttcctgctaagtgctggggttaaaagcaaggatatgaagaggatactggtcaggcagccacagattctggaatacacccttggcaatctgaaatcccatgttgattttctcgtaagcattggagttccgaatacacgaataggacaaattatttctgctgctccttcgatgttctcttacagtgtggagcactctctgaagccaacagtaaggtatctgattgaggaagttggtattgaggagagtgatgttgggaaagtagtgcagctaagcccacagattctggtgcagaaaattgatagtgcatggaaatctcgatcgcttttcctgacaaaagaactgggcgctcccaaagatagcatagttaagatggtcacaaaacaccctcagctgcttcactacagcattgaggatggaatcttacctcgaataaatttcctgagaagcattggtatgagaaacactgacattctcaaagtattgacaagtcttactcaggtgctatctttgtcattggaggaaaatctcaagccaaagtatctttacttggtcaatgaactcaagaatgaggttcaatccttaacgaaatatcctatgtatctgagcttgtctcttgatcagaggatccgtccccgccaccgttttctggtttcattgaagaaagctccaaagggtccatttcctctgagctcctttgtgcccacagatgagcgtttttgccagaggtgggctgggactagcttggagacataccatacattcagacagaggttgctgctaacaggttttgcagagaagtctggaaggaaaacactagtctcaagacggtag

SEQ ID NO: 2378 - protein, 506 aa, Sorghum bicolor
  misc_feature: Ceres ANNOT ID no. 6023883
  misc_feature (164)..(471): Pfam Id: mTERF Pfam Desc: mTERF
  misc_feature (222)..(471): NCBI GI: 85541253 NCBI Desc: mterf-like protein [brassica napus]
  misc_feature (230)..(471): NCBI GI: 115455761 NCBI Desc: os03g0785200 [oryza sativa (japonica cultivar-group)]
  misc_feature (231)..(446): NCBI GI: 33589698 NCBI Desc: at1g78930 [arabidopsis thaliana]
  misc_feature (194)..(472): NCBI GI: 42569224 NCBI Desc: mitochondrial transcription termination factor-related / mterf-related [arabidopsis thaliana]
  misc_feature (222)..(467): NCBI GI: 18655377 NCBI Desc: at2g36000/f11f19.9 [arabidopsis thaliana]
  misc_feature: Useful for making plants with altered Lignin content
  misc_feature: Useful for making plants with altered alkaloid content
  misc_feature: Useful for making plants with altered terpenoid content
  misc_feature: Useful for making plants with modulated nitrogen use efficiency
  misc_feature: Functional homolog of the protein sequence given in SEQ ID NO 13087
  misc_feature: Functional homolog of the protein sequence given in SEQ ID NO 13088
  misc_feature: Functional homolog of the protein sequence given in SEQ ID NO 13214
  misc_feature: Functional homolog of the protein sequence given in SEQ ID NO 13264
  misc_feature: GREAT-hit functional homolog of the protein sequence given in SEQ ID NO 13301
  misc_feature: Useful for making plants with altered alkaloid content
  misc_feature: Useful for making plants with altered lignin content
  misc_feature: Useful for making plants with altered terpenoid content
  misc_feature: Functional homolog of the protein sequence given in SEQ ID NO 13301
MALQLQLPRPLAAARPSALLPSRDHGASASATALHARAGGVAFSLQTNVRLLKPNRRVRRSRDPYYDLDEDDEEEAEFDEEDDDEGYESDDDMSGLEYPGVLYSNSPRASSKRQELEPPLVKENWEGRQPKTRDNYGSPGKSKSLYPRSKVGRSSMDLKNMDSEVELKNASISRSLFQKLQEDYDFDDKWLPLIDYLCTFGLKESHFTYIYERHMACFQISQASAEERLDFLLSAGVKSKDMKRILVRQPQILEYTLGNLKSHVDFLVSIGVPNTRIGQIISAAPSMFSYSVEHSLKPTVRYLIEEVGIEESDVGKVVQLSPQILVQKIDSAWKSRSLFLTKELGAPKDSIVKMVTKHPQLLHYSIEDGILPRINFLRSIGMRNTDILKVLTSLTQVLSLSLEENLKPKYLYLVNELKNEVQSLTKYPMYLSLSLDQRIRPRHRFLVSLKKAPKGPFPLSSFVPTDERFCQRWAGTSLETYHTFRQRLLLTGFAEKSGRKTLVSRR

SEQ ID NO: 2379 - DNA, 1035 bp, Sorghum bicolor
  misc_feature: Ceres ANNOT ID no. 6023903
  misc_feature: Encodes the peptide sequence at SEQ ID NO 2380
atggaggcggagaagaagacgccggcggtgtccgatgtgggcgcgtgggcgatgaacgtcgtcagctccgtcagtctcatcatggccaacaagcagctcatgtcctcctccggctacgccttcgccttcgccaccacgctgaccgggttccacttcacggtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggcttctaccagatctccaaattgagcatgattccggtcgtctgcctgatggaatgggtgctgaacagcaagcactacaccactaaggtcatatcggcagtgattgtcgtggccgccggtgtcgggatttgcacggtcacggatgtcgaggtcaatgccaagggattcatctgcgcttgcgtggcagtgttctgcacgtcgcttcaacagattacaattggctcctttcagaagaagtacaacattggatcatttgagctgctgagcaaaactgcaccaattcaggcactttcgcttgttatactgggcccctttgtggactactatctaaatggacggtcattgttgaactaccctttttcaggaggggcaactttcttcatactgctttcctgctccctggctgtcttttgcaacatgagccaatacctctgcatcggtcggttctcagcgacctcattccaggtcctgggccacatgaagaccgtgtgcgtgctgatcctcggctggatcctgtttgactcggccctcaccgtgaagaacatcctcgggatgctgcttgccgtgatgggcatggtggtctacagctgggccgtggaagcggagaagaaggcggcagccccgatcccccggaacaagagcgacatgctcgatggcgaggacgtacccctcaaggccagggtgagtggcgtgcccacgggcgacctcgaggacggcgagatgaagagctag

SEQ ID NO: 2380 - protein, 344 aa, Sorghum bicolor
  misc_feature: Ceres ANNOT ID no. 6023903
  misc_feature (156)..(298): Pfam Id: TPT Pfam Desc: Triose-phosphate Transporter family
  misc_feature (1)..(344): NCBI GI: 50509221 NCBI Desc: transporter-related-like [oryza sativa (japonica cultivar-group)]
  misc_feature (2)..(296): NCBI GI: 47497659 NCBI Desc: transmembrane protein-like [oryza sativa (japonica cultivar-group)]
  misc_feature (2)..(305): NCBI GI: 115487396 NCBI Desc: os12g0154000 [oryza sativa (japonica cultivar-group)]
  misc_feature (9)..(312): NCBI GI: 145343050 NCBI Desc: dmt family transporter: phosphate/phosphoenolpyruvate dmt [ostreococcus lucimarinus cce9901]
  misc_feature (13)..(327): NCBI GI: 48717036 NCBI Desc: phosphate translocator-like [oryza sativa (japonica cultivar-group)]
  misc_feature: Useful for making plants with altered cell wall content and/or composition
  misc_feature: GREAT-hit functional homolog of the protein sequence encoded by LOCUS at1g76670
  misc_feature: Useful for making plants with altered cell wall content and/or composition
  misc_feature: Functional homolog of the protein sequence given in SEQ ID NO 13788
  misc_feature: The sequence is a functional homolog of SEQ ID NO. 484 in the 11/188,298 US application
  misc_feature: The sequence is a functional homolog of SEQ ID NO. 360 in the 11/188,298 US application
MEAEKKTPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQITIGSFQKKYNIGSFELLSKTAPIQALSLVILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAVEAEKKAAAPIPRNKSDMLDGEDVPLKARVSGVPTGDLEDGEMKS

SEQ ID NO: 2381 - DNA, 840 bp, Sorghum bicolor
  misc_feature: Ceres ANNOT ID no. 6023907
  misc_feature: Encodes the peptide sequence at SEQ ID NO 2382
atgattaaaaatgcggtggccacgctgatggtgcgcctccaccacctgccgctaccccgcgccgcgcccgctcccacctaccgctgccgccgccacatcacgctccctctcccgcggccgcaagcatcggccgctgcgatgtcgacggcgacggaacaggcggtcgccgaccagaagcgcgccctgcgcgccgacgtgcgcagggcgctgaaggccctctctcctgatcagcgcgccagcgaagatctggctattcaaactacaataatggattcctcttggttcaaagcaagcaaaaggttgtgtgcttatataagctgtaagcagttgcgagaagtcgatacatcaaaaatactagaagagtgtctatcatcgaatcctggacaagaggaactggcaaaggatctttatgttcctcgagtggaggataagaaccgtaatatgcggatgctcaaaatcaccaccatggatgatttagttaagaattcaatgaacattctggaaccgtcacctgtggatgctactgggaaagatcgcgaagatgtattgtcatcatcttcccctgttgatcttttattattgccaggacaagcttttgatagaactggtcgaagactgggacgtggtggagggtactatgacacattcttgatgaaataccaagaacttgcaaaagagaaagggtggaatcagcctctcttggtcgctctttcatactcggtgcaaattatggacgagggcgtcatcccagttaattcaactgatgttcctattgatgctctggtctcctcctctggtgtcattccaataagtgctgcggctttgcagaggatgcgatga

SEQ ID NO: 2382 - protein, 279 aa, Sorghum bicolor
  misc_feature: Ceres ANNOT ID no. 6023907
  misc_feature (59)..(264): Pfam Id: 5-FTHF_cyc-lig Pfam Desc: 5-formyltetrahydrofolate cyclo-ligase family
  misc_feature (1)..(278): NCBI GI: 115472993 NCBI Desc: os07g0578600 [oryza sativa (japonica cultivar-group)]
  misc_feature (40)..(276): NCBI GI: 22087556 NCBI Desc: 5-formyltetrahydrofolate cycloligase [lycopersicon esculentum]
  misc_feature (19)..(278): NCBI GI: 21536640 NCBI Desc: 5-formyltetrahydrofolate cyclo-ligase-like protein [arabidopsis thaliana]
  misc_feature (54)..(277): NCBI GI: 9955549 NCBI Desc: 5-formyltetrahydrofolate cyclo-ligase-like protein [arabidopsis thaliana]
  misc_feature (19)..(209): NCBI GI: 79327754 NCBI Desc: 5-formyltetrahydrofolate cyclo-ligase [arabidopsis thaliana]
MIKNAVATLMVRLHHLPLPRAAPAPTYRCRRHITLPLPRPQASAAAMSTATEQAVADQKRALRADVRRALKALSPDQRASEDLAIQTTIMDSSWFKASKRLCAYISCKQLREVDTSKILEECLSSNPGQEELAKDLYVPRVEDKNRNMRMLKITTMDDLVKNSMNILEPSPVDATGKDREDVLSSSSPVDLLLLPGQAFDRTGRRLGRGGGYYDTFLMKYQELAKEKGWNQPLLVALSYSVQIMDEGVIPVNSTDVPIDALVSSSGVIPISAAALQRMR

SEQ ID NO: 2383 - DNA, 987 bp, Sorghum bicolor
  misc_feature: Ceres ANNOT ID no. 6023920
  misc_feature: Encodes the peptide sequence at SEQ ID NO 2384
atggccgccgcctcctcccgccgcgcgtcgcaactgctggggtccgccgcctcccgcctcctccatgcgcggggattcgccgcggcggccgccgcggcgccctcgccggcggtcttcgtcgacaagagcacccgcgtgatctgccagggcatcacggggaagaacggcaccttccacaccgagcaggccatcgagtacggcactaacatggttggtggagtgactcctaagaaaggtggaactgaacatttagggctcccagtgtttaactctgtagcagaagctaaggctgaaacaaaagccaatgcatctgttatatatgttccaccaccatttgctgccgccgctataatggaggcaatggatgctgagctcgaccttgtcgtctgcattacggaaggaattccacagcatgacatggtgaaagtgaaggctgcattaaacaggcagtctaaaactagattgattgggccaaattgccctggtatcattaagcctggtgagtgtaaaattggaatcatgccaggttacatccacaagcctgggcgtattgggatcgtatctcgttctggtaccttgacatatgaagcggtgtttcaaacaacagctgtaggcttggggcagtcaacttgtgtaggtattggtggcgacccgttcaatggcacaaattttgttgattgccttgaaaagtttgttgacgaccctcagacagaaggtattgttctcattggtgaaattggtggtacagctgaggaggatgctgcaacattcatccaggaaagcaaaacacaaaagcctgtcgttgcattcattgctggacttacggcacccccaggccgtcgcatgggtcatgctggaggaggaaagggtactgcccaggacaaaatcaaggcactcagagaggccggtgttaccgttgtcgagtcaccagcgaagattggatctaccatgtttgaaatcttcaagcagcgtggaatggtagaatag

SEQ ID NO: 2384 - protein, 328 aa, Sorghum bicolor
  misc_feature: Ceres ANNOT ID no. 6023920
  misc_feature (169)..(307): Pfam Id: Ligase_CoA Pfam Desc: CoA-ligase
  misc_feature (39)..(135): Pfam Id: CoA_binding Pfam Desc: CoA binding domain
  misc_feature (3)..(328): NCBI GI: 75294330 NCBI Desc: probable succinyl-coa ligase [gdp-forming] subunit alpha, mitochondrial precursor (succinyl-coa synthetase subunit alpha) (scs-alpha)
  misc_feature (6)..(327): NCBI GI: 27357175 NCBI Desc: succinyl-coa ligase alpha 1 subunit [lycopersicon esculentum]
  misc_feature (16)..(326): NCBI GI: 49617539 NCBI Desc: succinyl-coa ligase alpha 2 subunit [lycopersicon esculentum]
  misc_feature (20)..(328): NCBI GI: 21593483 NCBI Desc: succinyl-coa synthetase, alpha subunit [arabidopsis thaliana]
  misc_feature (38)..(328): NCBI GI: 16510 NCBI Desc: succinate--coa ligase (gdp-forming) [arabidopsis thaliana]
  misc_feature (20)..(328): SWISSPROT Homolog: EC 6.2.1.4 Succinyl-CoA ligase [GDP-forming] subunit alpha-2, mitochondrial precursor
  misc_feature (37)..(323): SWISSPROT Homolog: EC 6.2.1.5 Succinyl-CoA ligase [ADP-forming] subunit alpha
  misc_feature (37)..(291): SWISSPROT Homolog: EC 6.2.1.9 Malate--CoA ligase subunit alpha
MAAASSRRASQLLGSAASRLLHARGFAAAAAAAPSPAVFVDKSTRVICQGITGKNGTFHTEQAIEYGTNMVGGVTPKKGGTEHLGLPVFNSVAEAKAETKANASVIYVPPPFAAAAIMEAMDAELDLVVCITEGIPQHDMVKVKAALNRQSKTRLIGPNCPGIIKPGECKIGIMPGYIHKPGRIGIVSRSGTLTYEAVFQTTAVGLGQSTCVGIGGDPFNGTNFVDCLEKFVDDPQTEGIVLIGEIGGTAEEDAATFIQESKTQKPVVAFIAGLTAPPGRRMGHAGGGKGTAQDKIKALREAGVTVVESPAKIGSTMFEIFKQRGMVE

SEQ ID NO: 2385 - DNA, 792 bp, Sorghum bicolor
  misc_feature: Ceres ANNOT ID no. 6023922
  misc_feature: Encodes the peptide sequence at SEQ ID NO 2386
atggcactcgtctccgcctcctcgtcctccaccaccgccgtcgcggcgctccccaggaatgggcagcagcgcgcgtcgtcgacgtccttcctcggcggcaagacgctgctgaggcaggccaccgaggcggcccggccgtcgttcgccgtgcgcgccgcggcggaccccgacaggccgatctggttccccggcagcacccctcccccgtggctcgacggcagccttccgggcgacttcggctttgatccctggggcctcggatctgacccggagagcctgcggtggaacgtgcaggcggagctggtgcactgccggtgggcgatgctcggcgcggcgggcatcttcatcccggagttcctgaccaagatcggcatcctcaacacgcccttctggtacaccgccggcgagcagcagtacttcaccgacaccaccaccctcttcatcatcgagctcatcctcatcggctgggccgagggccgccgctgggctgacatcatcaagcccggaagcgtcaacactgaccccatcttccccagcaacaagctcaccggcaccgacgtcgggtaccctggtggcctgtggtttgacccactcggctggggctccggctcgccggagaagatcaaggagctgcgcaccaaggagatcaagaacggacgcctcgccatgctcgccgtcatgggcgcctggttccaggccgagtacaccggcactggccccatcgacaacctcttcgcccacctcgccgaccccggccacgccaccatcttccaggccttcacccctaaatga

SEQ ID NO: 2386 - protein, 263 aa, Sorghum bicolor
  misc_feature: Ceres ANNOT ID no. 6023922
  misc_feature (66)..(234): Pfam Id: Chloroa_b-bind Pfam Desc: Chlorophyll A-B binding protein
  misc_feature (1)..(263): NCBI GI: 666054 NCBI Desc: lhci-680, photosystem i antenna protein [hordeum vulgare subsp. vulgare]
  misc_feature (1)..(263): NCBI GI: 551047 NCBI Desc: type ii lhci [lolium temulentum]
  misc_feature (3)..(263): NCBI GI: 19180 NCBI Desc: chlorophyll a/b-binding protein [lycopersicon esculentum]
  misc_feature (3)..(263): NCBI GI: 226259 NCBI Desc: chlorophyll binding protein
  misc_feature (4)..(263): NCBI GI: 6850838 NCBI Desc: lhca2 protein [arabidopsis thaliana]
  misc_feature: Useful for making plants with modulated oxidative stress sensitivity
  misc_feature: Functional homolog of the protein sequence given in SEQ ID NO 13028
MALVSASSSSTTAVAALPRNGQQRASSTSFLGGKTLLRQATEAARPSFAVRAAADPDRPIWFPGSTPPPWLDGSLPGDFGFDPWGLGSDPESLRWNVQAELVHCRWAMLGAAGIFIPEFLTKIGILNTPFWYTAGEQQYFTDTTTLFIIELILIGWAEGRRWADIIKPGSVNTDPIFPSNKLTGTDVGYPGGLWFDPLGWGSGSPEKIKELRTKEIKNGRLAMLAVMGAWFQAEYTGTGPIDNLFAHLADPGHATIFQAFTPK

SEQ ID NO: 2387 - DNA, 1149 bp, Sorghum bicolor
  misc_feature: Ceres ANNOT ID no. 6023931
  misc_feature: Encodes the peptide sequence at SEQ ID NO 2388
atggctcccctggcctcccatcctctcccgtcccgcgctcccaccaccgcccctcgcttcctcgccgcccccgccatccgggtgctcagcctgtcgcggtctgcgtcgccgctcctctccgcctccgcaggccgcttccctcaggcccctcgcgctccctgcagtgccgcccgtgagcaccgccgcgacaccgtgcgggaatgcactcgagctgatgctgctggaccagctccattatcaaagacactattagacctcaaggattcctgctggagatttctaaggccacatacaatccgaggaactgctttaggatccatagcattggttgcgagagccttgatagagaattcccatctgataaactggtggttactattcaaagcattctatgggcttttagcattgatctgtggcaatggttacatagttgggattaatcagatctatgatgttgctattgacaaggtaaacaagccatatttacccattgctgccggtgatctctcagttgagtcagcatggttgttggtgatattatttgcagctgcaggtttttcaattgttatagcgaaatttggacctttcattacctctctatactgtcttggcctatttcttggcactatatattctgttcctccattcagactgaagagatatccggttgctgcttttcttatcattgcaacggttcgcggtttccttctcaactttggcgtgtactatgctactagggctgcactaggtcttacattccaatggagctcccctgttgctttcattacatgcttcgtgacactatttgctttggtcattgctataaccaaagatctccctgatgttgaaggagatcgcaagtaccaaatatcaactttggcaacaaagcttggtgtcagaaatatcgcattccttggatctggtttactattagcaaactatattggtgctattgttgtagcttttaccatgcctcaggctttcaggagcactgtaatggttcctgcgcacgctgtccttgccgctggtttaattttccagacatgggttctggagcaagcgaagtacacaaaggatgctatttcacagtactaccggttcatctggaatctcttctatgctgaatatatcttcttcccgttaatatag

SEQ ID NO: 2388 - protein, 382 aa, Sorghum bicolor
  misc_feature: Ceres ANNOT ID no. 6023931
  misc_feature (101)..(382): Pfam Id: UbiA Pfam Desc: UbiA prenyltransferase family
  misc_feature (4)..(382): NCBI GI: 115472969 NCBI Desc: os07g0576000 [oryza sativa (japonica cultivar-group)]
  misc_feature (12)..(382): NCBI GI: 81295668 NCBI Desc: homogentisate phytyltransferase vte2-2 [arabidopsis thaliana]
  misc_feature (4)..(382): NCBI GI: 81295670 NCBI Desc: homogentisate phytyltransferase vte2-2 [glycine max]
  misc_feature (71)..(382): NCBI GI: 121490370 NCBI Desc: homogentisate prenyltransferase [chlamydomonas reinhardtii]
  misc_feature (89)..(242): NCBI GI: 113477330 NCBI Desc: ubia prenyltransferase [trichodesmium erythraeum ims101]
MAPLASHPLPSRAPTTAPRFLAAPAIRVLSLSRSASPLLSASAGRFPQAPRAPCSAAREHRRDTVRECTRADAAGPAPLSKTLLDLKDSCWRFLRPHTIRGTALGSIALVARALIENSHLINWWLLFKAFYGLLALICGNGYIVGINQIYDVAIDKVNKPYLPIAAGDLSVESAWLLVILFAAAGFSIVIAKFGPFITSLYCLGLFLGTIYSVPPFRLKRYPVAAFLIIATVRGFLLNFGVYYATRAALGLTFQWSSPVAFITCFVTLFALVIAITKDLPDVEGDRKYQISTLATKLGVRNIAFLGSGLLLANYIGAIVVAFTMPQAFRSTVMVPAHAVLAAGLIFQTWVLEQAKYTKDAISQYYRFIWNLFYAEYIFFPLI

SEQ ID NO: 2389 - DNA, 1131 bp, Sorghum bicolor
  misc_feature: Ceres ANNOT ID no. 6023935
  misc_feature: Encodes the peptide sequence at SEQ ID NO 2390
atggcttgcgcggccgctcccagccccctccccgctcgccgcagcggcacggcggcccgcgtggtcttcgccgtggggccccacccgccgcgattctacgggcgttttaaaccctccacggccacgggaggcgcgccacgctccagcctgcgcgtcgtggcctcgagctccaaggcggacccagtagaggagagacccgcagtcgcgccgctcccggacgtagcagtctcggccgacgcgtcctcgccggtggtgcctcagccccaagtaagcaccggcacatggaaatggaagggctacaacattcgctaccagtacgctggaacatcaggccctgcattggttctgattcatgggtttggggcaaacagtgaccattggcggaaaaatattcctgttctagccgtcgcacacagggtatatgcgatagatctaattggttatggctactccgataagcctaatccgcgtgaggtaggggagaacttttatacttttgagacatggggagaacagctgaatacattttgtgcggaagtggttcagagtgaagctttcttcatatgcaattcaattggaggggttgttggtctgcaggcagccgttatggaacctaaaaaatgtaagggaattgttttattggatatttcactaaggatgcttcacatcacaaagcagccatggtttggaaagcctttcatcaaatcttttcaaagtctcctaaggaacactattgttgggaagctattttttaatgctgttgctacaccagaatctgtgaaaaatattctttgccagtgttatcatgacacatctgcagtgacagatgagctagttcagattattctacagcctggtcttgatcctggagcagtggatgtattccttgagttcatctgctactctggaggacctctacctgaagagttgcttccattggttaagtgtccagttttggtagcatggggggagaaggacccatgggagcctgttgagcttggaagagcttatgcatcttttgatacagttgaagattttgttgttttgccagatgttggacactgccctcaggatgaagcacctgaccttgtaaatccgcttgtcgaatcatttgtccagcgccatacttag

SEQ ID NO: 2390 - protein, 376 aa, Sorghum bicolor
  misc_feature: Ceres ANNOT ID no. 6023935
  misc_feature (138)..(370): Pfam Id: Abhydrolase_1 Pfam Desc: alpha/beta hydrolase fold
  misc_feature (75)..(375): NCBI GI: 18420047 NCBI Desc: hydrolase, alpha/beta fold family protein [arabidopsis thaliana]
  misc_feature (76)..(372): NCBI GI: 67924627 NCBI Desc: alpha/beta hydrolase fold [crocosphaera watsonii wh 8501]
  misc_feature (93)..(376): NCBI GI: 86604874 NCBI Desc: hydrolase, alpha/beta fold family [cyanobacteria bacterium yellowstone a-prime]
  misc_feature (91)..(376): NCBI GI: 75906849 NCBI Desc: alpha/beta hydrolase fold [anabaena variabilis atcc 29413]
  misc_feature (90)..(372): NCBI GI: 113477240 NCBI Desc: alpha/beta hydrolase fold [trichodesmium erythraeum ims101]
MACAAAPSPLPARRSGTAARVVFAVGPHPPRFYGRFKPSTATGGAPRSSLRVVASSSKADPVEERPAVAPLPDVAVSADASSPVVPQPQVSTGTWKWKGYNIRYQYAGTSGPALVLIHGFGANSDHWRKNIPVLAVAHRVYAIDLIGYGYSDKPNPREVGENFYTFETWGEQLNTFCAEVVQSEAFFICNSIGGVVGLQAAVMEPKKCKGIVLLDISLRMLHITKQPWFGKPFIKSFQSLLRNTIVGKLFFNAVATPESVKNILCQCYHDTSAVTDELVQIILQPGLDPGAVDVFLEFICYSGGPLPEELLPLVKCPVLVAWGEKDPWEPVELGRAYASFDTVEDFVVLPDVGHCPQDEAPDLVNPLVESFVQRHT

SEQ ID NO: 2391 - DNA, 1035 bp, Sorghum bicolor
  misc_feature: Ceres ANNOT ID no. 6023936
  misc_feature: Encodes the peptide sequence at SEQ ID NO 2392
atgtcggcggcgcagcagcagaaggcggcggcctcgacctcggcggcgggagcggagcaggaggaggtggagcacgggccattccctatcgagcagctccaggcttctggaatagctgcattggatgtgaagaagctgaaagattctggtctccacactgtggaggctgtagcttacactccaaggaaagatcttgtgcagatcaaagggataagtgaagctaaagttgacaagataattgaagcggcatccaagatagttccactgggatttacaagtgccagtcaacttcatgcgcagcggctggagattattcaagttacaactggatcaagagagcttgataagatcttggagggtggcatagaaacaggatctatcactgagatatatggtgagtttcgctctggaaagactcaattgtgtcacaccctttgtgttacatgtcagcttccactggaccagggtggtggtgaaggaaaggctctatatattgacgcagagggtaccttcagaccacaaagactcctgcagattgctgacaggtttggactgaatggtgctgatgtgttagagaatgtggcttatgccagagcttataatacggatcatcaatctagacttctgctggaggcagcttccatgatgatagagaccaggtttgctctcatggttgtagacagtgccacagctctgtacagaactgatttctcaggaagaggggagctatcagcgaggcaaatgcacatggctaagttcctgaggagccttcagaagttagctgatgagtttggagtagctgtggttatcaccaatcaagtagtggcacaagtggatggatctgccatgtttgctggaccgcagttcaagcccattggtggaaacatcatggctcatgcttcgaccacaaggcttgctcttcgaaagggacgaggggaggagcggatctgtaaagtaataagctctccctgcctggctgaagctgaagcaaggtttcagttagcttctgaaggtgttgcagatgtcaaggactga

SEQ ID NO: 2392 - protein, 344 aa, Sorghum bicolor
  misc_feature: Ceres ANNOT ID no. 6023936
  misc_feature (83)..(343): Pfam Id: Rad51 Pfam Desc: Rad51
  misc_feature (2)..(344): NCBI GI: 4886752 NCBI Desc: rad51 homolog rad51a [zea mays]
  misc_feature (9)..(344): NCBI GI: 115486271 NCBI Desc: os11g0615800 [oryza sativa (japonica cultivar-group)]
  misc_feature (9)..(344): NCBI GI: 18874071 NCBI Desc: rad51 [oryza sativa (japonica cultivar-group)]
  misc_feature (19)..(344): NCBI GI: 4886754 NCBI Desc: rad51 homolog rad51b [zea mays]
  misc_feature (5)..(344): NCBI GI: 112419535 NCBI Desc: rad51 homolog [populus nigra]
MSAAQQQKAAASTSAAGAEQEEVEHGPFPIEQLQASGIAALDVKKLKDSGLHTVEAVAYTPRKDLVQIKGISEAKVDKIIEAASKIVPLGFTSASQLHAQRLEIIQVTTGSRELDKILEGGIETGSITEIYGEFRSGKTQLCHTLCVTCQLPLDQGGGEGKALYIDAEGTFRPQRLLQIADRFGLNGADVLENVAYARAYNTDHQSRLLLEAASMMIETRFALMVVDSATALYRTDFSGRGELSARQMHMAKFLRSLQKLADEFGVAVVITNQVVAQVDGSAMFAGPQFKPIGGNIMAHASTTRLALRKGRGEERICKVISSPCLAEAEARFQLASEGVADVKD

SEQ ID NO: 2393 - DNA, 771 bp, Sorghum bicolor
  misc_feature: Ceres ANNOT ID no. 6023937
  misc_feature: Encodes the peptide sequence at SEQ ID NO 2394
atgtcttatgctgtgctagccttactagccatctctgccgttgtctcgacggaggccgcaggcggcggcgtcgacgcgccgagtccagctccgtcggggcctctcaatctgaccgagatcctcacgaagggctcccagtacaacgcgttcattcgcctgctcaaggacaccgaggtgacctcgcaggtggccagcctgctggacagcgaccggaacgccgacggcctgacggtgctggccccgacggacgcggcgttcgcgggtctcaggccgggcacgctgaaccggatggacgcgcaggcgcagtcgcagctggtgctgttccacatcctgcccaagtactacaccttcgtgacgttccagaccaccaccaaccccgtgcgcacgcaggcctccggccagcacggcgtgtacaccgtgaacgtcaccagcggcggcgagcggcgggtcaacgtgtcgtcggggctcatggaggccatgcttgggaagacgctctactcggcgtacccgctggcggtgtactccgtggacaaggtcctgctctcgccggcgctcttcggccgcagcgacgtgaaggatggagccgaggcaccggcggcggcctcgaaaccgcagaagcaagccccttcttcgacggcggctggtgatcacgctcctgctaatgaggctgacgccacggccgccgcgggggcagacaccacaaggaccagtaggtggctggcttttgctgctactgcgtccgcggtcgtgctcagcctgctctcatgttaa

SEQ ID NO: 2394 - protein, 256 aa, Sorghum bicolor
  misc_feature: Ceres ANNOT ID no. 6023937
  misc_feature (46)..(182): Pfam Id: Fasciclin Pfam Desc: Fasciclin domain
  misc_feature (2)..(254): NCBI GI: 56202243 NCBI Desc: arabinogalactan protein-like [oryza sativa (japonica cultivar-group)]
  misc_feature (7)..(231): NCBI GI: 115349912 NCBI Desc: fasciclin-like protein fla14 [triticum aestivum]
  misc_feature (26)..(254): NCBI GI: 92875493 NCBI Desc: beta-ig-h3/fasciclin [medicago truncatula]
  misc_feature (1)..(255): NCBI GI: 607774 NCBI Desc: arabinogalactan-like protein
  misc_feature (26)..(247): NCBI GI: 21553523 NCBI Desc: arabinogalactan protein-like [arabidopsis thaliana]
  misc_feature: Useful for making plants with altered cell wall content and/or composition
  misc_feature: Functional homolog of the protein sequence encoded by LOCUS at5g03170
  misc_feature: Useful for making plants with altered carbohydrate content
  misc_feature: Functional homolog of the protein sequence given in SEQ ID NO 13789
MSYAVLALLAISAVVSTEAAGGGVDAPSPAPSGPLNLTEILTKGSQYNAFIRLLKDTEVTSQVASLLDSDRNADGLTVLAPTDAAFAGLRPGTLNRMDAQAQSQLVLFHILPKYYTFVTFQTTTNPVRTQASGQHGVYTVNVTSGGERRVNVSSGLMEAMLGKTLYSAYPLAVYSVDKVLLSPALFGRSDVKDGAEAPAAASKPQKQAPSSTAAGDHAPANEADATAAAGADTTRTSRWLAFAATASAVVLSLLSC

SEQ ID NO: 2395 - DNA, 3384 bp, Sorghum bicolor
  misc_feature: Ceres ANNOT ID no. 6023943
  misc_feature: Encodes the peptide sequence at SEQ ID NO 2396
  misc_feature: Up-regulated in root tissues in response to methyl jasmonate treatment
atggcgtccgccgaggaccaggccgcggccgccgcgctgctggggggcgacccggcggcgttcgacgcgctgctctcgacgctcatgtcgtcctccaacgccgaccgctccgccgccgaggccgccttccaccgcctccgggcctcgcacccggagcccctcgcgctgaggctcgccacctcgctcgcggcgcctgccacccccgctgacctgcgcgccatggcgggggtcctcctccggaaggtcctctccccgaccccgtcctccgacgcatcctccaacaacgcagccgcgtccccggcgccgctctggccgcagctctctcccgcggggcagaccgcgctcaaggcgcacctcctctccgcgctccagtccgatcctcccaagcccatcgctaagaaggtctgcgacgccgtctctgagctcgccgcctcgctgctgcccgagaacgcctggcccgagctgctgccgttcctcttccgcgctgcgtcgggtgctgaggcgcccaacctccaggagtcagcgctgcttatcttcgcgaggctggcggattacatcgcggagtcgctcctcgaccatctgatgactatccacaacctcctcgcctccgccctggcgcatcccacgtcccctgatgttcggattgccgccctgggtgccgcagtcaacctcgtccagtgcctgccaaccaactccgaccgggataagatgcaggatttgctcccagcaatgatgagggcgctcactgattgcctaaactctggccaggaggcctctgcgcaggaggcactggagctgctcgtcgagcttgctggcgctgagccaaggttcctgaggaggcagattgctgatgtggtgggggcaatgttgcaagttgctgaggctgcacagctggaagatgggaccagacacttggcggtggagtttgtgattacccttgctgaggctagggagcgtgcaccaggaatgatgcggcgactcccccagtttgttggtaggctgtttgcagtgctgatgcagatgctgcttgatgtcgaggatgaccctgcatggcactctgctgaaactgaagatgaggacgcaggggaagggaacaactatggagtggcacaggagtgccttgaccgccttgccatcgccattggagggaacgcaattgtgccaattgcatctgagctgctaccacagtacctgtctgctcctgagtggcagaagcaccatgctgcgctcattacacttgcacagattgcggaaggatgtgcaaaggttatgcttaaaaatttggaacaagtcgtttcgatgatattgaatggatttcaacatccccacccgcgtgtgagatgggctgctatcaatgccattggtcagctctctacggatttgggtcctgatcttcaagttcattaccaccagcaggtgctgcctgcattggcgaacgctatggatgatttccagaatccacgagttcaggcacatgcagcttcagcaattttgaattttagtgagaattgtacaccggaaattttgacgccttacctggatggaatcgtgaacaaattacttgttcttcttcagaatggcaagcaaatggtgcaggagggagcattgacagctctagcgtcagtagcagattcatcacaggaccacttcaagaaatactatgatgctgttatgccatacctaaaatctatcttgatgcatgcaactgataagtccaataggatgcttcgtgccaagtccatggagtgtataagtttggtaggaatggctgtgggtaaggacaagttcagagacgacgcaaggcaggttatggaagtacttatggctttgcaaggagctccgatggaaacagatgatccaattaccagctacatgttgcaggcttgggccaggctatgcaaatgtcttggacaggattttcttccttacatgagtgttgttatgcctccactgcttcagtctgctcagctgaagcctgatgttacgattacttcagccgaatcagatgatgatattgagtcagatgatgatagcattgaaacaatcacacttggtgacaaaagaattggaatccgaactagtgtgctggaagagaaagcaacagcttgcaacatgctgtgctgctatgctgatgagcttaaggagggtttcttcccatggattgatcaggttgccccaacgttggtccctctgctgaagttttacttccacgaggaagtcagaagagctgctgttgcagccatgcctgaactcctacgctcggcaaagttggctgttgagaaggggcaggctcaaggccgtgatcagtcttatgttaaacagttgtctgactacataattccagcacttgttgaagcactgcacaaggagccagaaacagaaatgtgctcatccatgctggattctttaaatgagtgtatgcagctttctggtcttctgcttgatcaaacccaagtacgagctatctcggatgagattaaaaatgtcattatagccagcgctacccggaaaagagaacgttctgagagaacaaaagcggaagattttgatgctgatgaaggagagctactcaaagaagagaatgaacaggaggaggaagtatttgatcaggtcagcgagtgcctaggaactttgattaaaaccttcaaagcttctttcttgcccttttttgaagagctctctatgtacattacaccaatgttgggaaaggataaaacacccgaagagagaaggatagctatctgtatttttgatgatgttgcagagcaatgccgtgaatcagctttgaagtattatgacacataccttcctttccttttggaggcttcaaacgatgaaaattcagatgttcggcaggctgctgtctatggtgtgggtgtatgtgccgagtttggtggtcatgtttttcgccctctagtaggagaggccctatcgaaattaaacaatgttataagacatcctgaggcacgacttccagacaatatcatggcatatgataatgctgtttcggcacttggaaaaatatgccaatttcatcgtgatggtattgatgcagctcaggttattccagcctggcttagctgcttgcctataaaagacgacaagattgaagctaaagttgtacatgaacaactttgctcaatggtggagaggtcggattctgaaattctcggtcctcaaagccagtatcttcctaaaattgtttcaatttttgcagaggttttgtgcaatggaacagaactcgccacagatgaaactagaaacaggatggtgaatatcttgaggcgtttccagcagactttgcctcctgattttcttgcatcaacgttttccaacttgcaaccgcagcaacagctactgctacagtccatcttgtcgacatag

SEQ ID NO: 2396 - protein, 1127 aa, Sorghum bicolor
  misc_feature: Ceres ANNOT ID no. 6023943
  misc_feature (425)..(461): Pfam Id: HEAT Pfam Desc: HEAT repeat
  misc_feature (929)..(965): Pfam Id: HEAT Pfam Desc: HEAT repeat
  misc_feature (7)..(1127): NCBI GI: 140070663 NCBI Desc: heat [medicago truncatula]
  misc_feature (236)..(1127): NCBI GI: 124359278 NCBI Desc: heat [medicago truncatula]
  misc_feature (437)..(1127): NCBI GI: 124361010 NCBI Desc: heat [medicago truncatula]
  misc_feature (484)..(1127): NCBI GI: 115454793 NCBI Desc: os03g0701000 [oryza sativa (japonica cultivar-group)]
  misc_feature (51)..(1127): NCBI GI: 28194088 NCBI Desc: karyopherin-beta 3 variant [xenopus laevis]
  misc_feature: Up-regulated in root tissues in response to methyl jasmonate treatment
MASAEDQAAAAALLGGDPAAFDALLSTLMSSSNADRSAAEAAFHRLRASHPEPLALRLATSLAAPATPADLRAMAGVLLRKVLSPTPSSDASSNNAAASPAPLWPQLSPAGQTALKAHLLSALQSDPPKPIAKKVCDAVSELAASLLPENAWPELLPFLFRAASGAEAPNLQESALLIFARLADYIAESLLDHLMTIHNLLASALAHPTSPDVRIAALGAAVNLVQCLPTNSDRDKMQDLLPAMMRALTDCLNSGQEASAQEALELLVELAGAEPRFLRRQIADVVGAMLQVAEAAQLEDGTRHLAVEFVITLAEARERAPGMMRRLPQFVGRLFAVLMQMLLDVEDDPAWHSAETEDEDAGEGNNYGVAQECLDRLAIAIGGNAIVPIASELLPQYLSAPEWQKHHAALITLAQIAEGCAKVMLKNLEQVVSMILNGFQHPHPRVRWAAINAIGQLSTDLGPDLQVHYHQQVLPALANAMDDFQNPRVQAHAASAILNFSENCTPEILTPYLDGIVNKLLVLLQNGKQMVQEGALTALASVADSSQDHFKKYYDAVMPYLKSILMHATDKSNRMLRAKSMECISLVGMAVGKDKFRDDARQVMEVLMALQGAPMETDDPITSYMLQAWARLCKCLGQDFLPYMSVVMPPLLQSAQLKPDVTITSAESDDDIESDDDSIETITLGDKRIGIRTSVLEEKATACNMLCCYADELKEGFFPWIDQVAPTLVPLLKFYFHEEVRRAAVAAMPELLRSAKLAVEKGQAQGRDQSYVKQLSDYIIPALVEALHKEPETEMCSSMLDSLNECMQLSGLLLDQTQVRAISDEIKNVIIASATRKRERSERTKAEDFDADEGELLKEENEQEEEVFDQVSECLGTLIKTFKASFLPFFEELSMYITPMLGKDKTPEERRIAICIFDDVAEQCRESALKYYDTYLPFLLEASNDENSDVRQAAVYGVGVCAEFGGHVFRPLVGEALSKLNNVIRHPEARLPDNIMAYDNAVSALGKICQFHRDGIDAAQVIPAWLSCLPIKDDKIEAKVVHEQLCSMVERSDSEILGPQSQYLPKIVSIFAEVLCNGTELATDETRNRMVNILRRFQQTLPPDFLASTFSNLQPQQQLLLQSILST

SEQ ID NO: 2397 - DNA, 1023 bp, Sorghum bicolor
  misc_feature: Ceres ANNOT ID no. 6023959
  misc_feature: Encodes the peptide sequence at SEQ ID NO 2398
atgcccttgctgctcacgccgggcgctcgggcggcgccctcgccgtcaacgctgtcgcgcctactccttccgctccacctacaaattactaatggccggcacaaccaccggcacggtcacgtctccgcttcccccctcctctaccctcgcctccgcaaccgccgcggccgattcttcgcgtcctcctcctcctcgtcccagatggcggcgcctgccgacgcccccggtggttcttcggacgcgtttgaggtgatccgcgttcaccaggcaaaagctgctcgtctttctccagttgaagaaatacggaccattctggaccgaagtgtcagaggcgttcttgctacccattctcaggatcatgctggttatccatctagttcaatggttgattttgcatgtgatcaagatggttcccccatattagcagtgagtagtttagcagttcattcaaagaatctctccggaaatcctaaatgctcacttcttgtcgccaaagaccctgaggacagaacggatactgtaatcactgtatatggtgatgctgttcctgtttctgacgaagaaaaagattccgtgagaagtgcttacctaagaaggcatcctgatgctttttgggttgactttggtgacttcagtttcctgcacatcaaacctaaagctgtgcgctatgtatctggcgttgcaactgctctccttggctctggagaattcggtgctgccgagtacaaggaagctaacgttgatccaatatctcaattctcaactcctattacaagccatatgaacaaggatcatgctgatgatacaaagctcattgtgcaacactccactactgttaaggtggattttgcttatatgctggatgtggacagccttggttttaatgtgaaggctggttatgatggaagtgttctaaagttgcgtatccccttcccaaggcaggcgcaagacaggaaggatgttaaaacactaattgtggaaatgctccaagctgcaagagcctcatcttcagatcctgaatga

SEQ ID NO: 2398 - protein, 340 aa, Sorghum bicolor
  misc_feature: Ceres ANNOT ID no. 6023959
  misc_feature (95)..(188): Pfam Id: Pyridox_oxidase Pfam Desc: Pyridoxamine 5'-phosphate oxidase
  misc_feature (12)..(333): NCBI GI: 82400120 NCBI Desc: root border cell-specific protein-like protein [solanum tuberosum]
  misc_feature (60)..(333): NCBI GI: 7381225 NCBI Desc: root border cell-specific protein [pisum sativum]
  misc_feature (96)..(333): NCBI GI: 116228192 NCBI Desc: pyridoxamine 5'-phosphate oxidase-related, fmn-binding [solibacter usitatus ellin6076]
  misc_feature (111)..(334): NCBI GI: 109897813 NCBI Desc: pyridoxamine 5'-phosphate oxidase-related, fmn-binding [pseudoalteromonas atlantica t6c]
  misc_feature (96)..(337): NCBI GI: 90422122 NCBI Desc: pyridoxamine 5'-phosphate oxidase-related, fmn-binding [rhodopseudomonas palustris bisb18]
MPLLLTPGARAAPSPSTLSRLLLPLHLQITNGRHNHRHGHVSASPLLYPRLRNRRGRFFASSSSSSQMAAPADAPGGSSDAFEVIRVHQAKAARLSPVEEIRTILDRSVRGVLATHSQDHAGYPSSSMVDFACDQDGSPILAVSSLAVHSKNLSGNPKCSLLVAKDPEDRTDTVITVYGDAVPVSDEEKDSVRSAYLRRHPDAFWVDFGDFSFLHIKPKAVRYVSGVATALLGSGEFGAAEYKEANVDPISQFSTPITSHMNKDHADDTKLIVQHSTTVKVDFAYMLDVDSLGFNVKAGYDGSVLKLRIPFPRQAQDRKDVKTLIVEMLQAARASSSDPE

SEQ ID NO: 2399 - DNA, 855 bp, Sorghum bicolor
  misc_feature: Ceres ANNOT ID no. 6023979
  misc_feature: Encodes the peptide sequence at SEQ ID NO 2400
atgagagattttgcatcttgcctaagtcaaagtgccgttcaggttgcgcattcctcttcctcaagtgggcagaacttggtgcagtgtgcatacctggcacgccttcgcggcaagccttgcgtggtcaccgtcacctggagcaaggtggcgtcggggcaggctttcgccattgccatccatgactactccaaccgttgcctctgcaagacggaggtgaagccctggctgttctcgaagaggaagggttccaaggtcgtggaattggatagtggcaatgtggagatcatctgggacctgtcagccgcaaagttcgcggctgggccagagccactcgaaggcttccgtgttgctctactctatgatcttgaagttgtccttgttttgggtgacctaagcaaggaggaggatcgctgggttctgtcggatgctttgcattctgatgcagtcatgatagctaggaaggagcacatctatgcgaagaaggtgtattcggcgaaagctcgatttttggacattggtcagattcatcacatctccatagagtgcgacacggcaggggcgagggatcccagcttagagattaggattggcaagaagaaagtgttgcaggtgaagaggctggcatggaaattcagagggaaccagactatctatgtcgatggacttccagtggaggtgctctgggatgtgcatgactggctatttggttcctcgaatggatgcgccgtgtttttgtttcagtcaggccactccatggaaaaatccttgttcagaacatgctcacagaatgaaaaggaggctcaagcacatcgttttggtttcacattgatactaaaagcgtggaagactgagtaa

SEQ ID NO: 2400 - protein, 284 aa, Sorghum bicolor
  misc_feature: Ceres ANNOT ID no. 6023979
  misc_feature (27)..(253): NCBI GI: 116309418 NCBI Desc: h0321h01.2 [oryza sativa (indica cultivar-group)]
  misc_feature (31)..(240): NCBI GI: 115477775 NCBI Desc: os08g0557300 [oryza sativa (japonica cultivar-group)]
  misc_feature (150)..(253): NCBI GI: 70664008 NCBI Desc: osjnba0042i15.11 [oryza sativa (japonica cultivar-group)]
MRDFASCLSQSAVQVAHSSSSSGQNLVQCAYLARLRGKPCVVTVTWSKVASGQAFAIAIHDYSNRCLCKTEVKPWLFSKRKGSKVVELDSGNVEIIWDLSAAKFAAGPEPLEGFRVALLYDLEVVLVLGDLSKEEDRWVLSDALHSDAVMIARKEHIYAKKVYSAKARFLDIGQIHHISIECDTAGARDPSLEIRIGKKKVLQVKRLAWKFRGNQTIYVDGLPVEVLWDVHDWLFGSSNGCAVFLFQSGHSMEKSLFRTCSQNEKEAQAHRFGFTLILKAWKTE

SEQ ID NO: 2401 - DNA, 990 bp, Sorghum bicolor
  misc_feature: Ceres ANNOT ID no. 6023985
  misc_feature: Encodes the peptide sequence at SEQ ID NO 2402
atgtcgcagccgccggcgccggcgccgccgtatcggccgtataggcaggtgcgggaggcgacgccccacagccgggcggtctcctgcgtgcggttctccccctgcgggcgcctcctcgcgacagcgtccctcgacggaacggtcgcgctgctctccccgtcctcgctctccgtaatcgccgtcctgcgcggccactccgacggcgtctccgacctgtcctggtccacggagtcgtactacctctgctccgcctccgacgaccgcaccatccgcatctgggatatccggcccgtcctcgccggcggcgcccaggccgccgccgccgaccccggcgccgaccgctgcatccgcgtgctcaaggggcacaccaacttcgtcttcagcgccaacttcaacccgcagaccagctcgcagatcgcctccgggggatttgactgtaccgtgcgcatttgggacgtcaagaacggccgatgcacccgcgccatcgaagcgcactccgagcccgtcacctccgtgcatttcattagggacggatccatcgttgtatcaggaagccatgacgggagctgcaagatttgggacgccaagaccggggcttgcctcaagacggtcatcgatgaaaagaagcccgcggtctccttctccatgttctcgcccaatggcaagtttatccttgtcgccatgctcgataattcactgaagctatgcaattttgctaccggcaagttcttgaaggtatacagtggacatgtgaacagacaatactgcatccagtctgcgttctctgttacgaatgggaagtacattgtcagtggatcagaagacaactgcgtgtatatatgggacctccaagggagaaatattcttcagaaactagaaggccatacagacactgtcatctcggtatcctgccatccaacagagaacaagattgcttctggtggcctagataatgataggactgtaagattatgggttcaagatagttga

SEQ ID NO: 2402 - protein, 329 aa, Sorghum bicolor
  misc_feature: Ceres ANNOT ID no. 6023985
  misc_feature (14)..(52): Pfam Id: WD40 Pfam Desc: WD domain, G-beta repeat
  misc_feature (56)..(94): Pfam Id: WD40 Pfam Desc: WD domain, G-beta repeat
  misc_feature (113)..(152): Pfam Id: WD40 Pfam Desc: WD domain, G-beta repeat
  misc_feature (156)..(194): Pfam Id: WD40 Pfam Desc: WD domain, G-beta repeat
  misc_feature (241)..(282): Pfam Id: WD40 Pfam Desc: WD domain, G-beta repeat
  misc_feature (7)..(328): NCBI GI: 57525219 NCBI Desc: similar to zgc:56591 protein [gallus gallus]
  misc_feature (5)..(328): NCBI GI: 116667226 NCBI Desc: chain a, structural basis for the specific recognition of methylated histone h3 lysine 4 by the wd-40 protein wdr5
  misc_feature (5)..(328): NCBI GI: 109157928 NCBI Desc: chain a, structure of wdr5
  misc_feature (5)..(328): NCBI GI: 110590570 NCBI Desc: chain b, histone h3 recognition and presentation by the wdr5 module of the mll1 complex
  misc_feature (5)..(328): NCBI GI: 112490210 NCBI Desc: chain c, wdr5 and unmodified histone h3 complex at 2.25 angstrom
  misc_feature: The sequence is a functional homolog of SEQ ID NO. 502 in the 11/188,298 US application
  misc_feature: The sequence is a functional homolog of SEQ ID NO. 485 in the 11/188,298 US application
MSQPPAPAPPYRPYRQVREATPHSRAVSCVRFSPCGRLLATASLDGTVALLSPSSLSVIAVLRGHSDGVSDLSWSTESYYLCSASDDRTIRIWDIRPVLAGGAQAAAADPGADRCIRVLKGHTNFVFSANFNPQTSSQIASGGFDCTVRIWDVKNGRCTRAIEAHSEPVTSVHFIRDGSIVVSGSHDGSCKIWDAKTGACLKTVIDEKKPAVSFSMFSPNGKFILVAMLDNSLKLCNFATGKFLKVYSGHVNRQYCIQSAFSVTNGKYIVSGSEDNCVYIWDLQGRNILQKLEGHTDTVISVSCHPTENKIASGGLDNDRTVRLWVQDS

SEQ ID NO: 2403 - DNA, 465 bp, Sorghum bicolor
  misc_feature: Ceres ANNOT ID no. 6023987
  misc_feature: Encodes the peptide sequence at SEQ ID NO 2404
atgtcgtcgtcgccacgccacccttgcttcggcgccctcccggagcgcctcggctacgtgcagtgcaacctctgcgccaccatcctgctgctgctgaagacggtggccgtgcagtgcggcagctgctgcggcatcctctccgtcgcgctgccgcccccggcgccggcgtccgtcgagctgcccctgcaggaggccggcgttggtccgccgccgagggactccgacgagagcagcggagaggacagggagacggaggctaccgttgctgacaaccatgctgccttccctgcggttaacaaacctccagttaggaagcaacggacgccgtcggcctacaattgcttcatcaaggaggagatacagaggattaaggcgagacatcccagcatcacccacaaggaggccttcagcgctgcttctaaaaattgggctcacttacctaggatccagaagaagggagagtga

SEQ ID NO: 2404 - protein, 154 aa, Sorghum bicolor
  misc_feature: Ceres ANNOT ID no. 6023987
  misc_feature (8)..(153): Pfam Id: YABBY Pfam Desc: YABBY protein
  misc_feature (1)..(152): NCBI GI: 124271040 NCBI Desc: osyabby7 protein [oryza sativa (japonica cultivar-group)]
  misc_feature (69)..(149): NCBI GI: 32330677 NCBI Desc: yabby15 protein [zea mays]
  misc_feature (51)..(149): NCBI GI: 57157494 NCBI Desc: filamentous flower like protein [nuphar japonica]
  misc_feature (69)..(149): NCBI GI: 32330679 NCBI Desc: yabby9 protein [zea mays]
  misc_feature (90)..(149): NCBI GI: 55771078 NCBI Desc: filamentous flower like protein [amborella trichopoda]
MSSSPRHPCFGALPERLGYVQCNLCATILLLLKTVAVQCGSCCGILSVALPPPAPASVELPLQEAGVGPPPRDSDESSGEDRETEATVADNHAAFPAVNKPPVRKQRTPSAYNCFIKEEIQRIKARHPSITHKEAFSAASKNWAHLPRIQKKGE

SEQ ID NO: 2405 - DNA, 573 bp, Sorghum bicolor
  misc_feature: Ceres ANNOT ID no. 6023998
  misc_feature: Encodes the peptide sequence at SEQ ID NO 2406
atgggcggtggtggcgcggcggccgtggcggcggcgctggtggtggtggtgctgtgggcgggcgtggcgtcggcggccgtgtacgaggtgggcgacaagaccgggtggaccatcatgggcaaccccgactatgccgcctgggccaactccaagaagttccacctcggcgacactgttgtgttcacgtacaacaagcagttccacaacgtgctggcagtgagcaaggcggactacaagaactgcgacgccaccaaaccgacggccacctggtccacgggcaacgactccgtcgtcctcaacaccacgggccaccactacttcctctgcggcttcacgggccactgcgccgccggccagaaggtggacatccgcgtcgccgcctcctctgctgccccttccgcgtcccccaccgccgcaccgtccccgaccccctccggctccaagccctccggcggcgccacggccgcgccgtcgccgcaccccaacgccgcgccgaaggccctctccgccagctccctggcagcgaccgtcgccgcgtccctgctctctctagccgcggccgtgcttgcatga

SEQ ID NO: 2406 - protein, 190 aa, Sorghum bicolor
  misc_feature: Ceres ANNOT ID no. 6023998
  misc_feature (36)..(119): Pfam Id: Cu_bind_like Pfam Desc: Plastocyanin-like domain
  misc_feature (13)..(189): NCBI GI: 92893294 NCBI Desc: blue (type 1) copper domain [medicago truncatula]
  misc_feature (7)..(184): NCBI GI: 144923457 NCBI Desc: blue (type 1) copper domain [medicago truncatula]
  misc_feature (8)..(190): NCBI GI: 8515096 NCBI Desc: phytocyanin homolog [pinus taeda]
  misc_feature (7)..(183): NCBI GI: 4104058 NCBI Desc: blue copper-binding protein homolog [triticum aestivum]
  misc_feature (25)..(131): NCBI GI: 2493319 NCBI Desc: mavicyanin
MGGGGAAAVAAALVVVVLWAGVASAAVYEVGDKTGWTIMGNPDYAAWANSKKFHLGDTVVFTYNKQFHNVLAVSKADYKNCDATKPTATWSTGNDSVVLNTTGHHYFLCGFTGHCAAGQKVDIRVAASSAAPSASPTAAPSPTPSGSKPSGGATAAPSPHPNAAPKALSASSLAATVAASLLSLAAAVLA

SEQ ID NO: 2407 - DNA, 873 bp, Sorghum bicolor
  misc_feature: Ceres ANNOT ID no. 6024003
  misc_feature: Encodes the peptide sequence at SEQ ID NO 2408
atgggcacgccggagttccccgacctggggaagcactgcagcgtcggcgactgcaaccagatcgacttcctccccttcacctgcgaccgctgcgaccatgtcttttgccttcaacaccgaagttatacatcacaccaatgcccaaatgcaaatatgaaagatgtcactgtcctcatctgcccactctgtgctaaaggtgttcgcctcaatccaagtgaagacccaaatatcacctgggatactcatgttaacactgattgtgatccatcaaattaccaaaaagtgacgaagaaaaagaaatgccctgttcctgggtgcagagagacactaacattttccaacaccatcagatgcaaagattgcaccaaagaacactgcctgaaacatagatttgggcctgatcataagtgcccaggaccaagaaaagtggattctggctttccctttgtaagcatgctaaggagaagtcagaaagcagagacacgctcaaatagcagtaacaacaatggttcttcatggtggagttccagtcttgtgaatgcagcaacgaatttcaaatcgtcagccgaagctggaatgcagaagctgagcactgtgactagccaagccttccagaaggctaaggatgggatgtccccaaatagcagcagcagcagtggtgaccttgtggagcaatgtgttcactgcccagcaagattttccaccgtgggggccttaattgaacatgttgagaaatcccaccagatgaactcacaaccaagtcatggccgagtgacgattgatgtttgcccaaaatgcagcaaggggttccgagatcctgtgttgcttgtggagcatgttgagagggaacatggaggaacgtcaagagtgtaa

SEQ ID NO: 2408 - protein, 290 aa, Sorghum bicolor
  misc_feature: Ceres ANNOT ID no. 6024003
  misc_feature (13)..(55): Pfam Id: zf-AN1 Pfam Desc: AN1-like Zinc finger
  misc_feature (1)..(289): NCBI GI: 122069714 NCBI Desc: zinc finger an1 and c2h2 domain-containing stress-associated protein 16 (ossap16)
  misc_feature (193)..(289): NCBI GI: 115472883 NCBI Desc: os07g0569700 [oryza sativa (japonica cultivar-group)]
  misc_feature (2)..(139): NCBI GI: 49387714 NCBI Desc: zinc finger (an1-like)-like protein [oryza sativa (japonica cultivar-group)]
  misc_feature (2)..(139): NCBI GI: 75123062 NCBI Desc: zinc finger an1 domain-containing stress-associated protein 17 (ossap17)
  misc_feature (5)..(200): NCBI GI: 50415427 NCBI Desc: mgc83152 protein [xenopus laevis]
MGTPEFPDLGKHCSVGDCNQIDFLPFTCDRCDHVFCLQHRSYTSHQCPNANMKDVTVLICPLCAKGVRLNPSEDPNITWDTHVNTDCDPSNYQKVTKKKKCPVPGCRETLTFSNTIRCKDCTKEHCLKHRFGPDHKCPGPRKVDSGFPFVSMLRRSQKAETRSNSSNNNGSSWWSSSLVNAATNFKSSAEAGMQKLSTVTSQAFQKAKDGMSPNSSSSSGDLVEQCVHCPARFSTVGALIEHVEKSHQMNSQPSHGRVTIDVCPKCSKGFRDPVLLVEHVEREHGGTSRV

SEQ ID NO: 2409 - DNA, 594 bp, Sorghum bicolor
  misc_feature: Ceres ANNOT ID no. 6024004
  misc_feature: Encodes the peptide sequence at SEQ ID NO 2410
atggcagcagtcgcccaggccgcaccggtggtgactgcggccgccgcacacaccgtctaccttcccgccgcgtgcaggggcatttcgccgcgggcggcgaacgggacgacgactggcgcgttcaggttcaggtggcgaccccggcggcgcacgctggcacggccggcgcggcgcgggagccgagccacggtccgcggccgggggctggggctcgtcgtcgtggccgagttcggcgggacgtacgaggacgggttcgaagacgtgcacaagaacatcatcaactacttcacttacaaggccacgcacacggttctccatcagctgtacgagatgaatcccccagcctacacttggctctacagttacattaacgtcaacgatccattagatggcgattatttccttcgcttgctcgccaaggagaggcaagacctagcggagagagtgatggtcacgcgcctccatctatacgaaatgcgaccacacacgatgatgtacgagcggatctccaaggagaacctggatatcatgcgccaaaggttggtcgagacagtggtctggccgacggatgacacaaacaccggcgagttctaa

SEQ ID NO: 2410 - protein, 197 aa, Sorghum bicolor
  misc_feature: Ceres ANNOT ID no. 6024004
  misc_feature (90)..(196): Pfam Id: RcbX Pfam Desc: RbcX protein
  misc_feature (86)..(181): NCBI GI: 82471077 NCBI Desc: chaperonin-like protein [nostoc sp. sag 29.90]
  misc_feature (86)..(193): NCBI GI: 82471101 NCBI Desc: chaperonin-like protein [nostoc punctiforme sag 71.79]
  misc_feature (86)..(181): NCBI GI: 82470992 NCBI Desc: chaperonin-like protein [nostoc sp. 'peltigera neopolydactyla cyanobiont']
  misc_feature (86)..(193): NCBI GI: 82471080 NCBI Desc: chaperonin-like protein [nostoc sp. sag 36.92]
  misc_feature (86)..(193): NCBI GI: 82470972 NCBI Desc: chaperonin-like protein [nostoc sp. 'peltigera rufescens 1 cyanobiont']
MAAVAQAAPVVTAAAAHTVYLPAACRGISPRAANGTTTGAFRFRWRPRRRTLARPARRGSRATVRGRGLGLVVVAEFGGTYEDGFEDVHKNIINYFTYKATHTVLHQLYEMNPPAYTWLYSYINVNDPLDGDYFLRLLAKERQDLAERVMVTRLHLYEMRPHTMMYERISKENLDIMRQRLVETVVWPTDDTNTGEF

SEQ ID NO: 2411 - DNA, 1659 bp, Sorghum bicolor
  misc_feature: Ceres ANNOT ID no. 6024014
  misc_feature: Encodes the peptide sequence at SEQ ID NO 2412
atggcctccacggcgacctcgcgccgccggccgcggcggggctccaagggccccaacgccgacctatgccgcaccctcaccgactgcacccgccgcggggacgcggccgccgccatggccgccttcgacgccgccgtctccggcgccggcgccgacgccgacacccctctccgcctcgccgctcaccagtacaaccagctcctccacctcctcgcctccgccgaccgctcttccttccccggccccgccgccgccgccgccgcgcgccgcgtcttcgcccacatgctgcaggccggggcgccgccctccgaggctaccatcacctccctcgcgcgcgtcatcgccgccgccgatgacccagggtcttcggctgccgacgaggcgttcgagctcgtggccaccatgaaggacaagtacggcctctccccgcgcctccgctcctacggccccgtcctcgctgcgttccgaagtgccggggaggccgccaaggcctacgctgtagaagcgcacatgacggcctccggcgtctcgcctgaggaacccgagcttgccgccctcctggatgtcagctccagagccggggacgcggacaaggtgtatgagtatatgcataagctgaggcaagccgtggactgcgtcagcgaggagactgcaggagttgtggaggcatggttcaggagcgacaaggcggcaatggccggtaagtctgaatggaatgctgctcaggtgaaggatgccattgtagcgaacggtggcggctgccaccgtcttgggtggcttggaactggcccttggacgatgcagcgggtgagagttggggctgatgatcagtgtgcagggtgtagataccgcctcgcttgcattgacattgacatggaggagacacggaagtttgctgattctgttgctggtttggcccttgagagggagactaaaacaaatttcagccgctttcaggagtggttggaagcaaataaagaatatcaagcaatagtcgacggtgcaaatattgcactgtatcaacaaaattttgcggagggtggtttcagtttgactcagctcgatgccgttataacagagctacgggatagatatcatgggaaatggccacttgtcatactacacaataaacgaattgccaaacttatggaaaattcatccaatagacatttgattgagacttggagaacaaatggggcattgtatacttcaccaagtgggtcaaatgatgactggtattggttgtatgcagcaatcaaactaaattgtttgcttgtgactaatgatgaaatgagagatcacatatttgagcttctagggtcatccttttttccgaagtggaagcaacgtcatcgggtaaagtacacctttaataaaggaaaagcggtgcttgtgatgccaccctcttattcttcagagattcaagagtcagaaatgggatcttggcacattccgatggaagagaagtctggggatgagagaggtaggatttggctttgtattggcaggggaggttcctgcaaagaacatggtgaagttcccacaactaatggagttgtccacgaaattcctccaaccgaggcatctaaagtggtgcagcagaggctggcagaaaataagaatgagacgatatctggtaaaagaaaggatagagattga

SEQ ID NO: 2412 - protein, 552 aa, Sorghum bicolor
  misc_feature: Ceres ANNOT ID no. 6024014
  misc_feature (3)..(552): NCBI GI: 57899860 NCBI Desc: pentatricopeptide (ppr) repeat-containing protein-like [oryza sativa (japonica cultivar-group)]
  misc_feature (6)..(503): NCBI GI: 92872159 NCBI Desc: tetratricopeptide-like helical [medicago truncatula]
  misc_feature (7)..(503): NCBI GI: 51536606 NCBI Desc: at2g32230 [arabidopsis thaliana]
  misc_feature (91)..(535): NCBI GI: 144924739 NCBI Desc: tetratricopeptide-like helical [medicago truncatula]
  misc_feature (140)..(503): NCBI GI: 115461538 NCBI Desc: os04g0692500 [oryza sativa (japonica cultivar-group)]
MASTATSRRRPRRGSKGPNADLCRTLTDCTRRGDAAAAMAAFDAAVSGAGADADTPLRLAAHQYNQLLHLLASADRSSFPGPAAAAAARRVFAHMLQAGAPPSEATITSLARVIAAADDPGSSAADEAFELVATMKDKYGLSPRLRSYGPVLAAFRSAGEAAKAYAVEAHMTASGVSPEEPELAALLDVSSRAGDADKVYEYMHKLRQAVDCVSEETAGVVEAWFRSDKAAMAGKSEWNAAQVKDAIVANGGGCHRLGWLGTGPWTMQRVRVGADDQCAGCRYRLACIDIDMEETRKFADSVAGLALERETKTNFSRFQEWLEANKEYQAIVDGANIALYQQNFAEGGFSLTQLDAVITELRDRYHGKWPLVILHNKRIAKLMENSSNRHLIETWRTNGALYTSPSGSNDDWYWLYAAIKLNCLLVTNDEMRDHIFELLGSSFFPKWKQRHRVKYTFNKGKAVLVMPPSYSSEIQESEMGSWHIPMEEKSGDERGRIWLCIGRGGSCKEHGEVPTTNGVVHEIPPTEASKVVQQRLAENKNETISGKRKDRD

SEQ ID NO: 2413 - DNA, 1578 bp, Sorghum bicolor
  misc_feature: Ceres ANNOT ID no. 6024238
  misc_feature: Encodes the peptide sequence at SEQ ID NO 2414
atggaggacgtcaggatcgggagcttcgacttggacgccgtcgccgcgtacccgacgacgctgcccagccccaggatggtcgccgcagctggacgagacctccaactcatccattcgccgcgccagccgtcgtcggggttcagcaagagcctcaacccgatctacaccgacgaccacgacaccacgacggcggcaacaacaacgaattcgtcaccatcatccgccgaaggcgcgcacgctgcgacggcgggagccgcacgggactgcccgccgccaaagccgacggcccctgtgcccgccgcgcggcgccacaccggcggggacgggcgctgggaggccatccgcgcggccgagcccccgctcagcctgggccacttccgcctcctacggcgcctgggctacggcgacatcggcagcgtctacctggtcgagctccgcggcggcggcggcgcgctcttcgccatgaaggtgatggacaagggcaccctggcgggccgcaacaagctggcccgcgcggagacggagcgggagatcctgggcctgctggaccacccgttcctgcccacgctctactcccacttccagacccacaagttctgctgcctcctcatggagtactgctgcggcggcaacctccactccctccgccagcggcagcccggcaagcgcttcgccgaggacgccgccaggttctacgcctgcgaggtgctgcttgcgctcgagtacctgcacatgctcggcgtcgtgtaccgggacctcaagcccgagaacgtgctcgtcagggaggaaggacacatcatgctctccgacttcgacctctcgctccgctgctccgtcagcccggcgcttgtccgctccccgtccggccgtgtcagcgccggcggcggcctcggtctcgcccacggctgcatgctcccgggcatcctcccgggcaagaagaagaacaacaagaagaagaacaagctggacgacgacgagacggtggctatagctagcgtcgtcggctgcaagaagaagccgtcgtcgctggagttcacggccgagccgacgagcgcgcggtccatgtcgttcgtgggcacccacgagtacctggcgccggagatcatccgcggcgacggccacggcagcgccgtcgactggtggaccttcggcatcttcctctacgagctcctgcacggcgccacgcccttcaagggctccgggaaccgcgccacgctcttcaacgtcgtcgcgcagccgctcaggttccccgacgcgccggcggtcagcgccgcggccagggacctcatccggggcctgctggccaaggagccgcacaaccggctcgcgtcccgccgcggcgcggccgaggtgaagcagcaccctttcttcgaaggcgtcaactgggcactcgtcaggagcgcccagccgccctacatccccgacgccgccgccgttgatcactgctcgtcccaattcgccttcagcgacggagcggcggcggcgcaaggtggtggcacgcccaagagcgacgcacggaaaaccggatcgcgtcacactgattctgattcgtcgcatgctgattttgagtacttttag

SEQ ID NO: 2414 - protein, 525 aa, Sorghum bicolor
  misc_feature: Ceres ANNOT ID no. 6024238
  misc_feature (126)..(457): Pfam Id: Pkinase Pfam Desc: Protein kinase domain
  misc_feature (126)..(457): Pfam Id: Pkinase_Tyr Pfam Desc: Protein tyrosine kinase
  misc_feature (104)..(525): NCBI GI: 1360141 NCBI Desc: protein kinase [solanum berthaultii]
  misc_feature (104)..(525): NCBI GI: 7672777 NCBI Desc: viroid symptom modulation protein [lycopersicon esculentum]
  misc_feature (39)..(525): NCBI GI: 115435510 NCBI Desc: os01g0233800 [oryza sativa (japonica cultivar-group)]
  misc_feature (40)..(525): NCBI GI: 3152560 NCBI Desc: strong similarity to ser/thr protein kinases, especially gbx97980 from solanum berthaultii, gbx90990 from solanum tuberosum and gbd10909 from a. thaliana. [arabidopsis
  misc_feature (40)..(525): NCBI GI: 3152560 (continued) thaliana]
  misc_feature (100)..(525): NCBI GI: 4966365 NCBI Desc: similar to gbj04556 g11a protein from oryza sativa and contains a pf00069 eukaryotic protein kinase domain. [arabidopsis thaliana]
  misc_feature (60)..(474): SWISSPROT Homolog: EC 2.7.11.1 Protein kinase PVPK-1
  misc_feature: The sequence is a functional homolog of SEQ ID NO. 441 in the 11/188,298 US application
  misc_feature: The sequence is a functional homolog of SEQ ID NO. 340 in the 11/188,298 US application
  misc_feature: The sequence is a functional homolog of SEQ ID NO. 399 in the 11/188,298 US application
  misc_feature: The sequence is a functional homolog of SEQ ID NO. 464 in the 11/188,298 US application
  misc_feature: The sequence is a functional homolog of SEQ ID NO. 310 in the 11/188,298 US application
  misc_feature: The sequence is a functional homolog of SEQ ID NO. 332 in the 11/188,298 US application
  misc_feature: The sequence is a functional homolog of SEQ ID NO. 311 in the 11/188,298 US application
  misc_feature: The sequence is a functional homolog of SEQ ID NO. 498 in the 11/188,298 US application
  misc_feature: The sequence is a functional homolog of SEQ ID NO. 323 in the 11/188,298 US application
  misc_feature: The sequence is a functional homolog of SEQ ID NO. 358 in the 11/188,298 US application
  misc_feature: The sequence is a functional homolog of SEQ ID NO. 520 in the 11/188,298 US application
  misc_feature: The sequence is a functional homolog of SEQ ID NO. 495 in the 11/188,298 US application
  misc_feature: The sequence is a functional homolog of SEQ ID NO. 312 in the 11/188,298 US application
MEDVRIGSFDLDAVAAYPTTLPSPRMVAAAGRDLQLIHSPRQPSSGFSKSLNPIYTDDHDTTTAATTTNSSPSSAEGAHAATAGAARDCPPPKPTAPVPAARRHTGGDGRWEAIRAAEPPLSLGHFRLLRRLGYGDIGSVYLVELRGGGGALFAMKVMDKGTLAGRNKLARAETEREILGLLDHPFLPTLYSHFQTHKFCCLLMEYCCGGNLHSLRQRQPGKRFAEDAARFYACEVLLALEYLHMLGVVYRDLKPENVLVREEGHIMLSDFDLSLRCSVSPALVRSPSGRVSAGGGLGLAHGCMLPGILPGKKKNNKKKNKLDDDETVAIASVVGCKKKPSSLEFTAEPTSARSMSFVGTHEYLAPEIIRGDGHGSAVDWWTFGIFLYELLHGATPFKGSGNRATLFNVVAQPLRFPDAPAVSAAARDLIRGLLAKEPHNRLASRRGAAEVKQHPFFEGVNWALVRSAQPPYIPDAAAVDHCSSQFAFSDGAAAAQGGGTPKSDARKTGSRHTDSDSSHADFEYF

SEQ ID NO: 2415 - DNA, 1713 bp, Sorghum bicolor
  misc_feature: Ceres ANNOT ID no. 6024438
  misc_feature: Encodes the peptide sequence at SEQ ID NO 2416
atggccgacgaggccctggaccagccgccggacgcggcgccgtctccgtccccggctccagcgacgccgccggcccccgccacgccgtcccccgcggcggcgctgctccgcccgcggcgggaggcgttcgagcacgggctcctgcccatccccaagctcatcttcccggagggaacgctggcgcagacgctcgcccagctcaaggagaagctcgccgcctcggcggcccccgacgggcgcgtgcccgccgcggcgctggcggaggcgctgcagatcccgcaggagcaggcggcgctcgccctcgccacgctcgcggcggtgctcccggccgaggaccccgcgctcggggacggcgccgtggatggtgccgccgcggacatccgcgacgtgctgctcttcctctacatccagtcttacaagcgcctcgtcccgcggagcgcgcacaaggactcgcccgccgtggcggacgtctggccctccacctccgcgttcgatgggtacctctccgcgctctccccgatccagcttgttcgcagtaacagccgtcgttttatgccttctcaagctgatgaagaaattcatcagttgtcctatctgcaaaagcatatggcgaatattcttactctcttggcagattctgttgagggtgagggtgacgattcgctggtattgacaatggagacttttgagcaccttggatttctagttcaattctcagaaggaacttccttaagccaggctgctacattttttgcaaactcagatccagacatgcctgctgcgcctgtccctgctgctcaggttcttgattggatgtcacagaatatagcttctgcactggaatattctgctgagaggtccgcagcaaaggaaagcaacctgcaaaccatgtctgatcttgatgtaaccatggctgaggccaacacaagtcacccacggaacagcacacctagtgccaatcctgcgtactacagaaatgtaacgtttgtggaaggcttttccaaaacctctgttgtcaagcatgcatctgatgtcaaagggacaataaaggttttgaactgccatgattctgttatctacatattagcaccactgaagtatgctactgtgtatggctgttctgatgctacagttgttcttggtgctgttggtaaggtagtaaaagtggagcattgtgaaagagtgcatatcattgcagctgcaaaacggatttgtattgccaactgccgtgagtgcatattctacttaggagtaaatcaccaacctcttgtgttgggggacaaccataaattacaagatcatatgacgcaagtgggtgtcgattccagtgtcaacaaatgggaccaaccttttgtgttgggagttgttgatccacatgattcattgtcccatcctgctggggtttcagatgttaaagctgaatcagcaacatgtctggatcctgatctattcaccaattttttgattcctagttggtttggggatgaaaggcaagagcctacaaactgcaatcctttcccactgcctgaaatttatggagcattccaaagcaaaaagcgttctgctctggaagatatccaaaagatgattcgggagctgcagcttgacgagaatcggaaaagggaattggcatctgcccttcatgctcagttcaaggattggttatacgcttcgggcaatatccgccagctctactgtctacaaggtgattaa

SEQ ID NO: 2416 - protein, 570 aa, Sorghum bicolor
  misc_feature: Ceres ANNOT ID no. 6024438
  misc_feature (346)..(451): Pfam Id: TBCC Pfam Desc: Tubulin binding cofactor C
  misc_feature (1)..(570): NCBI GI: 49388111 NCBI Desc: tubulin-specific chaperone c-like protein [oryza sativa (japonica cultivar-group)]
  misc_feature (14)..(570): NCBI GI: 124360656 NCBI Desc: tubulin binding cofactor c [medicago truncatula]
  misc_feature (4)..(570): NCBI GI: 17380620 NCBI Desc: at3g57890/t10k17_100 [arabidopsis thaliana]
  misc_feature (23)..(558): NCBI GI: 42569861 NCBI Desc: tubulin-specific chaperone c-related [arabidopsis thaliana]
  misc_feature (1)..(432): NCBI GI: 51091222 NCBI Desc: tubulin-specific chaperone c-like [oryza sativa (japonica cultivar-group)]
MADEALDQPPDAAPSPSPAPATPPAPATPSPAAALLRPRREAFEHGLLPIPKLIFPEGTLAQTLAQLKEKLAASAAPDGRVPAAALAEALQIPQEQAALALATLAAVLPAEDPALGDGAVDGAAADIRDVLLFLYIQSYKRLVPRSAHKDSPAVADVWPSTSAFDGYLSALSPIQLVRSNSRRFMPSQADEEIHQLSYLQKHMANILTLLADSVEGEGDDSLVLTMETFEHLGFLVQFSEGTSLSQAATFFANSDPDMPAAPVPAAQVLDWMSQNIASALEYSAERSAAKESNLQTMSDLDVTMAEANTSHPRNSTPSANPAYYRNVTFVEGFSKTSVVKHASDVKGTIKVLNCHDSVIYILAPLKYATVYGCSDATVVLGAVGKVVKVEHCERVHIIAAAKRICIANCRECIFYLGVNHQPLVLGDNHKLQDHMTQVGVDSSVNKWDQPFVLGVVDPHDSLSHPAGVSDVKAESATCLDPDLFTNFLIPSWFGDERQEPTNCNPFPLPEIYGAFQSKKRSALEDIQKMIRELQLDENRKRELASALHAQFKDWLYASGNIRQLYCLQGD

SEQ ID NO: 2417 - DNA, 255 bp, Sorghum bicolor
  misc_feature: Ceres ANNOT ID no. 6024465
  misc_feature: Encodes the peptide sequence at SEQ ID NO 2418
atgaaggtcaagattcttcagtggcatgcagtggcttcttggacgtgggatgcacaggatgagacatgtggcatatgcaggatggcttttgatggctgttgccctgactgtaagttccctggtgacgattgcccactcatttggggtgcctgcaaccatgcttatcatcttcattgcatactgaagtgggtcaattctcaaacatccacacccctttgccccatgtgccgtagagagtggcagtttaagggctaa

SEQ ID NO: 2418 - protein, 84 aa, Sorghum bicolor
  misc_feature: Ceres ANNOT ID no. 6024465
  misc_feature (1)..(84): NCBI GI: 115452541 NCBI Desc: os03g0302700 [oryza sativa (japonica cultivar-group)]
  misc_feature (1)..(83): NCBI GI: 16197625 NCBI Desc: anaphase promoting complex subunit 11 [arabidopsis thaliana]
  misc_feature (15)..(84): NCBI GI: 124365542 NCBI Desc: zinc finger, ring-type [medicago truncatula]
  misc_feature (1)..(83): NCBI GI: 85857156 NCBI Desc: anaphase-promoting complex subunit apc11 [carassius auratus]
  misc_feature (1)..(82): NCBI GI: 55237486 NCBI Desc: ensangp00000021962 [anopheles gambiae str. pest]
  misc_feature: Useful for making plants with altered alkaloid content
  misc_feature: Useful for making plants with altered terpenoid content
  misc_feature: GREAT-hit functional homolog of the protein sequence given in SEQ ID NO 13297
  misc_feature: Useful for making plants with altered alkaloid content
  misc_feature: Useful for making plants with altered terpenoid content
  misc_feature: Functional homolog of the protein sequence given in SEQ ID NO 13297
  misc_feature: The sequence is a functional homolog of SEQ ID NO. 424 in the 11/188,298 US application
  misc_feature: The sequence is a functional homolog of SEQ ID NO. 329 in the 11/188,298 US application
  misc_feature: The sequence is a functional homolog of SEQ ID NO. 271 in the 11/188,298 US application
MKVKILQWHAVASWTWDAQDETCGICRMAFDGCCPDCKFPGDDCPLIWGACNHAYHLHCILKWVNSQTSTPLCPMCRREWQFKG

SEQ ID NO: 2419 - DNA, 2394 bp, Sorghum bicolor
  misc_feature: Ceres ANNOT ID no. 6024468
  misc_feature: Encodes the peptide sequence at SEQ ID NO 2420
atgggcgctctgtcggcttcgacttcgtcggtgaactggctagtcgaggacgacatcctcctcaagaacgcagtcgaggctggtgcctcattggagtccttagccaaaggagctgtatgtttttcccgtaaattcactcttcaagaaatacaggaccgctggaattcattgctttatgacccagaaatctcaacacaagcagcttctcggatggctgagtatgagaatgaactttccacttccgatccagccaaggcacataaacttttcaactcaaaagcaaaggatttttcatttcagaaacggaaaatagacagtgtaaagaatctatattatgcgatgagaaagagagtacgcaatgatccatgtaacagtggtgaccttggatttcttgttgccccctgttcatgtatggcaactggcagtgagtgtgtctgtggaggcctacctaacaatattgaaccagagctgaattcagtgagccgctatgggcaagtgggttcaagctacaatggtggacatgcatattctgaaatgaatggacaatcttttcatacgaagcatactgagagcatggcaagagatggggatggtaccaataacgtcgtgtatggctactcagatgtaggccaactatatgaacatcatgcctatgcagcgaataatcatgggaatagtgaagggaacaatgtttctctaaagagtatcacagattttcaggattctatgcagtttcagcacttggacaacaatcaatgtggtaatggagtggtagactcaaaggctttggtgatccctaaccatttcagtggaagtgtgcaggaacctacgcctctccaagtgattggtcaacctgagggttctgaagcaccagatggtgcaatctggagtggggttcagcaaagagacaggctcactcttgctgatgataagaatgtaaagtcagaaaacagggaccctctcacattcgaagcaaatttagatggtgggatgtctggtttagatcacgctgcagattttatggacttcccatttttcagtaatagtgaagactttgatatcctgaatagtgaaaattttttgaattctccaagtgagggaaaccaggaggatttagatgaccctgccttcaaagttgttcatggggttagatcaagcatgcaaaatctggtgcatcccgatgatgccaatatctcctgtgatcaaatagatcttggcgatgtaaaaaataatgcagatgcttctggtataatcttagttcctactcccttactagtgccctgtcctggcctgtatgtggagtgcaaattgaacacagaagatcctgaaattccttgcaatgatgatgtttctacaccaacagagtatcctcttgaatgctgtacttctacctttgggcagaaatctgagaatactatctattcagcctcccctgcaaccaaacaaaaagaagactcagtggctcatgacgaaggtggtgtcctaggagctaaaccgtcagaaggtgcttcaacaactggagcccttttgactggtaacattgacacaaatgatgcaaatacatgcatgctagctttgccctctttcagtgctgctggatttggtgaaggatcgccttgtagtttaggaccacatgagagctttgataactctcatggtttgactttgcaaaattcagttcaagctcctgatcagatgcaacacaactcacttaatggtcaaccagaattaggtgacaaggctgcactacagaactgtacgccatcgaatgcgctgccagatttgggtattcagaacactattgcaaatgcggcaacaccagctcaagcagaagaatgccttgaccatgaaaaagatgttccaaactactatgatctagaagctttgattcttgaccaggatctcatcccgtgggatcaagactctgatttgatgcatcctgaagttaccagatttcatcatccggaaagcaggaaggcattgattagattggagcaaggtgctcggtcttatatgaacagagctatcatgtcgcatggtgcttttgcagttatttatggattgcacttgaaatgctacataaaggatcctgaggttactcttggaagagagacagaagatgtcaaagttgacattgatttgggaaaagaagggagggcaaataagatatctcgccgacaggcggttatcaagatggatgaatctgggtcttttcatattaagaacataggaaaatgtccaatctttgttaatagcaaggaaataccaagctgcaaacgcatcaacttaaactctgattcattaatcgagattaaggacatgaggtttatttttcatgtaaaccaagacgctgtgaggcagtacattgatcgtaacctgaagccagaacgctag

SEQ ID NO: 2420 - protein, 797 aa, Sorghum bicolor
  misc_feature: Ceres ANNOT ID no. 6024468
  misc_feature (699)..(772): Pfam Id: FHA Pfam Desc: FHA domain
  misc_feature (454)..(794): NCBI GI: 18410049 NCBI Desc: forkhead-associated domain-containing protein / fha domain-containing protein [arabidopsis thaliana]
  misc_feature (611)..(795): NCBI GI: 92888970 NCBI Desc: forkhead-associated [medicago truncatula]
  misc_feature (614)..(790): NCBI GI: 15222287 NCBI Desc: forkhead-associated domain-containing protein / fha domain-containing protein [arabidopsis thaliana]
  misc_feature (614)..(774): NCBI GI: 9369376 NCBI Desc: f10a5.25 [arabidopsis thaliana]
  misc_feature (611)..(794): NCBI GI: 30696454 NCBI Desc: forkhead-associated domain-containing protein / fha domain-containing protein [arabidopsis thaliana]
  misc_feature: The sequence is a functional homolog of SEQ ID NO. 380 in the 11/188,298 US application
MGALSASTSSVNWLVEDDILLKNAVEAGASLESLAKGAVCFSRKFTLQEIQDRWNSLLYDPEISTQAASRMAEYENELSTSDPAKAHKLFNSKAKDFSFQKRKIDSVKNLYYAMRKRVRNDPCNSGDLGFLVAPCSCMATGSECVCGGLPNNIEPELNSVSRYGQVGSSYNGGHAYSEMNGQSFHTKHTESMARDGDGTNNVVYGYSDVGQLYEHHAYAANNHGNSEGNNVSLKSITDFQDSMQFQHLDNNQCGNGVVDSKALVIPNHFSGSVQEPTPLQVIGQPEGSEAPDGAIWSGVQQRDRLTLADDKNVKSENRDPLTFEANLDGGMSGLDHAADFMDFPFFSNSEDFDILNSENFLNSPSEGNQEDLDDPAFKVVHGVRSSMQNLVHPDDANISCDQIDLGDVKNNADASGIILVPTPLLVPCPGLYVECKLNTEDPEIPCNDDVSTPTEYPLECCTSTFGQKSENTIYSASPATKQKEDSVAHDEGGVLGAKPSEGASTTGALLTGNIDTNDANTCMLALPSFSAAGFGEGSPCSLGPHESFDNSHGLTLQNSVQAPDQMQHNSLNGQPELGDKAALQNCTPSNALPDLGIQNTIANAATPAQAEECLDHEKDVPNYYDLEALILDQDLIPWDQDSDLMHPEVTRFHHPESRKALIRLEQGARSYMNRAIMSHGAFAVIYGLHLKCYIKDPEVTLGRETEDVKVDIDLGKEGRANKISRRQAVIKMDESGSFHIKNIGKCPIFVNSKEIPSCKRINLNSDSLIEIKDMRFIFHVNQDAVRQYIDRNLKPER

SEQ ID NO: 2421 - DNA, 729 bp, Sorghum bicolor
  misc_feature: Ceres ANNOT ID no. 6024472
  misc_feature: Encodes the peptide sequence at SEQ ID NO 2422
atggcctcctccgagtcctccaatcccacgcctgcggccgcggccgccgcgcgccaaccggcccgcgacttcctcgcccacctcgaggcctatctcgcccgccgcgacggcgttgacaagctgctcaagatctcccgctacgccgcgcgcctcgcgctcgccgctgggccgccgctgccccccggcgcctccgcccgcctcaagtccttcgagtccagcgtcggcctcagccgcaaggctttccgtctcggcaagttcgtgcagtccctcaacgcgctccgcgcccacccgcaccctcccccggcgctcgcgctactcgcctacggcggtgagggcgtctactacttcgtcgagcagttcgtttggcttgccaaggccgggctcctgcctgcgcaccttctcccgcgcctccagcgcctcagtgcctgggccgagctgccgggctacgtcggctccattgcgattaagctggaggaagtggcgaagatcgaatcttcgataaagaagcggctcgcggaggactgtgataaggagagcgaggcggtgaagacgatgcagggtaagctgctgctgaagcggatgtcagtggtgcaggacgtggcggatgctgtaatggcgctgggagacgtcaccgatggcaagggtttgctcgggagctccacactgatggcatcagctggcctgctctcggcgttgatcagcacgcataaaaactggaattcctgttga

SEQ ID NO: 2422 - protein, 242 aa, Sorghum bicolor
  misc_feature: Ceres ANNOT ID no. 6024472
  misc_feature (25)..(239): Pfam Id: PEX11 Pfam Desc: Peroxisomal biogenesis factor 11 (PEX11)
  misc_feature (21)..(241): NCBI GI: 38605902 NCBI Desc: osjnbb0020o11.14 [oryza sativa (japonica cultivar-group)]
  misc_feature (25)..(237): NCBI GI: 92886312 NCBI Desc: peroxisomal biogenesis factor 11 [medicago truncatula]
  misc_feature (25)..(237): NCBI GI: 56368449 NCBI Desc: peroxisomal membrane protein pex11-2 [arabidopsis thaliana]
  misc_feature (19)..(208): NCBI GI: 55296207 NCBI Desc: peroxisomal biogenesis factor 11 protein-like [oryza sativa (japonica cultivar-group)]
  misc_feature (19)..(208): NCBI GI: 115466122 NCBI Desc: os06g0127000 [oryza sativa (japonica cultivar-group)]
MASSESSNPTPAAAAAARQPARDFLAHLEAYLARRDGVDKLLKISRYAARLALAAGPPLPPGASARLKSFESSVGLSRKAFRLGKFVQSLNALRAHPHPPPALALLAYGGEGVYYFVEQFVWLAKAGLLPAHLLPRLQRLSAWAELPGYVGSIAIKLEEVAKIESSIKKRLAEDCDKESEAVKTMQGKLLLKRMSVVQDVADAVMALGDVTDGKGLLGSSTLMASAGLLSALISTHKNWNSC

SEQ ID NO: 2423 - DNA, 1296 bp, Sorghum bicolor
  misc_feature: Ceres ANNOT ID no. 6024477
  misc_feature: Encodes the peptide sequence at SEQ ID NO 2424
atggcagcgctcgccgccagcgaggggaatctttccccgacgctgcccctggccactctgatcggccgcgagctccgcggcgacggcaccgagcgcccgcacgtgcgctacggccactctggcttcgccaagcgcggcgaggactacttcctcgtcaagcccgactgcctccgcgtccccggagacccttcctcctctttctccgtcttcgctgtattcgacggccacaatggcgtgtcggcggcggtgttcagcaaggagaaattgctggagcacgtgatgagcgccgtgccgcagggcatcagccgcgaggactggctacaggcgctgccgcgcgcgctcgtcgcaggattcgtcaagacagacattgacttccagcgcaagggtgagacatcaggaacgacggcgacacttgttgtcgttgatgggttcacggtaactgtggcgtcagtgggggactctaggtgcattctggatacacatggaggcgaggtctcattgctgactgtggatcaccggctagaggagaatgcagaggagcgtgagcgcgttacggcgagcggaggggaggtcagccgacttaacctctgtggtggacaggaggtcggtcctctcagatgctggccgggtggattgtgcctttcaaggtccattggggatactgatgtcggcgagttcattgtaccgattccacatgtcaagcaagtgaagctcccaaatactggtggaagactaataattgcatcagatggaatatgggatgctctgtcctcagaaattgctgctcaggcgtgccggggattgcctgcagaactggctgccaaacttgttgttaagcaagctctgaagacaagtgggttgaaagatgacacaacatgtgtggttgtcgacatcatcccatctgatcattgttcaacaccaccagcattatctccaaagaaaaatcagaacaagttgaggtctcttatttttggtaggaggtctcatagttctgttggaaagctcaccaaatctgcttctttgggctctgtggaagaaatatttgaggaggggtctgcaatgttggaagaaaggttgggtagaaatttcccatcaaaagcaaatctgcccccatttcgctgtgcaatctgccaagtggaccaagaaccattcgaaggtttaatgacggacaatgtaggtggctgctgctcagccccatcaacaccatggggtggtccttatctttgctcagactgtaggaaaaagaaggatgcgatggaaggtaaaagatcgaatcgctcagcaacatgcaggtga

SEQ ID NO: 2424 - protein, 431 aa, Sorghum bicolor
  misc_feature: Ceres ANNOT ID no. 6024477
  misc_feature (39)..(291): Pfam Id: PP2C Pfam Desc: Protein phosphatase 2C
  misc_feature (1)..(431): NCBI GI: 34394411 NCBI Desc: protein phosphatase 2c-like [oryza sativa (japonica cultivar-group)]
  misc_feature (12)..(426): NCBI GI: 92879648 NCBI Desc: protein phosphatase 2c-like [medicago truncatula]
  misc_feature (13)..(430): NCBI GI: 124359155 NCBI Desc: protein phosphatase 2c-like [medicago truncatula]
  misc_feature (15)..(428): NCBI GI: 3249105 NCBI Desc: contains similarity to protein phosphatase 2c (abi1) gbx78886 from a. thaliana. [arabidopsis thaliana]
  misc_feature (15)..(355): NCBI GI: 16930415 NCBI Desc: at1g09160/t12m4_13 [arabidopsis thaliana]
  misc_feature: The sequence is a functional homolog of SEQ ID NO. 363 in the 11/188,298 US application
  misc_feature: The sequence is a functional homolog of SEQ ID NO. 386 in the 11/188,298 US application
  misc_feature: The sequence is a functional homolog of SEQ ID NO. 406 in the 11/188,298 US application
  misc_feature: The sequence is a functional homolog of SEQ ID NO. 448 in the 11/188,298 US application
MAALAASEGNLSPTLPLATLIGRELRGDGTERPHVRYGHSGFAKRGEDYFLVKPDCLRVPGDPSSSFSVFAVFDGHNGVSAAVFSKEKLLEHVMSAVPQGISREDWLQALPRALVAGFVKTDIDFQRKGETSGTTATLVVVDGFTVTVASVGDSRCILDTHGGEVSLLTVDHRLEENAEERERVTASGGEVSRLNLCGGQEVGPLRCWPGGLCLSRSIGDTDVGEFIVPIPHVKQVKLPNTGGRLIIASDGIWDALSSEIAAQACRGLPAELAAKLVVKQALKTSGLKDDTTCVVVDIIPSDHCSTPPALSPKKNQNKLRSLIFGRRSHSSVGKLTKSASLGSVEEIFEEGSAMLEERLGRNFPSKANLPPFRCAICQVDQEPFEGLMTDNVGGCCSAPSTPWGGPYLCSDCRKKKDAMEGKRSNRSATCR

SEQ ID NO: 2425 - DNA, 948 bp, Sorghum bicolor
  misc_feature: Ceres ANNOT ID no. 6024480
  misc_feature: Encodes the peptide sequence at SEQ ID NO 2426
atgtccttgtcttctatttgctgtgggaacttccatctactaaggaactctataggagacacttgcagtatcaggtggcttaaataccatagcagattaatatatgaaactttcctctcaagcagaagacatcaaagtagaccacttagtacaacagtgctagcaagaagcacaagaaaaggaagtaagcagtcattcagcaatagccgtcatttgcacggtaaatcggttgaatcatcaattgaagtgttcaagcagtcagagcttgagcagcttaaatcacttcactgctacaatgttgaggaagagttttctggggtcaagaccgaatggcctgcaactatccttgtttttgatattgaaactacaggcttctcacgccgtgaggacagaattattgagtttgctgttcgtgatcttatggggggaaagaatagcactttccagacactcataaatcccgagaaagaagtgagaaatgcatatgttcatggtattagcaacagcatgctctgcagacctgatgttccaagatttggagagcttgttcccattctgctacaatatgtgtggagtcgtcaaatggacggcaaaccagttctttgggttgctcataatgggcgttcctttgacgtaccctttctcatctttgagttccgacggtgtaaattagagatgcctggtgattggctctttgtagatactcttcctatcgcaagacaattggtcgattctgatgggtcaaaactcagttctgtgtcattgaagaacctgagagaacgctataatatcccactcacaggcagcgcgcatcgtgccatgcaggatgtgacaaccctctgttatgtgcttcagaaattgacctttgagctgaaactaactgttcctcagctgctcgagaagtctttccaagcatctgatcttccagcgactcgtgctgaaaagtaa

SEQ ID NO: 2426 - protein, 315 aa, Sorghum bicolor
  misc_feature: Ceres ANNOT ID no. 6024480
  misc_feature (115)..(284): Pfam Id: Exonuc_X-T Pfam Desc: Exonuclease
  misc_feature (98)..(307): NCBI GI: 116309750 NCBI Desc: h0215f08.4 [oryza sativa (indica cultivar-group)]
  misc_feature (98)..(304): NCBI GI: 115460648 NCBI Desc: os04g0623400 [oryza sativa (japonica cultivar-group)]
  misc_feature (112)..(291): NCBI GI: 76788983 NCBI Desc: dna polymerase iii, epsilon chain [chlamydia trachomatis a/har-13]
  misc_feature (112)..(291): NCBI GI: 15604982 NCBI Desc: dna pol iii epsilon chain [chlamydia trachomatis d/uw-3/cx]
  misc_feature (114)..(303): NCBI GI: 62148070 NCBI Desc: dna polymerase iii, epsilon chain [chlamydophila abortus s26/3]
MSLSSICCGNFHLLRNSIGDTCSIRWLKYHSRLIYETFLSSRRHQSRPLSTTVLARSTRKGSKQSFSNSRHLHGKSVESSIEVFKQSELEQLKSLHCYNVEEEFSGVKTEWPATILVFDIETTGFSRREDRIIEFAVRDLMGGKNSTFQTLINPEKEVRNAYVHGISNSMLCRPDVPRFGELVPILLQYVWSRQMDGKPVLWVAHNGRSFDVPFLIFEFRRCKLEMPGDWLFVDTLPIARQLVDSDGSKLSSVSLKNLRERYNIPLTGSAHRAMQDVTTLCYVLQKLTFELKLTVPQLLEKSFQASDLPATRAEK

SEQ ID NO: 2427 - DNA, 1983 bp, Sorghum bicolor
  misc_feature: Ceres ANNOT ID no. 6024482
  misc_feature: Encodes the peptide sequence at SEQ ID NO 2428
atggctggctccgtagctccacacgctgtggtcctcgctctcctcctgctcgcggggctcgcggcggcgcagagagggacgacgccgacgccgacgccggcggcggcgccccccgcgcccgaccccggctgcaacggcatcgaggtgacgtacaacttcgggggccgcaccaagatccggccctacgtcagcgacaagaacaagcagccctacgccttccgcgccaacgtcaccgtgcgcaactccggcacccgcccgctcaagtcgtgggcggcgctcgtcacgttcggctacgacgagatcctcgtcggcgtcgacggcgccgtgctcacgggcggcggcgagctgccgtacaacaccacggaggacgccggcaacgccacctccttctccgggtacccgcagacggacctcctcacgcccatcgccaccgccggggacctgtcgcagatccaggcctccgtcggcatcgtcggcacgctcttcgccgggcccggcttcgatccgctccccaccgcgctgtcgctggacgacccggcctacgcgtgccccgcggcgaccaacctcacctctaaggtgctgtccacctgctgcgtcctcacgccggaggccgaggccaatgccaccgtcatcgacgccaacgccaccgacccgaccaagaatttcctgccgcgcggcaccggcctacccctccagctaccttgcgctcgtcacgctcgagaacagccttggactgtgttccccaaaagtaactggcggatgtcgtgggagtggcggcgcggcgagttcatctactccatgaagggcgctcacccatcagaggtggacacctcgggctgtatctatggggcgcctgggcagtactaccagagccttgatttctcgcaggtgctcaattgtgaccgcaagccggtgatccttgacctgcccctgtcccggtacaatgacacccagattgggaagatcgacaactgctgcaggaatgggacaatcttgcccaagtccatggatgaagcacagtcgaaatcggcattccagatgcaagttttcaagatgccaccagacctgaaccggactaagctgttcccccctgccaatttcaagattgccggtgcatcatcgctgaacccggactacacctgtggccagccggtgcctgtcagcccaactgcgttccctgacccaagcgggcttgactcgacgacacttgctgtggcaacatggcaggtggtgtgcaacattaccacaacgaagggggccaagcccaagtgctgtgtgaccttctcggcgtactacaacgactcggtgatcccctgcaacacctgcgcctgtgggtgccctgcaaacaggcgaggtccaacgtgcagcacgactgcacaatccatgctcttgccaccggaggcgctgcttatgccattcaacaaccgctcacacaaggcgttggcgtgggctgagctgaagcattacaatgtgccccggccaatgccttgtggtgacttctgtggtgtgagcatcaattggcatgtctcaacagactacaacaagggctggagtgctcgggtgacattgttcaactgggaggatgtcgacatggccaattggtttgctgccatcgtcatggacaaggcgtatgatggctttgagaaggcgtactcatttaacgccacctcagtgggcaagaacacaatctttatgcagggtttggaggggcttaattacctggtgaagcagaccaacatgagtgggattgactaccttgtgcccggtaagcaacagtcagtcctctcattcaccaagaagctgaccccggggataaatgttgttgctggagatggcttcccaacaaaggtcttcttcaatggcgacgaatgtgctatgccgcagagaattccgatgagcaatgggttcggcaaccgtctcagcagtggccttgctttggtcttgttccttgctgcttcggctttcctattgcttcagcaatga

SEQ ID NO: 2428 - protein, 660 aa, Sorghum bicolor
  misc_feature: Ceres ANNOT ID no. 6024482
  misc_feature (241)..(416): Pfam Id: Phytochel_synth Pfam Desc: Phytochelatin synthetase-like conserved region
  misc_feature (1)..(660): NCBI GI: 34733385 NCBI Desc: roothairless 3 [zea mays]
  misc_feature (36)..(658): NCBI GI: 119034684 NCBI Desc: brittle stalk-2-like protein 8 [zea mays]
  misc_feature (44)..(658): NCBI GI: 119034652 NCBI Desc: brittle stalk-2-like protein 5 [zea mays]
  misc_feature (33)..(632): NCBI GI: 92877766 NCBI Desc: phytochelatin synthetase-like conserved region; carbohydrate-binding [medicago truncatula]
  misc_feature (40)..(655): NCBI GI: 51970268 NCBI Desc: gpi-anchored protein [arabidopsis thaliana]
  misc_feature: Useful for making plants with altered cell wall content and/or composition
  misc_feature: Functional homolog of the protein sequence encoded by LOCUS at3g16860
  misc_feature: Functional homolog of the protein sequence encoded by LOCUS at4g16120
  misc_feature: Useful for making plants with altered carbohydrate content
  misc_feature: Functional homolog of the protein sequence given in SEQ ID NO 13790
  misc_feature: Useful for making plants with altered cell wall content and/or composition
  misc_feature: Functional homolog of the protein sequence given in SEQ ID NO 13791
MAGSVAPHAVVLALLLLAGLAAAQRGTTPTPTPAAAPPAPDPGCNGIEVTYNFGGRTKIRPYVSDKNKQPYAFRANVTVRNSGTRPLKSWAALVTFGYDEILVGVDGAVLTGGGELPYNTTEDAGNATSFSGYPQTDLLTPIATAGDLSQIQASVGIVGTLFAGPGFDPLPTALSLDDPAYACPAATNLTSKVLSTCCVLTPEAEANATVIDANATDPTKNFLPRGTGLPLQLPCARHAREQPWTVFPKSNWRMSWEWRRGEFIYSMKGAHPSEVDTSGCIYGAPGQYYQSLDFSQVLNCDRKPVILDLPLSRYNDTQIGKIDNCCRNGTILPKSMDEAQSKSAFQMQVFKMPPDLNRTKLFPPANFKIAGASSLNPDYTCGQPVPVSPTAFPDPSGLDSTTLAVATWQVVCNITTTKGAKPKCCVTFSAYYNDSVIPCNTCACGCPANRRGPTCSTTAQSMLLPPEALLMPFNNRSHKALAWAELKHYNVPRPMPCGDFCGVSINWHVSTDYNKGWSARVTLFNWEDVDMANWFAAIVMDKAYDGFEKAYSFNATSVGKNTIFMQGLEGLNYLVKQTNMSGIDYLVPGKQQSVLSFTKKLTPGINVVAGDGFPTKVFFNGDECAMPQRIPMSNGFGNRLSSGLALVLFLAASAFLLLQQ

SEQ ID NO: 2429 - DNA, 1224 bp, Sorghum bicolor
  misc_feature: Ceres ANNOT ID no. 6024484
  misc_feature: Encodes the peptide sequence at SEQ ID NO 2430
atgatccctttaaaccggagggcaagcctgcccagggctgggatggagtactttgatgcaaggcggaagcctcataatgttgggaaaatcattgcagccctggtcctcacaacagtctgtatatttgttctgaagcaatctcctggttttggtggcaatagcgtgttttctcgccatgaacctggggttacccatgtcttagttacaggaggagctggttatattggttcacatgccgctttaaggctcttaaaggataattatcgagttaccattgtggataatctatctagaggaaacatgggagcagtaaaggttctgcagggcttatttccgcagcctgggagactacaattcatctttgctgatcttggggaccagaaatctgtcaacaagatatttgctgaaaatgcatttgatgctgtgatgcactttgcagctgttgcttatgtgggagagagcacattggaaccccttaggtactatcacaatattacatcgaacactttattgattttggaggctatggcatctcatggagtcaaaaccctcatctactctagtacatgtgctacctatggagaaccagagaagatgcctattacagaagccacacctcagttccctatcaatccatatggaaaagctaagaaaatggcagaggatatcatattagatttctcaaagtcgaagggagctgacatggctgtcatgattttaagatatttcaatgttattggctctgaccctgagggaagattaggtgaggctcctaggccagaactccgagagcatggtcggatatctggggcatgcttcgatgcagcattaggagtcattccaggattgaaggttaaaggaacagattatcccacagctgatggaacctgcataagagattatattgatgtcacagatttagttgatgctcatgtgaaagcactcaacaaggcagagcctagaaaagtcggcatttacaatgttggaacaggaagaggtcgctcggttaatgagtttgttgatgcctgcaagaaagcaactggggttaacatcaaaattgaatacctcagcagaaggccaggagattatgcagaagtatacagcgatccaacaaagatcaacaaggagctcaactggacagctcaatataccgatctcaaagagagcctgtcagtcgcatggaggtggcaaaagtcgcatccgcacggctacgggccaaactaa

SEQ ID NO: 2430 - protein, 407 aa, Sorghum bicolor
  misc_feature: Ceres ANNOT ID no. 6024484
  misc_feature (66)..(329): Pfam Id: Epimerase Pfam Desc: NAD dependent epimerase/dehydratase family
  misc_feature (67)..(321): Pfam Id: 3Beta_HSD Pfam Desc: 3-beta hydroxysteroid dehydrogenase/isomerase family
  misc_feature (68)..(315): Pfam Id: NAD_binding_4 Pfam Desc: Male sterility protein
  misc_feature (1)..(407): NCBI GI: 27529690 NCBI Desc: udp-galactose 4-epimerase-like protein [oryza sativa (japonica cultivar-group)]
  misc_feature (1)..(407): NCBI GI: 84873496 NCBI Desc: udp-d-xylose epimerase 3 [hordeum vulgare]
  misc_feature (15)..(405): NCBI GI: 115460580 NCBI Desc: os04g0618200 [oryza sativa (japonica cultivar-group)]
  misc_feature (1)..(406): NCBI GI: 113610395 NCBI Desc: os07g0139400 [oryza sativa (japonica cultivar-group)]
  misc_feature (1)..(406): NCBI GI: 25553524 NCBI Desc: udp-galactose 4-epimerase-like protein [oryza sativa (japonica cultivar-group)]
  misc_feature (5)..(405): SWISSPROT Homolog: EC 5.1.3.5 UDP-arabinose 4-epimerase 1
  misc_feature: Useful for making plants with altered cell wall content and/or composition
  misc_feature: GREAT-hit functional homolog of the protein sequence encoded by LOCUS at1g30620
  misc_feature: GREAT-hit functional homolog of the protein sequence encoded by LOCUS at2g34850
  misc_feature: GREAT-hit functional homolog of the protein sequence encoded by LOCUS at4g20460
  misc_feature: GREAT-hit functional homolog of the protein sequence encoded by LOCUS at5g44480
  misc_feature: Useful for making plants with altered carbohydrate content
  misc_feature: Functional homolog of the protein sequence given in SEQ ID NO 13764
  misc_feature: Useful for making plants with altered cell wall content and/or composition
  misc_feature: Functional homolog of the protein sequence given in SEQ ID NO 13765
MIPLNRRASLPRAGMEYFDARRKPHNVGKIIAALVLTTVCIFVLKQSPGFGGNSVFSRHEPGVTHVLVTGGAGYIGSHAALRLLKDNYRVTIVDNLSRGNMGAVKVLQGLFPQPGRLQFIFADLGDQKSVNKIFAENAFDAVMHFAAVAYVGESTLEPLRYYHNITSNTLLILEAMASHGVKTLIYSSTCATYGEPEKMPITEATPQFPINPYGKAKKMAEDIILDFSKSKGADMAVMILRYFNVIGSDPEGRLGEAPRPELREHGRISGACFDAALGVIPGLKVKGTDYPTADGTCIRDYIDVTDLVDAHVKALNKAEPRKVGIYNVGTGRGRSVNEFVDACKKATGVNIKIEYLSRRPGDYAEVYSDPTKINKELNWTAQYTDLKESLSVAWRWQKSHPHGYGPN

SEQ ID NO: 2431 - DNA, 1197 bp, Sorghum bicolor
  misc_feature: Ceres ANNOT ID no. 6024488
  misc_feature: Encodes the peptide sequence at SEQ ID NO 2432
atgatggccgaggcagcgagagcgcagccgcggcagcagggcggttggctggatctacctgaagacatcatgcacgacatcctcctccgcctgcccccgaagttcgtcgtccgctgccgcgccgtctgcagttcctggctccgcctcgcctccgaccgcagcttccttctcgcccaccaccgccgccagccctccctgcccctcgtctacttcatcctcaacgacgtcggcgacccggaggtcagcgagtaccggctcgcggtcttcgacctccgcgccgtcgagttgcagactgtcgtcagattctcgggccacggcaatgggtggatggcccgtgaccgtgagaggaggctcgctctccatggctcctgcgacggggtcctcctcctatcctccgactaccacctattcctctgcaacccgaccacgcgccactggggtcgcctcccaccccttcaccgcgaccacaccatcgcaggactctactcgcacaggatctcggacgactaccgggtgctctacttccggcgccatggagatggaaactactactactacgtcatggcggccgggaccaggaagcagaggctggtcagtcgtcaggtatccccaatacactcctcatggcacacctggtttgcgcggcacacaccgcccgtcctcctccatggcaaccttcactggccccctgtctcgtcaagacccgagtccatagccgtcttcgacacggtcgccgaagtgttccggttgatgccttctcccgccgtcaacgtgaacaaccagctcgtctcgaatgtgaagctgcttgacatggagggtgctcttgccatgtcaagtagctggagcgagacttatggggatgacgggccctcgagggttgatctgtggtttctggaggactacaaatccaatgtttgggtctgcaagtaccgcattgagttgccggtggaagatatcagccgtttccttggattgctcgatttgtggactgctgttgttgtgtcccatgagggagatgtgctggttgatctcatgaatcgcctgctgggctatgacagggagggcaattcagttgcaaatttgccgtgtgattgcagcttgctggagattggtccacatatgcttaagcggagccttgttcctcatgcatcgcttccgatgaagaaccatagtcccaacaaaccacatttcgtctga

SEQ ID NO: 2432 - protein, 398 aa, Sorghum bicolor
  misc_feature: Ceres ANNOT ID no. 6024488
  misc_feature (14)..(61): Pfam Id: F-box Pfam Desc: F-box domain
  misc_feature (2)..(248): NCBI GI: 38346536 NCBI Desc: osjnba0040d17.11 [oryza sativa (japonica cultivar-group)]
  misc_feature (2)..(398): NCBI GI: 38346045 NCBI Desc: osjnba0059d20.17 [oryza sativa (japonica cultivar-group)]
  misc_feature (118)..(398): NCBI GI: 38346527 NCBI Desc: osjnba0040d17.2 [oryza sativa (japonica cultivar-group)]
  misc_feature (118)..(398): NCBI GI: 115457216 NCBI Desc: os04g0193300 [oryza sativa (japonica cultivar-group)]
  misc_feature (2)..(257): NCBI GI: 38344215 NCBI Desc: osjnbb0026e15.3 [oryza sativa (japonica cultivar-group)]
  misc_feature: The sequence is a functional homolog of SEQ ID NO. 456 in the 11/188,298 US application
MMAEAARAQPRQQGGWLDLPEDIMHDILLRLPPKFVVRCRAVCSSWLRLASDRSFLLAHHRRQPSLPLVYFILNDVGDPEVSEYRLAVFDLRAVELQTVVRFSGHGNGWMARDRERRLALHGSCDGVLLLSSDYHLFLCNPTTRHWGRLPPLHRDHTIAGLYSHRISDDYRVLYFRRHGDGNYYYYVMAAGTRKQRLVSRQVSPIHSSWHTWFARHTPPVLLHGNLHWPPVSSRPESIAVFDTVAEVFRLMPSPAVNVNNQLVSNVKLLDMEGALAMSSSWSETYGDDGPSRVDLWFLEDYKSNVWVCKYRIELPVEDISRFLGLLDLWTAVVVSHEGDVLVDLMNRLLGYDREGNSVANLPCDCSLLEIGPHMLKRSLVPHASLPMKNHSPNKPHFV

SEQ ID NO: 2433 - DNA, 510 bp, Sorghum bicolor
  misc_feature: Ceres ANNOT ID no. 6024489
  misc_feature: Encodes the peptide sequence at SEQ ID NO 2434
atggacggaggatccggcaatgcctccggcggcggcggcggcggcagcggcggcgcgtcgacgtgctgctactacgcgctcctcggcatccgcaagaacgcctccgccaccgacatacgcaccgcgtaccggaggctcgcgatgaagtggcacccggaccggtgggccagcgatccaggcgcggccggcgaggccaagcggcggttccagcggatccaggaggcgtactccgttttgtcggacaaggggaagaaggccatgtacgacgccgggctcttcgatcccctcgacgacgacgaccaggatttctccgacttcatgcaggagatgctggtgatgatggataacgtgaaaaacgagaagccggacacgctggaggacctgcagaagatgctagaggacatcgtgaacggcgacggcgtgggcgggcgcgtgccgccgccggcggccgacggtgcccggcggacgcgcgtcgcgccgtacccgcagccgcagcaggcgcgcaggtga

SEQ ID NO: 2434 - protein, 169 aa, Sorghum bicolor
  misc_feature: Ceres ANNOT ID no. 6024489
  misc_feature (23)..(89): Pfam Id: DnaJ Pfam Desc: DnaJ domain
  misc_feature (14)..(158): NCBI GI: 23428796 NCBI Desc: dnaj-like protein [glycine max]
  misc_feature (24)..(139): NCBI GI: 1350548 NCBI Desc: heat shock-like protein [picea glauca]
  misc_feature (24)..(156): NCBI GI: 62900234 NCBI Desc: chaperone protein dnaj
  misc_feature (24)..(156): NCBI GI: 62900075 NCBI Desc: chaperone protein dnaj 1
  misc_feature (24)..(89): NCBI GI: 121998257 NCBI Desc: chaperone protein dnaj [halorhodospira halophila sl1]
MDGGSGNASGGGGGGSGGASTCCYYALLGIRKNASATDIRTAYRRLAMKWHPDRWASDPGAAGEAKRRFQRIQEAYSVLSDKGKKAMYDAGLFDPLDDDDQDFSDFMQEMLVMMDNVKNEKPDTLEDLQKMLEDIVNGDGVGGRVPPPAADGARRTRVAPYPQPQQARR

SEQ ID NO: 2435 - DNA, 6462 bp, Sorghum bicolor
  misc_feature: Ceres ANNOT ID no. 6024491
  misc_feature: Encodes the peptide sequence at SEQ ID NO 2436
atggaagaggagggacaccacggagttgttttggcatgcagcatctgtgggttcctcttcgctgtccttagccctctcagcttttgggttctatgggctgtgaattggaggccatggaggttatacagttggatatatgcaaggaaatggccaacatatgtgcaaggacctcaactaagcacactttgcagccttttgactctttttgcatggcttgttgtcatttcccccatagcagttctcctcgtgtggggaagcatccttattgctcttctggaaaggaacataattggtttagctgttataatggcgggtgttgctttgcttctgtcattctactctataatgctctggtggagaacacaatggcaaagctcaaaggctgttgcttaccttctcctcctggcagtattcctactatgtgcctacgacttttgtgctatttatgtgacagctagtgctagtgcttccgagcttaattctccatcagggttcttcttcggggtgtctgcaatatcattggccatcaatatgctttttatatgtaaaatactgtttaatgtaagtggatttgatgttgatgaatatgtgcggaggtcatacaagtttgcctattctgactgtgttgaagtggctcctgtttcatgctctcctgagccaccagatcctagtgagttatacatgacaaaatccagcagggtcttgcatttagggcttctctacattagctcgctgcttgtgcttgttgcctattccatcttgtatggtcttacgtcaaaagaagctcgttggctgggtgctttaacttcagttgcagtggtgatccttgactggaatttgggcttgtgttcatttagatttgagcttcttaaaagtcggatgatagtgttatttgtggctggaacatcaagggctttccttatatccttcggagttcattactgttatgcttttgtagcatctgtgcttttatctgctgctgtctcttcctggctttctatttcaaacccctcagttgcaaggatagacgctctaagaagtacagttataaagctacgagagggatttcgaagaaaaggacaaaatagttcttcaaattcatcagaaggctgcggctctagtgtgaagcgtagtagcggtagtgttgaagctgttcaaaatggtaatgcaacggattctatgtacagaagcaactcacaaagcgatggtgtcaattggaacagtattccttttgatcgatcaaacagttgtcaagaaggccggagctctgacaagaacatagatagtgcacgtgcaagcttagctcataggagtaattcatgcctatctgctgtccaagactctgaaactgctgttgtttcaatagataggcatggagatcccactacttcacttgtttgttctagcagtggtttggaaagtcatggctgtgagcctagtggatcagccaccacctcaggtaatcaacagttattggatttgaacctggcagcgatatttcaggacagactaaatgacccaaggatttcatctatgctaaaaaagaacggtggacttggagatgtagaactagctaatcttcttcaggataaaggactggatccaaatttttcctacatgctgaaagacaaagtcatggatccacggattttagctttgctacagaggagcagcttggatgcagatagagagcatcaagatgatgtagatgtcacagctactgattcagatagattggataccactattgcaaaccagatctctttgtcagaagaactaaggagaagcggtctagaaaaatggttgaacatttcaaggctaatattccatcatttagctggatctccaatacgtgcttttattgttttcacagtaatgttcataatagagactactactgtggctatatatcgaccagagaccatcaaagtgataaatgcaacacatgaacagtttgaatttggtttctcgatactgcttctgtcaccagttgtctgctccattatggcattcatttggtctctgcgtgctgaagaaatgatgatgacatccaagccccggaagtatggtttcatcgcatggctactgagcacatgtgttggtttgtttctctctttcttaagcaagtcatcagttatattgggcttgtctctcacagtaccacttatggtggcttgcctctcatttgctgttcccatatggatgcgtaatggttaccgtttctggattcctggaagggagtttgataatcgtgaaaatgttagtcaagctccaggaaagaaagagcgggctctctttgttatcagcatagctgttttcactgcatcagttattggccttggcgcgatagtgtcagcaaagcctttagacgctttaggctataaagggtgggatgctgataagaacagcttctattctccctatgcaacatcgatgtatcttggatgggcgttgtcttcaacaattgctgtgattaccacggggttgatacctattgttgcttggtttgcaacgtaccggttttcaccttcatcagctatatgtgttggcctctttgcaactgttcttgtgtccttctgcggtgcatcctactggggagtggttaattcacgagaggatggtgtgcctctaaaggctgatttcctggcagcattacttcccttgctttgcattcctgcatttttctcgctgttcaccgggctgtacaaatggaaggatgatgattggaagatttctcgtggcgtttacctttttgttggcatgggaatgttgctgttgtttggtgcagttgcagctgttattgtcacaatcaggccctggactgttggagttgcttgcctcgtagccattctgttccttgtatttgttattggggtcatccactactggacatctaacaacttctatctaacgaggactcagatgctgcttgtttgttccattgcttttctcctagccttggctgccttcctgatgggtttatttcacggaaagccttttgttggagcatctataggttatttctcatttatatttcttctcactggaagggctttgactgtccttctatcaccgccaatcgtagtgtattcgccaagagtattgcctgtatacgtttatgatgctcatgcagactctgctaaaaatgttagctatgcctttcttattctgtacgggattgcattagcaactgaagtttggggtgttattgctagtctaataatgaatccaccatttgttggggctggcgtttctgctactactcttgtaattgctttcagttttgctgtttctcgaccatgcctgactcttaagatgatggaggatgcagttcattttctaagcaaggatacagttgtgcaagcgatgtcacggtctgctaataaaactagaaatgctatatctgggacttactcagcgcctcagaggtctgcaagctctgctgctcttttggttggagatcctgctcttacattggacagggctgggaactttgtgcttcctagggctgatgttatgaagctgagagatcgtttgagaaatgaagaaattgctgcaggatctttcttatgtggagtaaaagattgtttagtattttgcccccagtccctgtcaaacgtagattatcggaggaatatgtgtgcccatgcacgtattttggctttggaagaagcaattgatacggaatgggtgtatatgtgggacaaatttggtggttatttacttctgttgcttggattgactgccaaagctgaacaaatacaggatgaagtacgtctaagactctttttggatagcataggcctttccgatttgagtgccaaagaaattaagaaatggatgcccgaagatcggaggcaatttgagcttattcaagaaagttacataagggaaaaagaaatggaagaggaggctttgatgcaaaggcgagaggaagaaggaaagggaagagaaaggaggagggcattactggagagagaggaacgaaaatggaaggagctcgaaatatcattgctttcttccattcctaatactggaagcagggatgctgcagctatggcagcagctgtccgagctgttggaggtgaatctgctctggaagattcttttgcaagagatagggtctcttcaatagccaatcacatacgaaaggcacaattggctcggcgagcagaacagactggtattccaggcactgtatgcatacttgatgatgaaccaaggagtactggtcgtcattgtggagaacttgacttgtgcctctgtcaaagtcaaaaggttactttgtctattgctgtcatggttcaacctgtatctggtccagtgtgtctttttggaagtgaattccaaaagaaggtttgctgggaaatcttagtggcaggatcagaacagggaatggaagctggacaggttggtcttcgattagtgactaagggtgaaaggatgactactgttgctaaagagtggaacattggtgcgtctagtattgcagatggcaggtggcatcttgtcactgtaactttagatgccgacctaggtgaagcaacttctttcattgatggagtttatgatggatatcagaatgggttgccgttgccaacagagaacggtatttgggaacctgggactgatatttgggttggtgctaggccacccaccgacttagatgcctttggtaggtcagatagtgaaggttctgactcaaagatgcagatcatggatgcttttctatggggaagatgtctcagtgaagatgaggttactgtgttacatactgccatgtctcctgctgagtatggattttttgaccttgcacccggcgatgcttggcatggaagttattctgcaagggtggatgactgggaaagtgaagatgcttatgaggtttatgatcaaggggatgtcgaatgggatggacagtactcaagtggtaggaaacgtccagtacatgattctgtagctattgacattgactccttcgctaggagaccaagaaaaccaaggtttgagacacgtgatgaagtcaaccagcgtatgctttctgttgaaagggctgtcagggatgctcttgttgcgaaaggagagagaaacttcactgatcaagagttccctccagaggatcgttctttatttgtagatccaatgaatccacccctgaaactgcaggttgtttctgagtggatgaggccttctgacatagcaaaggagatatccatcagttctcagccttgcttgttttcgggttctgtgaattcctcagatgtgtgtcagggtcggttgggagactgttggttcctaagtgcagtcgcagttttaactgagatgtctcgtatatcagaagttataatcactcctgagtacaacgatgaagggatttacactgtcagattctgcattcagggtgagtgggtagccgtggttgttgatgattggatcccgtgcgagtctccggggaaaccagcattcgctactagtagaaagcaaaatgagctttgggtatccattcttgagaaggcttatgcgaaacttcatggctcttatgaggcattggaaggtgggcttgttcaagatgctctagtggatctcacaggtggggctggtgaagagattgatatgcgaagtcctcaagcacaacttgatctggctagtggaagattgtggtcccagttgttgcatttcaaacaagaaggttttcttcttggtgctggaagtccttctggatctgatgctcacatctcatcaagtggcattgttcagggacatgcatactcaattttgcaggtaagagaagttgatggccacaaactcatccaaatcagaaatccatgggcaaatgaagttgaatggaatggaccatggtcagactcttcaccagagtggaccgaacgaatgaagcataagctcatgcatgttccacagtcgaagaatggggtattctggatgtcttggcaagattttcagattcactttcggtcaatatatgtttgtcgtgtttatccaccagagatgcgttattctgtccatgggcaatggcgtggctacaatgcaggtggttgccaagattacgactcatggcatcaaaatccacagtatcgacttagagtaacaggacgtgatgcactataccctgttcatgtttttattacccttactcagggtgttggtttctctagaaagacgaatggtttccgtaactaccaatctagtcatgattcttcaatgttttacattggaatgaggatactcaagacacagggctgccgtgctgcttacaatatctacatgcatgaatcagctggtggaacagattatgttaactcgagagagatatcatgtgaactggtcttggatccttaccccaaagggtacacgattgtgccaactaccatccatcctggggaggaagcaccttttgtcttgtcagttttttcaaaagcatcaatcaaactagaggctgtttaa

SEQ ID NO: 2436 - protein, 2153 aa, Sorghum bicolor
  misc_feature: Ceres ANNOT ID no. 6024491
  misc_feature (1698)..(1999): Pfam Id: Peptidase_C2 Pfam Desc: Calpain family cysteine protease
  misc_feature (2004)..(2151): Pfam Id: Calpain_III Pfam Desc: Calpain large subunit, domain III
  misc_feature (1)..(2153): NCBI GI: 20268666 NCBI Desc: calpain-like protein [zea mays]
  misc_feature (1)..(2153): NCBI GI: 20268664 NCBI Desc: calpain-like protein [zea mays]
  misc_feature (1)..(2153): NCBI GI: 20268668 NCBI Desc: dek1-calpain-like protein [oryza sativa]
  misc_feature (1)..(2153): NCBI GI: 41052847 NCBI Desc: dek1-calpain-like protein [oryza sativa (japonica cultivar-group)]
  misc_feature (4)..(2153): NCBI GI: 38490651 NCBI Desc: phytocalpain [nicotiana benthamiana]
  misc_feature: The sequence is a functional homolog of SEQ ID NO 24 in US patent 7189889
MEEEGHHGVVLACSICGFLFAVLSPLSFWVLWAVNWRPWRLYSWIYARKWPTYVQGPQLSTLCSLLTLFAWLVVISPIAVLLVWGSILIALLERNIIGLAVIMAGVALLLSFYSIMLWWRTQWQSSKAVAYLLLLAVFLLCAYDFCAIYVTASASASELNSPSGFFFGVSAISLAINMLFICKILFNVSGFDVDEYVRRSYKFAYSDCVEVAPVSCSPEPPDPSELYMTKSSRVLHLGLLYISSLLVLVAYSILYGLTSKEARWLGALTSVAVVILDWNLGLCSFRFELLKSRMIVLFVAGTSRAFLISFGVHYCYAFVASVLLSAAVSSWLSISNPSVARIDALRSTVIKLREGFRRKGQNSSSNSSEGCGSSVKRSSGSVEAVQNGNATDSMYRSNSQSDGVNWNSIPFDRSNSCQEGRSSDKNIDSARASLAHRSNSCLSAVQDSETAVVSIDRHGDPTTSLVCSSSGLESHGCEPSGSATTSGNQQLLDLNLAAIFQDRLNDPRISSMLKKNGGLGDVELANLLQDKGLDPNFSYMLKDKVMDPRILALLQRSSLDADREHQDDVDVTATDSDRLDTTIANQISLSEELRRSGLEKWLNISRLIFHHLAGSPIRAFIVFTVMFIIETTTVAIYRPETIKVINATHEQFEFGFSILLLSPVVCSIMAFIWSLRAEEMMMTSKPRKYGFIAWLLSTCVGLFLSFLSKSSVILGLSLTVPLMVACLSFAVPIWMRNGYRFWIPGREFDNRENVSQAPGKKERALFVISIAVFTASVIGLGAIVSAKPLDALGYKGWDADKNSFYSPYATSMYLGWALSSTIAVITTGLIPIVAWFATYRFSPSSAICVGLFATVLVSFCGASYWGVVNSREDGVPLKADFLAALLPLLCIPAFFSLFTGLYKWKDDDWKISRGVYLFVGMGMLLLFGAVAAVIVTIRPWTVGVACLVAILFLVFVIGVIHYWTSNNFYLTRTQMLLVCSIAFLLALAAFLMGLFHGKPFVGASIGYFSFIFLLTGRALTVLLSPPIVVYSPRVLPVYVYDAHADSAKNVSYAFLILYGIALATEVWGVIASLIMNPPFVGAGVSATTLVIAFSFAVSRPCLTLKMMEDAVHFLSKDTVVQAMSRSANKTRNAISGTYSAPQRSASSAALLVGDPALTLDRAGNFVLPRADVMKLRDRLRNEEIAAGSFLCGVKDCLVFCPQSLSNVDYRRNMCAHARILALEEAIDTEWVYMWDKFGGYLLLLLGLTAKAEQIQDEVRLRLFLDSIGLSDLSAKEIKKWMPEDRRQFELIQESYIREKEMEEEALMQRREEEGKGRERRRALLEREERKWKELEISLLSSIPNTGSRDAAAMAAAVRAVGGESALEDSFARDRVSSIANHIRKAQLARRAEQTGIPGTVCILDDEPRSTGRHCGELDLCLCQSQKVTLSIAVMVQPVSGPVCLFGSEFQKKVCWEILVAGSEQGMEAGQVGLRLVTKGERMTTVAKEWNIGASSIADGRWHLVTVTLDADLGEATSFIDGVYDGYQNGLPLPTENGIWEPGTDIWVGARPPTDLDAFGRSDSEGSDSKMQIMDAFLWGRCLSEDEVTVLHTAMSPAEYGFFDLAPGDAWHGSYSARVDDWESEDAYEVYDQGDVEWDGQYSSGRKRPVHDSVAIDIDSFARRPRKPRFETRDEVNQRMLSVERAVRDALVAKGERNFTDQEFPPEDRSLFVDPMNPPLKLQVVSEWMRPSDIAKEISISSQPCLFSGSVNSSDVCQGRLGDCWFLSAVAVLTEMSRISEVIITPEYNDEGIYTVRFCIQGEWVAVVVDDWIPCESPGKPAFATSRKQNELWVSILEKAYAKLHGSYEALEGGLVQDALVDLTGGAGEEIDMRSPQAQLDLASGRLWSQLLHFKQEGFLLGAGSPSGSDAHISSSGIVQGHAYSILQVREVDGHKLIQIRNPWANEVEWNGPWSDSSPEWTERMKHKLMHVPQSKNGVFWMSWQDFQIHFRSIYVCRVYPPEMRYSVHGQWRGYNAGGCQDYDSWHQNPQYRLRVTGRDALYPVHVFITLTQGVGFSRKTNGFRNYQSSHDSSMFYIGMRILKTQGCRAAYNIYMHESAGGTDYVNSREISCELVLDPYPKGYTIVPTTIHPGEEAPFVLSVFSKASIKLEAV

SEQ ID NO: 2437 - DNA, 1902 bp, Sorghum bicolor
  misc_feature: Ceres ANNOT ID no. 6024515
  misc_feature: Encodes the peptide sequence at SEQ ID NO 2438
  misc_feature: Down-regulated in shoot tissues in response to aminocyclopropane carboxylic treatment
  misc_feature: Down-regulated in shoot tissues in response to salicylic acid treatment
atggcgcccgttgcggctccgatacgcgacctgctcacctccttcagccccagcgcggacttcctcgcgctctcttctggggacggccgcatcaaggtatgggacgccgtgcggggccggctgcaaaccgagtttgccgacatcccggcagtggaggcgggcgcggtcccggtcgctgagtcgaagcgcggccacctcgccctcgattacacctgcatgaagtgggtacagctttccagcaagaagaagaggaaggctgggagctcactgattgtgcttggtacaggcagtggggatgtgctggcacttgatgtcgctgcgggcaattggaagtggaaggtcagcgattgccaccctgggggcgtgacggctgtagcgtactcaaaacatgggcggagtgtgtacacggcaggcgctgatggcatggtctgtaggattgatgcctctgatggggctgttgttgggaaatttaaatcttcttcaaaggcaatatctgcattagctgtgtcatcagatggaaatgtgttagcaacagcagctggccagttgaggacttttgacacttccagcaacaaaaagattaaaaaattctctggacatccagttgctgtgaggagcatggtttttagcaatgatagccagtatgttttgtcatctggagttggggaacgctatattgccatttggaagctgggcagtgggaaaacccagagctcaaactgtatcctgtcgatggagcacccagcaatatttgtggactgtaaatgttcagacgaaggagaaacacacattttggctatttctgagattggtgtctgctatttctggtctgcaaatgatgtggatgacctgcgtaataagaagccgaccaagatcatattgtctgagtcatctgttccaacagttcatcaggcattctcgatttttgccgcaaaacttcaaggagtggatggacctaattctgcccatgtactactggcttatgggtctgtagtgaaaccatcttttgataaacttttggtttgttatggtacggatattaatttgggcatttctcaagatggagttctcttgccaaatactcaaaccaccatgacaaagaaagtccaatctgtgaaaaagcaagaaattataactgctctagaccgagccaatgctgaagatgctatccttcctcttccaaagctccatacacaggaaaagaaaaggaaacatggtgtaacaaaacccagtgatgaggtggagcctgagattcatagtgacctcaccactacaagatctattcataaaagagttcctgtgcaaagaatcgaagatgacagcatatgcatcgaggatatgatgagggagtgtggtatcattgacactagattagatgagagcatgaagggccatcctggcattccctctgatattttgtccgatctgtttgatgatggcagcataaaatttgatgctaatttacctagcaagaagatccgaggtcatctaagatcattgaaacctggagatgcttgcaaacttcttgagaatttagtatctgcatggataataagatctggtagcacagaagttgtattgcgctggatatactgcctgttagtcattcatggccgttttattccctctgagaaaacaacaaaagtaattagcaacctgcacaagatgtgtgcagaaagatacaaagctactgaagatttgctgaagctttctggccggcttcgattaataacggctcaggtcgacaaggctgctagtagcatgtctgagccgacatcagaggagatgcaggatgctgctttccagtctgacgaagacgaggatgaagacgttgatgaaacagtgtttggtcaagattcacaaaatagcgatgacgacgacgatcatgatgatgctaagtag

SEQ ID NO: 2438 - protein, 633 aa, Sorghum bicolor
  misc_feature: Ceres ANNOT ID no. 6024515
  misc_feature (493)..(578): Pfam Id: NUC189 Pfam Desc: NUC189 domain
  misc_feature (8)..(432): NCBI GI: 30683535 NCBI Desc: transducin family protein / wd-40 repeat family protein [arabidopsis thaliana]
  misc_feature (14)..(426): NCBI GI: 27882005 NCBI Desc: loc398447 protein [xenopus laevis]
  misc_feature (14)..(426): NCBI GI: 50927202 NCBI Desc: loc398447 protein [xenopus laevis]
  misc_feature (1)..(631): NCBI GI: 119620927 NCBI Desc: hcg16536, isoform cra_a [homo sapiens]
  misc_feature (1)..(631): NCBI GI: 452523 NCBI Desc: kiaa0007 [homo sapiens]
  misc_feature: Down-regulated in shoot tissues in response to aminocyclopropane carboxylic treatment
  misc_feature: Down-regulated in shoot tissues in response to salicylic acid treatment
  misc_feature: The sequence is a functional homolog of SEQ ID NO. 502 in the 11/188,298 US application
MAPVAAPIRDLLTSFSPSADFLALSSGDGRIKVWDAVRGRLQTEFADIPAVEAGAVPVAESKRGHLALDYTCMKWVQLSSKKKRKAGSSLIVLGTGSGDVLALDVAAGNWKWKVSDCHPGGVTAVAYSKHGRSVYTAGADGMVCRIDASDGAVVGKFKSSSKAISALAVSSDGNVLATAAGQLRTFDTSSNKKIKKFSGHPVAVRSMVFSNDSQYVLSSGVGERYIAIWKLGSGKTQSSNCILSMEHPAIFVDCKCSDEGETHILAISEIGVCYFWSANDVDDLRNKKPTKIILSESSVPTVHQAFSIFAAKLQGVDGPNSAHVLLAYGSVVKPSFDKLLVCYGTDINLGISQDGVLLPNTQTTMTKKVQSVKKQEIITALDRANAEDAILPLPKLHTQEKKRKHGVTKPSDEVEPEIHSDLTTTRSIHKRVPVQRIEDDSICIEDMMRECGIIDTRLDESMKGHPGIPSDILSDLFDDGSIKFDANLPSKKIRGHLRSLKPGDACKLLENLVSAWIIRSGSTEVVLRWIYCLLVIHGRFIPSEKTTKVISNLHKMCAERYKATEDLLKLSGRLRLITAQVDKAASSMSEPTSEEMQDAAFQSDEDEDEDVDETVFGQDSQNSDDDDDHDDAK

SEQ ID NO: 2439 - DNA, 1389 bp, Sorghum bicolor
  misc_feature: Ceres ANNOT ID no. 6024518
  misc_feature: Encodes the peptide sequence at SEQ ID NO 2440
atggcagcagcccctgccggtgcccccgcaatcaccgcctcatcctcctttcttgcttcgccgccgttcgctctcaaggcatcgacgactagccaccgccgacctgcggggagagtctccgtcaacatccgctgcgtcagtagcccgccggccgtcgacacatcttacaagactaatgtcccgcgcaatgctaacatggccaagctccaagcaggatatctgtttcctgagattgccaggagaagagcagctcatttgctgaagtatccagatgccaagataataagccttgggataggtgacactaccgagcccattccaaatgtcataacaaatgccatggcagagagagcacttgccttgtcaacaattgatggctacagcggttatggagccgagcaaggtgaaaagaaactcagagcagcaattgctgcaacctactatgcggaccttggtattgaagattcagatatttttgtctctgatggtgccaagtgtgacatatctcgcttgcaggtcctttttggatctaatgtgacaattgcggtccaagatccctcataccctgcatatgttgattcaagtgttatcatgggccaaactgacttatatcagcaagatgttcagaagtacggaaacattcaatacatgagatgcagtccagaaaatggatttttccctgatctgtcaactatccctcggacagatattattttcttttgttcacccaacaatcctactggtgctgctgcatctcgggaccaactgaccaaattagtaaaatttgcaaaggacaatgggtccatcattgtctatgattctgcttatgcaatgtacatatcagatgacagcccaaagtctatctttgaaattcctggagcaaaggaggttgctcttgagacagcgtcattctcgaaatatgctgggttcactggtgtccgtctaggttggactgttgtccccaaggagctccttttctctgatggacatccagttgctaaagatttcaatcgcatagtctgcacttgcttcaatggtgcatcaaacatttcacaagctggtggtttagcttgcctctctccagagggtctgaaggctatgcatgatgttgttggcttctacaaggagaacactgaaataattgttgacacatttacatcacttggattcaacgtgtatggtgcgaagaacgctccttacgtatgggtgcacttccctggccgcaattcgtgggacgtgtttgctgagatcctggagaaggcgaatgtggttactactcctggcagtggatttggaccgggtggcgaaggctttgtgagggtcagcgcattcggacacagagataacatcattgaagctgcaaggagattaaagcagctgtacaagtga

SEQ ID NO: 2440 - protein, 462 aa, Sorghum bicolor
  misc_feature: Ceres ANNOT ID no. 6024518
  misc_feature (92)..(457): Pfam Id: Aminotran_1_2 Pfam Desc: Aminotransferase class I and II
  misc_feature (12)..(462): NCBI GI: 92882071 NCBI Desc: aminotransferases class-i pyridoxal-phosphate-binding site [medicago truncatula]
  misc_feature (36)..(462): NCBI GI: 146270973 NCBI Desc: ll-diaminopimelate aminotransferase [synthetic construct]
  misc_feature (63)..(460): NCBI GI: 45658671 NCBI Desc: aspartate aminotransferase [leptospira interrogans serovar copenhageni str. fiocruz l1-130]
  misc_feature (63)..(460): NCBI GI: 24213476 NCBI Desc: aminotransferase [leptospira interrogans serovar lai str. 56601]
  misc_feature (63)..(462): NCBI GI: 67924273 NCBI Desc: aminotransferase, class i and ii [crocosphaera watsonii wh 8501]
  misc_feature: Useful for making plants with modulated nitrogen use efficiency
  misc_feature: GREAT-hit functional homolog of the protein sequence given in SEQ ID NO 13353
  misc_feature: Useful for making plants with modulated nitrogen use efficiency
  misc_feature: Functional homolog of the protein sequence given in SEQ ID NO 13353
  misc_feature: The sequence is a functional homolog of SEQ ID NO. 526 in the 11/188,298 US application
  misc_feature: The sequence is a functional homolog of SEQ ID NO. 286 in the 11/188,298 US application
  misc_feature: The sequence is a functional homolog of SEQ ID NO. 527 in the 11/188,298 US application
MAAAPAGAPAITASSSFLASPPFALKASTTSHRRPAGRVSVNIRCVSSPPAVDTSYKTNVPRNANMAKLQAGYLFPEIARRRAAHLLKYPDAKIISLGIGDTTEPIPNVITNAMAERALALSTIDGYSGYGAEQGEKKLRAAIAATYYADLGIEDSDIFVSDGAKCDISRLQVLFGSNVTIAVQDPSYPAYVDSSVIMGQTDLYQQDVQKYGNIQYMRCSPENGFFPDLSTIPRTDIIFFCSPNNPTGAAASRDQLTKLVKFAKDNGSIIVYDSAYAMYISDDSPKSIFEIPGAKEVALETASFSKYAGFTGVRLGWTVVPKELLFSDGHPVAKDFNRIVCTCFNGASNISQAGGLACLSPEGLKAMHDVVGFYKENTEIIVDTFTSLGFNVYGAKNAPYVWVHFPGRNSWDVFAEILEKANVVTTPGSGFGPGGEGFVRVSAFGHRDNIIEAARRLKQLYK

SEQ ID NO: 2441 - DNA, 1365 bp, Sorghum bicolor
  misc_feature: Ceres ANNOT ID no. 6024531
  misc_feature: Encodes the peptide sequence at SEQ ID NO 2442
atggcactgcaaaacattggtgcttcaaacagggatgatgccttctacaggtacaagatgcccagaatgatcaccaagatagaaggtcgtggtaatggtatcaagacaaatgttgtgaacatggttgacatagcaaaagcacttgccaggccagcttcctacacaaccaagtactttggatgtgagcttggtgcacagtccaaatttgatgagaagacagggatttccttggttaatggggctcatgatactgcaaagctggctggtctccttgaggtattcatcaagaagtatgtccagtgttatggatgtgggaatcctgagactgagattctcatctcaaagacacagatgatatcactgaaatgtgcagcctgtgggtttgtctcagatgttgacatgagggacaagctcacaaccttcatcctgaaaaacccaccagaacagaagaagggaggaaaagacaagaaggccatgaggagagctgagaaggaacgcctgaaggaaggtgaggctgctgatgaggagcagaagaaactgaagaaggatgcaaagaagaagggtggtgcatcttccaaggagtccactgccaagggttcgaagaagaaggctactgctgctggctctgatgaggaccactcaacctctccaactcgcagtcgtgatggtgaccatgcagctgcagatgaggaagaggatgatgatgatgtccagtggcagactgacacttctatcgaggctgcgaagcagcgcatgcaggagcagcttagtgcagcaactgctgaaatggtgatgctgtccactgaggagactgagaagaagaagaaacaggcaacccacaaagatggcactgctaatggttcagcaaaagaaatacctgatgagaaacctgctgtcgctaagcctagtccctatgaagaactggttggagacatcaaggctagcctgggaagtgctcctacccctacccagctcaaggctgtgctggcctcctcaacccttcctccccaggatgtgatgaatgctctcctcgaggctctctttgatggtgtaggcaagggattcgcgaaggaggttgtgaagaacaagaagtaccttacagttgctgtgccagatgagggtgcccagaccctgctggttcaggccattgaggcttttggtggcaagtgcaaccctgaggcactgaaggaggtaccagttgtcctgaaagccctgtacgatggagatatcctggaggaagaaaccatcgtggactggtacaatgctgctgttgcagctggaaaggactcccaggtcatcaagaacgccaagcccttcgttgagtggctgcagagcgcggagtctgaggaagaggacgatgagtga

SEQ ID NO: 2442 - protein, 454 aa, Sorghum bicolor
  misc_feature: Ceres ANNOT ID no. 6024531
  misc_feature (1)..(131): Pfam Id: eIF-5_eIF-2B Pfam Desc: Domain found in IF2B/IF5
  misc_feature (373)..(454): Pfam Id: W2 Pfam Desc: eIF4-gamma/eIF5/eIF2-epsilon
  misc_feature (1)..(454): NCBI GI: 4160402 NCBI Desc: eukaryotic translation initiation factor 5 [zea mays]
  misc_feature (1)..(454): NCBI GI: 1806575 NCBI Desc: eukaryotic initiation factor-5 [zea mays]
  misc_feature (1)..(451): NCBI GI: 126513560 NCBI Desc: translation initiation factor eif5 [triticum aestivum]
  misc_feature (63)..(453): NCBI GI: 42733476 NCBI Desc: bri1-kd interacting protein 107 [oryza sativa (japonica cultivar-group)]
  misc_feature (1)..(453): NCBI GI: 92897431 NCBI Desc: translation initiation factor if5; eif4-gamma/eif5/eif2-epsilon [medicago truncatula]
MALQNIGASNRDDAFYRYKMPRMITKIEGRGNGIKTNVVNMVDIAKALARPASYTTKYFGCELGAQSKFDEKTGISLVNGAHDTAKLAGLLEVFIKKYVQCYGCGNPETEILISKTQMISLKCAACGFVSDVDMRDKLTTFILKNPPEQKKGGKDKKAMRRAEKERLKEGEAADEEQKKLKKDAKKKGGASSKESTAKGSKKKATAAGSDEDHSTSPTRSRDGDHAAADEEEDDDDVQWQTDTSIEAAKQRMQEQLSAATAEMVMLSTEETEKKKKQATHKDGTANGSAKEIPDEKPAVAKPSPYEELVGDIKASLGSAPTPTQLKAVLASSTLPPQDVMNALLEALFDGVGKGFAKEVVKNKKYLTVAVPDEGAQTLLVQAIEAFGGKCNPEALKEVPVVLKALYDGDILEEETIVDWYNAAVAAGKDSQVIKNAKPFVEWLQSAESEEEDDE

SEQ ID NO: 2443 - DNA, 513 bp, Sorghum bicolor
  misc_feature: Ceres ANNOT ID no. 6024532
  misc_feature: Encodes the peptide sequence at SEQ ID NO 2444
atgggcaagcgcctacctgccgccgccgccgccgccgccgcggttcgttcttacgcccgcagcattcgcgtcccatccgataccgccgccgcctcatccgccgggagggcagccaagacgccggcggccccgctggatacgcccaggaaatccgctgccgccgccgccgcggccagctccgggcgggccgaggtgcgggatttggcggcggcgtgcgggctagaggcggacgagagggtgcctctcgcggaggtggtgtcagactgcacgaggcggtggttccaggacgcactcaaggaggcgcgcgccggcgacatcaccatgcaggtgctcgtcggccagatgtaccgcagcggatacggtgtcaacaagaacgagcacaaggcaagagtttggatggaaaaagcatcaagatatcggtctacagtctggaaagttagcaataaacgtccagggtacaatgctagtgactcagactcaggctcagatgatgctaaggaaacatgcaaataa

SEQ ID NO: 2444 - protein, 170 aa, Sorghum bicolor
  misc_feature: Ceres ANNOT ID no. 6024532
  misc_feature (80)..(163): NCBI GI: 145360752 NCBI Desc: binding [arabidopsis thaliana]
  misc_feature (77)..(168): NCBI GI: 92877975 NCBI Desc: sel1-like repeat [medicago truncatula]
  misc_feature (2)..(137): NCBI GI: 118052425 NCBI Desc: sel1-like repeat [comamonas testosteroni kf-1]
MGKRLPAAAAAAAAVRSYARSIRVPSDTAAASSAGRAAKTPAAPLDTPRKSAAAAAAASSGRAEVRDLAAACGLEADERVPLAEVVSDCTRRWFQDALKEARAGDITMQVLVGQMYRSGYGVNKNEHKARVWMEKASRYRSTVWKVSNKRPGYNASDSDSGSDDAKETCK

SEQ ID NO: 2445 - DNA, 1167 bp, Sorghum bicolor
  misc_feature: Ceres ANNOT ID no. 6024544
  misc_feature: Encodes the peptide sequence at SEQ ID NO 2446
atgctcttcgccccctcgcgcctaccgcctcgcagcctccgcctcgctccgggctccccaatggcctccacgctcgccatcctcaggccctccgcgccggccccgctcgcgggccgccgggcgcgggctgccgcgccggcgaccgcgagggtggcgctgtcgtccagatctaggtattcgtcggccagggtgtcgctcggctccgaggttgcagtgggcgccgacgcgctcttcgccgactataagcccaccaccgctttcctcttccccggccagggtgcccaaaccgttggaatgggggcagaagctcagagtgttccagcagctaccaaattgttcaaccaggcaaatgaaatccttggatatgacttgctggatctttgcaccaatgggccaaaagaaaagctggattcaacagtgatcagtcagccggctatatatgttaccagccttgcagcagtagaggtactacgtgcacgcgatggaggccaagatgtgattaactctgtagatgttacatgtggtctcagtttgggagaatataccgctcttgcatttgctggtgcttttagctttgaggacggactgaagcttgtgaagctaagaggagaagctatgcaggatgcttcagatgctgccaatagtgcaatggttagtgtgattggtctggattcagaaaaggtgcaagaactatgtgatgctgctaatgaggaagtagatgacagtgaaagagttcagatagcaaactttctgtgccctgggaattatgcagtttctggtggtgtaaaaggtattgaagtagttgaagccaaagcaaagtccttcaaggccagaatgacggttcgcctagctgttgctggtgctttccatactagcttcatgcaaccagctgtttcaagattggaatctgcgttggctgccactgagataagaacacctagaatcccagtcatctccaatgttgatgcgcagccccactcagatcctgacaccatcaagcagattttagcgcggcaggtaacctctccggtgcagtgggaaaccactgttaagactcttatgggcaaggggcttgagaaaagttatgaactcggaccaggaaaggttatagcaggtattctcaagagaatcaacaaaggcgctagcattgagaacatcggggcttga

SEQ ID NO: 2446 - protein, 388 aa, Sorghum bicolor
  misc_feature: Ceres ANNOT ID no. 6024544
  misc_feature (86)..(388): Pfam Id: Acyl_transf_1 Pfam Desc: Acyl transferase domain
  misc_feature (53)..(388): NCBI GI: 82618886 NCBI Desc: malonyltransferase [glycine max]
  misc_feature (21)..(388): NCBI GI: 12003283 NCBI Desc: malonyl-coa:acp transacylase [perilla frutescens]
  misc_feature (55)..(386): NCBI GI: 5139348 NCBI Desc: [acyl-carrier protein] s-malonyltransferase [brassica napus]
  misc_feature (1)..(340): NCBI GI: 79602384 NCBI Desc: transferase [arabidopsis thaliana]
  misc_feature (94)..(361): NCBI GI: 32423794 NCBI Desc: malonyl-coa:acp transacylase [phaeodactylum tricornutum]
MLFAPSRLPPRSLRLAPGSPMASTLAILRPSAPAPLAGRRARAAAPATARVALSSRSRYSSARVSLGSEVAVGADALFADYKPTTAFLFPGQGAQTVGMGAEAQSVPAATKLFNQANEILGYDLLDLCTNGPKEKLDSTVISQPAIYVTSLAAVEVLRARDGGQDVINSVDVTCGLSLGEYTALAFAGAFSFEDGLKLVKLRGEAMQDASDAANSAMVSVIGLDSEKVQELCDAANEEVDDSERVQIANFLCPGNYAVSGGVKGIEVVEAKAKSFKARMTVRLAVAGAFHTSFMQPAVSRLESALAATEIRTPRIPVISNVDAQPHSDPDTIKQILARQVTSPVQWETTVKTLMGKGLEKSYELGPGKVIAGILKRINKGASIENIGA

SEQ ID NO: 2447 - DNA, 513 bp, Sorghum bicolor
  misc_feature: Ceres ANNOT ID no. 6024553
  misc_feature: Encodes the peptide sequence at SEQ ID NO 2448
atggcttcccctgatccatcggcggcaggcgccggcgccgggggcgagtcgacgagccaggcggcggccgtggagccgatccggatgcccacggtggaggagatcaaggggcaggacatctggaacaactgcgccgtccgcagcgtcgtcagtggcgtcatgggaggcggtcttggtgtacttatgggactattctttggagctttggacaacccaataatggcagaggagatgacagcaaggcagcaaatagtatacacagcaaagcagatgggtaggagaagtataagtaatgccaaaacctttgcagtcatgggtctgattttctcagcagctgaatgtaccatagagaaggttcgggcaaagcatgacactaccaatacagcagtagctggctgtgtcactggaggagctttagctgtaaaaggtggcccaaaagctacatgcattggatgtgcagggtttgctgcgttctcagtggcaattgagaagttctttgaccggcatacttga

SEQ ID NO: 2448 - protein, 170 aa, Sorghum bicolor
  misc_feature: Ceres ANNOT ID no. 6024553
  misc_feature (37)..(169): Pfam Id: Tim17 Pfam Desc: Tim17/Tim22/Tim23 family
  misc_feature (1)..(170): NCBI GI: 115452455 NCBI Desc: os03g0296300 [oryza sativa (japonica cultivar-group)]
  misc_feature (2)..(170): NCBI GI: 18398755 NCBI Desc: mitochondrial import inner membrane translocase subunit tim17/tim22/tim23 family protein [arabidopsis thaliana]
  misc_feature (5)..(170): NCBI GI: 89213235 NCBI Desc: at3g10110 [arabidopsis thaliana]
  misc_feature (29)..(170): NCBI GI: 42562146 NCBI Desc: mitochondrial import inner membrane translocase subunit tim17/tim22/tim23 family protein [arabidopsis thaliana]
  misc_feature (8)..(169): NCBI GI: 145347059 NCBI Desc: mpt family transporter: inner membrane translocase (import) tim22 [ostreococcus lucimarinus cce9901]
MASPDPSAAGAGAGGESTSQAAAVEPIRMPTVEEIKGQDIWNNCAVRSVVSGVMGGGLGVLMGLFFGALDNPIMAEEMTARQQIVYTAKQMGRRSISNAKTFAVMGLIFSAAECTIEKVRAKHDTTNTAVAGCVTGGALAVKGGPKATCIGCAGFAAFSVAIEKFFDRHT

SEQ ID NO: 2449 - DNA, 756 bp, Sorghum bicolor
  misc_feature: Ceres ANNOT ID no. 6024558
  misc_feature: Encodes the peptide sequence at SEQ ID NO 2450
atggccacccgcctcgccatcgccgcgctcctcctgctcgcctccgcttcctccgccgcggccggcgaggaggggaccgagaaggtggccgtggcgctgtactacgagtcgctgtgcccctactcggcgcgcttcgtggtgaagcacctcgccaaggtcttcgtggacggcctcctcgaggtcgtggacctcacgctcgtcccctacggaaacgctcggatccacgccggcggagtgatctcctgccagcatggtccgtacgagtgccttctcaacaccgtggaagcctgcgccatcgacgcctggccggatttggatgtgcatttcagtttcatctactgcgtggaggacctggtggtgaagggaaagggccagtacaaggactggaagtcctgcttccagaagctgggcctcgaccccaaacctgtaacacaatgctacaacagcgaacttggccacaagcttgagctcaagtacgcgaaccagactaacgctctcgagcccccgcaccggtacgtcccctgggtggtcgtcgacgggcagcccctgctagaggattacgagaatttcgaggcttacatctgcaaggcctacaagggcactccaccgaaggcctgcgaggggctgggacgtctgcagatggtgctcgagacagcggaggcgcgcaacggcgtcagctacaactccggcatcagcaagcctgcaactgctgaagatgggggtagggagcgtaaggtgtggcggggagaattctaa

SEQ ID NO: 2450 - protein, 251 aa, Sorghum bicolor
  misc_feature: Ceres ANNOT ID no. 6024558
  misc_feature (29)..(140): Pfam Id: GILT Pfam Desc: Gamma interferon inducible lysosomal thiol reductase (GILT)
  misc_feature (20)..(210): NCBI GI: 30793446 NCBI Desc: 27k protein [triticum aestivum]
  misc_feature (10)..(206): NCBI GI: 15809756 NCBI Desc: at1g07080/f10k1_15 [arabidopsis thaliana]
  misc_feature (5)..(206): NCBI GI: 18413888 NCBI Desc: gamma interferon responsive lysosomal thiol reductase family protein / gilt family protein [arabidopsis thaliana]
  misc_feature (29)..(206): NCBI GI: 37572313 NCBI Desc: legumaturain [homo sapiens]
  misc_feature (29)..(206): NCBI GI: 62857489 NCBI Desc: ifi30 [xenopus tropicalis]
MATRLAIAALLLLASASSAAAGEEGTEKVAVALYYESLCPYSARFVVKHLAKVFVDGLLEVVDLTLVPYGNARIHAGGVISCQHGPYECLLNTVEACAIDAWPDLDVHFSFIYCVEDLVVKGKGQYKDWKSCFQKLGLDPKPVTQCYNSELGHKLELKYANQTNALEPPHRYVPWVVVDGQPLLEDYENFEAYICKAYKGTPPKACEGLGRLQMVLETAEARNGVSYNSGISKPATAEDGGRERKVWRGEF

SEQ ID NO: 2451 - DNA, 1977 bp, Sorghum bicolor
  misc_feature: Ceres ANNOT ID no. 6024567
  misc_feature: Encodes the peptide sequence at SEQ ID NO 2452
atggcgagctccggcggaatctccgaccagctcttcgtctccgtcaagttagagagcccgcgcctcgcggagctcgacctcgccccccacctcttcggctcccaccccgtggctggctcgtgggacccctgcaaggccctgccgttggagcgggcggctacctccgtgtgggagttcagctgcgtcgtgccttcgcagcacgaatcgctggatttcaagtttgttttgaagcgagaagatgatagttctcagtacattattgaggagggacctaaccgaccactcggttgccagagcaatgaatttgaaatgaggactgcagtgtttaaactcaatgaagggaaggaggtacttgagtgcaaggttcagattgagacagaaatgttatccccatttgacctggcagctagttggagggctcatcaggagtattttcagccttcaagggtgcgagggacccacgatgtcactatcaaccctgggttagaaggcagggccaagagtgcaattggagggcatgcgccatcactggaagaacaaagggcaatgtttgttgatagaggtgttggctcaccaaactttgcaagaccaacaaaggaaaccttttcgatgagcaactttaagttggattctgactcaaaggttgtacattattcacttcagcagggtatgccagcagcagaaggcgctgttgcagcagctgcagtagctgatcagatgtatgggccaaaagaggaccgcaagttggccatcgtgttggttgggctaccagctcgtggtaagacctttacagcagctaaacttacaagatatctcagatggttaggtcatgaaacaaagcacttcaatgttggaaagtaccgccggctcaagcatggaactaatcagactgctgatttctttcgtggagataacagggagggtgtggaggcacgcaacgaggtggctgcattagcaatggaagatatgctatcttggatgcaggaaggtggtcaggttggtattttcgatgccacaaacagcacaagaatacggagaaacatgctgatgaaaatggctgaaggaaaatgtaagatcatctttttggaaacattatgtaatgaccaagatgttcttgagagaaatatacgattgaaagttcaacaaagtcccgattatgcagagcaaacagattttgaagctggtgtacaagatttcaaagagcgattgacctactatgaaaaggtctatgaacctgtggaagaaggttcttacataaaaatgattgacatggttagtgggaagggaggccaaataaagattaatgacataagtggttacttgcctggacggattgttttcttcttggttaactgtcatctgacgcctcgtcctatcctgctaacaagacatggcgaaagtatggataatgtcagaggaagaattggtggagactcttctttgagtgaggttggtgagctttattcaagaaagcttgcaagctttgtggagaagcgactgaagtccgagcggactgcctctatatggactagcacactccagagaacaatattaacagcacatccgatcattggttttccaaagatacaatggcgtgctcttgacgagataaatgctggggtatgtgatgggatgacatacgatgaaataaagaaaagtaaacctgaagaatatgaatcacgaagaaaagacaagctgaggtatcgttatccaagaggagaatcctaccttgacgtcattcaaagattagaacctgtaataattgagcttgaacggcagcgtgctccagttgtagtcatagctcaccaggctgtgttaagagcactttatgcatattttgcggacaaaccactcgaggaagtcccaaatattgagatacctctgcatacaataattgagatacaaatgggtgttgctggtgttcaagaaaaacggtacaaactcatggacgcaattcatcccacagcggggttgtaa

SEQ ID NO: 2452 - protein, 658 aa, Sorghum bicolor
  misc_feature: Ceres ANNOT ID no. 6024567
  misc_feature (237)..(456): Pfam Id: 6PF2K Pfam Desc: 6-phosphofructo-2-kinase
  misc_feature (458)..(609): Pfam Id: PGAM Pfam Desc: Phosphoglycerate mutase family
  misc_feature (169)..(650): NCBI GI: 14149116 NCBI Desc: fructose-6-phosphate 2-kinase/fructose-2,6-bisphosphatase [bruguiera gymnorrhiza]
  misc_feature (130)..(650): NCBI GI: 8954036 NCBI Desc: identical to fructose-6-phosphate 2-kinase/fructose-2,6-bisphosphates from arabidopsis thaliana gbaf190739. it contains a 6-phosphofructo-2-kinase domain
  misc_feature (130)..(650): NCBI GI: 8954036 (continued) pf01591. ests gbaa597674 and gbai995873 come from this gene
  misc_feature (180)..(650): NCBI GI: 15222304 NCBI Desc: fructose-6-phosphate 2-kinase / fructose-2,6-bisphosphatase (f2kp) [arabidopsis thaliana]
  misc_feature (180)..(650): NCBI GI: 8572069 NCBI Desc: fructose-6-phosphate 2-kinase/fructose-2,6-bisphosphatase [arabidopsis thaliana]
  misc_feature (180)..(650): NCBI GI: 13096098 NCBI Desc: fructose-6-phosphate 2-kinase/fructose-2,6-bisphosphatase [arabidopsis thaliana]
MASSGGISDQLFVSVKLESPRLAELDLAPHLFGSHPVAGSWDPCKALPLERAATSVWEFSCVVPSQHESLDFKFVLKREDDSSQYIIEEGPNRPLGCQSNEFEMRTAVFKLNEGKEVLECKVQIETEMLSPFDLAASWRAHQEYFQPSRVRGTHDVTINPGLEGRAKSAIGGHAPSLEEQRAMFVDRGVGSPNFARPTKETFSMSNFKLDSDSKVVHYSLQQGMPAAEGAVAAAAVADQMYGPKEDRKLAIVLVGLPARGKTFTAAKLTRYLRWLGHETKHFNVGKYRRLKHGTNQTADFFRGDNREGVEARNEVAALAMEDMLSWMQEGGQVGIFDATNSTRIRRNMLMKMAEGKCKIIFLETLCNDQDVLERNIRLKVQQSPDYAEQTDFEAGVQDFKERLTYYEKVYEPVEEGSYIKMIDMVSGKGGQIKINDISGYLPGRIVFFLVNCHLTPRPILLTRHGESMDNVRGRIGGDSSLSEVGELYSRKLASFVEKRLKSERTASIWTSTLQRTILTAHPIIGFPKIQWRALDEINAGVCDGMTYDEIKKSKPEEYESRRKDKLRYRYPRGESYLDVIQRLEPVIIELERQRAPVVVIAHQAVLRALYAYFADKPLEEVPNIEIPLHTIIEIQMGVAGVQEKRYKLMDAIHPTAGL

SEQ ID NO: 2453 - DNA, 1002 bp, Sorghum bicolor
  misc_feature: Ceres ANNOT ID no. 6024579
  misc_feature: Encodes the peptide sequence at SEQ ID NO 2454
atggcctccacctcctcctcctcgcctcagccgccgccaccggcggcgtcgccaggggcggcttccccgtccgaggagcgccgcgcaggcggaggcggccggccaccggtcccgccctacgtcaaggcggcggcggggtccctgggcggcgttatggaggcgtgctgcctgcagcccatcgacgtcgtcaagacgaggctgcagctcgaccgcacgggggcgtaccgcggcatcgcgcactgcggcgccaccgtggcccgcgccgagggcgtgcgcgcgctctggaaggggctcacgcccttcgccacgcacctcacgctcaagtacgcgctccggctcggctccaacgccgtgctgcagtccgcgttcaaggaccccgacacgggcaaggtctccgcgcacggccgcctcgcctccggctttggcgccggcgtcatcgaggcgctcctcatcgttacccccttcgaggtggtaaagattagattgcaacaacaaaaagggctaagcccagacttgcttagatataaaggtcccatacactgcgcaagaactatagttcgagaggaaggcatatttggtctttggtctggagcattgccaactgtcatgcgcaatggcacaaatcaagcggcaatgttctcagccaagaacacatttgatattgttctatggaagaagcatgaaggggacgggaaggtgctcctgccatggcagtcaatgatctctgggttccttgcaggaacagcaggccctgtctgcacaggaccctttgatgtcgtgaagactaggttgatggctcaagggagaactggtgacatcaaatacaatggcatggtgcatgccatacgaacaatatattccgaagaggggttgcgagcactgtggaaaggcttgcttccccggctcatgaggattccacctggacaggctataatgtgggcagtggctgatcaggtgatgggcctctatgagcgaacttatctgcagccagttcatatttga

SEQ ID NO: 2454 - protein, 333 aa, Sorghum bicolor
  misc_feature: Ceres ANNOT ID no. 6024579
  misc_feature (38)..(127): Pfam Id: Mito_carr Pfam Desc: Mitochondrial carrier protein
  misc_feature (132)..(227): Pfam Id: Mito_carr Pfam Desc: Mitochondrial carrier protein
  misc_feature (235)..(327): Pfam Id: Mito_carr Pfam Desc: Mitochondrial carrier protein
  misc_feature (17)..(333): NCBI GI: 115452405 NCBI Desc: os03g0292200 [oryza sativa (japonica cultivar-group)]
  misc_feature (19)..(329): NCBI GI: 145349128 NCBI Desc: mc family transporter: succinate/fumarate [ostreococcus lucimarinus cce9901]
  misc_feature (39)..(319): NCBI GI: 44985484 NCBI Desc: agl311cp [eremothecium gossypii]
  misc_feature (39)..(319): NCBI GI: 45200786 NCBI Desc: agl311cp [eremothecium gossypii]
  misc_feature (27)..(326): NCBI GI: 115385705 NCBI Desc: succinate/fumarate mitochondrial transporter [aspergillus terreus nih2624]
  misc_feature: The sequence is a functional homolog of SEQ ID NO. 398 in the 11/188,298 US application
  misc_feature: The sequence is a functional homolog of SEQ ID NO. 385 in the 11/188,298 US application
  misc_feature: The sequence is a functional homolog of SEQ ID NO. 517 in the 11/188,298 US application
MASTSSSSPQPPPPAASPGAASPSEERRAGGGGRPPVPPYVKAAAGSLGGVMEACCLQPIDVVKTRLQLDRTGAYRGIAHCGATVARAEGVRALWKGLTPFATHLTLKYALRLGSNAVLQSAFKDPDTGKVSAHGRLASGFGAGVIEALLIVTPFEVVKIRLQQQKGLSPDLLRYKGPIHCARTIVREEGIFGLWSGALPTVMRNGTNQAAMFSAKNTFDIVLWKKHEGDGKVLLPWQSMISGFLAGTAGPVCTGPFDVVKTRLMAQGRTGDIKYNGMVHAIRTIYSEEGLRALWKGLLPRLMRIPPGQAIMWAVADQVMGLYERTYLQPVHI

SEQ ID NO: 2455 - DNA, 1773 bp, Sorghum bicolor
  misc_feature: Ceres ANNOT ID no. 6024586
  misc_feature: Encodes the peptide sequence at SEQ ID NO 2456
atgtgtggcatcctcgccgtgctcggatgttccgactggtctcaggccaggagggctcgcgtcctcgcctgcgccagaaggctgaagcacaggggccccgactggtccggcctctaccagcacgagggcaacttcctggcgcagcagcggctcgccatcgtctcccccctgtccggcgaccagccgctgttcaacgaggaccgcaccgtcgtcgtcgtggccaatggagagatctacaaccacaagaacatccggaagcagttcaccggcacgcacaacttcaccacgggcagtgactgcgaggtcatcatccccctgtacgagaagtacggcgagaacttcgtcgacatgctggacggagtcttcgcgttcgtgctctacgacacccgcgacaggacctacgtggcagcgcgcgacgccatcggcgtgaacccgctctacatcggctggggcagtgacggttccgtctggatctcgtccgagatgaaggccctgaacgaggactgcgtgcggttcgagatcttcccgccgggccacctctactccagcgccgccggcgggttccggcggtggtacaacccgcagtggttccaggagcaggtgccccggacggcgccgtaccagccgctcgtcctcagagacgccttcgagaaggcggttatcaagaggctcatgactgacgtcccgttcggggtcctcctctccggcgggctcgactcctccctcgtcgcctccgtgaccaagcgccacctcgtcaagacggaggccgccgagaagttcgggaccgagctccactcctttgtcgtcggcctcgagggctcccctgacctcaaggccgcacgagaggtcgccgactacctcggaaccatccatcacgagttccatttcaccgtacaggacggcatcgacgcgatcgaggaggtgatctaccacgacgagacctacgacgtgacgacgatccgtgccagcacgcccatgttcctgatggctcgcaagatcaagtcgctgggggtgaagatggtgctgtccggtgagggctccgacgagctcctcggcggctacctctacttccacttcgctcccaacaaggaggagttccacaaggagacctgccgcaaggtgaaagccctgcaccagtacgactgcctgcgtgccaacaaggcgacgtcggcgtggggcctggaggtccgcgtgccgttcctcgacaaggagttcatcaacgtcgctatgagcatggaccctgaatggaaaatgtacgacaagaacctgggccgcatcgagaagtgggtcatgaggaaggcgttcgacgacgaggagaacccttacctgcccaagcatattctctacaggcagaaagaacagttcagtgacggtgttggctacaactggatcgatggtctcaaagccttcactgaacagcaggtcacggatgagatgatgagcaacgctgcccaaacgttcccgtacaacacgcccgtcaacaaggaggcctactactaccggatgatattcgagaggctcttccctcaggactcggcgagggagacggtgccgtggggcccgagcatcgcctgcagcacgcccgcggccatcgagtgggtggagcagtggaaggcctccaacgacccttccggccgcttcatctcctcccacgactccgccaccgacaacaccggcggcggtaagctggcggtggtggccaacggcggccacggcgccgcgaacggcacggtcaacggcggcaacgacgtcgctgtcgcgatcgcggtgtaa

SEQ ID NO: 2456 - protein, 590 aa, Sorghum bicolor
  misc_feature: Ceres ANNOT ID no. 6024586
  misc_feature (211)..(452): Pfam Id: Asn_synthase Pfam Desc: Asparagine synthase
  misc_feature (2)..(162): Pfam Id: GATase_2 Pfam Desc: Glutamine amidotransferases class-II
  misc_feature (74)..(589): NCBI GI: 115452397 NCBI Desc: os03g0291500 [oryza sativa (japonica cultivar-group)]
  misc_feature (1)..(590): NCBI GI: 984262 NCBI Desc: asparragine synthetase [zea mays]
  misc_feature (1)..(556): NCBI GI: 1617002 NCBI Desc: asparagine synthetase [asparagus officinalis]
  misc_feature (1)..(556): NCBI GI: 16076 NCBI Desc: asparagine synthase (glutamine-hydrolysing) [asparagus officinalis]
  misc_feature (1)..(554): NCBI GI: 6049841 NCBI Desc: asparagine synthetase [helianthus annuus]
  misc_feature (1)..(590): SWISSPROT Homolog: EC 6.3.5.4 Asparagine synthetase [glutamine-hydrolyzing]
MCGILAVLGCSDWSQARRARVLACARRLKHRGPDWSGLYQHEGNFLAQQRLAIVSPLSGDQPLFNEDRTVVVVANGEIYNHKNIRKQFTGTHNFTTGSDCEVIIPLYEKYGENFVDMLDGVFAFVLYDTRDRTYVAARDAIGVNPLYIGWGSDGSVWISSEMKALNEDCVRFEIFPPGHLYSSAAGGFRRWYNPQWFQEQVPRTAPYQPLVLRDAFEKAVIKRLMTDVPFGVLLSGGLDSSLVASVTKRHLVKTEAAEKFGTELHSFVVGLEGSPDLKAAREVADYLGTIHHEFHFTVQDGIDAIEEVIYHDETYDVTTIRASTPMFLMARKIKSLGVKMVLSGEGSDELLGGYLYFHFAPNKEEFHKETCRKVKALHQYDCLRANKATSAWGLEVRVPFLDKEFINVAMSMDPEWKMYDKNLGRIEKWVMRKAFDDEENPYLPKHILYRQKEQFSDGVGYNWIDGLKAFTEQQVTDEMMSNAAQTFPYNTPVNKEAYYYRMIFERLFPQDSARETVPWGPSIACSTPAAIEWVEQWKASNDPSGRFISSHDSATDNTGGGKLAVVANGGHGAANGTVNGGNDVAVAIAV

SEQ ID NO: 2457 - DNA, 1764 bp, Sorghum bicolor
  misc_feature: Ceres ANNOT ID no. 6024590
  misc_feature: Encodes the peptide sequence at SEQ ID NO 2458
atggcgagcgccgacgccgacgaagcgccgctgctctctgaggaacccctctgtccaggatcctgcagccgtgagctcgagctgcgggagttccgcgaccgctacgtgatccgctcgctcgacggcgccgccgccttcgccgtcgctcgctccggcggctccatccgccctctctccccagaggaagccgcagctggggctgggagcgactgcaaggtttccagaatatacggggtggtcggcatcataagattgctcgccggaagctatgtactcgttatcacttctcggaaagatgctggctcttatcagggatcccctgtgtaccatgtgaactcaatgaaattcttatgctgcaacgaggctataaagcacttaactccacaggaaagaagggatgaggcatacttcatgtctctactgagaattgcagaaactacttgtggattgtactattcatacgtcagggatttgacactaaacttgcagagggcatccaagttggctgcagggagggtacataaaccactatggaagcaggctgatccacgttttgtctggaacaaaaatttgttagaggagctcattgaagctaagtcagcgcaatttaccttgaaggatagaccagtcagaataacattgttctcaaggagatgcaacaggcgtttaggaacaagaatgtggagaaggggtgcgaatcttgaaggcgccacagcaaattttgtagaaacagaacagttggttgagtatgaaggtctcacatcctcatttatacaggttcgaggatcaattccacttctctgggagcaaatagtggatttaagctacaaaccacggcttagcattattgaacatgaagaaactcccaaggttgttcaacgccacttccatgatctttcacaacgatatggcgaggcaattgttattgacttgactgataaacgaggtgatgagggagatttgagtaatgcatttgctgctgaaatgggcagaattcctggtgtcaggtatatacattttgatttccatcatgtttgtcgtggaggtaactttgacaatttgcaagctctctacaatcaaattgaggaagctattcataagcaaggatattttcttatgaacactaaaggagagattttgttggagcaaagtggtgtagttaggtccaattgcatcgattgcctggaccgtacaaatgtgacacagagtttccttgcaagaaaatcattggattctcaattgcagcggatgggggcattattgtcatctgaaagcatttctctctctgataacattaatgatatattcaaaaaattatgggttgagcacggtgatgagctgagcctggagtacgctggttcttatgctttgaaaggggatctagtgagatatggacggcagacattacctggactaattaaagatggaatgagtgctctttcaagatattatttgaataattttcatgatggagtgcggcaagatgctcttgaccttattagcggttattatacagtcagtcaaggcagctcctctccttttcataatggtggatttgaatcttcttcgtatctgcctgtggcttctgcaatcatagttggtgggattactgcaacaactttcactcttagtcaagttggacggaatgcacaacacttgatctcctccattatctgtgcgggcttaacagtcggagtagtagccttggtgaaagccaatggaaaacagttttgctctaggccccgtctgtgtggtctaatctaa

SEQ ID NO: 2458 - protein, 587 aa, Sorghum bicolor
  misc_feature: Ceres ANNOT ID no. 6024590
  misc_feature (76)..(354): Pfam Id: Syja_N Pfam Desc: SacI homology domain
  misc_feature (1)..(587): NCBI GI: 115452391 NCBI Desc: os03g0290500 [oryza sativa (japonica cultivar-group)]
  misc_feature (26)..(582): NCBI GI: 50725775 NCBI Desc: inositol 5-phosphatase 3-like protein [oryza sativa (japonica cultivar-group)]
  misc_feature (129)..(583): NCBI GI: 31415729 NCBI Desc: sac domain protein 6 [arabidopsis thaliana]
  misc_feature (26)..(437): NCBI GI: 91807100 NCBI Desc: phosphoinositide phosphatase family protein [arabidopsis thaliana]
  misc_feature (75)..(583): NCBI GI: 54641209 NCBI Desc: ga21564-pa [drosophila pseudoobscura]
MASADADEAPLLSEEPLCPGSCSRELELREFRDRYVIRSLDGAAAFAVARSGGSIRPLSPEEAAAGAGSDCKVSRIYGVVGIIRLLAGSYVLVITSRKDAGSYQGSPVYHVNSMKFLCCNEAIKHLTPQERRDEAYFMSLLRIAETTCGLYYSYVRDLTLNLQRASKLAAGRVHKPLWKQADPRFVWNKNLLEELIEAKSAQFTLKDRPVRITLFSRRCNRRLGTRMWRRGANLEGATANFVETEQLVEYEGLTSSFIQVRGSIPLLWEQIVDLSYKPRLSIIEHEETPKVVQRHFHDLSQRYGEAIVIDLTDKRGDEGDLSNAFAAEMGRIPGVRYIHFDFHHVCRGGNFDNLQALYNQIEEAIHKQGYFLMNTKGEILLEQSGVVRSNCIDCLDRTNVTQSFLARKSLDSQLQRMGALLSSESISLSDNINDIFKKLWVEHGDELSLEYAGSYALKGDLVRYGRQTLPGLIKDGMSALSRYYLNNFHDGVRQDALDLISGYYTVSQGSSSPFHNGGFESSSYLPVASAIIVGGITATTFTLSQVGRNAQHLISSIICAGLTVGVVALVKANGKQFCSRPRLCGLI

SEQ ID NO: 2459 - DNA, 3273 bp, Sorghum bicolor
  misc_feature: Ceres ANNOT ID no. 6024595
  misc_feature: Encodes the peptide sequence at SEQ ID NO 2460
  misc_feature: Down-regulated in shoot tissues in response to salicylic acid treatment
atgtcaacgaatcctgatgagcctaagagtcgtgcccggacagactttttgctcaacaatgaatcagaggttcagaagttttgggatgagaacaaggtttttgaggctgatcctggcaatgagcctccaagccctggggaaaaattctttgggaactttccatacccttacatgaatggcttgctgcatctgggccatgccttctcgttgtccaagcttgagttcggtgctgcataccacaggcttcgtggctccaatgtccttttgccctttggtttccactgcactggaatgcccatcaaggcctcagctgataagcttgctagggaaatccaacaatatggatatcctccggtgtttcctgtggcagaggattctggtgctgcagtagcagatgctacccaagctgaccaggctgatgttgttgccccggataagtttaaggggaagaagtccaaggctactgcaaaggctggcgcacaaaagtaccagtgggagatcatgaagagctttggtctagatgatgaagaaattgccagatttcaagatccttatcactggttgactcacttccctccattggcaaaggaggttctcaagaaatttggcttgggttgtgactggaggaggtcattcataactactgacatgaacccatactatgatgcttttgttaagtggcagatgaggaagctgaagaaattgggcaaggttgttaaagacatgaggtacacgatctactctccgttggatggccaaccttgtgctgatcatgatagggcaacaggtgaaggtgtgcagccacaagaatacgtcttgattaaaatggaggtgatatcaccttttcctcccaagctgaaggcattggaagggaggaaggtatatttggcagctgctacgctaagacctgagacgatgtatggacagacaaattgctgggtccttcctgatggaatgtatggtgcttttgagatcaatgacactgatgtcttcatacttacagccaggtctgctcttaatcttgcataccaacacctatccagggtccctgaaaaaccaacctgcttatgtgaactgtctggcaatgatttgattggtttgccactgaaatctcctcttgccttcaatgacaccatatatgctcttccaatgctcacggtcttgactgacaaaggtactggcattgtgactagtgttccaagtgattcacctgatgatttcatggcgctgcaagatttagtcacaaagccagccttgagagcaaagtatggagtgaaagatgagtgggttcttccttatgagattataccaataatccacattcctgaatttggagacaagtcagcagagaaggtttgccatgatcttaagattaaaagccagaacgacaaggagaagcttgctgaagcaaaaagaatgacgtatctgaagggatttactgatggaacaatgattgtaggtgagttcagtggtagaaaggttcaagaagcaaagccgctgattaaaagcaagcttttggaagaaggcacagcagtgctatatagtgagccagagaagaaggtcatgtctagatctggtgatgaatgtgttgttgccctcactgatcagtggtacataacttatggtgaggctgaatggaagcagaaggcagccaaatgtttggaccgcatgaatacattctcaactgaaacccgtaatggttttgagcacacattgggctggctgaaccagtgggcttgttcgcgttcttttggccttggtactcgaatcccatgggatgagcagttccttgtagaatctctttctgattcaaccctatacatggcttactatacaattgcacatcatttgcaaaatggtaatatgtatgggaaagaaatatcttcagtaaggccagaagaaatgacagatgaagtctgggattttgtgttttgtgatggtccagcaccaaaaagtgacatccctgctgctctgttgaacaaaatgaagcaggaatttgagtactggtacccgtttgatatccgtgtgtctggtaaagaccttattcagaaccatctgacattctgcatatataatcatacagcacttcttcctgaacaccattggcctcttggttttcgctgcaatgggcatcttatgcttaattctgaaaaaatgtccaagtcaacagggaatttcttaactctcgaagatgccatcaaaaagtattcttctgatgccactagatttgcccttgctgatgctggtgatggtatggatgacgcaaactttgtcactgacattgcaaattctgctgtgctgaggcttacaaaagaaatttcatggatggaagaggttacagctgctgaatctaaattaagaactgggccgcccactacatatgctgaccgtgtgtttgcaaacgagatgaacattgcaatcaaagaaactgagaagagctacgatgctttcatgttcaaggaggccctgacgtctgggttctatgacctccaatcggctagagatgagtacaggctctcttgtggcgcagcaggcatgaaccgggatctgttgtggcgatttatggatgtccagaccaggcttatcacccccttttgcccacactatgctgagcacatttggcagaagatcatgaagaaagaaggctttgcaataaaagctggctggccagttgcagacaccccagatcctacactgagaattgcaaataaatacttgcaggattccatagtttcgttcaggaagctgcttcagaagcaagagtctggttccaagaagcctaagaagggagctgcaccagcacctccatccgagaaaaagaagatgagcattggccttatatatgtggacgagcactacactggctggaaagagcagtgcttgagggtgctgcagtccaagttcgacagccaaagtcgctccttcgcacctgataaggaaatagcagaagctctgaaggagtgtcccatcgggcaggaaatgaacttgaagcaagttctgaagctgtgcatgcccttcatcaaggataagaaagacgaggcaaaggaggttggtccgcaggcgctggacttgaagcttccgttcagtgagatggatgttctccaggagaacttggagctgatcaagaggcagcttggccttgagcaagtcgaggtgctctcggcgtccaacgaagctgctcgtgctaaagctggtgagcatgcttcgctgctggaggaaaagccaccatcacctggtgtccccatcgccatcttcctcagcaaacagagctga

SEQ ID NO: 2460 - protein, 1090 aa, Sorghum bicolor
  misc_feature: Ceres ANNOT ID no. 6024595
  misc_feature (796)..(933): Pfam Id: Anticodon_1 Pfam Desc: Anticodon-binding domain
  misc_feature (23)..(758): Pfam Id: tRNA-synt_1 Pfam Desc: tRNA synthetases class I (I, L, M and V)
  misc_feature (412)..(770): Pfam Id: tRNA-synt_1g Pfam Desc: tRNA synthetases class I (M)
  misc_feature (1)..(1028): NCBI GI: 115479999 NCBI Desc: os09g0503400 [oryza sativa (japonica cultivar-group)]
  misc_feature (7)..(1090): NCBI GI: 79339972 NCBI Desc: atp binding / leucine-trna ligase/ trna ligase [arabidopsis thaliana]
  misc_feature (7)..(1088): NCBI GI: 2160156 NCBI Desc: strong similarity to s. pombe leucyl-trna synthetase (gbz73100). [arabidopsis thaliana]
  misc_feature (13)..(1088): NCBI GI: 124360700 NCBI Desc: aminoacyl-trna synthetase, class ia [medicago truncatula]
  misc_feature (7)..(1056): NCBI GI: 7804450 NCBI Desc: leucyl trna synthetase [homo sapiens]
  misc_feature (7)..(1056): SWISSPROT Homolog: EC 6.1.1.4 Leucyl-tRNA synthetase, cytoplasmic
  misc_feature: Down-regulated in shoot tissues in response to salicylic acid treatment
MSTNPDEPKSRARTDFLLNNESEVQKFWDENKVFEADPGNEPPSPGEKFFGNFPYPYMNGLLHLGHAFSLSKLEFGAAYHRLRGSNVLLPFGFHCTGMPIKASADKLAREIQQYGYPPVFPVAEDSGAAVADATQADQADVVAPDKFKGKKSKATAKAGAQKYQWEIMKSFGLDDEEIARFQDPYHWLTHFPPLAKEVLKKFGLGCDWRRSFITTDMNPYYDAFVKWQMRKLKKLGKVVKDMRYTIYSPLDGQPCADHDRATGEGVQPQEYVLIKMEVISPFPPKLKALEGRKVYLAAATLRPETMYGQTNCWVLPDGMYGAFEINDTDVFILTARSALNLAYQHLSRVPEKPTCLCELSGNDLIGLPLKSPLAFNDTIYALPMLTVLTDKGTGIVTSVPSDSPDDFMALQDLVTKPALRAKYGVKDEWVLPYEIIPIIHIPEFGDKSAEKVCHDLKIKSQNDKEKLAEAKRMTYLKGFTDGTMIVGEFSGRKVQEAKPLIKSKLLEEGTAVLYSEPEKKVMSRSGDECVVALTDQWYITYGEAEWKQKAAKCLDRMNTFSTETRNGFEHTLGWLNQWACSRSFGLGTRIPWDEQFLVESLSDSTLYMAYYTIAHHLQNGNMYGKEISSVRPEEMTDEVWDFVFCDGPAPKSDIPAALLNKMKQEFEYWYPFDIRVSGKDLIQNHLTFCIYNHTALLPEHHWPLGFRCNGHLMLNSEKMSKSTGNFLTLEDAIKKYSSDATRFALADAGDGMDDANFVTDIANSAVLRLTKEISWMEEVTAAESKLRTGPPTTYADRVFANEMNIAIKETEKSYDAFMFKEALTSGFYDLQSARDEYRLSCGAAGMNRDLLWRFMDVQTRLITPFCPHYAEHIWQKIMKKEGFAIKAGWPVADTPDPTLRIANKYLQDSIVSFRKLLQKQESGSKKPKKGAAPAPPSEKKKMSIGLIYVDEHYTGWKEQCLRVLQSKFDSQSRSFAPDKEIAEALKECPIGQEMNLKQVLKLCMPFIKDKKDEAKEVGPQALDLKLPFSEMDVLQENLELIKRQLGLEQVEVLSASNEAARAKAGEHASLLEEKPPSPGVPIAIFLSKQS

SEQ ID NO: 2461 - DNA, 1884 bp, Sorghum bicolor
  misc_feature: Ceres ANNOT ID no. 6024599
  misc_feature: Encodes the peptide sequence at SEQ ID NO 2462
atgcccaaacgagacaaagcagcttccccgcgcgcttccccaccccacacacctccgccggggacggacagcgaggccgaggaggcagaccaggcgggggcgtccgcggcggagatggggacgtacaagtgctgcatcttcttcacgcgcaggttcgcgctcgccgacacctccacgccggaggacgtccgcgcgctcttctcccgctacgccggcggctcgccgtacatgcttgccgacgacctccgccgctacctcgccgcctggggaggtgccgacggcgaggtcccggagcagatcatcgaccgtatcctgcaggatcgcagccgaaccccgcggttcgggaggccggcgctcaccgttgacgacttcttacacttcctcttctccgaggacctcaacccacccctccgccactccaaggtcaatcaggacatgaacgcaccgctatcgcactattttatatacactggacacaactcgtatctgaccggtaatcaactcagcagtgactgcagtgatgttcccatcatcaaggcactgcaaataggtgtccgtgtaattgaattggacatatggccaaattcttctaaagatgacattgatgttctccatggaaggacactgactgccccagtatcacttatcaaatgcttgagatccatcaaagaatatgcttttgttgcatctccctatcctgttattataacactagaagaccaccttacacctgatcttcaggcgaaagtagctaagatggtccttgaagtgtttggagacatcctgtattaccctgaatcgaaacatcttcaagaatttccttcacctgaagctctaaaggggcgtgtcatgctctcaacaaaacccccaaaggagtatctcgaagcaaagggtggcaccatgaaggagagagaaattgaggcccagtttaaaaagggtgaaagagaagaagcagcatggggagtagaagttccagatattcatgaggagatgcaagtcgcgaacaggaatgatgatgatctattataccgcgaaagaggtgcagatggtgatgatgagaagaaaacgaagcatgtggcagcagagtataaacaccttatcactatcaaggcaggaaagccaaagggtcctctcgtggatgccttaaagaacgatccagacaaagttaggcgactcagtttgagtgagcaagaacttgcaaaagttgcagcacgtcatggtcccaacattgtgagcttcacgcatagaaatatgctgagaatatacccaaagggaacccgcttcaattcatccaactataatccatttcttggctgggtgcatggtgctcaaatggtggcattcaatatgcagggacatggaagagcactttggttaatgcatggcttttataaagccaatggctgttgcggttatgtgaagaaaccagatttcttgatgcaaacttgtccagatggaaaggtgtttgatccggaggcagatttgccagtgaaggcaacattgaaggtcaaggtatacatgggggaaggttggcaaaaggacttcaagcagacacatttcgacacatactcacctccagatttttatgtaaaggttggcatcgccggagttccattagactcggtgatgaggaagacgaaagccgtggaagacagctgggtgccggtgtgggaggaggagttcaccttcccgctgaccgtaccggagatcgcggtgctccgcgtggaggtgcacgagcaggacgtgagcgaagacgacttcggcgggcagacggcgctgcctgtggcggagctgcggccagggatccgcgccgtgccgctgttcgaccacaaggggctcaagttcaggagcgtcaagctcctcatgtgcttcgagttcgcgtag

SEQ ID NO: 2462 - protein, 627 aa, Sorghum bicolor
  misc_feature: Ceres ANNOT ID no. 6024599
  misc_feature (146)..(289): Pfam Id: PI-PLC-X Pfam Desc: Phosphatidylinositol-specific phospholipase C, X domain
  misc_feature (362)..(480): Pfam Id: PI-PLC-Y Pfam Desc: Phosphatidylinositol-specific phospholipase C, Y domain
  misc_feature (501)..(592): Pfam Id: C2 Pfam Desc: C2 domain
  misc_feature (62)..(142): Pfam Id: efhand_like Pfam Desc: Phosphoinositide-specific phospholipase C, efhand-like
  misc_feature (1)..(626): NCBI GI: 10880265 NCBI Desc: phosphoinositide-specific phospholipase c [digitaria sanguinalis]
  misc_feature (10)..(626): NCBI GI: 115452383 NCBI Desc: os03g0289300 [oryza sativa (japonica cultivar-group)]
  misc_feature (39)..(626): NCBI GI: 12698878 NCBI Desc: phosphoinositide-specific phospholipase c [oryza sativa]
  misc_feature (39)..(626): NCBI GI: 145308221 NCBI Desc: phosphoinositide-specific phospholipase c [nicotiana tabacum]
  misc_feature (39)..(626): NCBI GI: 1771381 NCBI Desc: phosphoinositide-specific phospholipase c [nicotiana rustica]
  misc_feature: Useful for making plants with modulated water use efficiency
  misc_feature: Functional homolog of the protein sequence given in SEQ ID NO 13598
MPKRDKAASPRASPPHTPPPGTDSEAEEADQAGASAAEMGTYKCCIFFTRRFALADTSTPEDVRALFSRYAGGSPYMLADDLRRYLAAWGGADGEVPEQIIDRILQDRSRTPRFGRPALTVDDFLHFLFSEDLNPPLRHSKVNQDMNAPLSHYFIYTGHNSYLTGNQLSSDCSDVPIIKALQIGVRVIELDIWPNSSKDDIDVLHGRTLTAPVSLIKCLRSIKEYAFVASPYPVIITLEDHLTPDLQAKVAKMVLEVFGDILYYPESKHLQEFPSPEALKGRVMLSTKPPKEYLEAKGGTMKEREIEAQFKKGEREEAAWGVEVPDIHEEMQVANRNDDDLLYRERGADGDDEKKTKHVAAEYKHLITIKAGKPKGPLVDALKNDPDKVRRLSLSEQELAKVAARHGPNIVSFTHRNMLRIYPKGTRFNSSNYNPFLGWVHGAQMVAFNMQGHGRALWLMHGFYKANGCCGYVKKPDFLMQTCPDGKVFDPEADLPVKATLKVKVYMGEGWQKDFKQTHFDTYSPPDFYVKVGIAGVPLDSVMRKTKAVEDSWVPVWEEEFTFPLTVPEIAVLRVEVHEQDVSEDDFGGQTALPVAELRPGIRAVPLFDHKGLKFRSVKLLMCFEFA

SEQ ID NO: 2463 - DNA, 1206 bp, Sorghum bicolor
  misc_feature: Ceres ANNOT ID no. 6024605
  misc_feature: Encodes the peptide sequence at SEQ ID NO 2464
atggccgccgccgccgcgggagaaacaccggtgggcgacggggctccgccgtcaggggctctgtactccttcggaacgccgtggccggagctcaatcaaggcctcacctacaccgacacgttccgttgcgctgatgcggacgccgttaccaccttgattgagttctactctagtaaatacaagagctcggcgccgttgccagggtggatcaagaggattggtaaccggcagataaccgttgatggtgaagttgtcactgatccagatatgactctcagggatggttctaagttggtatatcatcgttttccctggcaggagccatttgcgccatatttgctggaagtgctctacgaggatgatgacatggttgcccttaataagccttctggcttgcaagttctgcctaaaggcctctttcagcagcgcactgttttagcacagcttcaattgaaagactggaagatggcctcatcttgccgctccaagagaaaagatgtgcagtcacatccagtacctgttcatcgattagggaggggaacatcaggcctcctgctttgtgccaagacaaaggttgccaaagttcgacttgcatcttattttgctgagggtgctataaatgctgcaacgaaaagggataaatcagagttcagtgaagagcgaaaaatttcaaaattttatcgagccttagtgactggcatacttgataatgatgaggttgtggttacgcaacccatagggctagttcattatcctggagttgcagagggactttatgcggcatgttcctcaggaaagccagcaatgagcaaagtatgtgtacttgagagacttgcacaccaaaatcacacactggtccaggttgaaattcattcaggacgacctcaccaaatacggatacaccttgcatacattgggcaccctcttgtagatgatcctctctatggtattggtggccaccccaaatttgttgagccagaatctactggcacagataattcttttgcatttgatggaggttatgagagacctctgcaacctgttcctggagactgcgggtatcacctacatgcacattggctggtcctttgccacccaacaaccaataaggtgattaaacatatatctaatcttgggcaggtattatcaacatgcctttccgaggcactaaataaaatgcatgggttgaattggacacgaacttaa

SEQ ID NO: 2464 - protein, 401 aa, Sorghum bicolor
  misc_feature: Ceres ANNOT ID no. 6024605
  misc_feature (122)..(304): Pfam Id: PseudoU_synth_2 Pfam Desc: RNA pseudouridylate synthase
  misc_feature (25)..(384): NCBI GI: 42572641 NCBI Desc: pseudouridine synthase family protein [arabidopsis thaliana]
  misc_feature (25)..(309): NCBI GI: 22331748 NCBI Desc: pseudouridine synthase family protein [arabidopsis thaliana]
  misc_feature (25)..(309): NCBI GI: 17978940 NCBI Desc: at3g52260/t25b15_30 [arabidopsis thaliana]
  misc_feature (31)..(207): NCBI GI: 67924151 NCBI Desc: pseudouridine synthase, rlud [crocosphaera watsonii wh 8501]
  misc_feature (69)..(187): NCBI GI: 115452369 NCBI Desc: os03g0288500 [oryza sativa (japonica cultivar-group)]
MAAAAAGETPVGDGAPPSGALYSFGTPWPELNQGLTYTDTFRCADADAVTTLIEFYSSKYKSSAPLPGWIKRIGNRQITVDGEVVTDPDMTLRDGSKLVYHRFPWQEPFAPYLLEVLYEDDDMVALNKPSGLQVLPKGLFQQRTVLAQLQLKDWKMASSCRSKRKDVQSHPVPVHRLGRGTSGLLLCAKTKVAKVRLASYFAEGAINAATKRDKSEFSEERKISKFYRALVTGILDNDEVVVTQPIGLVHYPGVAEGLYAACSSGKPAMSKVCVLERLAHQNHTLVQVEIHSGRPHQIRIHLAYIGHPLVDDPLYGIGGHPKFVEPESTGTDNSFAFDGGYERPLQPVPGDCGYHLHAHWLVLCHPTTNKVIKHISNLGQVLSTCLSEALNKMHGLNWTRT

SEQ ID NO: 2465 - DNA, 1599 bp, Sorghum bicolor
  misc_feature: Ceres ANNOT ID no. 6024608
  misc_feature: Encodes the peptide sequence at SEQ ID NO 2466
atgtcggcggcggccacgatgacgtggcacgaggacctggccactctcgtgggtgacacgggcgttcgcctccccggcggcggggggcacgcgccggcggcggcgaatgttgcggcggcgggggccgggtggtacggggaggaggaagaggggagggcggaggaggggtgggcgcagcaggcgaaggggttcgcggagtccacggcggagatgctgcgggagctgggccgcgggctgtgggacgtcgccgcgcagagcctcgccggcgccgaggacagcgagctcgcgcggcggctccggaagcgggcggcggccacggggaagcgcctcagcttcatgaacgagtacctccccgaggagcgcgacccggtgaggtgttggctcatcgtcgccgcggtcgcattcgtcacactcctagttttaggtgctgggagtgacaatgaaactccagtagaccttcccaagaaacttatcattggtcccccaagtgccgatagaatccaacttcctgatggacggcatctggcttatgaagaacaaggtgtctcagctaacagagcaagattttcactgattgctcctcattcttttctgtcatcaaggctggcaggaatccctggaatcagtgcatctcttctggaagaatttggagtacgactggtgacctatgatcttcctggttttggtgaaagcgatccacacctaggccggaatctcaattcttctgcactggacatgctctatctggctaatgctctcaatattccggaaaagttctgggttgtgggctattctggaggtggcatgcatgcctggagtgctcttcgttacattcctgatcgagttgctggtgcagcaatgttcgcacctatggcaaatccatatgactccaagatgaccaaagacgagaggcgtaaaacatgggatagttggtcaacgaaacggaaactgatgcacattttagctcggaggtttccatcactgctaccgttcttttatcgccaaaccttcctttctggaaagcaaggacaacctgagagttggttgtcactgtcattggggaagaaggacaaaactttactggaaggtcctgtgttcaatgcattctgggaaaggaatgttgcggagtctgtgcgtcagggagatgcaaggccatttgtagaggaagctgtgctgcaagtatctgactggggtttcagcttatctgacatccaaatgcagaagaaagaggctcgaggcatttttgaactcatcaagtctcttttcaatcaggctgaaagagagtgggtgggatttctgggcccaatacatatatggcaggggatggacgaccgagtggtctcgccgtcagtggctgaatttgtgcggcggtcggttccaggggctacggtccacaagcttcttgatgaaggccacttctcatacttctgcttctgcgacgagtgccacaggcagatattctccacgctcttcggcattccccagggcccaatcaaccctgcgccgcaacccagcgaggttgtttcagagctcaccgaagaaacaacagtaccagacaatgccacagatcaggaacaaggaaaatcaggcctgccctga

SEQ ID NO: 2466 - protein, 532 aa, Sorghum bicolor
  misc_feature: Ceres ANNOT ID no. 6024608
  misc_feature (218)..(488): Pfam Id: Abhydrolase_1 Pfam Desc: alpha/beta hydrolase fold
  misc_feature (63)..(499): NCBI GI: 92880903 NCBI Desc: alpha/beta hydrolase fold [medicago truncatula]
  misc_feature (3)..(517): NCBI GI: 92868234 NCBI Desc: alpha/beta hydrolase fold [medicago truncatula]
  misc_feature (81)..(221): NCBI GI: 115488894 NCBI Desc: os12g0535400 [oryza sativa (japonica cultivar-group)]
  misc_feature (127)..(339): NCBI GI: 15232465 NCBI Desc: hydrolase, alpha/beta fold family protein [arabidopsis thaliana]
  misc_feature (160)..(380): NCBI GI: 115487372 NCBI Desc: os12g0152100 [oryza sativa (japonica cultivar-group)]
MSAAATMTWHEDLATLVGDTGVRLPGGGGHAPAAANVAAAGAGWYGEEEEGRAEEGWAQQAKGFAESTAEMLRELGRGLWDVAAQSLAGAEDSELARRLRKRAAATGKRLSFMNEYLPEERDPVRCWLIVAAVAFVTLLVLGAGSDNETPVDLPKKLIIGPPSADRIQLPDGRHLAYEEQGVSANRARFSLIAPHSFLSSRLAGIPGISASLLEEFGVRLVTYDLPGFGESDPHLGRNLNSSALDMLYLANALNIPEKFWVVGYSGGGMHAWSALRYIPDRVAGAAMFAPMANPYDSKMTKDERRKTWDSWSTKRKLMHILARRFPSLLPFFYRQTFLSGKQGQPESWLSLSLGKKDKTLLEGPVFNAFWERNVAESVRQGDARPFVEEAVLQVSDWGFSLSDIQMQKKEARGIFELIKSLFNQAEREWVGFLGPIHIWQGMDDRVVSPSVAEFVRRSVPGATVHKLLDEGHFSYFCFCDECHRQIFSTLFGIPQGPINPAPQPSEVVSELTEETTVPDNATDQEQGKSGLP

SEQ ID NO: 2467 - DNA, 453 bp, Sorghum bicolor
  misc_feature: Ceres ANNOT ID no. 6024609
  misc_feature: Encodes the peptide sequence at SEQ ID NO 2468
atggatctaggcgctacccgccgagggcgcctaccgatccacctcttgttggcgtcgctcaccgtcctcgtggtcctcaccgtgcgctccagcgccgaagtcatcactctcaccgaagagaccttctccgacaagataaaggagaaggacacaatttggtttgtgaaattttgcgtcccctggtgtaaacactgcaagaaccttggaacactatgggaggacctgggaaaggttatggaaggtgaggatgaaattgagatagggcaagttgactgtggtgtcagcaaaccagtatgctcaaaggtggatatccattcctacccaacattcaaggtgttttatgaaggcgaagaagtagcaaaatataaaggacatagggatgtggaatcactgaagaacttcgtgttgagtgaagctgagaaagcaggtgaggcgaagctccaagctgattga

SEQ ID NO: 2468 - protein, 150 aa, Sorghum bicolor
  misc_feature: Ceres ANNOT ID no. 6024609
  misc_feature (33)..(138): Pfam Id: Thioredoxin Pfam Desc: Thioredoxin
  misc_feature (1)..(150): NCBI GI: 59861275 NCBI Desc: protein disulfide isomerase [zea mays]
  misc_feature (15)..(150): NCBI GI: 124359813 NCBI Desc: thioredoxin domain 2; thioredoxin fold [medicago truncatula]
  misc_feature (1)..(136): NCBI GI: 1532175 NCBI Desc: similar to protein disulfide isomerase [arabidopsis thaliana]
  misc_feature (45)..(148): NCBI GI: 8778824 NCBI Desc: t6d22.5 [arabidopsis thaliana]
  misc_feature (34)..(140): NCBI GI: 19353593 NCBI Desc: txndc5 protein [mus musculus]
MDLGATRRGRLPIHLLLASLTVLVVLTVRSSAEVITLTEETFSDKIKEKDTIWFVKFCVPWCKHCKNLGTLWEDLGKVMEGEDEIEIGQVDCGVSKPVCSKVDIHSYPTFKVFYEGEEVAKYKGHRDVESLKNFVLSEAEKAGEAKLQAD

SEQ ID NO: 2469 - DNA, 1413 bp, Sorghum bicolor
  misc_feature: Ceres ANNOT ID no. 6024614
  misc_feature: Encodes the peptide sequence at SEQ ID NO 2470
atggccgccgccttcgaagcagctggtggccggaagggcagctgcttcttggaagtcggccgccgcgagatcggctcctccttcccccgcgcctcttcccgccgaatcagcggctccgagtatggaaaattgcgtggtcatgaaggctgtgttaataccgtaagcttcaaccctgctggtgacctccttgtgtccggttcagacgacacgaacatcatactatgggactggctttctaaaactaaaaagcttgtttacccttccggccaccaaggaaatgtcttccatgctcgtgtgatgccatttactgatgacagcaccatcgtaactgttgctgctgatggtcaggtacgagtaggacaactgaaggagggcggtgaagtcacaacaaaactagttggggagcacgattcccgggtgcataagatggctattgaaccaggaagcccttacatattttacagttgtggagaggatggcttggtacagcattttgacttaagaagcgtttcagcaacaaagcttttcacctgctattctttctttaatgacagacgccgtgtaagactgaatagcattgccattgacccacagaaaccttactatttttcaatttgtggttctgatgagtatgtacggttgtatgacatgaggagattccagttggatgattcaagaaacattaaccagcctgtagataccttctgccctaagcaccttattaagggtgggaaggtccacatcaccagtattgcatattcctatgcaagggagatacttgtatcctacaatgatgagcttatctatttgttccaacaaaatatgggtcttggtccaaatcctgtgtcagtagagccagagtttatcaacatgcttgatcagccacaagtatactcaggtcacaggaattttcgaactgttaagggagtcagtttctttggaccacatgatgaatatgttgtgagtggatcagattgtgggaatgtattcatatggaggaagaagggaggtgaattgatgaggatgatgaatggtgacacaagtgtagttaactgcattgaaccccacccgcatttcccgttcatggctaccagtgggattgataaaactgttaagctttggactcctgcatcgaaaaaattgatgtcactgcctaaaaatgcaaaccaaataatagcctccaatgaacgtgggagagaaattgatgcttctcgagcaggagtgacactttcatctgatgtcgtcatgcatgtgttgaggttacataggagacagtctggactgcatatggagaatgaatcaactagtgcagatttgtccagtgatgatgatgaggctttctacattggatctggtgatgcggtaaggagccgaagggaaaactctgatcccagggaatgcattgtgacatag

SEQ ID NO: 2470 - protein, 470 aa, Sorghum bicolor
  misc_feature: Ceres ANNOT ID no. 6024614
  misc_feature (38)..(76): Pfam Id: WD40 Pfam Desc: WD domain, G-beta repeat
  misc_feature (337)..(375): Pfam Id: WD40 Pfam Desc: WD domain, G-beta repeat
  misc_feature (17)..(390): NCBI GI: 18420246 NCBI Desc: transducin family protein / wd-40 repeat family protein [arabidopsis thaliana]
  misc_feature (11)..(284): NCBI GI: 54291610 NCBI Desc: transducin family protein-like [oryza sativa (japonica cultivar-group)]
  misc_feature (44)..(445): NCBI GI: 62860040 NCBI Desc: wdr42a [xenopus tropicalis]
  misc_feature (40)..(445): NCBI GI: 62898682 NCBI Desc: h326 variant [homo sapiens]
  misc_feature (22)..(445): NCBI GI: 458692 NCBI Desc: homologous to mouse gene pc326:genbank accession number m95564
  misc_feature: The sequence is a functional homolog of SEQ ID NO. 502 in the 11/188,298 US application
MAAAFEAAGGRKGSCFLEVGRREIGSSFPRASSRRISGSEYGKLRGHEGCVNTVSFNPAGDLLVSGSDDTNIILWDWLSKTKKLVYPSGHQGNVFHARVMPFTDDSTIVTVAADGQVRVGQLKEGGEVTTKLVGEHDSRVHKMAIEPGSPYIFYSCGEDGLVQHFDLRSVSATKLFTCYSFFNDRRRVRLNSIAIDPQKPYYFSICGSDEYVRLYDMRRFQLDDSRNINQPVDTFCPKHLIKGGKVHITSIAYSYAREILVSYNDELIYLFQQNMGLGPNPVSVEPEFINMLDQPQVYSGHRNFRTVKGVSFFGPHDEYVVSGSDCGNVFIWRKKGGELMRMMNGDTSVVNCIEPHPHFPFMATSGIDKTVKLWTPASKKLMSLPKNANQIIASNERGREIDASRAGVTLSSDVVMHVLRLHRRQSGLHMENESTSADLSSDDDEAFYIGSGDAVRSRRENSDPRECIVT

SEQ ID NO: 2471 - DNA, 936 bp, Sorghum bicolor
  misc_feature: Ceres ANNOT ID no. 6024619
  misc_feature: Encodes the peptide sequence at SEQ ID NO 2472
atgacgatgatggcgccgcatccgcagccactgccgctggcacagccaccgccggcggcggcagcggcgttcggggacaccacgctcaccaaggtgttcgtgggcgggctggcgtgggagacccacaaggacacactccgcgagcacttcgagcgctacggcgacatcctcgaggccgtcatcatctccgacaagctcaccggccgctccaagggctacggcttcgtgacgttcaaggaggcggacgcggccaagaaggcgtgcgaggacgccacccccgtcatcaacggccgccgcgccaactgcaacctcgcctccctcggcgccaagccgcggccccagccgccgcacatcctccgccccgggccctcgccgccggccaccccggcgccgcacgcgcacgcgctcccctccccacaccagcccacgccagccatcgcggtgggatccaggggtgtgtcgccggtgccatggtactaccacccctccacgacgccccctccgccgccgccgccggccgcgcactacgcccacggcgcgcaccagcagtaccacggcgtgctcccattctaccccgccgccaccacctacgggtactccccaaattacgtcgcggacctgagctacaatgcgaagttaggccaagcggcagctggcggcacggccgggtcgtacctacagccacaggggcacttcgcgtacccggcggcagcgcagggcggcatgcatgtggcggcgcccaacggcatgatgccggtgtacccgttctaccactaccagtaccaccacgcctcgcagggtctgggcgtccccgccgcgcacttcttccccccggtctccgccgccgccgtcaccaccgtcccggccatcgtctccaagcccaccgtcatggccgctcctcccaaaggggcagcggacctcaataaaccgtcataa

SEQ ID NO: 2472 - protein, 311 aa, Sorghum bicolor
  misc_feature: Ceres ANNOT ID no. 6024619
  misc_feature (32)..(102): Pfam Id: RRM_1 Pfam Desc: RNA recognition motif. (a.k.a. RRM, RBD, or RNP domain)
  misc_feature (19)..(117): NCBI GI: 42571597 NCBI Desc: rna recognition motif (rrm)-containing protein [arabidopsis thaliana]
  misc_feature (19)..(117): NCBI GI: 13605871 NCBI Desc: at1g22910/f19g10_13 [arabidopsis thaliana]
  misc_feature (19)..(117): NCBI GI: 42571595 NCBI Desc: rna recognition motif (rrm)-containing protein [arabidopsis thaliana]
  misc_feature (24)..(231): NCBI GI: 15010636 NCBI Desc: at1g20880/f9h16_14 [arabidopsis thaliana]
  misc_feature (24)..(231): NCBI GI: 23505939 NCBI Desc: at1g20880/f9h16_14 [arabidopsis thaliana]
  misc_feature: The sequence is a functional homolog of SEQ ID NO. 339 in the 11/188,298 US application
  misc_feature: The sequence is a functional homolog of SEQ ID NO. 458 in the 11/188,298 US application
MTMMAPHPQPLPLAQPPPAAAAAFGDTTLTKVFVGGLAWETHKDTLREHFERYGDILEAVIISDKLTGRSKGYGFVTFKEADAAKKACEDATPVINGRRANCNLASLGAKPRPQPPHILRPGPSPPATPAPHAHALPSPHQPTPAIAVGSRGVSPVPWYYHPSTTPPPPPPPAAHYAHGAHQQYHGVLPFYPAATTYGYSPNYVADLSYNAKLGQAAAGGTAGSYLQPQGHFAYPAAAQGGMHVAAPNGMMPVYPFYHYQYHHASQGLGVPAAHFFPPVSAAAVTTVPAIVSKPTVMAAPPKGAADLNKPS

SEQ ID NO: 2473 - DNA, 978 bp, Sorghum bicolor
  misc_feature: Ceres ANNOT ID no. 6024624
  misc_feature: Encodes the peptide sequence at SEQ ID NO 2474
atgacggccaagggcggcgccacgccgtcccccggcggcgcggggggtgccgcggcggggaacggccgcctcttcacggtggggctggtcaccgcctggtactcctccaacatcggcgtgctcctgctcaacaagtacctcctcagcaactacggcttcaagtacccaatcttcctcaccatgtgccacatgtccgcctgcgccctgctctcctacgccgccatcgcctggctgcgcgtcgtgcccatgcagctcgtgcgctcccgcgtccagctcgccaagatcgccgcgctcagcctcgtcttctgcggctccgtcgtctccgggaacgtctcgctccgctacctccccgtctccttcaaccaggcggtcggcgccaccacgcccttcttcaccgccgtcttcgcctacatcatgaccgtcaagcgcgagtcctgggtcacctacctcaccctcgtgcccgtcgtcactggagtcatcatcgccagcggcggcgagcctagctttcatctgtttggattcatcatgtgcataggagcaactgcagcaagggcgttgaagacagtattgcaaggaattcttctgtcttctgagggggagaagcttaattctatgaatctgttattgtacatggctccaattgctgttattttcttgcttcctgcaactatctttatggaggataatgttgtcggcattacaattcagcttgcaaagaaggatttcactattgtttggttgctattgttcaattcttgtttggcatattttgtcaatttgaccaatttcttggtgacaaagcatactagcgcactgactctacaggttctcggaaatgcaaagggtgctgtggcagttgttgtctcgatcatgatattcaggaatcctgtgtccataacaggaatgctcggttacactctcacggttattggcgttattctttacagtgaatccaaaaagcgcagcaacaagccatga

SEQ ID NO: 2474 - protein, 325 aa, Sorghum bicolor
  misc_feature: Ceres ANNOT ID no. 6024624
  misc_feature (173)..(317): Pfam Id: TPT Pfam Desc: Triose-phosphate Transporter family
  misc_feature (23)..(323): Pfam Id: UAA Pfam Desc: UAA transporter family
  misc_feature (23)..(322): NCBI GI: 61651608 NCBI Desc: plastidic phosphate translocator-like protein2 [mesembryanthemum crystallinum]
  misc_feature (19)..(324): NCBI GI: 9759107 NCBI Desc: phosphate/phosphoenolpyruvate translocator protein-like [arabidopsis thaliana]
  misc_feature (19)..(324): NCBI GI: 52421287 NCBI Desc: at5g05820 [arabidopsis thaliana]
  misc_feature (2)..(322): NCBI GI: 115461805 NCBI Desc: os05g0121900 [oryza sativa (japonica cultivar-group)]
  misc_feature (17)..(321): NCBI GI: 21536504 NCBI Desc: phosphate/phosphoenolpyruvate translocator-like protein [arabidopsis thaliana]
  misc_feature: Useful for making plants with altered cell wall content and/or composition
  misc_feature: Functional homolog of the protein sequence encoded by LOCUS at1g12500
  misc_feature: Useful for making plants with altered cell wall content and/or composition
  misc_feature: Functional homolog of the protein sequence given in SEQ ID NO 13792
  misc_feature: The sequence is a functional homolog of SEQ ID NO. 360 in the 11/188,298 US application
  misc_feature: The sequence is a functional homolog of SEQ ID NO. 484 in the 11/188,298 US application
MTAKGGATPSPGGAGGAAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYIMTVKRESWVTYLTLVPVVTGVIIASGGEPSFHLFGFIMCIGATAARALKTVLQGILLSSEGEKLNSMNLLLYMAPIAVIFLLPATIFMEDNVVGITIQLAKKDFTIVWLLLFNSCLAYFVNLTNFLVTKHTSALTLQVLGNAKGAVAVVVSIMIFRNPVSITGMLGYTLTVIGVILYSESKKRSNKP

SEQ ID NO: 2475 - DNA, 1158 bp, Sorghum bicolor
  misc_feature: Ceres ANNOT ID no. 6024625
  misc_feature: Encodes the peptide sequence at SEQ ID NO 2476
atggcgcccacggcctgcctccggctccccttcctccccgcccgagcccgctccgccaccgccaccgccaccccgttctcgccccctcgccgcctttctctcaaatgcagcgccaccaacggtgacaactccaaccccaattacatctccatctctcccggcgtcgagtctgtggacgtcaacgggttgcgtcggccgcccgcgcctgtctccacccccaccgtccccggcgcccgcgatcccaattggctgcctcggccactcactagcgcggacgccatggaggcggacgggaaggggctcaaggttgcttaccagggttgcgctggggcatacagcgaagcggcagcaaagaaggcgtacccgaactgtgagactgtgccctgtgagcactttgacactgcatttcaggctgttcaaaactgggtagctgatagggcagtactgccacttgagaattcattgggaggtagcatacatcggaactatgatcttttgcttcggcatagtttgcacattgttggagaagttcgcctcgcagttcgccattgcttgttagccaatcctggcgtgaagattgaaaaccttaaaagtgctatgagtcatccccaggctcttgcacaatgtgagcacacattaacaggactaggaattgagcatagagaggccgttgatgacactgctggtgcagcaaagattgttgcagaacatatgctccaggacactggtgctattgctagttcattggctgctaaactctatggattggatgttcttgctgagaatattcaggatgacaaagataatgtcacccgttttatgttgctagctcgagaacccatcatacctcgcactgataaaccatttaagacaagcatagtcttttcactagaagaaggacctggacagctctttaaggcgcttgctgtattcgcactgagggaaatcaacctcacaaagatcgaaagtcgtccacacaaggaaaggcctcttcgagactgttcctcactcttaaagaactttgattacctcttttacgttgaccttgaagcatcaatggctgatccaaagactcagaatgctcttggaaatctgaaggagtttgcaacctttttaagagtcctcggaagctatcctgtagatgtgaatgaaccttag

SEQ ID NO: 2476 - protein, 385 aa, Sorghum bicolor
  misc_feature: Ceres ANNOT ID no. 6024625
  misc_feature (103)..(281): Pfam Id: PDT Pfam Desc: Prephenate dehydratase
  misc_feature (291)..(367): Pfam Id: ACT Pfam Desc: ACT domain
  misc_feature (71)..(383): NCBI GI: 92873068 NCBI Desc: prephenate dehydratase with act region [medicago truncatula]
  misc_feature (79)..(383): NCBI GI: 92887942 NCBI Desc: prephenate dehydratase with act region [medicago truncatula]
  misc_feature (69)..(382): NCBI GI: 115458232 NCBI Desc: os04g0406600 [oryza sativa (japonica cultivar-group)]
  misc_feature (69)..(382): NCBI GI: 116309442 NCBI Desc: osigba0142c11.3 [oryza sativa (indica cultivar-group)]
  misc_feature (23)..(382): NCBI GI: 115480717 NCBI Desc: os09g0566000 [oryza sativa (japonica cultivar-group)]
  misc_feature: Useful for making plants with altered lignin content
  misc_feature: Functional homolog of the protein sequence given in SEQ ID NO 13139
MAPTACLRLPFLPARARSATATATPFSPPRRLSLKCSATNGDNSNPNYISISPGVESVDVNGLRRPPAPVSTPTVPGARDPNWLPRPLTSADAMEADGKGLKVAYQGCAGAYSEAAAKKAYPNCETVPCEHFDTAFQAVQNWVADRAVLPLENSLGGSIHRNYDLLLRHSLHIVGEVRLAVRHCLLANPGVKIENLKSAMSHPQALAQCEHTLTGLGIEHREAVDDTAGAAKIVAEHMLQDTGAIASSLAAKLYGLDVLAENIQDDKDNVTRFMLLAREPIIPRTDKPFKTSIVFSLEEGPGQLFKALAVFALREINLTKIESRPHKERPLRDCSSLLKNFDYLFYVDLEASMADPKTQNALGNLKEFATFLRVLGSYPVDVNEP

SEQ ID NO: 2477 - DNA, 753 bp, Sorghum bicolor
  misc_feature: Ceres ANNOT ID no. 6024627
  misc_feature: Encodes the peptide sequence at SEQ ID NO 2478
atggcgaagagctacccgaccgtgagcgccgagtacagcgaggccgtcgagaaggccaggcaaaagctccgcgccctcatcgccgagaagagctgcgccccactcatgctccgcctcgcgtggcactccgccgggacgttcgacgtgtcgtcgaggaccggcggtcccttcggcacgatgaagaacccggcggaactggcgcatggcgccaacgcggggctggacatcgcggtgcggctgctcgagcccatcaaggaggagttccccatcctctcttacgccgatttctaccagctcgcgggagttgtggccgtggaggtcactggtgggcctcagatccccttccaccccggtagggaggacaagcctcagcccccacccgagggccgtcttcctgatgccactaagggttctgaccacctgaggcaagtctttggcaagcagatgggtctgagcgaccaggacattgttgccctttctggtggccacaccttgggaaggtgccacaaagagcggtctggttttgagggggcctggacttcaaaccctttggtcttcgacaactcttacttcaaggaacttctgagtggtgacaaggagggccttcttcagctcccaagtgacaaagccctgctgagcgaccctgccttccgccctcttgtggataaatatgctgcggatgagaaggcattctttgaagactacaaagaagcccacctcaagctctccgaactggggttcgctgatgcttaa

SEQ ID NO: 2478 - protein, 250 aa, Sorghum bicolor
  misc_feature: Ceres ANNOT ID no. 6024627
  misc_feature (19)..(227): Pfam Id: peroxidase Pfam Desc: Peroxidase
  misc_feature (1)..(250): NCBI GI: 145388991 NCBI Desc: asorbate peroxidase [pennisetum glaucum]
  misc_feature (1)..(250): NCBI GI: 1321661 NCBI Desc: ascorbate peroxidase [oryza sativa]
  misc_feature (1)..(250): NCBI GI: 30060252 NCBI Desc: ascorbate peroxidase [oryza sativa (indica cultivar-group)]
  misc_feature (1)..(250): NCBI GI: 3688398 NCBI Desc: ascorbate peroxidase [hordeum vulgare subsp. vulgare]
  misc_feature (1)..(250): NCBI GI: 73647738 NCBI Desc: ascorbate peroxidase [vitis pseudoreticulata]
  misc_feature (1)..(250): SWISSPROT Homolog: EC 1.11.1.11 L-ascorbate peroxidase 1, cytosolic
  misc_feature (31)..(195): SWISSPROT Homolog: EC 1.11.1.5 Cytochrome c peroxidase, mitochondrial precursor
  misc_feature: Useful for making plants with modulated heat sensitivity
  misc_feature: Functional homolog of the protein sequence given in SEQ ID NO 13793
  misc_feature: Useful for making plants with modulated water use efficiency
  misc_feature: Functional homolog of the protein sequence given in SEQ ID NO 13794
  misc_feature: Useful for making plants with altered carbohydrate content
  misc_feature: Functional homolog of the protein sequence given in SEQ ID NO 13795
  misc_feature: Useful for making plants with altered cell wall content and/or composition
  misc_feature: Functional homolog of the protein sequence given in SEQ ID NO 13796
MAKSYPTVSAEYSEAVEKARQKLRALIAEKSCAPLMLRLAWHSAGTFDVSSRTGGPFGTMKNPAELAHGANAGLDIAVRLLEPIKEEFPILSYADFYQLAGVVAVEVTGGPQIPFHPGREDKPQPPPEGRLPDATKGSDHLRQVFGKQMGLSDQDIVALSGGHTLGRCHKERSGFEGAWTSNPLVFDNSYFKELLSGDKEGLLQLPSDKALLSDPAFRPLVDKYAADEKAFFEDYKEAHLKLSELGFADA

SEQ ID NO: 2479 - DNA, 1164 bp, Sorghum bicolor
  misc_feature: Ceres ANNOT ID no. 6024637
  misc_feature: Encodes the peptide sequence at SEQ ID NO 2480
atgaggggcttccgctttgcgctggtccgtgcagcgcggtcgcggtcgcgggcggagctccagaccgtgcagcgccgcccgccgtcggatctcgcccaacgtttttcgcactcggcgtcagcgccggcgaggccatccttcggcatcgcgttcgacatcgatggggtcatcctgcgcggccgaagcccgatcgggggcgcgccgcgggccatccgccgcctctattccgaagaaggtagcctgaagattccgtttctgtttttaactaacggaggaggtgttccagagcatagaagggcccttgagctaagccaacttttaggagtcaacatttctccagcacaggttgtgcatggccattctccttacagagagctggtgaagcgtttcaaagatgaccttattgttgctgttggaaaaggagagcctgcagtagtgatgtctgagtacggatttagaaaagttctgtccatagatgaatatgcatcatattataaagatattgaccccctggctcctttcaagacttggaaagttgggcaaacagacagttacatgtttgcgaaagtgcacccatcatatgatgtttactcagagcgagttaaaggagtgtttgttgtcagcgatcctgttgactggggaagagatctacaggtactctgtgacatcttgtctactggtggacttcctgggactgaaaaaggggatcaacctcctttgtattttgcagctgatgatcttgaataccaggctgcatttccttctgagcggcttggcatgggtgccttcaggatagctttggaaagcatcttcaatcaaataaatgatcatccactgaagtatacatcttatgggaaacctaatccatttgtgttcaagaatgcagcaaacatacttggaaaacttattataagtatgtatcctaattcacagacatcaatggaagtaaaagactgtcagttttcaactatctacatggttggcgataatcctaaagtggatatcaatggagctatgaaggctggccacccatggtcatctgttcttacaaggacaggtgtttttagaggaaaagataacgacccacagtttcctgcagatgcggttgttgatactgttgaagatgccatcaactatattctggagaaggaatgtgtacagtga

SEQ ID NO: 2480 - protein, 387 aa, Sorghum bicolor
  misc_feature: Ceres ANNOT ID no. 6024637
  misc_feature (17)..(385): NCBI GI: 92874625 NCBI Desc: peptidase s26a, signal peptidase i; had-superfamily hydrolase, subfamily iia [medicago truncatula]
  misc_feature (48)..(382): NCBI GI: 44986327 NCBI Desc: agr297cp [eremothecium gossypii]
  misc_feature (48)..(382): NCBI GI: 45201393 NCBI Desc: agr297cp [eremothecium gossypii]
  misc_feature (75)..(384): NCBI GI: 89286009 NCBI Desc: had-superfamily subfamily iia hydrolase, tigr01456, cecr5 containing protein [tetrahymena thermophila sb210]
  misc_feature (42)..(299): NCBI GI: 126136579 NCBI Desc: phosphatidyl synthase [pichia stipitis cbs 6054]
MRGFRFALVRAARSRSRAELQTVQRRPPSDLAQRFSHSASAPARPSFGIAFDIDGVILRGRSPIGGAPRAIRRLYSEEGSLKIPFLFLTNGGGVPEHRRALELSQLLGVNISPAQVVHGHSPYRELVKRFKDDLIVAVGKGEPAVVMSEYGFRKVLSIDEYASYYKDIDPLAPFKTWKVGQTDSYMFAKVHPSYDVYSERVKGVFVVSDPVDWGRDLQVLCDILSTGGLPGTEKGDQPPLYFAADDLEYQAAFPSERLGMGAFRIALESIFNQINDHPLKYTSYGKPNPFVFKNAANILGKLIISMYPNSQTSMEVKDCQFSTIYMVGDNPKVDINGAMKAGHPWSSVLTRTGVFRGKDNDPQFPADAVVDTVEDAINYILEKECVQ

SEQ ID NO: 2481 - DNA, 2298 bp, Sorghum bicolor
  misc_feature: Ceres ANNOT ID no. 6024640
  misc_feature: Encodes the peptide sequence at SEQ ID NO 2482
atgggtagcgcttgccaagctggcatggacgggccttcccgcaaggatgtgttggggatagggaatgtcgccttagagaatggccaccatgaggttggagctgatgcagatgaatggagggaaaaggaagaggacttggccaatgggcacagtgcgccaccgggcatgcagcaggtggatgagcaggagcaacaaggacaaagcattcactgggagaggttcctacctgtgaagacactgagagtcatgctggtggagaatgatgactctactcgtcaggtggtcagtgccctgctccgtaagtgctgctatgaagttatccctgctgaaaatggttcacatgcatggcgatatcttgaagatctgcagaacaacattgaccttgtattgactgaggttttcatgccttgtctatctggcatcggtctgcttagcaaaatcacaagtcacaaaatttgcaaggacattcctgtgattatgatgtcttcaaatgactctatgagtatggtgtttaagtgtttgtcgaagggagcagttgacttcttggtaaagccactacgtaagaatgagcttaagaacctttggcagcacgtttggaggcgatgccacagttccagtggcagtggaagtgaaagcggcatccagacacagaagtgtgccaaaccaaatactggtgatgagtatgagaacgacagtgacagcaatcatgatgatgaagaaaatgatgaagacgacgacgatgacttcagtgtcggactcaatgctagggatggaagtgataatggcagtggtactcaaagctcatggacaaaacgtgctgtggagattgacagtccagaacctatgtctcctgatcaactagcagatccacctgatagtacatgtgcacaagtaattcaccccaaatcagagatatgcagtaacaagtggctaccgacagcaaacaaaaggaatggcaagaaacataaggagaataaagatgaatctatgggaagatacttagaaataggtgctcctaggaactcaagtgcagaatatcaatcatctctcaatgacgtatctgttaatccaacagaaaaacgtcatgagactcacatgccccaatgcaaatccaaaaagaaaatgatggcagaagatgattgtacagacatacctagtgaaataaatactgaaactgctgatttgattagctcaatagccagaaacacagaaggccaacaagcagtacgagctgttgatgcacctgatggcccttccaagatgcccgatggaaatgataagaatcatgattctcatatcgtggtgacaccccatgagttgggtttgaagagattgagaacagatggagctgcagatgaaatccatgatgagcgaaatattctcaaaagatcagatcagtcagccttcaccaggtaccatacatctgtggcttccaatcaaggtggagcaagatgtggggaaagctcttcaccacaagataacagttctgaggctgtgaaaacagactctacatgcaagatgaagtcaaattcagatgctgctccaataaagcagggctccaatggcagtagcaacaacgatgtgggctccagtacaaagaatgttattgcaaagccttcagctaacagggagagagtaacgtcaccatcagccatcaaatctacccagcatgcctcagcatttcatactatacagaatcaaacatcacctgctaatctggttggtaaagacaaagctgatgaaggaatttccaatgcagtgaaaatgagccacccaacagaggttccacaaagctgcgtccagcatcatcaccacgtgcattattacctccatgttatgacacagaaacagtcatcaatcgaccgtggatcatcagatgttcagtgtggttcgtcaaatgtgtttgatcctcctgttgaaggacatgctgcaaactatagtgtgaatgggggtgtctcagttggtcataatgggtgcaatggccagaatggaacgagcactgtccccaatattgcaagaccaaacatagagagtgttaatggtaccgtgagccaaaatatcgctggaggtggcattgtaagtgggagtgggagtggcaatgatgtgtatcagaatcgattcccccaacgagaagctgcattgaacaaattcagactgaagcggaaagatcggaactttggtaaaaaggttcgctaccaaagcaggaagaggcttgctgagcagcggcctcgggtccgtggacagtttgtgcgacaatctgggcaagaagatcaagcagcacaaggttcagaaagatga

SEQ ID NO: 2482 - protein, 765 aa, Sorghum bicolor
  misc_feature: Ceres ANNOT ID no. 6024640
  misc_feature (80)..(196): Pfam Id: Response_reg Pfam Desc: Response regulator receiver domain
  misc_feature (710)..(754): Pfam Id: CCT Pfam Desc: CCT motif
  misc_feature (1)..(765): NCBI GI: 68565886 NCBI Desc: two-component response regulator-like prr73 (pseudo-response regulator 73) (osprr73)
  misc_feature (1)..(765): NCBI GI: 51571885 NCBI Desc: pseudo-response regulator 73 [oryza sativa (indica cultivar-group)]
  misc_feature (49)..(765): NCBI GI: 71153070 NCBI Desc: two-component response regulator-like prr37 (pseudo-response regulator 37) (osprr37)
  misc_feature (49)..(765): NCBI GI: 51571877 NCBI Desc: pseudo-response regulator 37 [oryza sativa (japonica cultivar-group)]
  misc_feature (49)..(732): NCBI GI: 51571883 NCBI Desc: pseudo-response regulator 37 [oryza sativa (indica cultivar-group)]
  misc_feature: The sequence is a functional homolog of SEQ ID NO 932 in the 10/666,642US patent application
  misc_feature: The sequence is a functional homolog of SEQ ID NO 934 in the 10/666,642US patent application
  misc_feature: The sequence is a functional homolog of SEQ ID NO 935 in the 10/666,642US patent application
  misc_feature: The sequence is a functional homolog of SEQ ID NO 936 in the 10/666,642US patent application
  misc_feature: The sequence is a functional homolog of SEQ ID NO 937 in the 10/666,642US patent application
  misc_feature: Useful for making plants with modulated growth and phenotype characteristics
  misc_feature: The sequence is a functional homolog of SEQ ID NO 932 in the 20070033671 US patent application
  misc_feature: The sequence is a functional homolog of SEQ ID NO 934 in the 20070033671 US patent application
  misc_feature: The sequence is a functional homolog of SEQ ID NO 935 in the 20070033671 US patent application
  misc_feature: The sequence is a functional homolog of SEQ ID NO 936 in the 20070033671 US patent application
  misc_feature: The sequence is a functional homolog of SEQ ID NO 937 in the 20070033671 US patent application
  misc_feature: The sequence is a functional homolog of SEQ ID NO. 378 in the 11/188,298 US application
  misc_feature: The sequence is a functional homolog of SEQ ID NO. 370 in the 11/188,298 US application
MGSACQAGMDGPSRKDVLGIGNVALENGHHEVGADADEWREKEEDLANGHSAPPGMQQVDEQEQQGQSIHWERFLPVKTLRVMLVENDDSTRQVVSALLRKCCYEVIPAENGSHAWRYLEDLQNNIDLVLTEVFMPCLSGIGLLSKITSHKICKDIPVIMMSSNDSMSMVFKCLSKGAVDFLVKPLRKNELKNLWQHVWRRCHSSSGSGSESGIQTQKCAKPNTGDEYENDSDSNHDDEENDEDDDDDFSVGLNARDGSDNGSGTQSSWTKRAVEIDSPEPMSPDQLADPPDSTCAQVIHPKSEICSNKWLPTANKRNGKKHKENKDESMGRYLEIGAPRNSSAEYQSSLNDVSVNPTEKRHETHMPQCKSKKKMMAEDDCTDIPSEINTETADLISSIARNTEGQQAVRAVDAPDGPSKMPDGNDKNHDSHIVVTPHELGLKRLRTDGAADEIHDERNILKRSDQSAFTRYHTSVASNQGGARCGESSSPQDNSSEAVKTDSTCKMKSNSDAAPIKQGSNGSSNNDVGSSTKNVIAKPSANRERVTSPSAIKSTQHASAFHTIQNQTSPANLVGKDKADEGISNAVKMSHPTEVPQSCVQHHHHVHYYLHVMTQKQSSIDRGSSDVQCGSSNVFDPPVEGHAANYSVNGGVSVGHNGCNGQNGTSTVPNIARPNIESVNGTVSQNIAGGGIVSGSGSGNDVYQNRFPQREAALNKFRLKRKDRNFGKKVRYQSRKRLAEQRPRVRGQFVRQSGQEDQAAQGSER

SEQ ID NO: 2483 - DNA, 2631 bp, Sorghum bicolor
  misc_feature: Ceres ANNOT ID no. 6024645
  misc_feature: Encodes the peptide sequence at SEQ ID NO 2484
atgggcgccacggccttcgacttcgagtacaagagggacgcttatggattcgcggtgcggccacagcacgtgcagcgtttccgcgagtacgccaagatttacaaggaagaggaggaggagagggcgcacagatggagggacttcttggacaggttggctgagtcagccaatgtgcccgccacacccagcgtttcaccatatgcagctaccagggatggtgccacaggagcagatcaggcgcaagagaataacaacatcggaacacattgtgatgatgatgaagaagaggagggagctgagaatgcagaaggtaacaataaattggaaaacccgaaggaagctgataccagtgttgaatcacgagaagcaaatggtaagtcagaagatctgaaagatgtaactgacaacttggatgaagtgaaagaggagactagtagtagctctacagaagcaatcaaagccttagagggcttgatggaagccaatggtgacgttgaagaactaaaagattttaatgaaagctcagaagaattggaagaagagaataatgaaaacttggacaagctggtagagctcttcttggataaggggttgttggatgaactgaagcccataaaagttgagtcccggcggcgggtacgggcagcgcttagcatcattgataaaatgatgagctctcgggtagtgaagggtggtaatggtgcaaatgatactcatggaaaggatggagcacagcttgcttctattgaagaggaaggaaggactgcagaagtgagtcatgacagagatccagctgaggttgaggagccttgtgttgtggagaaggttgaacttggacaggagacacctgatgattctacaggtactgctttggagggaggcaatgatgggtcttattttccttggagggaggagcttgagagcttggttcgtggaggcgtgccaatggctcttagaggagagatatggcaagcatttgtgggtgtcggtgctcggaggattactgggtactacaacaaattgcttgatgacaggactgtgacattggatgaaaaggaccttgtggacccagtggtcaatgaacaaagaagtgcactgagaaaagttacacagcctgagaagtggaaaggacagatagagaaggatttgccacgaacatttccaggacaccctgcattagatgaggatgggaggaatgctttgaggcggttattaaccgcatatgcaaggcataatccatcagttgggtactgccaggccatgaacttctttgctgggctatttttgctattcatgcctgaagaaaatgcattttgggctttagtaggggttattgatgattattttgatggatactacactgaagaaatgattgaatctcaggttgaccaactcgtccttgaggaggttgtacgagaaaggttccctaaattagccaaacatatggatttcttgggagttcaagtgggatgggtgactggaccatggttcctttcaattttcatcaatatgcttccatgggaaagtgtacttcgtgtttgggatgtcatcctttttgaaggaaatcgtacaatgttgttcagaacgacgcttgctttgctggatttatatgggcctgcactggtgaccacaaaagatgctggagatgcaattacactactgcagtctctggctggatctacttttgacagcagccagcttgtattgacagcttgtatgggcttccaatcagttagagaattgggattgaaagagttaaggaaaaagcacaggcctgaaattttaactgcaatggaggaaagatcgaaagaccggggctcctggaaagataagaaggggttagcaaccaaactttatagctttaagcatgatccttcattcgtgtgctcaccagttaagtccaaggacgggttagatggttcaaaggtgaatggagagattgggccagcaaatcttgagacctatcttactgctagttctatactggataatgatttggatcagggtgttgatcttcaagatcaggtgtcatggctaaagattgaactatgcaagctgctcgaggagaaaagatcagctgatctcaggggtgaggaattggaaactgctttgatggaaatggttgagcatgacaacagacgtatgttgagtgctaaggttgagaagctggaagcagaggtatatgaactgcgaaaagctttttcagacaagcaagagcaagagcaagtaatgcttcagatcttgttacgaatggagcaagaacagaaagtggcagaagatgcccgcataaccgctgagcgagatgctgctgaacaaaaacatgctgctcacttgctccaggagaagtatgaagcagcaatggcagcactttcacaaatggagaaaagagctgtaatggcagaaacaatgctggaagctacaaagcattaccaggctgggcaagttaaagccaaccaatctttcacttcaagttcacctcgtgcggaccatgttcctgggaaggtagatcaagaaccaaaccaagatgcacctaacaggagaatcggcatcagcctgctttctaggggacttggatggcttgacaagaacaaggccctacatgtcattatcagagcccttgtttcttactag

SEQ ID NO: 2484 - protein, 876 aa, Sorghum bicolor
  misc_feature: Ceres ANNOT ID no. 6024645
  misc_feature (310)..(544): Pfam Id: TBC Pfam Desc: TBC domain
  misc_feature (12)..(864): NCBI GI: 115452313 NCBI Desc: os03g0283800 [oryza sativa (japonica cultivar-group)]
  misc_feature (139)..(869): NCBI GI: 56201938 NCBI Desc: rabgap/tbc domain-containing protein-like [oryza sativa (japonica cultivar-group)]
  misc_feature (139)..(864): NCBI GI: 115440889 NCBI Desc: os01g0835000 [oryza sativa (japonica cultivar-group)]
  misc_feature (206)..(820): NCBI GI: 42569762 NCBI Desc: rabgap/tbc domain-containing protein [arabidopsis thaliana]
  misc_feature (138)..(825): NCBI GI: 42565945 NCBI Desc: rabgap/tbc domain-containing protein [arabidopsis thaliana]
MGATAFDFEYKRDAYGFAVRPQHVQRFREYAKIYKEEEEERAHRWRDFLDRLAESANVPATPSVSPYAATRDGATGADQAQENNNIGTHCDDDEEEEGAENAEGNNKLENPKEADTSVESREANGKSEDLKDVTDNLDEVKEETSSSSTEAIKALEGLMEANGDVEELKDFNESSEELEEENNENLDKLVELFLDKGLLDELKPIKVESRRRVRAALSIIDKMMSSRVVKGGNGANDTHGKDGAQLASIEEEGRTAEVSHDRDPAEVEEPCVVEKVELGQETPDDSTGTALEGGNDGSYFPWREELESLVRGGVPMALRGEIWQAFVGVGARRITGYYNKLLDDRTVTLDEKDLVDPVVNEQRSALRKVTQPEKWKGQIEKDLPRTFPGHPALDEDGRNALRRLLTAYARHNPSVGYCQAMNFFAGLFLLFMPEENAFWALVGVIDDYFDGYYTEEMIESQVDQLVLEEVVRERFPKLAKHMDFLGVQVGWVTGPWFLSIFINMLPWESVLRVWDVILFEGNRTMLFRTTLALLDLYGPALVTTKDAGDAITLLQSLAGSTFDSSQLVLTACMGFQSVRELGLKELRKKHRPEILTAMEERSKDRGSWKDKKGLATKLYSFKHDPSFVCSPVKSKDGLDGSKVNGEIGPANLETYLTASSILDNDLDQGVDLQDQVSWLKIELCKLLEEKRSADLRGEELETALMEMVEHDNRRMLSAKVEKLEAEVYELRKAFSDKQEQEQVMLQILLRMEQEQKVAEDARITAERDAAEQKHAAHLLQEKYEAAMAALSQMEKRAVMAETMLEATKHYQAGQVKANQSFTSSSPRADHVPGKVDQEPNQDAPNRRIGISLLSRGLGWLDKNKALHVIIRALVSY

SEQ ID NO: 2485 - DNA, 903 bp, Sorghum bicolor
  misc_feature: Ceres ANNOT ID no. 6024654
  misc_feature: Encodes the peptide sequence at SEQ ID NO 2486
atggctacatctctggatgttccactggatgatttgattaagagcagaaatgggaggggaaggggaaggggcaggggacaaggaggccgaggcagaggtgatggccaaagattggctcgtggttcatggcgtgggcgtggtactggcaccttccgtggaaggggactaggggtgccttcgcgaaggccacttggtgttaatactcggtcctcatcatttgctattgccaagtcattcaataaagcaaaggattttgtgtggagacatgatctctttgaggatagcatggtggcagctgggctttctgggatagaatctggtacaaagctgtacatttcaaacttgcactatggagtgacaagggaagatatacaggagcttttttcagaaatgggtcatttgaagcactgtgctgttcattacgacagttacagacacccaactggttcggctgaggtgatattcaccaggagaagtgaagctcttgcagcactgaagagatataataatgtgcgccttgatgggaaggcaatgaagattgaagtaataggagctgatttgggtctatcatctgctgccgcaccccgaattagtgttgttcctggtgcaagcggaagagggcctggtggaagtgggtttggactaggtgcatctggcccatctagttcgcttcctgggtggaagcgtggaggttttgttcaaagaggaggacaagggcgtggtggttttgctcaaagagggcgagggcaagtgcgtggccgcggacgcggccgtggccgtagtagctttggtcaggtccgtggacgtggctatgtgcgcaagggtaatgtggagaaatcagccgaacaattggacaaggaccttgacaactaccaccactctggtgcaatgaatgtcgactaa

SEQ ID NO: 2486 - protein, 300 aa, Sorghum bicolor
  misc_feature: Ceres ANNOT ID no. 6024654
  misc_feature (110)..(180): Pfam Id: RRM_1 Pfam Desc: RNA recognition motif. (a.k.a. RRM, RBD, or RNP domain)
  misc_feature (4)..(291): NCBI GI: 94466659 NCBI Desc: aly protein [nicotiana benthamiana]
  misc_feature (1)..(298): NCBI GI: 9663025 NCBI Desc: dip2 protein [arabidopsis thaliana]
  misc_feature (1)..(299): NCBI GI: 9663023 NCBI Desc: dip1 protein [arabidopsis thaliana]
  misc_feature (77)..(292): NCBI GI: 46982390 NCBI Desc: hin19 [nicotiana tabacum]
  misc_feature (41)..(249): NCBI GI: 9757916 NCBI Desc: rna and export factor binding protein 2-i-like protein [arabidopsis thaliana]
  misc_feature: Useful for making plants with altered alkaloid content
  misc_feature: Functional homolog of the protein sequence given in SEQ ID NO 13119
  misc_feature: Useful for making plants with modulated biomass
  misc_feature: Functional homolog of the protein sequence given in SEQ ID NO 13041
  misc_feature: The sequence is a functional homolog of SEQ ID NO. 458 in the 11/188,298 US application
MATSLDVPLDDLIKSRNGRGRGRGRGQGGRGRGDGQRLARGSWRGRGTGTFRGRGLGVPSRRPLGVNTRSSSFAIAKSFNKAKDFVWRHDLFEDSMVAAGLSGIESGTKLYISNLHYGVTREDIQELFSEMGHLKHCAVHYDSYRHPTGSAEVIFTRRSEALAALKRYNNVRLDGKAMKIEVIGADLGLSSAAAPRISVVPGASGRGPGGSGFGLGASGPSSSLPGWKRGGFVQRGGQGRGGFAQRGRGQVRGRGRGRGRSSFGQVRGRGYVRKGNVEKSAEQLDKDLDNYHHSGAMNVD

SEQ ID NO: 2487 - DNA, 3006 bp, Sorghum bicolor
  misc_feature: Ceres ANNOT ID no. 6024656
  misc_feature: Encodes the peptide sequence at SEQ ID NO 2488
atggcgcccgccgcggccgtcaccggcgccggggatcccgaccaccgtatcgcgcgcgaggtggcgcgggtgctggacgagtgccgcgcgtcccacgccgtgcacccgcggaagctgcgggagctcgcggcgctccgctcctcctcaggaggaggaggcggcggcggccgcctcttcctcgaagccttctgcgacgctctcacgccgctcttcgccctcgcccgccgatccgccggatccgaccgcgtcgctcgcttcgtcgctgccttcgcgtccgcttctgcatcttcttcggccgacggcggtgggaacgggttcctcgaggagttccttcgcttcctcgtcaccgcgtccaaggccgcgcaccggcccgccagattccgcgcatgccaaatcatctccgagattataatgcggttgcctgatgatgctgaggtgagcgatgagatttgggatgaagtaattgatggcatgaaggtccgggttcaagataaaatcgctgcaattcgcacatatgctgtgcgagcattgtcccgttttgcggttgatggggaggatggtggcattgttgatctattcctcgagaccctagacaacgagcagaatgaggttcggaaggcaataattttttctcttccaccatcaaataatactctagagagtgttgttgaatcaatgggcctatctgataggtctgcttcagtaaacaacgagtgcctgaagatgctcaaggatgagtggcttgtgaagtactgtggaggagatgtgatttcccttctcagatttcttgatgttgagacatatgaatcagttggagaatctgtaatggcagtgcttctaaaagatggtgctttgcgagtgcatgatgggcacagtattaggcagtacttcactgcaaatgcagaacaagattccaatattcaactcatggatgctgaggttggcctttactggagaatcatgtgcaagcatttgcaagctgaagctcaggtcaaaggctcagaagctgcagcaactacaggtgcggaagcagcagtatatgcttctgaggctactgataaaaatgatcttctagacagtgtccttcctagcacaattactgattatgttgatttggtaaaggcacacctttctgccggaccaaattatcacttcacatcaaggcaactattgctacttggtgaaatgcttgatttctctgatactacgaaccgaaagattgcaagttcttttctgcatgagcttcttgtcaggcctcttgaacatgaagttgatgatgatgggaaccagattgcaattggagatggtgtgagtcttggaggagacaaagactgggcaaaagcagtggcagagttggccaaaaaagtgcattcttctgttggtgaattcgagatggtggtttccactgttgttgaagagatggttagaccttgcagggagagaacagctgacttcatgcagtggatgcactgtctcgccgtgacaggtcttctgcttcagaatacttcaaccctacggaatctccaggccacagcaattgagccttcagaactgcttcactctttgttgcttcctgcagcaaaacaaaatcatgttgatgtacaaagagctgctttaagatgcctttgtctccttggactgttagagaatagacctaatacagagttggtgaagcagctacgcttatctttcatcaatgggcctgacttggttagtgccatagcatgcaaggccttgattgatcttgtaacttggcatgggccacaacaaatagatcgagccattggaattgaatcgccagattctagctatgaaaagtctcagttcactcaagttgacctgtctgatatgaatgctgatgatctaaacattggagttcttgatattttattttctggatttcataaagatgactgggaattcgatctagagggtgataatcatgataatgtcccaaccattcttggtgaaggttttgcaaagattcttctcctcagtgggaattttgcaagtatacctgctgatttgcatactgttatcctcgctcaactcattagattgtatttctcagaggaagctaaagaacttgaaaggtcaattagttgtatctccaacgcatttgtacctgtcatgaaagccatgtggcctggtttatatggtaatgctgggggtagccctgttgctatttcaaagagacggaaacttgcagttcaagcttctcgttttatggtgcaaatggtgcaaacccaattattttcgacagaaagtatggaccaagcttcgaaaagtcctgaaagtccttcagtttctgctaatgtgtcaaacaattttgacatcagcgaggaaggacttgctatccgtatagcactagaggtagccagttgcccagataagaagaccgcagctgggaaagcatatgctttggctctgtgcaaggttgtgccgcttctaagattccggcaatcagaacagaaagccatcaagtgcatgagaggcttggttaatcatttggctgtttcagtggcttccgacaaggagctcgtgaaggagctagctcaaatggctgcacggcttagatcgcttgatgcctgtccagacgaagaactgtcacaagatgacgcagatgtcatattcaagaaactcggattggatgatggcttcaagttggacaccaccaatcaagcagtgcctcctacaccagcaccacggtcagtccggcctccagctccccccaggagaagaacgaaacaggcaccaccatcctctagcgatgaaagtgacgaagaagagggagaagttagcgtgcctgcaacatcggtaagcagggttccagccactcccagtatgactgctgctgctgcacgttctcagagagcaagcaagactgctgctctgagcaagatgtctgcgaaaccacctgctattgcgtctgatggcagtgagccggacgatcagtctgacgtcacgagtgaggaggaggattcatcccatgaggaatcgtcatag

SEQ ID NO: 2488 - protein, 1001 aa, Sorghum bicolor
  misc_feature: Ceres ANNOT ID no. 6024656
  misc_feature (1)..(1001): NCBI GI: 115467426 NCBI Desc: os06g0256000 [oryza sativa (japonica cultivar-group)]
  misc_feature (196)..(994): NCBI GI: 30693126 NCBI Desc: chromosome condensation family protein [arabidopsis thaliana]
  misc_feature (196)..(994): NCBI GI: 110741552 NCBI Desc: chromosome condensation protein -like [arabidopsis thaliana]
  misc_feature (278)..(996): NCBI GI: 140052682 NCBI Desc: condensin complex subunit 3 , related [medicago truncatula]
  misc_feature (681)..(1001): NCBI GI: 52077257 NCBI Desc: chromosome condensation protein-like [oryza sativa (japonica cultivar-group)]
MAPAAAVTGAGDPDHRIAREVARVLDECRASHAVHPRKLRELAALRSSSGGGGGGGRLFLEAFCDALTPLFALARRSAGSDRVARFVAAFASASASSSADGGGNGFLEEFLRFLVTASKAAHRPARFRACQIISEIIMRLPDDAEVSDEIWDEVIDGMKVRVQDKIAAIRTYAVRALSRFAVDGEDGGIVDLFLETLDNEQNEVRKAIIFSLPPSNNTLESVVESMGLSDRSASVNNECLKMLKDEWLVKYCGGDVISLLRFLDVETYESVGESVMAVLLKDGALRVHDGHSIRQYFTANAEQDSNIQLMDAEVGLYWRIMCKHLQAEAQVKGSEAAATTGAEAAVYASEATDKNDLLDSVLPSTITDYVDLVKAHLSAGPNYHFTSRQLLLLGEMLDFSDTTNRKIASSFLHELLVRPLEHEVDDDGNQIAIGDGVSLGGDKDWAKAVAELAKKVHSSVGEFEMVVSTVVEEMVRPCRERTADFMQWMHCLAVTGLLLQNTSTLRNLQATAIEPSELLHSLLLPAAKQNHVDVQRAALRCLCLLGLLENRPNTELVKQLRLSFINGPDLVSAIACKALIDLVTWHGPQQIDRAIGIESPDSSYEKSQFTQVDLSDMNADDLNIGVLDILFSGFHKDDWEFDLEGDNHDNVPTILGEGFAKILLLSGNFASIPADLHTVILAQLIRLYFSEEAKELERSISCISNAFVPVMKAMWPGLYGNAGGSPVAISKRRKLAVQASRFMVQMVQTQLFSTESMDQASKSPESPSVSANVSNNFDISEEGLAIRIALEVASCPDKKTAAGKAYALALCKVVPLLRFRQSEQKAIKCMRGLVNHLAVSVASDKELVKELAQMAARLRSLDACPDEELSQDDADVIFKKLGLDDGFKLDTTNQAVPPTPAPRSVRPPAPPRRRTKQAPPSSSDESDEEEGEVSVPATSVSRVPATPSMTAAAARSQRASKTAALSKMSAKPPAIASDGSEPDDQSDVTSEEEDSSHEESS

SEQ ID NO: 2489 - DNA, 690 bp, Sorghum bicolor
  misc_feature: Ceres ANNOT ID no. 6024678
  misc_feature: Encodes the peptide sequence at SEQ ID NO 2490
atggctcggcatgttcttcgcggcgcaagtttcgcaatcgtaaccaccgtgctcatgtctgtgctgggaccagggaccaacgaagtcgaggagtcctcctcctcctcatcatccttggcggacgtgtacaagggcgagctgacgccgctgcagaggcacgtcgccttcttcgaccgcaacaaggacggcatcatctacccctccgagacataccaagggtttcgagctatcgggtgtggcgtcgccctgtctgctgccgctgccgtcttcgtcaacggaggacttggacccaagaccgtaccggagaatgagaagagtgcgccgtttaagctcccaatttacgtgaagaacatccacaagggcaagcacggaagcgattcaggcgtctacgattccaacggaagatttgttcctgaaaagtttgaggagattttcaagaagtatgcccacaccaggcctgatgcacttacaggcaaagagctacaggagatgctgcaagcaaacagggaacctaaagacttgaaaggatggctgggtggcttcacagagtggaaggtgctgtactccctctgcaaagacaaggacgggtttctccacaaagatactgtcagggcggtctacgatggcagcctgtttgaaaggttggagcaagagaggaactcaaagaaagaatcgagtaagaagaaatga

SEQ ID NO: 2490 - protein, 229 aa, Sorghum bicolor
  misc_feature: Ceres ANNOT ID no. 6024678
  misc_feature (42)..(217): Pfam Id: Caleosin Pfam Desc: Caleosin related protein
  misc_feature (44)..(229): NCBI GI: 145336050 NCBI Desc: caleosin-related family protein [arabidopsis thaliana]
  misc_feature (44)..(229): NCBI GI: 9295714 NCBI Desc: f26f24.9 [arabidopsis thaliana]
  misc_feature (32)..(226): NCBI GI: 37652831 NCBI Desc: calcium binding protein [fagus sylvatica]
  misc_feature (47)..(221): NCBI GI: 115451637 NCBI Desc: os03g0222600 [oryza sativa (japonica cultivar-group)]
  misc_feature (47)..(226): NCBI GI: 32488447 NCBI Desc: osjnba0004n05.4 [oryza sativa (japonica cultivar-group)]
MARHVLRGASFAIVTTVLMSVLGPGTNEVEESSSSSSSLADVYKGELTPLQRHVAFFDRNKDGIIYPSETYQGFRAIGCGVALSAAAAVFVNGGLGPKTVPENEKSAPFKLPIYVKNIHKGKHGSDSGVYDSNGRFVPEKFEEIFKKYAHTRPDALTGKELQEMLQANREPKDLKGWLGGFTEWKVLYSLCKDKDGFLHKDTVRAVYDGSLFERLEQERNSKKESSKKK

SEQ ID NO: 2491 - DNA, 642 bp, Sorghum bicolor
  misc_feature: Ceres ANNOT ID no. 6024680
  misc_feature: Encodes the peptide sequence at SEQ ID NO 2492
atggcagcagcttcttcatatttgccgccagtggtgacagcggttctgtttctatgggtcttctttagctgtgggcatgtggaggcaagtattcattttggcaacatgactgctcttcaaaagcacgttgaatttttcgaccggaataaggatggcattattacaccttcagagctcttccgaggatatgttgcacttggatgtgatgccgtatttgccagaaaaaaagccgcatctatgagtgctggtgttggtccaaaaacaagccctgttggtgcaccactgcctcatttatccatatacgtacaatatatccataaagcaatgcatggaagtgatacaggtgcatacgacgctgaaggaaggtttgttcctgcaaagtttgaagaaatattcacaaagcatgcaaaggtcaggccagatgcgttaacgtatgaggagattgaggagatgattctagcaaatcgagatccattagacccacaatcgtggtctgcaccagaaaaagaatggggactgatatacaagcttgcaagtgataagcaaggattccttcataaggactctacaagaggcatatatgatggaagtgtgttttacaagttggagaaactgaggatgtctgcaagatgtgatatgtga

SEQ ID NO: 2492 - protein, 213 aa, Sorghum bicolor
  misc_feature: Ceres ANNOT ID no. 6024680
  misc_feature (31)..(204): Pfam Id: Caleosin Pfam Desc: Caleosin related protein
  misc_feature (93)..(210): NCBI GI: 115467406 NCBI Desc: os06g0254300 [oryza sativa (japonica cultivar-group)]
  misc_feature (36)..(209): NCBI GI: 9295714 NCBI Desc: f26f24.9 [arabidopsis thaliana]
  misc_feature (36)..(209): NCBI GI: 145336050 NCBI Desc: caleosin-related family protein [arabidopsis thaliana]
  misc_feature (36)..(209): NCBI GI: 115451637 NCBI Desc: os03g0222600 [oryza sativa (japonica cultivar-group)]
  misc_feature (35)..(199): NCBI GI: 32488447 NCBI Desc: osjnba0004n05.4 [oryza sativa (japonica cultivar-group)]
MAAASSYLPPVVTAVLFLWVFFSCGHVEASIHFGNMTALQKHVEFFDRNKDGIITPSELFRGYVALGCDAVFARKKAASMSAGVGPKTSPVGAPLPHLSIYVQYIHKAMHGSDTGAYDAEGRFVPAKFEEIFTKHAKVRPDALTYEEIEEMILANRDPLDPQSWSAPEKEWGLIYKLASDKQGFLHKDSTRGIYDGSVFYKLEKLRMSARCDM

SEQ ID NO: 2493 - DNA, 624 bp, Sorghum bicolor
  misc_feature: Ceres ANNOT ID no. 6024683
  misc_feature: Encodes the peptide sequence at SEQ ID NO 2494
atggcgggtcggcaacgtgcaccggcagcagcttcttcatatttgcagccggtgatgccagcggttctgtttctatgggtctttagctgtcggcatgtggaggcaagcattgattttgccaacatgactgctcttcaaaagcacgttgaatttttcgaccggaataaggatggcattattacagcttcagagctctttgaaggatatgttgcaattggatgtgatgccgtatttgccagagattcattgcaggatgatgcaccactgcctcattcatccatatacgtagagtatatccataaagcaatgcatggaagtgatacaggtgcatacgacgctaaaggaaggtttgttcctgcaaagtttgaagaaatattcacaaagcatgcaaaggtcagaccagatgcactaacgttcgaggaaattgaggagatgattctagcaaatcgagatccattagaccctcaatcatggtctgcacctgaaggagaatggggactgatatacaagcttgcaagtgataagcaaggatttcttcacaaggactctgcaagaggcatatatgatggcagtgtgttttacaagttggaggagcagaggacgtctgcaagaagtgatatgtga

SEQ ID NO: 2494 - protein, 207 aa, Sorghum bicolor
  misc_feature: Ceres ANNOT ID no. 6024683
  misc_feature (37)..(198): Pfam Id: Caleosin Pfam Desc: Caleosin related protein
  misc_feature (77)..(205): NCBI GI: 115467406 NCBI Desc: os06g0254300 [oryza sativa (japonica cultivar-group)]
  misc_feature (37)..(205): NCBI GI: 9295714 NCBI Desc: f26f24.9 [arabidopsis thaliana]
  misc_feature (37)..(205): NCBI GI: 145336050 NCBI Desc: caleosin-related family protein [arabidopsis thaliana]
  misc_feature (38)..(203): NCBI GI: 115451637 NCBI Desc: os03g0222600 [oryza sativa (japonica cultivar-group)]
  misc_feature (41)..(200): NCBI GI: 32488447 NCBI Desc: osjnba0004n05.4 [oryza sativa (japonica cultivar-group)]
MAGRQRAPAAASSYLQPVMPAVLFLWVFSCRHVEASIDFANMTALQKHVEFFDRNKDGIITASELFEGYVAIGCDAVFARDSLQDDAPLPHSSIYVEYIHKAMHGSDTGAYDAKGRFVPAKFEEIFTKHAKVRPDALTFEEIEEMILANRDPLDPQSWSAPEGEWGLIYKLASDKQGFLHKDSARGIYDGSVFYKLEEQRTSARSDM

SEQ ID NO: 2495 - DNA, 1896 bp, Sorghum bicolor
  misc_feature: Ceres ANNOT ID no. 6024703
  misc_feature: Encodes the peptide sequence at SEQ ID NO 2496
atggaggaggagatccgagcggagttccagaatagcggcttctccatcgggggagccagctccgaggacgccgcccagattctctccacgctgctcacctactgcatcaactacaagatgagccccgcggacctcgtctccaactgggaggtctattacctcaacaggcaattggatggcttaaagcttgaaagctcatatcttgatggttttctgtcacatcttcagaatgaagttaaagaaaggataataaaagaagaagccaaccttcacatttactccagtaacgatgtcgacatgttagttccacatatcagattcatttacgtgctcttgagcaattcacatgcagatgaagtggcatttcatgacacgccaggctctaaacaggaaaagccacctgaagagtcatctaactctgagttaactcctctgacaagtgacagaccatcatccagcagagtggccaaaacaaatgctgatcgtattaccccttttgcaacacgagtaaataaatttacccaacagtatgttctcaatgctgataatgcagttagtgtgccaagtaaaaatgctgaaatcacagaagatgaagtaattagaagaattcaaccaagtcaaagatgttccttacaagttcagcgttcacagcctgaaccaggttgcagattcatgtatgacagaatggaagacagatttaattacttggaagatcggatacgaaaatcagcaagcttgttttctgcatctgggttttgtggacaacctgcagatgctacccttgcttcagaggagaaaatgtttgcagtcggtacagtagcttgtgatggggaaggtcatttgaatgaaaagtctatcttgctacagggcaggggacagcgtgtgcgccttgacttgaaggatcttgatcacttctctttgtttcctgggcaggtggtgggtatcgaaggccacaatcccagtggacactgttttgttgcatcaaaattaattgattccataccggtctctgtggatgctcaacttcctagtgctaagaaacaagctattgataatgaaagcaaccaaaattccgacgctggcactctgtcaagagcattgtcatcggtcatcgcagcaggtccctatacaacaaccgataatctgttgtttgaaccactgcaagaacttctttcatatgcttgtcgtaagcagcctcagctactcatattgatgggacccttcattgactctgatcatcctgacataaaaaaaggaactgttgaccagagctttcatgacattttccattttgaaattctgagaaagattcaagactttacccagtatctggggaacactgtccgtgtaattctcattccatcagtgcgtgatgctcaccatgactttgttttccctcagcctgcatttgatttgaattttccagaagatatcacacatcagattacttgtctggcaaatccatgcctcttcagttctaacgagatacattttggctgttgtacagtggacattctgaaacagctcagtggtgaggaaatttctcgcaagccacctgtcggaaagcctgcagacaggattggtagacttgcctcacacatattaaagcaacaaagttactatcctctatatccttctgctgctggtgtgccattagacttctcacttgctaaggaagcactggagatctcatcagcaccagatgttctccttcttccttctgatcttgcaccatttgtgaaggtgctttcccttggagaaggtagtgacgaccagaaacggtttatctgtgtgaaccctgggaggttggcaaagggtattggtgggggcacatttgtggagctttactacaatgagggcatcgacaagaccaacgcctccatcatccgcatatag

SEQ ID NO: 2496 - protein, 631 aa, Sorghum bicolor
  misc_feature: Ceres ANNOT ID no. 6024703
  misc_feature (370)..(581): Pfam Id: DNA_pol_E_B Pfam Desc: DNA polymerase alpha/epsilon subunit B
  misc_feature (235)..(631): NCBI GI: 115487992 NCBI Desc: os12g0242900 [oryza sativa (japonica cultivar-group)]
  misc_feature (2)..(631): NCBI GI: 30697540 NCBI Desc: dna polymerase alpha subunit b family [arabidopsis thaliana]
  misc_feature (292)..(593): NCBI GI: 11072016 NCBI Desc: f12a21.24 [arabidopsis thaliana]
  misc_feature (223)..(615): NCBI GI: 41107576 NCBI Desc: zgc:77841 protein [danio rerio]
  misc_feature (223)..(615): NCBI GI: 28279175 NCBI Desc: polymerase (dna-directed), alpha (70kd) [danio rerio]
MEEEIRAEFQNSGFSIGGASSEDAAQILSTLLTYCINYKMSPADLVSNWEVYYLNRQLDGLKLESSYLDGFLSHLQNEVKERIIKEEANLHIYSSNDVDMLVPHIRFIYVLLSNSHADEVAFHDTPGSKQEKPPEESSNSELTPLTSDRPSSSRVAKTNADRITPFATRVNKFTQQYVLNADNAVSVPSKNAEITEDEVIRRIQPSQRCSLQVQRSQPEPGCRFMYDRMEDRFNYLEDRIRKSASLFSASGFCGQPADATLASEEKMFAVGTVACDGEGHLNEKSILLQGRGQRVRLDLKDLDHFSLFPGQVVGIEGHNPSGHCFVASKLIDSIPVSVDAQLPSAKKQAIDNESNQNSDAGTLSRALSSVIAAGPYTTTDNLLFEPLQELLSYACRKQPQLLILMGPFIDSDHPDIKKGTVDQSFHDIFHFEILRKIQDFTQYLGNTVRVILIPSVRDAHHDFVFPQPAFDLNFPEDITHQITCLANPCLFSSNEIHFGCCTVDILKQLSGEEISRKPPVGKPADRIGRLASHILKQQSYYPLYPSAAGVPLDFSLAKEALEISSAPDVLLLPSDLAPFVKVLSLGEGSDDQKRFICVNPGRLAKGIGGGTFVELYYNEGIDKTNASIIRI

SEQ ID NO: 2497 - DNA, 1857 bp, Sorghum bicolor
  misc_feature: Ceres ANNOT ID no. 6024712
  misc_feature: Encodes the peptide sequence at SEQ ID NO 2498
atggctggaggcgacggcgctgcggcggcggcggcggccgtggagaaggcggtgaggtgcctcggcaggggcgtcgacatgacgggagacctgagactgaagcactgcaaggatgcggggggctgcctggtcctgaggaccggcgagaaggcggcggcggcggcggagaaggtcgtcgtgccgggctttggagtcgtcgccgatgtgcccgccgacgtcaagtgcggcaagggcgaccggatcaggttcaagtccgacgtgctcgagttcaacaagatgtctgaggtgttcaaccaccggaattcgctgacggggaagatcccgtcggggctcttcaactcgtgcttcgacctggagagcagctcctgggccgacgacgcctccgccaccaagtgcctcgccttcgacggctacttcatctccctcctcgacctccgcctcgactgccgcccgctcgccctcgccgaccacgtcgtccgtgacgtgccggcggcgtgggacccgtcagccatagcaagtttcatcgagaagtatgggacccacatcattgttgggctgggtttgggtggccaggatgtggtgtatgtgaagcaggacaactcgtctccactgtccccatctgagatcaaggagcacttggacaggctaggtgaccagctcttcactgggacatgcactctgcccccttcaaaccgcaaaaacagggaccacaaatttaaggtccctgaggcctttaatgtatttgatgcccaagtgacacagcaaagacttcacggaatgattactccagtgtcctgcaaagagggtgtgacggtgatatactccaagaggggagggaatgcagcggcgagcgaccactcagagtggctgctaactgtgcccacaatgccagatgcaataaacttcaagcttgtgcccatcacatcccttctcaaaggagtaactggcgtgggcttcctctctcatgccatcaacctatatctcagatacaaacctcaaatagaagatttgaggtacttcctggacttccagcaccacagattgtgggctccagtactcagtgatctaccacttggtccctgctcaaaccgacaaggtgccagtccagccttgaacttcagccttgtaggttcaaagctatatgtcagctcaagcgaggtgattgttccaagattaccagtcaccgggatgagattacatctggagggcaagaaaaataaccggttaggcatccacctgcaacatttgtcaaacaacccaacgttcatcgatgaaagatcagccaagccgccgatatggcggggatcggagatgatctccgacgagcgatactatgagccggtccagtggagaatgtttgcccacgtctgcacagtgccggtgaagtacgaccctcgctgggccagcgccggctcgccgtcggcggcgtacatcgtctccggcgcccagctgcacgtgaaggtccacgactcgaccaacatcctgcacctcaggctcctgtacacgcagctgccggggcacgccgtggtgcagtccaaatgggcgcacaacacggcgaggctgtcggggaaagggagcttcctgtccaagtcgttggcggcgtccttgggcgccggcggcgttgacaaggagcagcagcacccggcgaggattcacatcgactccgccgtgttcgccggaggaccaccggtgccggtcgggacccagaggctgctcaagtttgtcgagacgtctcaggtgaccatgggcccacaggacagtcctggatactggctggtcactggcgccaagctggatgttgaaaaggggaagatctcgcttcacgtcaagttttccctgcttgctccagtttcttga

SEQ ID NO: 2498 - protein, 618 aa, Sorghum bicolor
  misc_feature: Ceres ANNOT ID no. 6024712
  misc_feature (130)..(329): Pfam Id: MACPF Pfam Desc: MAC/Perforin domain
  misc_feature (14)..(329): NCBI GI: 8778214 NCBI Desc: f10b6.18 [arabidopsis thaliana]
  misc_feature (14)..(614): NCBI GI: 92895124 NCBI Desc: membrane attack complex component/perforin/complement c9 [medicago truncatula]
  misc_feature (13)..(617): NCBI GI: 92875831 NCBI Desc: membrane attack complex component/perforin/complement c9 [medicago truncatula]
  misc_feature (267)..(553): NCBI GI: 140053390 NCBI Desc: aldehyde oxidase and xanthine dehydrogenase, a/b hammerhead; membrane attack complex component/perforin/complement c9 [medicago truncatula]
  misc_feature (262)..(517): NCBI GI: 14209545 NCBI Desc: p0481e12.26 [oryza sativa (japonica cultivar-group)]
MAGGDGAAAAAAAVEKAVRCLGRGVDMTGDLRLKHCKDAGGCLVLRTGEKAAAAAEKVVVPGFGVVADVPADVKCGKGDRIRFKSDVLEFNKMSEVFNHRNSLTGKIPSGLFNSCFDLESSSWADDASATKCLAFDGYFISLLDLRLDCRPLALADHVVRDVPAAWDPSAIASFIEKYGTHIIVGLGLGGQDVVYVKQDNSSPLSPSEIKEHLDRLGDQLFTGTCTLPPSNRKNRDHKFKVPEAFNVFDAQVTQQRLHGMITPVSCKEGVTVIYSKRGGNAAASDHSEWLLTVPTMPDAINFKLVPITSLLKGVTGVGFLSHAINLYLRYKPQIEDLRYFLDFQHHRLWAPVLSDLPLGPCSNRQGASPALNFSLVGSKLYVSSSEVIVPRLPVTGMRLHLEGKKNNRLGIHLQHLSNNPTFIDERSAKPPIWRGSEMISDERYYEPVQWRMFAHVCTVPVKYDPRWASAGSPSAAYIVSGAQLHVKVHDSTNILHLRLLYTQLPGHAVVQSKWAHNTARLSGKGSFLSKSLAASLGAGGVDKEQQHPARIHIDSAVFAGGPPVPVGTQRLLKFVETSQVTMGPQDSPGYWLVTGAKLDVEKGKISLHVKFSLLAPVS

SEQ ID NO: 2499 - DNA, 1374 bp, Sorghum bicolor
  misc_feature: Ceres ANNOT ID no. 6024713
  misc_feature: Encodes the peptide sequence at SEQ ID NO 2500
atgggtgagcgggcgaaggaatggctcctcgccgccggcgccggcgtcgccgtcggcgcgctctctgccgccgtcatgaatcacctctcgagatccaagcggagagaggggtacgcgcgcaacctgctggaatccaatagaatgacgactgggaacgctcagtccacgaggcatctgggtgctgttggtagcttggatcttctctctgatgaagtggtctccgaacagcttacaaggaatatacaattttttggcattgactctcagaagaaagtgactaaatcctatgttgtggtcattggtcttggaggggttggcagtcatgcagcttcaatgctcctgagatctggtgttggcaggttgcttcttgtggattttgatcaggtatcactctcatcactaaatcggcatgctgtggcaaccagagatgatgttggaacttcaaaagcattatgcctcaagaagcatttttcaatgatatacccagagtgccaaatagatgcaaaagtgcaattgtatgatgcatcgtctgaggcggaaattctttctggacagcctgactttgttcttgattgcatagataacattgataccaaggtggcactccttgcagcttgcgtgcgcagaggtttgaaggtactttctgcaatgggggctggagcacgagctgatcccaccagaattcgtgttgcagatttaagagaatcaagcaatgattccctctctcgatcggtgaggtacaggctcaagaaagaacatggaattgagggtggaataccagtagttttttcattggaaaagccaaaggcaaagctgcttccttttcaagcttcaaaagaagaggaaactccatcagattaccagattgtgccaggattcagggttcgcattataccagtactgggaaccatccctgcaatatttggtcaagttatggcctcctatgtgattactcagcttgctggattagattttcaaactgaaccagttgttaacctggatttggatcattaccgtatacttcatcagcgtcttattgagcatgaagagctgatttatgggacagccgagcaagttctggtagatgctgaagaggtaatgtacattgtcaaagaattgtggcgaggtcgaagtgctagagaccaaagtcagaaggacactggtcggaaaatgtggagatctgtcaatgaactaatgcttgttcggtgggacaaatcaaaggctgctggcatctcaaacttaatacttctcaagtttagtgaggctgacgcccatgaatccaccacactggagcgaatacaagaagaagaacctgaattctactctatggtttcacgtgtcctgaaacgagctgagatggagtttgccttatga

SEQ ID NO: 2500 - protein, 457 aa, Sorghum bicolor
  misc_feature: Ceres ANNOT ID no. 6024713
  misc_feature (93)..(228): Pfam Id: ThiF Pfam Desc: ThiF family
  misc_feature (1)..(421): NCBI GI: 115467390 NCBI Desc: os06g0251000 [oryza sativa (japonica cultivar-group)]
  misc_feature (1)..(455): NCBI GI: 145334657 NCBI Desc: thif family protein [arabidopsis thaliana]
  misc_feature (1)..(455): NCBI GI: 42568166 NCBI Desc: thif family protein [arabidopsis thaliana]
  misc_feature (1)..(439): NCBI GI: 89286905 NCBI Desc: thif family protein [tetrahymena thermophila sb210]
  misc_feature (69)..(456): NCBI GI: 126131488 NCBI Desc: ubiquitin--protein ligase molybdopterin-converting factor [pichia stipitis cbs 6054]
MGERAKEWLLAAGAGVAVGALSAAVMNHLSRSKRREGYARNLLESNRMTTGNAQSTRHLGAVGSLDLLSDEVVSEQLTRNIQFFGIDSQKKVTKSYVVVIGLGGVGSHAASMLLRSGVGRLLLVDFDQVSLSSLNRHAVATRDDVGTSKALCLKKHFSMIYPECQIDAKVQLYDASSEAEILSGQPDFVLDCIDNIDTKVALLAACVRRGLKVLSAMGAGARADPTRIRVADLRESSNDSLSRSVRYRLKKEHGIEGGIPVVFSLEKPKAKLLPFQASKEEETPSDYQIVPGFRVRIIPVLGTIPAIFGQVMASYVITQLAGLDFQTEPVVNLDLDHYRILHQRLIEHEELIYGTAEQVLVDAEEVMYIVKELWRGRSARDQSQKDTGRKMWRSVNELMLVRWDKSKAAGISNLILLKFSEADAHESTTLERIQEEEPEFYSMVSRVLKRAEMEFAL

SEQ ID NO: 2501 - DNA, 2568 bp, Sorghum bicolor
  misc_feature: Ceres ANNOT ID no. 6024726
  misc_feature: Encodes the peptide sequence at SEQ ID NO 2502
atggggagggggccgctggggtcgaagcggagggtggcggagggcgagacggagccggaggaggaggaggaggagtcggcggcggagtacgaggtggaggaggtgcgcgaccacatcgcctcctcccgcggcagccgcctcgcgctcttcggctccgacctccgcctcggccgcttccgcccgcgccgccgcaccaggcgccgcctgctcgccggggaagtaggcgccgtcgagggcttcttccacgacctcgtcatccaccccgacaacaagtggtatcgattatggaccaagttcatactggtttgggcagtgtacagttccttcttcacgcccctagaatttggcttctacagaggactcccaaaaaacctctttttcctggatatagctggacagattgcattccttatcgacattgttgtgaaattttttgtggcataccgtgacccagacacatatcgaattgtctacaatcccactgctattgccctccggtattgcaaatcaagcttcatttttgatcttcttggctgcttcccatgggatgttatctacaaggcttgtggaagtaaagaagaagtaagatacctgctgtggattcgcttgacacgggttacaaagattacagagttcttctggcgtttagaaaaggacatacgtgtcaactaccttttcactaggatagtgaagctcatagttgtggaactctactgtacacacacagcagcctgtatcttctattacctggctacgacacttcctgaatcaatggaaggatatacgtggattgggagtttgcagttgggggactacaagtttacacatttcagggagatcgatcttgtcacacgctatataacatcattatactttgccattgtcaccatggcaactgttggttatggtgacattcatgctgtcaacataagggagatgatattcatcatgatctatgtttcctttgacatgattctaggagcttacctgatcggtaacatgactgccctcatcgtgaaaggctcgagaactgagcggtttagggacaagatgaaagaagtgatcaggtatatgaacagaaataaacttggaaaggaaataagagaacagatcaaaggacatttgaggttgcagtatgagagcagctacactgaagcttccgtccttcaggatatcccgatttctatccgtgcaaagatttctcaaacactgtataagccatatatcgaaagcattccactgttcaagggatgttccgcagagttcattcaacagattgtgatcaggttgcaagaggagttcttcctaccaggagaagtgattttggagcaaggaagtgcagtcgatcagttatacttcgtctgccacggtgcactggaaggtgttggcatcggtgaagacggacaagaagagactctgctgatgctggagccagagagctccttcggcgagatctcaatcctctgcaacatcccgcagccctacacggtccgcgtctgtgagctctgccggctcctgcgtctcgacaagcagtccttcaccaacatcctggagatctacttcgtcgacgggaggaggatcctgagcaatctctccgagagcgagtatggcggacgggtgaagcagctggaatcggacatcacgttccacatcgggaagcaggaggcggagctcaccctgcgggtcaacagcgcagccttctacggggacctgaaccagctgaaaagcctgatccgggcaggggctgatcccaagaacaccgactacgacggccgctcccctctgcatctcgcggcttccagagggtacgaggacgtcgtgcaattcctcatcaacgaaggcgttgacatcgaccataccgcagaccaatttgggaacacgccgttgctggaggcagtgaagcaggggcacgaacgggtggcagctctgctcttcaccaagggtgccaagctgaacctcaagaacgccggcagccacctgtgcacggcggtcgccaagggtgactcggacttcatccgtcgcgccctggcctacggcgccgacccaaactgcagggactacgaccaccgcacgccgctccacatcgccgccgccgagggcctctacctcatcgccaagatgcttgtcgaggccggcgccagcgtgttcgccacagacagatggggcaccactccgctggacgaagcgcgcaagtgcggcggccgcacgctgggggcgctgctggaggaagcgcgggccaacgagctggccatgttcccagagcgcggcgaggaagtgagggacaagatgcacccgcgacggtgctcggtgttcccgtaccacccgtggcgggcggcgggcacaggcgaggagcgccggcgtatggagggggtggtgctgtggatcccgcacaccatcgagagcctggtcgcgtcggcgcaggagaagctcgagttgccgggcccggcttcgcggctgcggctgctgtgcgaggacggggccagggtgctcgacgtcgacatggtcaatgacggccagaagctctacctggtcggaggcgaggacggcgatcagaaagatggtcagtag

SEQ ID NO: 2502 - protein, 855 aa, Sorghum bicolor
  misc_feature: Ceres ANNOT ID no. 6024726
  misc_feature (590)..(622): Pfam Id: Ank Pfam Desc: Ankyrin repeat
  misc_feature (624)..(656): Pfam Id: Ank Pfam Desc: Ankyrin repeat
  misc_feature (688)..(720): Pfam Id: Ank Pfam Desc: Ankyrin repeat
  misc_feature (432)..(522): Pfam Id: cNMP_binding Pfam Desc: Cyclic nucleotide-binding domain
  misc_feature (128)..(334): Pfam Id: Ion_trans Pfam Desc: Ion transport protein
  misc_feature (262)..(340): Pfam Id: Ion_trans_2 Pfam Desc: Ion channel
  misc_feature (78)..(855): NCBI GI: 58825796 NCBI Desc: potassium outward rectifying channel [zea mays]
  misc_feature (22)..(843): NCBI GI: 6728977 NCBI Desc: stelar k+ outward rectifying channel (skor) [arabidopsis thaliana]
  misc_feature (22)..(843): NCBI GI: 3810676 NCBI Desc: skor [arabidopsis thaliana]
  misc_feature (29)..(843): NCBI GI: 3641845 NCBI Desc: stelar k+ outward rectifying channel [arabidopsis thaliana]
  misc_feature (86)..(844): NCBI GI: 27651624 NCBI Desc: shaker-like potassium channel [vitis vinifera]
  misc_feature: The sequence is a functional homolog of SEQ ID NO 1838 in the 10/374,780US patent application
  misc_feature: Useful for making plants with modulated growth and phenotype characteristics
  misc_feature: The sequence is a functional homolog of SEQ ID NO 1838 in the 20060162006 US patent application
  misc_feature: The sequence is a functional homolog of SEQ ID NO. 503 in the 11/188,298 US application
MGRGPLGSKRRVAEGETEPEEEEEESAAEYEVEEVRDHIASSRGSRLALFGSDLRLGRFRPRRRTRRRLLAGEVGAVEGFFHDLVIHPDNKWYRLWTKFILVWAVYSSFFTPLEFGFYRGLPKNLFFLDIAGQIAFLIDIVVKFFVAYRDPDTYRIVYNPTAIALRYCKSSFIFDLLGCFPWDVIYKACGSKEEVRYLLWIRLTRVTKITEFFWRLEKDIRVNYLFTRIVKLIVVELYCTHTAACIFYYLATTLPESMEGYTWIGSLQLGDYKFTHFREIDLVTRYITSLYFAIVTMATVGYGDIHAVNIREMIFIMIYVSFDMILGAYLIGNMTALIVKGSRTERFRDKMKEVIRYMNRNKLGKEIREQIKGHLRLQYESSYTEASVLQDIPISIRAKISQTLYKPYIESIPLFKGCSAEFIQQIVIRLQEEFFLPGEVILEQGSAVDQLYFVCHGALEGVGIGEDGQEETLLMLEPESSFGEISILCNIPQPYTVRVCELCRLLRLDKQSFTNILEIYFVDGRRILSNLSESEYGGRVKQLESDITFHIGKQEAELTLRVNSAAFYGDLNQLKSLIRAGADPKNTDYDGRSPLHLAASRGYEDVVQFLINEGVDIDHTADQFGNTPLLEAVKQGHERVAALLFTKGAKLNLKNAGSHLCTAVAKGDSDFIRRALAYGADPNCRDYDHRTPLHIAAAEGLYLIAKMLVEAGASVFATDRWGTTPLDEARKCGGRTLGALLEEARANELAMFPERGEEVRDKMHPRRCSVFPYHPWRAAGTGEERRRMEGVVLWIPHTIESLVASAQEKLELPGPASRLRLLCEDGARVLDVDMVNDGQKLYLVGGEDGDQKDGQ

SEQ ID NO: 2503 - DNA, 1308 bp, Sorghum bicolor
  misc_feature: Ceres ANNOT ID no. 6024764
  misc_feature: Encodes the peptide sequence at SEQ ID NO 2504
  misc_feature: Up-regulated in root tissues in response to methyl jasmonate treatment
atggatgcccccgcccccgcccccgcccccggacctttcttctccggcgccgagtccaccgcggccgccgcccaggcgtccacgaccggagcccagccgccgccggtggatccgcaggcgcacgtgcccgtgcagggcgccggcgccgggagcggcagcggcgtcgcgcgaggctgccggcaccacgcgtacagccgcaagcagaagtcgctcggccttctctgctccaacttcgtggcgctgtacgaccgggaggacgtggaggtgattgggctggacgacgcggcaaagcggctcggcgtcgagcgccgccggatctacgatatcgtcaacgtcctcgagagcgtcgggattcttgtgcggagggccaagaatcggtatacatggctcggattcgggggagtccctgccgcgctgaaagaactcaaggagagggcgttaagggagatgtctggattaccggtgttactgccaatggaggactcctctactgccaacgttaatgatgaggatgatgaaaaactaggcgatgctgatgaagatgctgagagcgagaagctcagccagtctgttgacaatacgtctgataagcctgatgcacccagttgccgccttagatctgatcatcggaaggagaagtcccttgggctcctcactcagaattttgtcaagctcttcctcaccatggaggttgagacaatctcacttgacgaagctgcaaagcttctccttggagagggacatgcagagagcaacatgagaaccaaagttcgtcgattgtatgacattgccaatgtgctgtcttctttgaacctcattgagaagacacagcaagcagacacaagaaaacctgcgttccggtggctaggccaggcaaagcgaaagcaagagaacaatgtcatggttgctctacctccatccaggaaggcaatgcccaataagagagcatttggtactgatcttacaaacatggacaataagcgaggcaagttagacacttcagcggagaacaaagtcaagctcatgcagggtgctggcaacatagtgaagacttttgagaggcagctggggcaagggaaaaggagtgactttgtttatgggcccttccaccctgctagtgcaaagaaacaggaaactgatgatcaaaccgttaagcagcaggagaggaagaccattcaggactgggaaaaccttgctgtgtccttccgtccacaatatcagaatcaagccctgaacgatctgtttggccattatgtggaagcatggaaatcatggtacttggaccttacccgggaaacgagatcatga

SEQ ID NO: 2504 - protein, 435 aa, Sorghum bicolor
  misc_feature: Ceres ANNOT ID no. 6024764
  misc_feature (66)..(131): Pfam Id: E2F_TDP Pfam Desc: E2F/DP family winged-helix DNA-binding domain
  misc_feature (210)..(290): Pfam Id: E2F_TDP Pfam Desc: E2F/DP family winged-helix DNA-binding domain
  misc_feature (21)..(435): NCBI GI: 86129712 NCBI Desc: transcription regulator of the cell cycle tae2fe [triticum aestivum]
  misc_feature (17)..(431): NCBI GI: 46390563 NCBI Desc: transcription factor-like [oryza sativa (japonica cultivar-group)]
  misc_feature (60)..(409): NCBI GI: 92893590 NCBI Desc: transcription factor e2f/dimerisation partner (tdp) [medicago truncatula]
  misc_feature (65)..(307): NCBI GI: 119617744 NCBI Desc: e2f transcription factor 7, isoform cra_a [homo sapiens]
  misc_feature (65)..(307): NCBI GI: 145580626 NCBI Desc: e2f transcription factor 7 [homo sapiens]
  misc_feature: Up-regulated in root tissues in response to methyl jasmonate treatment
  misc_feature: The sequence is a functional homolog of SEQ ID NO. 416 in the 11/188,298 US application
MDAPAPAPAPGPFFSGAESTAAAAQASTTGAQPPPVDPQAHVPVQGAGAGSGSGVARGCRHHAYSRKQKSLGLLCSNFVALYDREDVEVIGLDDAAKRLGVERRRIYDIVNVLESVGILVRRAKNRYTWLGFGGVPAALKELKERALREMSGLPVLLPMEDSSTANVNDEDDEKLGDADEDAESEKLSQSVDNTSDKPDAPSCRLRSDHRKEKSLGLLTQNFVKLFLTMEVETISLDEAAKLLLGEGHAESNMRTKVRRLYDIANVLSSLNLIEKTQQADTRKPAFRWLGQAKRKQENNVMVALPPSRKAMPNKRAFGTDLTNMDNKRGKLDTSAENKVKLMQGAGNIVKTFERQLGQGKRSDFVYGPFHPASAKKQETDDQTVKQQERKTIQDWENLAVSFRPQYQNQALNDLFGHYVEAWKSWYLDLTRETRS

SEQ ID NO: 2505 - DNA, 666 bp, Sorghum bicolor
  misc_feature: Ceres ANNOT ID no. 6024765
  misc_feature: Encodes the peptide sequence at SEQ ID NO 2506
atggcggcccggtgctacgcagctgcctccgtggtcagagcaggagcgcacgacctctccctctccccctcctccttttccgtcacagccgcggcgcgtccgaggccggtaggaggagtgtgggcctgcggtggagccggaggagggtacagctggctccgcgccgtccgcgccatgggctccgcgccgtcgtcgtcgtcgtcgcaatccccgtcgccgcaaacgccttcaggacaaacccaagggaaagcagattatacatcactgagtgaagaggagtggaagaagcgcctgactaaagagcagtattatgttactcggcagaagggtactgagagagcattcactggggaatactggaatactaaaaccccaggcatttatcactgtgtctgctgcgacacccctctgtttgagtcatcaaccaaatttgatagtggtactggatggccatcctactataaaccaattggcgaaaatgtcaagagcaagcttgatatgtcaatcattttcatgccccggaccgaggtgctctgcgccgcctgtgatgctcatctggggcatgtctttgatgacgggccaccaccaacagggcagagatactgtatcaacagtgcatctctgaaattgaagcctcagtcgctggatcctttaggaagaagttaa

SEQ ID NO: 2506 - protein, 221 aa, Sorghum bicolor
  misc_feature: Ceres ANNOT ID no. 6024765
  misc_feature (91)..(213): Pfam Id: SelR Pfam Desc: SelR domain
  misc_feature (24)..(211): NCBI GI: 115468042 NCBI Desc: os06g0472000 [oryza sativa (japonica cultivar-group)]
  misc_feature (90)..(214): NCBI GI: 81300999 NCBI Desc: methionine sulfoxide reductase b [synechococcus elongatus pcc 7942]
  misc_feature (90)..(214): NCBI GI: 32129749 NCBI Desc: peptide methionine sulfoxide reductase msrb
  misc_feature (89)..(212): NCBI GI: 108803505 NCBI Desc: protein-methionine-s-oxide reductase [rubrobacter xylanophilus dsm 9941]
  misc_feature (90)..(209): NCBI GI: 113477493 NCBI Desc: methionine-r-sulfoxide reductase [trichodesmium erythraeum ims101]
  misc_feature (90)..(214): SWISSPROT Homolog: EC 1.8.4.12 Peptide methionine sulfoxide reductase msrB
  misc_feature: The sequence is a functional homolog of SEQ ID NO 12 in US patent 7220585
  misc_feature: The sequence is a functional homolog of SEQ ID NO. 421 in the 11/188,298 US application
MAARCYAAASVVRAGAHDLSLSPSSFSVTAAARPRPVGGVWACGGAGGGYSWLRAVRAMGSAPSSSSSQSPSPQTPSGQTQGKADYTSLSEEEWKKRLTKEQYYVTRQKGTERAFTGEYWNTKTPGIYHCVCCDTPLFESSTKFDSGTGWPSYYKPIGENVKSKLDMSIIFMPRTEVLCAACDAHLGHVFDDGPPPTGQRYCINSASLKLKPQSLDPLGRS

SEQ ID NO: 2507 - DNA, 3522 bp, Sorghum bicolor
  misc_feature: Ceres ANNOT ID no. 6024767
  misc_feature: Encodes the peptide sequence at SEQ ID NO 2508
atgcctttcttctccggcagcggcgggggccgctccggcgcgctactccccaccacctccaagccgaaggcgcaccaccacctccgttccaagtcctccctctccgcgccggcctcctcccgccgccgcgggggcggcctccactccgcgtcctccccttactcccgccgcgccctctgcctcgccgcgaccgccttcgccgcgctcttcatcctcgccttcctccgcctcggcttcccttcctcccgctccgccgcgctgtcttcccccgcccgcccccgcgcgcgcctcacccgcaggcccgccttccgcctccgggactcggccgcggccgaggccgcggcggccgccgtcgcggcacggatcggccgcgaggcgcccgtggatatcacgaccagggacctctacgaacggatcgagttcagcgacgaagacggcggcgcgtggaagcaggggtgggaggtcaagtacaggggcgacgagtgggacgccgagaagctcaaggtcttcgtcgcgccgcactcgcacaacgaccccggatggatccgcaccgtcgaggagtactacgagcgccagtcgcgccacatcctcgacaccatcgtcgagtccctctccaaggattcgcggaggaagttcatatgggaggagatgtcgtacctggagaggtggtggcgcgacgcgacgcccaagaagcaagaggcattcgctaagcttgtccgtgacgggcagctcgaaatcgtgagcggcggatgggtcatgaacgacgagattatggaggggaacatgtggctcaatgatactattggagttattcctaagaattcttggtcaattgatccatttggttattcatctacaatggcatatttgctaaggagaatgggtttccataacatgttaatccagagaacgcactatgaggtgaaaaaggagcttgcaatgaaaaaaaatcttgaatatttgtggaggcagaactgggatattgaagaaacaactgacatatttgttcacatgatgcccttctattcttatgatattccacacacgtgtggaccagaaccagctatctgctgccagtttgacttcgctcgaatgcgtggtttcagttatgaatcgtgcccatggagatttgatcctgttgagacaaatcctgacaatgtgaaagagagagcaacaaagcttctagaccagtacaggaaaaaatcaaccctgtatagaacgaatacacttctcgttcctttgggtgatgatttccgatatgttagtgtggaggaagcagaagtacaattccgcaattatgagaaactctttgattacataaactcaaatccgcatcttaacgccgaagtcaaatttggtaccttggaggattacttctccacattgagagatgaagctgaaaagataaactatacacggccaggtgaattgggttctgctgagctgcaaggttttccaacactttcaggggatttctttacatatgctgatagaaatcaggattactggagtggttactatgtgtcaaggccattcttcaaagctgttgatcgtgtactagaacagacgctccgtgcctcagagattctgggttcatttgttctaggatactgtcagaagtttcagtgtgcaaagctccctatcagcttctcacacaaactgacagcagcgaggaggaatttggcgctttttcagcatcatgatggggtaactggaacagctaaagatcatgttgtggtggactatgggactcgaatgcacacttcactgcaagatctacagttatttatgtccagggcagtcgaagtgcttttaggagatttccacgatagatctgatcctacattgttatcacatttcgagcctgtgcaggaacggtcaaagtatgatgttcagccggtgcatagggttcttcaccctgatgaaggtaaggcacagtcagttgtcttttttaacccattagaacagacaagggatgaggttgttatggttgttgtaagtactccggatgtttctgttctcaattcgaatgggtcctgtttgccaagtcaagtttcccctgagtggcagtttgtcagcaatgaaaagatttcgactggtcggcaccgcctttattggagagcttctgttcctccactaggtttggagacctactatgtggttactgggcaggattgtgaaaaagctattcctgctgtagtaaaaagatacacagctgcacaggaatttccttgccctgaaccataccattgttcaaagctggaaggcaaaacagtggagatgaagaactccaattacactctttcttttgatacaagtcacggtcttcttcagacagtaacccgccacaaggatggggaacaaactgtgataggtgaagaaattggcatgtacagaagccatggaagcggggcatacttgttcaaaccagttggggaagctcgttcaattgtcgaaggaggaggacatttcatccttactgaaggaccattggttcaagaagcccattctcttccaaagacggagtggcatgagtcacctctctcacatagtacacgtatgtacaattgtggagactctgtacaggacatgctgatcgagaaggaataccatgttgagcttgttggccatgcttttaatgataaggaactgattgtcagatacaagacagatattgacaaccaaaggatcttctattctgatctaaatggttttcagatgagtaggaggcagacatatgataagattcctctacagggaaattattacccaatgccatcacttgccttcttgcaggattcacatggtaaacggttttctgtacactccaagcagtcattgggtgcagcaagcttgaaaaatggatggctggagattatgttggatcgtaggttggttcaggatgatggccgtggtcttgggcagggagtaatggacaatcggcccatgaatgttatatttcatctcctcatggagtccaatgtctcagctttgcctaaaacccacagtttgcttactcttcaaccttccctcctctcgcaccgtgttggggcacacctgaactacccaatgcatgcttttatgagcaaaaaacctcatggaaaatccttcaagctggctcaacagtcatttgctccattagctgcttctttgccttgcgatgtacatattgtgaacctgaaggtccctcagcccctaagatttcctcacaccgaagcagcagaaccaagatttgctgttctgttgcagaggagaggctgggacgcatcatactgtaaaaggggtggactgcagtgtacaacagttggggaagagccagtaaatctgttctacatgttcaaagatttgtcagctgtgaatgtgaaggcaacttcgctgaacctcttacatgatgaccctgaaatgctaggttaccttgaacagatcggtgatgttgctcaggagggaaacgttcttatctcaccaatggagattcaggcatacaagttagacctacaaccaccatcaacacaggaagagtag

SEQ ID NO: 2508 - protein, 1173 aa, Sorghum bicolor
  misc_feature: Ceres ANNOT ID no. 6024767
  misc_feature (168)..(497): Pfam Id: Glyco_hydro_38 Pfam Desc: Glycosyl hydrolases family 38 N-terminal domain
  misc_feature (646)..(1162): Pfam Id: Glyco_hydro_38C Pfam Desc: Glycosyl hydrolases family 38 C-terminal domain
  misc_feature (501)..(586): Pfam Id: Alpha-mann_mid Pfam Desc: Alpha mannosidase, middle domain
  misc_feature (5)..(1167): NCBI GI: 9755662 NCBI Desc: alpha-mannosidase-like protein [arabidopsis thaliana]
  misc_feature (197)..(1167): NCBI GI: 140053754 NCBI Desc: glycoside hydrolase, family 38; galactose mutarotase-like [medicago truncatula]
  misc_feature (262)..(1167): NCBI GI: 38260678 NCBI Desc: glycosyl hydrolase [arabidopsis arenosa]
  misc_feature (100)..(1130): NCBI GI: 51477716 NCBI Desc: mannosidase, alpha, class 2a, member 2 [homo sapiens]
  misc_feature (134)..(1101): NCBI GI: 123232701 NCBI Desc: novel protein similar to vertebrate mannosidase, alpha, class 2a, member 1 (man2a1) [danio rerio]
MPFFSGSGGGRSGALLPTTSKPKAHHHLRSKSSLSAPASSRRRGGGLHSASSPYSRRALCLAATAFAALFILAFLRLGFPSSRSAALSSPARPRARLTRRPAFRLRDSAAAEAAAAAVAARIGREAPVDITTRDLYERIEFSDEDGGAWKQGWEVKYRGDEWDAEKLKVFVAPHSHNDPGWIRTVEEYYERQSRHILDTIVESLSKDSRRKFIWEEMSYLERWWRDATPKKQEAFAKLVRDGQLEIVSGGWVMNDEIMEGNMWLNDTIGVIPKNSWSIDPFGYSSTMAYLLRRMGFHNMLIQRTHYEVKKELAMKKNLEYLWRQNWDIEETTDIFVHMMPFYSYDIPHTCGPEPAICCQFDFARMRGFSYESCPWRFDPVETNPDNVKERATKLLDQYRKKSTLYRTNTLLVPLGDDFRYVSVEEAEVQFRNYEKLFDYINSNPHLNAEVKFGTLEDYFSTLRDEAEKINYTRPGELGSAELQGFPTLSGDFFTYADRNQDYWSGYYVSRPFFKAVDRVLEQTLRASEILGSFVLGYCQKFQCAKLPISFSHKLTAARRNLALFQHHDGVTGTAKDHVVVDYGTRMHTSLQDLQLFMSRAVEVLLGDFHDRSDPTLLSHFEPVQERSKYDVQPVHRVLHPDEGKAQSVVFFNPLEQTRDEVVMVVVSTPDVSVLNSNGSCLPSQVSPEWQFVSNEKISTGRHRLYWRASVPPLGLETYYVVTGQDCEKAIPAVVKRYTAAQEFPCPEPYHCSKLEGKTVEMKNSNYTLSFDTSHGLLQTVTRHKDGEQTVIGEEIGMYRSHGSGAYLFKPVGEARSIVEGGGHFILTEGPLVQEAHSLPKTEWHESPLSHSTRMYNCGDSVQDMLIEKEYHVELVGHAFNDKELIVRYKTDIDNQRIFYSDLNGFQMSRRQTYDKIPLQGNYYPMPSLAFLQDSHGKRFSVHSKQSLGAASLKNGWLEIMLDRRLVQDDGRGLGQGVMDNRPMNVIFHLLMESNVSALPKTHSLLTLQPSLLSHRVGAHLNYPMHAFMSKKPHGKSFKLAQQSFAPLAASLPCDVHIVNLKVPQPLRFPHTEAAEPRFAVLLQRRGWDASYCKRGGLQCTTVGEEPVNLFYMFKDLSAVNVKATSLNLLHDDPEMLGYLEQIGDVAQEGNVLISPMEIQAYKLDLQPPSTQEE

SEQ ID NO: 2509 - DNA, 1140 bp, Sorghum bicolor
  misc_feature: Ceres ANNOT ID no. 6024781
  misc_feature: Encodes the peptide sequence at SEQ ID NO 2510
atgagaatcgagcgtgatctccacatggctacagggaatggagaaactagctacacaaaaaattctaggattcaagagaaagctatgtttcacatgaagccggtccttgaggaggccactagagaagtatacacagctctcctccctaaaaccatggtggtggccgacttaggctgctcatcggggcctaacacactgcgcttcgtctccgaggtgattggcatcatagctcgccattgcaaggaacttgacgaccgacgacatgaccgcccgccgcagcttcagttcttcctcaatgaccttcccggaaatgacttcaacaatctcttccagctgatccagcagttccataagtcgacggcaagaaagcacaagggtgaggcagaagaggcactgcctccttgctatatcaccgggttgccgggttcctactacactaggatcttccctagtgaaagtgttcacctgttccactctttgttctgccttcagtggcgctctcaggcaccggagcaactgaagggcaccaaaaaaacatgcctagatatctacatcacaaagactatgtcaccgtcgatggtgaagctgtttcaacagcagtttcagaaggacttctccctcttcctcaagctacgctacgaggagctcgtgtctggcggccaaatggttctaacatttattggaaggaagcatgaggatgtgctcactggagagtctaaccatctttacggattgcttgcgcagtcgctgaaatccctagttgatgagggtcttgtggacaaggaaaaacttgagtcattctatctaccaatgtattcaccatcggttggtgaagtggaggcgatagtgaagcaagttgggttgttcaacatgaatcatgttaaagtattcgagataaattgggatccctacgatgactcggaagaaagtgatgttgtgcgtaacagtattaggagcggtgagaacgtcgccaagtgcctacgagcagtgatggagccgctggttgcaagccaatttggagaagccatactcgacaagttatttgaagagtacgctcgccgtgttgccaaacaccttgagaatgagaaaaccaagcatgctgtgctcgtcctgtccatgaagaaagcaatacatgtgtga

SEQ ID NO: 2510 - protein, 379 aa, Sorghum bicolor
  misc_feature: Ceres ANNOT ID no. 6024781
  misc_feature (36)..(376): Pfam Id: Methyltransf_7 Pfam Desc: SAM dependent carboxyl methyltransferase
  misc_feature (4)..(372): NCBI GI: 115467342 NCBI Desc: os06g0242000 [oryza sativa (japonica cultivar-group)]
  misc_feature (1)..(373): NCBI GI: 42528301 NCBI Desc: benzothiadiazole-induced s-adenosyl-l-methionine:salicylic acid carboxyl methyltransferase 1; bth-induced s-adenosyl-l-methionine:salicylic acid carboxyl
  misc_feature (1)..(373): NCBI GI: 42528301 (continued) methyltransferase 1 [oryza sativa (indica cultivar-group)]
  misc_feature (7)..(375): NCBI GI: 45238343 NCBI Desc: carboxyl methyltransferase [crocus sativus]
  misc_feature (1)..(375): NCBI GI: 23957318 NCBI Desc: s-adenosyl-l-methionine:salicylic acid methyltransferase [antirrhinum majus]
  misc_feature (1)..(375): NCBI GI: 134303371 NCBI Desc: salicylic acid/benzoic acid carboxyl methyltransferase [datura wrightii]
MRIERDLHMATGNGETSYTKNSRIQEKAMFHMKPVLEEATREVYTALLPKTMVVADLGCSSGPNTLRFVSEVIGIIARHCKELDDRRHDRPPQLQFFLNDLPGNDFNNLFQLIQQFHKSTARKHKGEAEEALPPCYITGLPGSYYTRIFPSESVHLFHSLFCLQWRSQAPEQLKGTKKTCLDIYITKTMSPSMVKLFQQQFQKDFSLFLKLRYEELVSGGQMVLTFIGRKHEDVLTGESNHLYGLLAQSLKSLVDEGLVDKEKLESFYLPMYSPSVGEVEAIVKQVGLFNMNHVKVFEINWDPYDDSEESDVVRNSIRSGENVAKCLRAVMEPLVASQFGEAILDKLFEEYARRVAKHLENEKTKHAVLVLSMKKAIHV

SEQ ID NO: 2511 - DNA, 549 bp, Sorghum bicolor
  misc_feature: Ceres ANNOT ID no. 6024794
  misc_feature: Encodes the peptide sequence at SEQ ID NO 2512
atgaggaagctcaagttccacgagcagaagctcctcaagaagaccaatttcttggagtacaagagggagcgcggccatcgcgaggcgctcgtcacacagcgctacggcctcgtcgagagggacgactacaagaagtacaacgggatatgcttaatggtgcagaagctcgttaacatcataaagcagatggacccgagagaccctttcagaatcgagatgacagatatgcttctcgataagctgtataatatgggtgtaatttcaacaaaagagagcttgataaagtgtgagaaactttcagtgagcgccttctgcaggcggagacttgcaacagttatggtgaagctcaagtttgcagagcaccttaaggaggctgtgacatacatcgaacaggggcatgtgcgtgtcggtccagagacagtcacggatccagcctttcttgtgaccagaaacatggaggacttcatcacctgggtggattcctcaaagatcaagaggaaggtcatggagtacaatgatgcattggatgattttgatgccatgttctga

SEQ ID NO: 2512 - protein, 182 aa, Sorghum bicolor
  misc_feature: Ceres ANNOT ID no. 6024794
  misc_feature (107)..(154): Pfam Id: S4 Pfam Desc: S4 domain
  misc_feature (1)..(106): Pfam Id: Ribosomal_S4 Pfam Desc: Ribosomal protein S4/S9 N-terminal domain
  misc_feature (1)..(181): NCBI GI: 38346067 NCBI Desc: osjnba0084k01.7 [oryza sativa (japonica cultivar-group)]
  misc_feature (1)..(181): NCBI GI: 51968508 NCBI Desc: ribosomal protein-like [arabidopsis thaliana]
  misc_feature (1)..(181): NCBI GI: 21554411 NCBI Desc: ribosomal protein-like [arabidopsis thaliana]
  misc_feature (1)..(181): NCBI GI: 9755620 NCBI Desc: ribosomal protein-like [arabidopsis thaliana]
  misc_feature (1)..(179): NCBI GI: 49250357 NCBI Desc: mgc69249 protein [xenopus tropicalis]
MRKLKFHEQKLLKKTNFLEYKRERGHREALVTQRYGLVERDDYKKYNGICLMVQKLVNIIKQMDPRDPFRIEMTDMLLDKLYNMGVISTKESLIKCEKLSVSAFCRRRLATVMVKLKFAEHLKEAVTYIEQGHVRVGPETVTDPAFLVTRNMEDFITWVDSSKIKRKVMEYNDALDDFDAMF

SEQ ID NO: 2513 - DNA, 849 bp, Sorghum bicolor
  misc_feature: Ceres ANNOT ID no. 6024834
  misc_feature: Encodes the peptide sequence at SEQ ID NO 2514
atgcctccgaagatcaagcggaaggctccggcctcaccggcgaggcacgacccttcgccggagccctacccttcccacgcctccccctcctcggcacaatgcctggcagtccgcgacgccctcctcgcgttccacgggttccccgaggagttcgcgcccttccgcctcctccgcctcggtggccgctcgcctaaccgtgaccctcggcctcagcctttgtctcccacagtgcttgacggcctcgtcatcaccctcctctctcagaacactaccgacgccatctcgcgccgcgccttcgcctccctcaaggccgctttcccctcctgggaccaggtggtggatgaggaagggaagaggctggaggacgccatccggtgcggcggcctggcgacgacgaaggcggccaggatacgggccatgctgagggacgtgagggagcggaggggcaagatttgcctcgagtacctgcgggagctgtcggtggatgaggttaagaaggagctctctcggttcaaagggattggaccaaagaccgctcctggagtggcatgtgtgctgatgttctatctacagaaggatgattttccagtggatactcatgtactccgcattacaaaggctatgggttgggttcctgcaacagctagcagggagaaggcctacattcatctaaataataagattcctgatgatctgaagtttgatttgaattgtctttttgtaactcatgggaagctttgtcagtcatgtaccaaaaaggtggtaagtgataaaagcaagaattccaatgctgcctgtcctctagcaggttactgttgcattggagaagaaaagcttcagcaacagtga

SEQ ID NO: 2514 - protein, 282 aa, Sorghum bicolor
  misc_feature: Ceres ANNOT ID no. 6024834
  misc_feature (82)..(229): Pfam Id: HhH-GPD Pfam Desc: HhH-GPD superfamily base excision DNA repair protein
  misc_feature (1)..(281): NCBI GI: 51535812 NCBI Desc: hhh-gpd base excision dna repair protein-related-like [oryza sativa (japonica cultivar-group)]
  misc_feature (1)..(202): NCBI GI: 115467308 NCBI Desc: os06g0237900 [oryza sativa (japonica cultivar-group)]
  misc_feature (22)..(271): NCBI GI: 92893612 NCBI Desc: hhh-gpd [medicago truncatula]
  misc_feature (8)..(271): NCBI GI: 18408516 NCBI Desc: hhh-gpd base excision dna repair protein-related [arabidopsis thaliana]
  misc_feature (64)..(249): NCBI GI: 86609598 NCBI Desc: base excision dna repair protein, hhh-gpd family [cyanobacteria bacterium yellowstone b-prime]
MPPKIKRKAPASPARHDPSPEPYPSHASPSSAQCLAVRDALLAFHGFPEEFAPFRLLRLGGRSPNRDPRPQPLSPTVLDGLVITLLSQNTTDAISRRAFASLKAAFPSWDQVVDEEGKRLEDAIRCGGLATTKAARIRAMLRDVRERRGKICLEYLRELSVDEVKKELSRFKGIGPKTAPGVACVLMFYLQKDDFPVDTHVLRITKAMGWVPATASREKAYIHLNNKIPDDLKFDLNCLFVTHGKLCQSCTKKVVSDKSKNSNAACPLAGYCCIGEEKLQQQ

SEQ ID NO: 2515 - DNA, 789 bp, Sorghum bicolor
  misc_feature: Ceres ANNOT ID no. 6024888
  misc_feature: Encodes the peptide sequence at SEQ ID NO 2516
atggccgtcctcctccgcggcacctccgccgccacctcgaccgttggtccctcctcggcgctgctcgccaccaccttccgccgctcccgcggccgccttctgccccgtgccgccccgcagcgccgcttgtatgtggcccgcgcctcggcccagccgctcgaggtctgcgccaaggagtccatcaccgtccctggccgcctcggagactgtcctttcacacagagggttttgttgactatagaggagaagcatctgccttatgaactgaagctagttgatctagctaataagccagattggttatttgaaatcaacccagaaggtaaagtgcctatcgtgaagcttgaggaaaaatggattggtgattctgatgttataacacagacattagaggagaagtatcctgaaccacccttggcaactccaccagaaaaggcttcagttgggtcaaaaatattttccactttcattggtttcctcaaaagcaaagatccaagcgatggaacagaagaggcactacttaatgagcttacttcatttgatagtcatctaaaagacaatggtccgtttattaatggcggaacaatttctgctgctgatctctctctgggccctaaactatatcacatggagatagctctgggccactataagaattggtctgttccagattcactttctcatgtaaaaacatacatgaagtcgattttctcaacggattcttttgtcaaaactcaagctctgccagaggatgtaattgctggatggcgcccaaaagtcatgggttaa

SEQ ID NO: 2516 - protein, 262 aa, Sorghum bicolor
  misc_feature: Ceres ANNOT ID no. 6024888
  misc_feature (63)..(132): Pfam Id: GST_N Pfam Desc: Glutathione S-transferase, N-terminal domain
  misc_feature (11)..(262): NCBI GI: 123187087 NCBI Desc: dehydroascorbate reductase [solanum tuberosum]
  misc_feature (11)..(262): NCBI GI: 66475038 NCBI Desc: dehydroascorbate reductase [lycopersicon esculentum]
  misc_feature (13)..(262): NCBI GI: 46093477 NCBI Desc: dehydroascorbate reductase [brassica oleracea]
  misc_feature (12)..(262): NCBI GI: 11761812 NCBI Desc: glutathione dependent dehydroascorbate reductase precursor [arabidopsis thaliana]
  misc_feature (50)..(262): NCBI GI: 66732627 NCBI Desc: dehydroascorbate reductase [lotus corniculatus var. japonicus]
MAVLLRGTSAATSTVGPSSALLATTFRRSRGRLLPRAAPQRRLYVARASAQPLEVCAKESITVPGRLGDCPFTQRVLLTIEEKHLPYELKLVDLANKPDWLFEINPEGKVPIVKLEEKWIGDSDVITQTLEEKYPEPPLATPPEKASVGSKIFSTFIGFLKSKDPSDGTEEALLNELTSFDSHLKDNGPFINGGTISAADLSLGPKLYHMEIALGHYKNWSVPDSLSHVKTYMKSIFSTDSFVKTQALPEDVIAGWRPKVMG

SEQ ID NO: 2517 - DNA, 1167 bp, Sorghum bicolor
  misc_feature: Ceres ANNOT ID no. 6024895
  misc_feature: Encodes the peptide sequence at SEQ ID NO 2518
atggctctccacgcggcggcgccggcatgcgcggtgttctgccgcctcccgtcgtcctccccttctcacgacgccggcggcaggcgctccctccccgccgtcgcgaggccccgcggcgtcgtctctgccgcgccgctgcggacacgcgcagttcgaacaaaggcaaccttcagtgatggcgtccctgaaacgagcaattctccacatgtggtctgctttggtgaattgctaattgacttcgtcccaactgtcaatggcttgtcactgtcagaagcaccagccttcaagaaggctcctgggggtgcacctgccaatgttgcagttggaatagctcgtcttggtggctctgcagctttcattggaaaggttggtgatgatgaatttggctacatgctagctgatatattgaagcagaataatgtaaataatcaagggttactatttgatcctcatgctagaacagctttggcatttgtgacactccgaagtgatggtgaacgtgagtttatgttctatcgtaatccaagtgctgatatgctacttgaagaaaaagaacttgaccttgatcttatacagaaggcaaaaatattccaccatggctcgataagtcttataactgagccctgtaaaactgcacatattgcagctgccaaagctgctaaagatgctggagtacttgtttcatacgatccaaatttgaggcttccattgtggtcatcagctgaggatgctagagatggtatcctaagcatatgggaaactgctgatgttatcaagataagtgaagaggaggtttcctttcttacaaatggggaggatccttatgatgatgccgttgtaaagaaacttatccactcaaacctgaagttgcttcttgtcactgaaggtccagatggctgtaggtattactctaaggactttagtggtagagttggtggacttaaggtaagtgctgttgacacaactggtgctggcgatgcctttgttgctggagtgctatctcaattagccacagacttttcactgctccaggacgaaggtcggttgagagaagccctgaagtttgcaaacgtctgtggagctctcactgtgacagagagaggcgctattcctgcgctgcccacccgacaacaagtgcttgatgccctgaccgatgttgttgcttga

SEQ ID NO: 2518 - protein, 388 aa, Sorghum bicolor
  misc_feature: Ceres ANNOT ID no. 6024895
  misc_feature (67)..(376): Pfam Id: PfkB Pfam Desc: pfkB family carbohydrate kinase
  misc_feature (1)..(388): NCBI GI: 38604456 NCBI Desc: fructokinase 3 [lycopersicon esculentum]
  misc_feature (55)..(388): NCBI GI: 23476263 NCBI Desc: fructokinase [lycopersicon esculentum]
  misc_feature (65)..(388): NCBI GI: 2102691 NCBI Desc: fructokinase
  misc_feature (70)..(388): NCBI GI: 45550051 NCBI Desc: fructokinase [citrus unshiu]
  misc_feature (63)..(383): NCBI GI: 1052973 NCBI Desc: fructokinase [beta vulgaris]
  misc_feature (70)..(375): SWISSPROT Homolog: EC 2.7.1.4 Fructokinase-2
  misc_feature: The sequence is a functional homolog of SEQ ID NO. 302 in the 11/188,298 US application
  misc_feature: The sequence is a functional homolog of SEQ ID NO. 299 in the 11/188,298 US application
MALHAAAPACAVFCRLPSSSPSHDAGGRRSLPAVARPRGVVSAAPLRTRAVRTKATFSDGVPETSNSPHVVCFGELLIDFVPTVNGLSLSEAPAFKKAPGGAPANVAVGIARLGGSAAFIGKVGDDEFGYMLADILKQNNVNNQGLLFDPHARTALAFVTLRSDGEREFMFYRNPSADMLLEEKELDLDLIQKAKIFHHGSISLITEPCKTAHIAAAKAAKDAGVLVSYDPNLRLPLWSSAEDARDGILSIWETADVIKISEEEVSFLTNGEDPYDDAVVKKLIHSNLKLLLVTEGPDGCRYYSKDFSGRVGGLKVSAVDTTGAGDAFVAGVLSQLATDFSLLQDEGRLREALKFANVCGALTVTERGAIPALPTRQQVLDALTDVVA

SEQ ID NO: 2519 - DNA, 672 bp, Sorghum bicolor
  misc_feature: Ceres ANNOT ID no. 6024903
  misc_feature: Encodes the peptide sequence at SEQ ID NO 2520
atggaagtgccgcctctgccaacggcggcggcggaagaggagcgccggagcgtagcgacggggccgtgcctccccaggctgctctccggcgtcctctcgggggccctcaccggcatcttcgccgtcgctggaggcctgacgggggcgttcaccggcgcattggccggccgagcttccgacagtggcgtcctccggggagccgggctgggggcctttgcgggggcggtgctctccatcgaggttctcgaggcttcgcgcgcctactggagggcggaccgatcgagcccgcagagcacatcctccatgggggacttcatagaacaactccttcatgctcgatttgtgcaagagcagtatgagccatcagcatatatggcatatcgttggcaggttggaattgcggacaatgatgatctgttcgatgtccttgaagatgttttatctgaagggctatcacaagatactctaaagaagttgccacgtcatgtggtgactgaacagaagcaggaatcgattggtgaaaacgtgtcttgcgctatttgcctgcaggatgttgttagcggagagacagtgaggaagttgccaaagtgctctcacaccttccatcagccttgtgtggacagatggttcattgaccatggttcatgcccagtatgtaggcaggatgtgtag

SEQ ID NO: 2520 - protein, 223 aa, Sorghum bicolor
  misc_feature: Ceres ANNOT ID no. 6024903
  misc_feature (178)..(219): Pfam Id: zf-C3HC4 Pfam Desc: Zinc finger, C3HC4 type (RING finger)
  misc_feature (10)..(223): NCBI GI: 20147407 NCBI Desc: at1g74410/f1m20_9 [arabidopsis thaliana]
  misc_feature (27)..(223): NCBI GI: 27524904 NCBI Desc: nep1-interacting protein 2 [arabidopsis thaliana]
  misc_feature (24)..(223): NCBI GI: 27524902 NCBI Desc: nep1-interacting protein [arabidopsis thaliana]
  misc_feature (28)..(223): NCBI GI: 115472067 NCBI Desc: os07g0479100 [oryza sativa (japonica cultivar-group)]
  misc_feature (109)..(223): NCBI GI: 38228693 NCBI Desc: zinc finger protein [fagus sylvatica]
  misc_feature: Useful for making plants with altered alkaloid content
  misc_feature: Functional homolog of the protein sequence given in SEQ ID NO 13112
  misc_feature: Useful for making plants with altered carbohydrate content
  misc_feature: Functional homolog of the protein sequence given in SEQ ID NO 13797
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
MEVPPLPTAAAEEERRSVATGPCLPRLLSGVLSGALTGIFAVAGGLTGAFTGALAGRASDSGVLRGAGLGAFAGAVLSIEVLEASRAYWRADRSSPQSTSSMGDFIEQLLHARFVQEQYEPSAYMAYRWQVGIADNDDLFDVLEDVLSEGLSQDTLKKLPRHVVTEQKQESIGENVSCAICLQDVVSGETVRKLPKCSHTFHQPCVDRWFIDHGSCPVCRQDV

SEQ ID NO: 2521 - DNA, 1914 bp, Sorghum bicolor
  misc_feature: Ceres ANNOT ID no. 6024932
  misc_feature: Encodes the peptide sequence at SEQ ID NO 2522
atgaagaaatggcatggcggctttgccgttgtatctttgttcatcatcttgatgttaagatatgtgatattggatagcccacttgcagagaaatcgcttcagtatgttttccaacaaaacaggacggtagaattacattggttggatgttccaaacccacctgcaatccagaatccacagaattcttctgaagtaatatcaaccagactcttggcatccaacctttccattaccagaaatctctctgatagagaacttcaatctttactttgttggaatcatttgagacacctattatctcatgcccatatcctgccagatggagtagaggcaatcaaggaagctggagttgcatggagggaactcaatacagcccttgcatatgatgactcagttgtttctgttaatgccagcattcagcagaaggacaaaggaaagcaatgcccttattctatcagaaggatgaatgccacaagattaggtgataggtttgctttaaaacttccctgtggattgattcagggctcttcaataactattattggtactcctggtggtcttctgggtaattttaagatagagttaactggagccgcagttcctggtgaaccagaccctccaattgtccttcattataatgtccgtcttcttggtgataaactcacagaagatcctgtaatagtccaaaatacatggacaatagctgatgattggggttctgaaaaccgttgcccatctcctgattcagatgctaaggacagtgcaaaagtggatgatctagaaaaatgtagcagcatggtaggtgaggaccagaaagaaatccttccctctaagttacattcaaatgtttcgaccatgccacctgcaaggaagaagaaagcagaacctagaaagtattttccattcagacagggatatcttgctgtagcaattcttcgtatcggagcacatgggatccatatgactgtagatggcaaacatatcacttcgtttgcattccgagaggatttggaaccagggtttgttggtgaagtaagaattgctggagatattaaattgctatctgtgatagcaagtggcctgcctacaacagaggacttcgagcatgtgactgacttagaaacattgaaggctccacctgtgcccatgaataaatctgttgatcttttcattggggtcttctctacagcaaataatttcaaacgccgaatggcagttcgcagaacttggatgcagtatgatgatgtgcgctcaggaaaagttacagttcgattctttgttggcctgcacaaaaatgaggtagtcaatgaggaactctggaatgaagcacgaacatatggagacatccagctgatgccatttgtggattactatagcctgattctttggaagaccatagcaatctgcatctatgggacaaatgtcctgtcagccaagtatgtgatgaaaactgatgacgatgcttttgttcgagtagatgaaatactctcttcccttgaccgaaccaatatcagccatggactattgtatggtcgtgtcaattctgattcccagcctcatcgagatccatatagcaagtggtacataacccctgaggaatggcctgaggagagttatcctccatgggcgcatggaccaggatatattgtttcaaaggacatagctaaagaagtttacaggaaacacaagagtggggagttaaagatgttcaagctagaggatgtcgcaatgggaatatggatcaatgagatgaagaaggatggcttggatgtcaagtatgagaatgatgggaggatcttggttgaagggtgcgaggatgggtatgtggttgctcactaccaagaaccaagggatatgatgtgcctctgggataagtttcagaaaacaaaacgaggaacatgttgcaaagaataa

SEQ ID NO: 2522 - protein, 637 aa, Sorghum bicolor
  misc_feature: Ceres ANNOT ID no. 6024932
  misc_feature (163)..(358): Pfam Id: Gal-bind_lectin Pfam Desc: Galactoside-binding lectin
  misc_feature (401)..(597): Pfam Id: Galactosyl_T Pfam Desc: Galactosyltransferase
  misc_feature (45)..(635): NCBI GI: 115446881 NCBI Desc: os02g0577300 [oryza sativa (japonica cultivar-group)]
  misc_feature (16)..(342): NCBI GI: 9295733 NCBI Desc: t24p13.20 [arabidopsis thaliana]
  misc_feature (173)..(636): NCBI GI: 13605629 NCBI Desc: at3g06440/f24p17_7 [arabidopsis thaliana]
  misc_feature (107)..(635): NCBI GI: 5882743 NCBI Desc: ests gbh36134 and gbh36132 come from this gene. [arabidopsis thaliana]
  misc_feature (107)..(635): NCBI GI: 19699371 NCBI Desc: at1g74800/f25a4_38 [arabidopsis thaliana]
  misc_feature: The sequence is a functional homolog of SEQ ID NO. 346 in the 11/188,298 US application
MKKWHGGFAVVSLFIILMLRYVILDSPLAEKSLQYVFQQNRTVELHWLDVPNPPAIQNPQNSSEVISTRLLASNLSITRNLSDRELQSLLCWNHLRHLLSHAHILPDGVEAIKEAGVAWRELNTALAYDDSVVSVNASIQQKDKGKQCPYSIRRMNATRLGDRFALKLPCGLIQGSSITIIGTPGGLLGNFKIELTGAAVPGEPDPPIVLHYNVRLLGDKLTEDPVIVQNTWTIADDWGSENRCPSPDSDAKDSAKVDDLEKCSSMVGEDQKEILPSKLHSNVSTMPPARKKKAEPRKYFPFRQGYLAVAILRIGAHGIHMTVDGKHITSFAFREDLEPGFVGEVRIAGDIKLLSVIASGLPTTEDFEHVTDLETLKAPPVPMNKSVDLFIGVFSTANNFKRRMAVRRTWMQYDDVRSGKVTVRFFVGLHKNEVVNEELWNEARTYGDIQLMPFVDYYSLILWKTIAICIYGTNVLSAKYVMKTDDDAFVRVDEILSSLDRTNISHGLLYGRVNSDSQPHRDPYSKWYITPEEWPEESYPPWAHGPGYIVSKDIAKEVYRKHKSGELKMFKLEDVAMGIWINEMKKDGLDVKYENDGRILVEGCEDGYVVAHYQEPRDMMCLWDKFQKTKRGTCCKE

SEQ ID NO: 2523 - DNA, 1200 bp, Sorghum bicolor
  misc_feature: Ceres ANNOT ID no. 6024939
  misc_feature: Encodes the peptide sequence at SEQ ID NO 2524
atggagaacaatactcctccaaaatctgggacaggcttcttcaaaacttgcttcaatggagttaatgctctctcaggggttggaatattatctattccatatgcattgtctcaaggaggatggttgagcttacttattttcttaaccatagccatcatctgtttctatactggtattctcctacagagatgtatagactcgagttcgcttgttaagacctatcctgatattggtgagctagcttttgggcggaaagggaaaatcatagtagcaatattcttgtacctagagctgtatcttgtggctattgatttcttgatattagaaggtgacaacttggagaaattatttccaaatgctaacttccatgctgctgggctcaaggttggaagcaagcaagggtttgtgttgatcttcagtctacttgttttaccaacaacatggcttcggagcttgaacatgcttgcatatgtcgccctaggtggagtcatggcttctgtcattttaatcgcctctgttctgtgggttggaacatttgatggggttggttttcataagaaaggtgtgcctgtggactggtctggtatgccaactgctatgagcttatatgcgttctgcttcagtggccatgctgtttttccgatgatatacaccggcatgagaaacaggaaaacgttccccacagtgttgctcatctgcttcattatatgcactcttagctacggtctgactggtgtcgttggatacttgatgtttggggaatcactaagttcccaggtgactctgaaccttccatcaaaccgttttgcctccaacgtcgcgatctacacgacgttgatcaatccgttcaccaagttcgcgctgctgatcactccaatagcagaggctatcgaggataagcttcatgtgggcaagaacaggaccgtcagtattgtcatccggactgccctggtcgtcagcacaaccattgtggcccttgccgtgcccttctttgcctatgtcgtcgctcttacgggctcgtttctcagcagcacggtcacaatgttgataccttgtgtttgctacctgaagatcagctcaagaacctccaggaatctgaggctggagctggtagtttgcttggttattatcatgattggggcgggggtaattgtggtcggcacgtatagctcactgaaacagattgttaatagcttttga

SEQ ID NO: 2524 - protein, 399 aa, Sorghum bicolor
  misc_feature: Ceres ANNOT ID no. 6024939
  misc_feature (9)..(390): Pfam Id: Aa_trans Pfam Desc: Transmembrane amino acid transporter protein
  misc_feature (5)..(399): NCBI GI: 38344962 NCBI Desc: osjnba0072f16.7 [oryza sativa (japonica cultivar-group)]
  misc_feature (5)..(399): NCBI GI: 116310060 NCBI Desc: osigba0097p08.12 [oryza sativa (indica cultivar-group)]
  misc_feature (8)..(398): NCBI GI: 87240673 NCBI Desc: amino acid/polyamine transporter ii [medicago truncatula]
  misc_feature (8)..(398): NCBI GI: 87240664 NCBI Desc: amino acid/polyamine transporter ii [medicago truncatula]
  misc_feature (11)..(398): NCBI GI: 42565277 NCBI Desc: amino acid transporter family protein [arabidopsis thaliana]
  misc_feature: The sequence is a functional homolog of SEQ ID NO. 438 in the 11/188,298 US application
  misc_feature: The sequence is a functional homolog of SEQ ID NO. 313 in the 11/188,298 US application
MENNTPPKSGTGFFKTCFNGVNALSGVGILSIPYALSQGGWLSLLIFLTIAIICFYTGILLQRCIDSSSLVKTYPDIGELAFGRKGKIIVAIFLYLELYLVAIDFLILEGDNLEKLFPNANFHAAGLKVGSKQGFVLIFSLLVLPTTWLRSLNMLAYVALGGVMASVILIASVLWVGTFDGVGFHKKGVPVDWSGMPTAMSLYAFCFSGHAVFPMIYTGMRNRKTFPTVLLICFIICTLSYGLTGVVGYLMFGESLSSQVTLNLPSNRFASNVAIYTTLINPFTKFALLITPIAEAIEDKLHVGKNRTVSIVIRTALVVSTTIVALAVPFFAYVVALTGSFLSSTVTMLIPCVCYLKISSRTSRNLRLELVVCLVIIMIGAGVIVVGTYSSLKQIVNSF

SEQ ID NO: 2525 - DNA, 1515 bp, Sorghum bicolor
  misc_feature: Ceres ANNOT ID no. 6024953
  misc_feature: Encodes the peptide sequence at SEQ ID NO 2526
atggccggcggccgcgcgttccggccgtccgcgccgcgccgcgcggcgttcgcggctctgctcacgctcctcctcctcgcggcactctccttcctcctctcttccacgccgcccgcctcgtcggcacgttcctcgtcccccccgccgtccgcgcgcctcgccgccgtccgccgacacgcggccgaccacgcggccgtccttgccgcgtacgccgcgcacgcacggaagctcaaggaggcctccgcagcgcagtcgctctcgttctcgaccctctcctccgacctctccgcgctctccgcccgcctcgcctcccacctctcctcctcctcgctccccgaggacgcgctcaggcccctcgagaaggaggcccgcgagcgcatcaagttcgcgcgcgcactcgccgctgacgccaaggaggggttcgacactcagtccaagatccagaagctctccgacaccgtcttcgccgtcggcgagcagctctcgcgcgcgcgccgcgcgggccgcatgtcctcccgcatcgctgcggattccacccccaagtcgctccactgcctcgccatgcgcctcctcgaggcccgcctcgccaacccctccgcatttgccgacgaccccgacccgtcccccgagttcgatgaccccgcgttgtaccattacgccatcttctccgacaatgtgctcgccgtctccgtcgtggtggcctctgctgcgcgcgccgcggccgacccttcgcgccacgtcttccacgtggtcaccgcgcccatgtacctgcctgcattccgggtctggttcgcgcggcgcccgccgccgcttggcgtgcacgtccagctccttgcttactccgactttccattcctcaatgccaccaactcgcctgtggtcaggcagatcgacgccggcaacagggacgtcgagttgctggattacctgaggttctacctcccagatatgttcccgacgctgcggagggtggtccttttggaggacgatgtggtggtgcagaaggatttggcagcgctttggcaggtcgacttggatgggaaggtgaatggcgcagtggagacttgcttcggggggtttaggaggtataggaagtatctcaacttcacgcagcccattgtgcgggatcgattcaatcccagcgcctgtgcatgggcatatgggttaaatgtgttcgatcttgagacatggcggcgggatggttgcacagaattgttccatcagtatatggaaatgaatgaggatggcgagctgtgggatcctacatccattctaacagctgggctgatgtccttctatggcaataccaagccactggataagtcatggcatgtaatgggtcttggctataatccaagcatcagccctgaggcaatccgtagtgctgcagtgatacacttcgatgggaacatgaagccctggcttgatgttgctttgaaccaatacaaggccctgtggacaaagtatgtggacactgaaatggagttcctaacactctgtaactttggtctttga

SEQ ID NO: 2526 - protein, 504 aa, Sorghum bicolor
  misc_feature: Ceres ANNOT ID no. 6024953
  misc_feature (185)..(478): Pfam Id: Glyco_transf_8 Pfam Desc: Glycosyl transferase family 8
  misc_feature (1)..(504): NCBI GI: 51535547 NCBI Desc: glycosyl transferase protein a-like [oryza sativa (japonica cultivar-group)]
  misc_feature (288)..(504): NCBI GI: 92889023 NCBI Desc: glycosyl transferase, family 8 [medicago truncatula]
  misc_feature (304)..(504): NCBI GI: 108936776 NCBI Desc: glycosyltransferase [plantago major]
  misc_feature (304)..(501): NCBI GI: 52077221 NCBI Desc: glycosyl transferase family 8 protein-like [oryza sativa (japonica cultivar-group)]
  misc_feature (304)..(501): NCBI GI: 92885182 NCBI Desc: nudix hydrolase; glycosyl transferase, family 8 [medicago truncatula]
  misc_feature: Useful for making plants with altered cell wall content and/or composition
  misc_feature: Functional homolog of the protein sequence encoded by LOCUS at3g02350
MAGGRAFRPSAPRRAAFAALLTLLLLAALSFLLSSTPPASSARSSSPPPSARLAAVRRHAADHAAVLAAYAAHARKLKEASAAQSLSFSTLSSDLSALSARLASHLSSSSLPEDALRPLEKEARERIKFARALAADAKEGFDTQSKIQKLSDTVFAVGEQLSRARRAGRMSSRIAADSTPKSLHCLAMRLLEARLANPSAFADDPDPSPEFDDPALYHYAIFSDNVLAVSVVVASAARAAADPSRHVFHVVTAPMYLPAFRVWFARRPPPLGVHVQLLAYSDFPFLNATNSPVVRQIDAGNRDVELLDYLRFYLPDMFPTLRRVVLLEDDVVVQKDLAALWQVDLDGKVNGAVETCFGGFRRYRKYLNFTQPIVRDRFNPSACAWAYGLNVFDLETWRRDGCTELFHQYMEMNEDGELWDPTSILTAGLMSFYGNTKPLDKSWHVMGLGYNPSISPEAIRSAAVIHFDGNMKPWLDVALNQYKALWTKYVDTEMEFLTLCNFGL

SEQ ID NO: 2527 - DNA, 579 bp, Sorghum bicolor
  misc_feature: Ceres ANNOT ID no. 6024961
  misc_feature: Encodes the peptide sequence at SEQ ID NO 2528
atggggtccggatctttcctcaaggtgctggctaacaacttcgatgtcctagcagggccactcatatcacttgcatatcctctatatgcttctgttagagcaatagagaccaaaaatcctgtagatgaccagcagtggctcacttactgggtgttgtactcatttatcactttgtttgagctaacttttgctccaattatcgagtggcttccattttggtcatatgcaaagttgttctttaactgctggttggtcttaccttggttcaatggtgctgcttatgtttacgaccattttgtgcggccaacgtttgtgaaccgccaaatagtgaacatatggtatgttccaaggaatgagaagctaggtaaatctgatgatgttctgtcagctgcagagagatatattgagcaaaatggaccggaagcatttgagaagctcatcagcaagtctacaaagtcttcaaaatcaaggaacacaaagcggtcgatcttggaggaggcagaggctgaaaacagagctaaggctgaaagagaatcgtgggatgaaaatcccttctacgacaaaaattacagatactaa

SEQ ID NO: 2528 - protein, 192 aa, Sorghum bicolor
  misc_feature: Ceres ANNOT ID no. 6024961
  misc_feature (7)..(104): Pfam Id: TB2_DP1_HVA22 Pfam Desc: TB2/DP1, HVA22 family
  misc_feature (2)..(153): NCBI GI: 92892431 NCBI Desc: athva22a, 65476-64429 [imported] - arabidopsis thaliana [medicago truncatula]
  misc_feature (2)..(155): NCBI GI: 4884934 NCBI Desc: athva22b [arabidopsis thaliana]
  misc_feature (7)..(155): NCBI GI: 57899745 NCBI Desc: abscisic acid-induced protein-like [oryza sativa (japonica cultivar-group)]
  misc_feature (17)..(104): NCBI GI: 57012614 NCBI Desc: hva22-like protein e (athva22e)
  misc_feature (10)..(101): NCBI GI: 404589 NCBI Desc: a22
MGSGSFLKVLANNFDVLAGPLISLAYPLYASVRAIETKNPVDDQQWLTYWVLYSFITLFELTFAPIIEWLPFWSYAKLFFNCWLVLPWFNGAAYVYDHFVRPTFVNRQIVNIWYVPRNEKLGKSDDVLSAAERYIEQNGPEAFEKLISKSTKSSKSRNTKRSILEEAEAENRAKAERESWDENPFYDKNYRY

SEQ ID NO: 2529 - DNA, 2139 bp, Sorghum bicolor
  misc_feature: Ceres ANNOT ID no. 6024997
  misc_feature: Encodes the peptide sequence at SEQ ID NO 2530
atggagagtacagacaaggatgacaaaacaattcctgtcatagaagaggcttctaatcctggacaaaattgtgaagatgaaggggattggtcaaggaaaacagaaatgttaaatgtagaagcgccaaattcctcgaatgacaaattaaacaatgaatcagaagtgcagatccaagagggagatgatgattcagaaaagggcttaaatggacaaatgaatgaaaggacaagctcagatgtcttggaatatgcaagctcaaacgagatcacaaaagagattcttcctgaagacaaatctgaagagccagtgtttgatggaactgaggttcctgaaatagaagaaatgaggcgttcttccaatcaatctgtggaacttgactcagaggctcaggggtctgtactcaatgaccgggctgttgccataaaaaattttgttaaagaaaagagtgcaattgcagtttcaacatttatgcggcgcctttctggcaaaaaggatgagaatgaatttaaggctgaagctgacaagactgttggttcagaatgcatggactgtgagaagactgggacagatgatgaatccaagcctaaagaggtgcagcagaaatctgaggaaaggactgcttggaacccactgaacttcattaaaattggccgagattttgatacttttgtaactggggaagcattgaatgaaaatgtgcctggtttgttggagccaccaacattgaagagtaggataataatatacacaaaactggggtgtgaagattgcaaaatggttcgtctattcttgcatcagaagaggctcaagtatgttgagattaacattgacatcttccctggtagaaagttggaattggagaagaatactggatcatccactgtaccaaaagtgtactttaatgacctactgattggagggttaattgagttgaagaaaatggaagattctggtatacttgatgagaatatcggtgttctgttcaatgaagaaccctcatcttctgctccattgccccccttacctggagaagatgatgaatcaggaagtgggaagattgatgagttggcaaccattgtcagaaaaatgagagagtccatcactcctaaggatagattctataagatgagaagatttagtaactgctttcttggtagtgaggctgtggatttcatatcagaagatcaatatctggagagagatgaggcagtggaatttggaaggaagcttgcaagaaaatacttctttcgtcatgttctaggtgaaaatgtctttgaagatggaaacaacctatatcgtttcctggatcatgatcctatagttatgactcaatgctacaacatccctaggggcatcatggatgttgcaccaaagcccattgctgaagtggcatcaaggctgaggttgttatcctgtgccatttttgaagcttatgtatcagcagatggtagacatgttgactacagaagcatccaaggttctgaggaatttaaaagatatattagaacagttgaggagctccagagggtggaaatcgatgatttatcacgtgaagaaaagcttgctttcttcataaatctatacaatatgatggctatccatgcattagtgacatgtggccatcctgctggaccactggacagaagaaacttttttggaggttttaagtatgtcattggtggatgtgcttattcactgtcagcgatccaaaatggcattctacgcggcaaccaaaggccaccatacaacattaccaaacctttcgggcagaaagaccaaagatccaaggtggcccttccataccatgaacctcttgttcactttgctttggtatgtggcaccaaatctggacctgcacttaggtgttactcgccaggagatatcgataaagaactgatggaagctgcacgtgatttcctaaggaatggaggactgattgttgatcctgaagccaaaattgcatctgcaagcaagattttgaaatggtatagcacggattttggtaagaacgagacggaagtgctgaagcatgctgccaactatcttgcgcctgcagagtcagagcagctcttggaactgctcgcgagcactcaactgaaagtcatgtaccaaaactacgactggagcatcaacatttag

SEQ ID NO: 2530 - protein, 712 aa, Sorghum bicolor
  misc_feature: Ceres ANNOT ID no. 6024997
  misc_feature (246)..(305): Pfam Id: Glutaredoxin Pfam Desc: Glutaredoxin
  misc_feature (363)..(434): Pfam Id: DEP Pfam Desc: Domain found in Dishevelled, Egl-10, and Pleckstrin
  misc_feature (1)..(712): NCBI GI: 51536062 NCBI Desc: glutaredoxin-related-like protein [oryza sativa (japonica cultivar-group)]
  misc_feature (482)..(709): NCBI GI: 19682975 NCBI Desc: similar to dictyostelium discoideum (slime mold). nucleotide exchange factor rasgef p
  misc_feature (469)..(710): NCBI GI: 145617938 NCBI Desc: glycoside hydrolase 15-related [geobacter bemidjiensis bem]
  misc_feature (482)..(689): NCBI GI: 50725195 NCBI Desc: ternary complex factor mip1-like protein [oryza sativa (japonica cultivar-group)]
  misc_feature (494)..(702): NCBI GI: 53793306 NCBI Desc: ternary complex factor mip1-like [oryza sativa (japonica cultivar-group)]
MESTDKDDKTIPVIEEASNPGQNCEDEGDWSRKTEMLNVEAPNSSNDKLNNESEVQIQEGDDDSEKGLNGQMNERTSSDVLEYASSNEITKEILPEDKSEEPVFDGTEVPEIEEMRRSSNQSVELDSEAQGSVLNDRAVAIKNFVKEKSAIAVSTFMRRLSGKKDENEFKAEADKTVGSECMDCEKTGTDDESKPKEVQQKSEERTAWNPLNFIKIGRDFDTFVTGEALNENVPGLLEPPTLKSRIIIYTKLGCEDCKMVRLFLHQKRLKYVEINIDIFPGRKLELEKNTGSSTVPKVYFNDLLIGGLIELKKMEDSGILDENIGVLFNEEPSSSAPLPPLPGEDDESGSGKIDELATIVRKMRESITPKDRFYKMRRFSNCFLGSEAVDFISEDQYLERDEAVEFGRKLARKYFFRHVLGENVFEDGNNLYRFLDHDPIVMTQCYNIPRGIMDVAPKPIAEVASRLRLLSCAIFEAYVSADGRHVDYRSIQGSEEFKRYIRTVEELQRVEIDDLSREEKLAFFINLYNMMAIHALVTCGHPAGPLDRRNFFGGFKYVIGGCAYSLSAIQNGILRGNQRPPYNITKPFGQKDQRSKVALPYHEPLVHFALVCGTKSGPALRCYSPGDIDKELMEAARDFLRNGGLIVDPEAKIASASKILKWYSTDFGKNETEVLKHAANYLAPAESEQLLELLASTQLKVMYQNYDWSINI

SEQ ID NO: 2531 - DNA, 357 bp, Sorghum bicolor
  misc_feature: Ceres ANNOT ID no. 6024998
  misc_feature: Encodes the peptide sequence at SEQ ID NO 2532
atggccggcgggaaggagccgatcgaggtgaagttccggctgttcgacggcaccgacatcgggcccagcaagtacgaccccaacaccaccgtcaccgcgctcaaggagttcgtcctcgcccggtggccgcaggataaagaaatagttccaaaaactgtcaatgatgtgaagctcatcaatgctggaaggatactggagaatagcaaaactcttgctgaatctcgagtcccagttggagaagttcctggaagtgtgattacgatgcatgttgttgtgcggcctccccaatctaacaaaagtgagaagcaacagtcaaactccccgaagccgaacagatgtggatgcacgatattgtga

SEQ ID NO: 2532 - protein, 118 aa, Sorghum bicolor
  misc_feature: Ceres ANNOT ID no. 6024998
  misc_feature (1)..(118): NCBI GI: 75134491 NCBI Desc: membrane-anchored ubiquitin-fold protein 3 precursor (membrane-anchored ub-fold protein 3) (osmub3)
  misc_feature (5)..(118): NCBI GI: 4097587 NCBI Desc: ntgp5 [nicotiana tabacum]
  misc_feature (3)..(118): NCBI GI: 75116001 NCBI Desc: membrane-anchored ubiquitin-fold protein 2 precursor (membrane-anchored ub-fold protein 2) (osmub2)
  misc_feature (2)..(118): NCBI GI: 38347220 NCBI Desc: osjnba0055c08.14 [oryza sativa (japonica cultivar-group)]
  misc_feature (1)..(99): NCBI GI: 9280680 NCBI Desc: f2e2.12 [arabidopsis thaliana]
MAGGKEPIEVKFRLFDGTDIGPSKYDPNTTVTALKEFVLARWPQDKEIVPKTVNDVKLINAGRILENSKTLAESRVPVGEVPGSVITMHVVVRPPQSNKSEKQQSNSPKPNRCGCTIL

SEQ ID NO: 2533 - DNA, 990 bp, Sorghum bicolor
  misc_feature: Ceres ANNOT ID no. 6025016
  misc_feature: Encodes the peptide sequence at SEQ ID NO 2534
atggctggggttctttctcaccatgcgctggcatcttcgcaatcccactggtgcagtgcaaagaactatagattcgaaaagaggacgggcagtgcccgcttggtttatgtaaagggaagttgtggttcaggcagccgaaaactgggtttggtttgggcctcgagctcgcagcagtcttctgtcatggagccgatgcacctaccatcggatggcaacagtggccacaccccaaagaaatcaagtgaaagcgctcttatattgattcggcatggtgaatccctgtggaatgagaaaaatctgtttactggctgtgttgatgtacccctgacaccaaagggtgttgaggaggccattgaggcaggtaaaaggatatgcaatatcccaatcgatgtaatatatacttcatcactgattcgtgctcagatgaccgcaatgcttgccatgatgcagcatcggcgcaagaagatcccagttatcatgcataatgagagtgaacaagctcacaggtggagtcagatatacagtgaggagacaaggaaacactccattccagtcataacagcttggtatggtgagttacaaggccttaataagcaagaaactgcagatcggtttggcaaagaacaagttcatgagtggcgccgcagttatgatatccctcccccaaatggagaaagcctagagatgtgtgctgagagagctgttgcttatttcaaagatcagattgttccacaacttgtggctggtaaacatgtgatggttgctgcacatgggaattcacttcgttcaattataatgcatctggacaaactaacttctcaagaggtaataagccttgagctgtctactggcattcccatgctttacatattcaaggaaggaaagtttattcgccgtggcagcccggtaggaccttcagaggccagtgtttatgcttataccaggaccttggctaaatacagacagaagcttgatagtatggttcagtaa

SEQ ID NO: 2534 - protein, 329 aa, Sorghum bicolor
  misc_feature: Ceres ANNOT ID no. 6025016
  misc_feature (84)..(264): Pfam Id: PGAM Pfam Desc: Phosphoglycerate mutase family
  misc_feature (47)..(325): NCBI GI: 56381947 NCBI Desc: at1g22170 [arabidopsis thaliana]
  misc_feature (53)..(326): NCBI GI: 42563306 NCBI Desc: phosphoglycerate/bisphosphoglycerate mutase family protein [arabidopsis thaliana]
  misc_feature (53)..(326): NCBI GI: 6573769 NCBI Desc: f28k19.26 [arabidopsis thaliana]
  misc_feature (85)..(304): NCBI GI: 89331289 NCBI Desc: phosphoglycerate mutase [chlamydophila felis fe/c-56]
  misc_feature (85)..(298): NCBI GI: 81312377 NCBI Desc: 2,3-bisphosphoglycerate-dependent phosphoglycerate mutase (phosphoglyceromutase) (pgam) (bpg-dependent pgam) (dpgm)
  misc_feature (85)..(299): SWISSPROT Homolog: EC 5.4.2.1 2,3-bisphosphoglycerate-dependent phosphoglycerate mutase
MAGVLSHHALASSQSHWCSAKNYRFEKRTGSARLVYVKGSCGSGSRKLGLVWASSSQQSSVMEPMHLPSDGNSGHTPKKSSESALILIRHGESLWNEKNLFTGCVDVPLTPKGVEEAIEAGKRICNIPIDVIYTSSLIRAQMTAMLAMMQHRRKKIPVIMHNESEQAHRWSQIYSEETRKHSIPVITAWYGELQGLNKQETADRFGKEQVHEWRRSYDIPPPNGESLEMCAERAVAYFKDQIVPQLVAGKHVMVAAHGNSLRSIIMHLDKLTSQEVISLELSTGIPMLYIFKEGKFIRRGSPVGPSEASVYAYTRTLAKYRQKLDSMVQ

SEQ ID NO: 2535 - DNA, 894 bp, Sorghum bicolor
  misc_feature: Ceres ANNOT ID no. 6025018
  misc_feature: Encodes the peptide sequence at SEQ ID NO 2536
atgagtttccaggacgtctgccacgacctggaggcgggccacccgctcccgccgcgtcccccgccgccgccgccgccgcgggccgtggtggcgcactgcgtcttccagatcaacaccaaggtgtcggagctccgccgcctcgcgcacgagctcggcgccgccggactagggggcaacggcgacgcccgcgtggtccgtgagcgcatccgcagggcgcgcgccgacgtcacgcgcctggctcggaacacggcgcggaggctggccgaccccgccgccgccgccgcggtcgggcctaacctggccgcggacttccaggccgcgctcagggagttccagtgggtgcaggaccggatcatcgaggccgatcgccaggaaaccgccgccgccgccgccgccgcccgtcttgcgccgccgctgatgtttcctcctccgtcgccgccgagctacggctctcccatacgatcatcacaactgaacaatgccaataccaatgccactgccggcgctgccgatcagcaatgcaacatccagatgcagcaacagcagcagctggtggaatcacggaggacgcaggagctagccctgctggacaacgagatcgccttcaacgaggccctcgtcgaggagagggggcgggagatatgcaagattcagcaggagatcgctgagatcaacgagatcttcgtggagctcgcaaagctagtccgtgaccagcaatggaacatcgatgtcgtcgagtccaacgtggagaaggccgccatggagacgagcaaggcggaagagaagctctccaaggccgcactgacgcatgagacgaactcgtcgatgaactgcttgctgatcactgtttttgggctcgtcatgttgatctttgcgttagtgtttgtagcgtag

SEQ ID NO: 2536 - protein, 297 aa, Sorghum bicolor
  misc_feature: Ceres ANNOT ID no. 6025018
  misc_feature (209)..(271): Pfam Id: SNARE Pfam Desc: SNARE domain
  misc_feature (166)..(294): NCBI GI: 7488213 NCBI Desc: probable syntaxin - arabidopsis thaliana
  misc_feature (163)..(294): NCBI GI: 9755735 NCBI Desc: syntaxin homologue [arabidopsis thaliana]
  misc_feature (163)..(294): NCBI GI: 21595750 NCBI Desc: syntaxin homologue [arabidopsis thaliana]
  misc_feature (166)..(297): NCBI GI: 76573305 NCBI Desc: syntaxin-like protein [solanum tuberosum]
  misc_feature (166)..(297): NCBI GI: 22597174 NCBI Desc: syntaxin [glycine max]
MSFQDVCHDLEAGHPLPPRPPPPPPPRAVVAHCVFQINTKVSELRRLAHELGAAGLGGNGDARVVRERIRRARADVTRLARNTARRLADPAAAAAVGPNLAADFQAALREFQWVQDRIIEADRQETAAAAAAARLAPPLMFPPPSPPSYGSPIRSSQLNNANTNATAGAADQQCNIQMQQQQQLVESRRTQELALLDNEIAFNEALVEERGREICKIQQEIAEINEIFVELAKLVRDQQWNIDVVESNVEKAAMETSKAEEKLSKAALTHETNSSMNCLLITVFGLVMLIFALVFVA

SEQ ID NO: 2537 - DNA, 1563 bp, Sorghum bicolor
  misc_feature: Ceres ANNOT ID no. 6025019
  misc_feature: Encodes the peptide sequence at SEQ ID NO 2538
atgtgcgtcatttccaacgtcttcgccatgcaagggaaggacctgaatgttgcagatccacagagctgcaatgcagcacgggcacggttgaagagcgcgagcctgcactatgtggatttgcccaataggcagaaggatgatacacgccagtaccagatgtttgttgctacatggaatgttggaggaaagactccgagtaacaggcttaacctgcaagattttctccaggttgaagaatcacctgacatttacgtcttagggtttcaggagatagttcccctgaccgccgggaacgtgctggtggtggaggacaacgagccggcgtccaggtggctggctctcatccaccaggcgctgaacgagccccaggagcagcccgacgacgacgacgacccgccaccgccggatccgtcgccgcctgcagaagcccggcgccatcatcaccgccgccgagactcctccctcttcttccagacgccgtcgctcaaggtgctgagcaacagctaccgcgtcgacagcgcgctcgtcaagacgtgcaactgctccgccgagccgtcgtccatgcgccgcagggcgacggagatacgcgcgtccgtgtaccgcgccgaggtcgaggccgaggccgaagcggcggcggcggcggcggcgtcgtccatgagcaccgcgagcggcggcgagacatccaccagcgggtgcaacaacgacgccaccgacgcagcagcagacgacgccgccgcagcaggctcgccggcggcgcagtgcgagcctggctgcggcatgagctactgcctgatcgggagcaagcagatggtggggctgttcctgtcggtgtgggtgaagcgggagctggtggagcacatcggccacctccgcgtggactgcgtcggcaggggcatcatgggctggctcggcaacaagggctgcatcgccatcagcatgacgctgcaccgcaccagcttctgcttcgtctgcagccacctggcctccggcgagaaggagggcgacgagctgcgccgcaacgccgacgtcgccgagatcatcaggagcgcgcacttcccgcgcgcctgcaagctgccggccagccatcgcgtcccggaaaagattcttgaccacgaccggatgatatggctcggtgacctgaactatcgagtgtcgctgagctacgaagagacaagaacgttgctggaggagaatgactgggacgagcttctgaagaaagatcagctgataattgagagagaagcagggagagtgttcagtggctggaacgaaggcaagatctgcttcgcgccgacgtacaagtacacgcacaactccgacgcgtacgccggcgagacggccaagtccaagaagaagcggaggacgccggcatggtgcgaccggatactgtggcacggcgacggcatcgagcagctgcagtacctgcgcggcgagtccaggttctccgaccaccgtccggtgtgtggcgtgttcgccgtcgaggtggacacccacgacagcagcaagatgaagagggggtactactccgtgaacgcgcggatgggtcatgacaagccggcgtag

SEQ ID NO: 2538 - protein, 520 aa, Sorghum bicolor
  misc_feature: Ceres ANNOT ID no. 6025019
  misc_feature (53)..(491): Pfam Id: Exo_endo_phos Pfam Desc: Endonuclease/Exonuclease/phosphatase family
  misc_feature (250)..(517): NCBI GI: 53793645 NCBI Desc: at5g65090 [arabidopsis thaliana]
  misc_feature (250)..(517): NCBI GI: 10178171 NCBI Desc: inositol-1, 4, 5-trisphosphate 5-phosphatase-like protein [arabidopsis thaliana]
  misc_feature (154)..(496): NCBI GI: 145334295 NCBI Desc: endonuclease/exonuclease/phosphatase family protein [arabidopsis thaliana]
  misc_feature (154)..(496): NCBI GI: 30680735 NCBI Desc: endonuclease/exonuclease/phosphatase family protein [arabidopsis thaliana]
  misc_feature (262)..(505): NCBI GI: 92883941 NCBI Desc: inositol polyphosphate related phosphatase [medicago truncatula]
MCVISNVFAMQGKDLNVADPQSCNAARARLKSASLHYVDLPNRQKDDTRQYQMFVATWNVGGKTPSNRLNLQDFLQVEESPDIYVLGFQEIVPLTAGNVLVVEDNEPASRWLALIHQALNEPQEQPDDDDDPPPPDPSPPAEARRHHHRRRDSSLFFQTPSLKVLSNSYRVDSALVKTCNCSAEPSSMRRRATEIRASVYRAEVEAEAEAAAAAAASSMSTASGGETSTSGCNNDATDAAADDAAAAGSPAAQCEPGCGMSYCLIGSKQMVGLFLSVWVKRELVEHIGHLRVDCVGRGIMGWLGNKGCIAISMTLHRTSFCFVCSHLASGEKEGDELRRNADVAEIIRSAHFPRACKLPASHRVPEKILDHDRMIWLGDLNYRVSLSYEETRTLLEENDWDELLKKDQLIIEREAGRVFSGWNEGKICFAPTYKYTHNSDAYAGETAKSKKKRRTPAWCDRILWHGDGIEQLQYLRGESRFSDHRPVCGVFAVEVDTHDSSKMKRGYYSVNARMGHDKPA

SEQ ID NO: 2539 - DNA, 1104 bp, Sorghum bicolor
  misc_feature: Ceres ANNOT ID no. 6025023
  misc_feature: Encodes the peptide sequence at SEQ ID NO 2540
atggcagccatagatttgtacacaaaccagctgagctcctcgtcgtcgtcctcctcggaccaggagctcatgaaagcactcgaaccttttatccgaagtgcttcttcacccacctcctccacctccaccaccacctctcccttctcctactcgtacccctactgctctgctctgcctcaagattcgtactacctccccgccacatcctcttacacctccttcccgccaccacctcctgctcccaccgccgccacctccttctcccagctcccgcctctgccgcagtcctcgtcgtcgtacgcctctccggcggcggcgtcgtacccgacgtcgtcgtcggcggacgccgcgtcggggctggcggcgctgaaccacctgggcccggcggcgcaaatccaccagatccaggcgcagctcttggcgcagcatcaagagcagcagcagcagcagaggggcctgctggcggcggcggcgttcctcggcccgcgggccacgcagcccatgaagcacgccggtgcgccgtcggcgtcgtccgcgaagctgttccgcggcgttcggcagcggcactggggcaagtgggtggcggagatccggctgcccaggaaccggacgcggctgtggctcggcaccttcgactccgccgaggacgcggcgctcgcctacgacaaggcggccttccgcctccgcggcgacgcggcgcgcctcaacttcccgtcactccgccgcggcggcgtgcacctcgcgggcccgctcgacgcctccgtcgacgccaagctcaccgccatctgccagggcctcaccaccgccgagcccgcgtcgtccaaggccgccgacaccgacgccagcaccaccgccaccgctgccccagactcgcccaaggcctcggcgtccacgaccaccacggagggcgacgagtcggtacactccgccggctcgcctccttcctccctcccggcgttcttccagccaccgccgccgccgcagcagcagcatcccgagatggtaagcctggacttcacggaggcgccgtgggacgagtccgccgccctgcacctcaacaagtatccgtcctgggagatcgactgggactccatcctctcgtga

SEQ ID NO: 2540 - protein, 367 aa, Sorghum bicolor
  misc_feature: Ceres ANNOT ID no. 6025023
  misc_feature (180)..(231): Pfam Id: AP2 Pfam Desc: AP2 domain
  misc_feature (94)..(367): NCBI GI: 49388786 NCBI Desc: dre binding factor 2 [oryza sativa (japonica cultivar-group)]
  misc_feature (94)..(367): NCBI GI: 32140997 NCBI Desc: dre binding factor 2 [oryza sativa (japonica cultivar-group)]
  misc_feature (92)..(367): NCBI GI: 31745669 NCBI Desc: ap2-domain dre binding factor dbf1 [oryza sativa (japonica cultivar-group)]
  misc_feature (96)..(365): NCBI GI: 34099926 NCBI Desc: dreb2 [glycine max]
  misc_feature (64)..(366): NCBI GI: 47934119 NCBI Desc: transcription factor dre-binding factor 2 [gossypium hirsutum]
  misc_feature: The sequence is a functional homolog of SEQ ID NO 10 in the 10/412,699US patent application
  misc_feature: The sequence is a functional homolog of SEQ ID NO 100 in the 10/412,699US patent application
  misc_feature: The sequence is a functional homolog of SEQ ID NO 1000 in the 10/412,699US patent application
  misc_feature: The sequence is a functional homolog of SEQ ID NO 116 in the 11/479,226US patent application
  misc_feature: The sequence is a functional homolog of SEQ ID NO 124 in the 11/479,226US patent application
  misc_feature: The sequence is a functional homolog of SEQ ID NO 1288 in the 10/374,780US patent application
  misc_feature: The sequence is a functional homolog of SEQ ID NO 1289 in the 10/374,780US patent application
  misc_feature: The sequence is a functional homolog of SEQ ID NO 1290 in the 10/374,780US patent application
  misc_feature: The sequence is a functional homolog of SEQ ID NO 1291 in the 10/374,780US patent application
  misc_feature: The sequence is a functional homolog of SEQ ID NO 1434 in the 10/412,699US patent application
  misc_feature: The sequence is a functional homolog of SEQ ID NO 1435 in the 10/412,699US patent application
  misc_feature: The sequence is a functional homolog of SEQ ID NO 1436 in the 10/412,699US patent application
  misc_feature: The sequence is a functional homolog of SEQ ID NO 164 in the 11/375,241US patent application
  misc_feature: The sequence is a functional homolog of SEQ ID NO 1712 in the 10/412,699US patent application
  misc_feature: The sequence is a functional homolog of SEQ ID NO 1948 in the 10/374,780US patent application
  misc_feature: The sequence is a functional homolog of SEQ ID NO 198 in the 10/374,780US patent application
  misc_feature: The sequence is a functional homolog of SEQ ID NO 2233 in the 10/666,642US patent application
  misc_feature: The sequence is a functional homolog of SEQ ID NO 243 in the 11/479,226US patent application
  misc_feature: The sequence is a functional homolog of SEQ ID NO 256 in the 11/375,241US patent application
  misc_feature: The sequence is a functional homolog of SEQ ID NO 501 in the 10/374,780US patent application
  misc_feature: The sequence is a functional homolog of SEQ ID NO 52 in the 11/375,241US patent application
  misc_feature: The sequence is a functional homolog of SEQ ID NO 6 in the 10/412,699US patent application
  misc_feature: The sequence is a functional homolog of SEQ ID NO 642 in the 10/412,699US patent application
  misc_feature: The sequence is a functional homolog of SEQ ID NO 722 in the 10/225,066US patent application
  misc_feature: The sequence is a functional homolog of SEQ ID NO 860 in the 11/435,388US patent application
  misc_feature: The sequence is a functional homolog of SEQ ID NO 906 in the 11/435,388US patent application
  misc_feature: The sequence is a functional homolog of SEQ ID NO 96 in the 10/714,887US patent application
  misc_feature: The sequence is a functional homolog of SEQ ID NO 96 in the 11/435,388US patent application
  misc_feature: The sequence is a functional homolog of SEQ ID NO 996 in the 10/225,066US patent application
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 100 in the 20040045049 US patent application
  misc_feature: The sequence is a functional homolog of SEQ ID NO 1000 in the 20040045049 US patent application
  misc_feature: The sequence is a functional homolog of SEQ ID NO 1434 in the 20040045049 US patent application
  misc_feature: The sequence is a functional homolog of SEQ ID NO 1435 in the 20040045049 US patent application
  misc_feature: The sequence is a functional homolog of SEQ ID NO 1436 in the 20040045049 US patent application
  misc_feature: The sequence is a functional homolog of SEQ ID NO 1712 in the 20040045049 US patent application
  misc_feature: The sequence is a functional homolog of SEQ ID NO 642 in the 20040045049 US patent application
  misc_feature: The sequence is a functional homolog of SEQ ID NO 96 in the 20060015972 US patent application
  misc_feature: The sequence is a functional homolog of SEQ ID NO 1291 in the 20060162006 US patent application
MAAIDLYTNQLSSSSSSSSDQELMKALEPFIRSASSPTSSTSTTTSPFSYSYPYCSALPQDSYYLPATSSYTSFPPPPPAPTAATSFSQLPPLPQSSSSYASPAAASYPTSSSADAASGLAALNHLGPAAQIHQIQAQLLAQHQEQQQQQRGLLAAAAFLGPRATQPMKHAGAPSASSAKLFRGVRQRHWGKWVAEIRLPRNRTRLWLGTFDSAEDAALAYDKAAFRLRGDAARLNFPSLRRGGVHLAGPLDASVDAKLTAICQGLTTAEPASSKAADTDASTTATAAPDSPKASASTTTTEGDESVHSAGSPPSSLPAFFQPPPPPQQQHPEMVSLDFTEAPWDESAALHLNKYPSWEIDWDSILS

SEQ ID NO: 2541 - DNA, 1101 bp, Sorghum bicolor
  misc_feature: Ceres ANNOT ID no. 6025037
  misc_feature: Encodes the peptide sequence at SEQ ID NO 2542
atggggtatctgccggcgctgggcgggaaggcggcgcacctggtgtccgacctcgccaccgtcatcctcaaccccgtctccgagcgcgagcgccagcgacaccacccctcccacctcccggaggccaatgaaggaaaagacacactattcgatgatgatgattctgaccaaaattctgagactcctgatggtcctgacacatcttccttcagagcatttctgatgtcctttgtgccttcctcaactgccagcaaggattcaatggagaccataactgagcataatctagatgtggaatacccaactttaacacctgttgggaaggcatgtagtgggaggaaaagtctgcttagtagagggaaacattccattggtaggattattagcaaagcaggacttggtaatttgaaacagaaacagacccccagcattgatggtgaaatcataagtcaaacagaatcagttgcacccagatttgaaatgaagcgatcaaaagaatcaactttgcatgataaattgccagctatgtctgaaccatctgttcttctaacagaaatgatgcgagctgttctttatacatctcttcctgttcttgctcaaggaaggaactggatgctggtatacagcacctggaggcatggaatttctttgtctactctgtatcgaagaagcaggctttgtgctggctactcacttctgatagttggggatcgaagaggagcagtttttggtggtttggtcgaggccccactgcagcctatcataaaaaagaagtatcagggaactaatgactgctttgtgttcaccaacgtagatggccgtcctgttatatgccatccaacaggtgctaataactattttacgttttgttctaccgactatttggcaatgggaggtggtggtcacttcgcactttatctcgatggagaccttgtgactggttctagttccacttccgagacttttaacaacccatgcttatcccatacccaggaattcaaaatcaaagatgtggagctttggggcttcgtcaatgcttccaagtatgaagagatgctcacggtctgccgcaccgaaaagcaaggaatttggaatctgtga

SEQ ID NO: 2542 - protein, 366 aa, Sorghum bicolor
  misc_feature: Ceres ANNOT ID no. 6025037
  misc_feature (206)..(344): Pfam Id: TLD Pfam Desc: TLD
  misc_feature (1)..(366): NCBI GI: 51535088 NCBI Desc: nucleolar protein-like [oryza sativa (japonica cultivar-group)]
  misc_feature (1)..(363): NCBI GI: 46805939 NCBI Desc: oxidation protection protein-like [oryza sativa (japonica cultivar-group)]
  misc_feature (141)..(343): NCBI GI: 94733752 NCBI Desc: novel protein similar to vertebrate oxidation resistance 1 (oxr1) [danio rerio]
  misc_feature (174)..(343): NCBI GI: 13540300 NCBI Desc: nucleolar protein c7b [mus musculus]
  misc_feature (174)..(343): NCBI GI: 119612311 NCBI Desc: oxidation resistance 1, isoform cra_c [homo sapiens]
  misc_feature: Useful for making plants with altered protein content
  misc_feature: Functional homolog of the protein sequence given in SEQ ID NO 13487
MGYLPALGGKAAHLVSDLATVILNPVSERERQRHHPSHLPEANEGKDTLFDDDDSDQNSETPDGPDTSSFRAFLMSFVPSSTASKDSMETITEHNLDVEYPTLTPVGKACSGRKSLLSRGKHSIGRIISKAGLGNLKQKQTPSIDGEIISQTESVAPRFEMKRSKESTLHDKLPAMSEPSVLLTEMMRAVLYTSLPVLAQGRNWMLVYSTWRHGISLSTLYRRSRLCAGYSLLIVGDRRGAVFGGLVEAPLQPIIKKKYQGTNDCFVFTNVDGRPVICHPTGANNYFTFCSTDYLAMGGGGHFALYLDGDLVTGSSSTSETFNNPCLSHTQEFKIKDVELWGFVNASKYEEMLTVCRTEKQGIWNL

SEQ ID NO: 2543 - DNA, 1029 bp, Sorghum bicolor
  misc_feature: Ceres ANNOT ID no. 6025059
  misc_feature: Encodes the peptide sequence at SEQ ID NO 2544
atggccaagcacatcagtgtcctgctactgatggctgtggcgctcgccgcaaccatggccgagccgtcgacggcgaccaggaagctcatgttcctggtccagccacagccgaacctcctcacgtaccacaacggcgccgtgctgagcggcgacatccccgtctccatcctctggtacggccgcttcacgccggcgcagaaggccgtcgtctccgacttcctcttctccctctctgccgcgccgccgcaggagccgtcgtcttcgtcgtcgtcgtcgtcccccgcgccgtccgttgcccagtggtggagcaacatcaaccagctctacctctccaaggcggcggcggcggccgtcagcaagaagaacggcgcgcagggcggcgccaagcggaacgcgcggggggtcctgtcgggccaggtcaccgacgagggctgctcgctggggaagagcctgaagctgtcccagcttccatcgctggcggcggcggccgcggcacgccccgccgccaagaaggaccagggcggcggcggcgtcgtgctggtgctcacggcgcgggacgtggccgtggagggcttctgcatgagccggtgcggccaccacggttcgtactcgtacgacggcggcgcgcggtccggctcccggtcccgtcgcgcggcggcggcggcgtacgcgtgggtgggcaaccccgtcgaccagtgcccgggccagtgcgcgtggccgttccaccagccggcgtacgggccgcaggcgccgccgccgctggtgccgcccagcggggacgcgggcatggacggcgtggtgatcaacgtggccagcatggtcgccggcggcgaccgcggcgcaccgctggaggccgccacggcgtgcgccggcgtgtacggcaagggcgcgtaccctgggtacgccgggcggctgctcgtggacggcgcgacgggcgccagctacaacgcgcacggcgcgcgcgggaggaagtacctgctcccggcgctgttcaaccccgacacgtcggcgtgctccacgctggtgtag

SEQ ID NO: 2544 - protein, 342 aa, Sorghum bicolor
  misc_feature: Ceres ANNOT ID no. 6025059
  misc_feature (40)..(342): Pfam Id: Phi_1 Pfam Desc: Phosphate-induced protein 1 conserved region
  misc_feature (92)..(342): NCBI GI: 115467136 NCBI Desc: os06g0220000 [oryza sativa (japonica cultivar-group)]
  misc_feature (90)..(342): NCBI GI: 115448781 NCBI Desc: os02g0756800 [oryza sativa (japonica cultivar-group)]
  misc_feature (128)..(342): NCBI GI: 3759184 NCBI Desc: phi-1 [nicotiana tabacum]
  misc_feature (132)..(342): NCBI GI: 115467140 NCBI Desc: os06g0220300 [oryza sativa (japonica cultivar-group)]
  misc_feature (146)..(342): NCBI GI: 140039309 NCBI Desc: phosphate-induced protein 1 conserved region [medicago truncatula]
MAKHISVLLLMAVALAATMAEPSTATRKLMFLVQPQPNLLTYHNGAVLSGDIPVSILWYGRFTPAQKAVVSDFLFSLSAAPPQEPSSSSSSSSPAPSVAQWWSNINQLYLSKAAAAAVSKKNGAQGGAKRNARGVLSGQVTDEGCSLGKSLKLSQLPSLAAAAAARPAAKKDQGGGGVVLVLTARDVAVEGFCMSRCGHHGSYSYDGGARSGSRSRRAAAAAYAWVGNPVDQCPGQCAWPFHQPAYGPQAPPPLVPPSGDAGMDGVVINVASMVAGGDRGAPLEAATACAGVYGKGAYPGYAGRLLVDGATGASYNAHGARGRKYLLPALFNPDTSACSTLV

SEQ ID NO: 2545 - DNA, 2118 bp, Sorghum bicolor
  misc_feature: Ceres ANNOT ID no. 6025075
  misc_feature: Encodes the peptide sequence at SEQ ID NO 2546
atgtgggtgttctacatgatatcgctgccgctgacggtggggatggtggcggcgacgctgcgctacttcgcggggcccgcagtgccggcccacgtcctcgccgtcgtcggctacgcgtggctctgctccctctccttcgtcgtcctcgtcccgaccgacatctggacggcagtttctggcaatggagatcagaagagtgacgttagattcttctggagctggtcgtattggagtacatttatcctagcatggtctattgttcccactcttcagggctatgaagattctggagatttcacgttcagagaaagactgaaagctagcatccacaagaacatgacctattatgcaattgttggagccatcggcctttttggactcattctaattataataatgcgccatgattgggtccgtggtatcttgggcttttccatggcatgctcaaatacctttggcttagtgacaggtgccttcctgcttggttttggattgagtgaaattccaaggaatgtatggcgaagtgctgattggactcgtcgtctacaatttttatctcatagagtttcgaagatggctacaaagcttgatcatgctcaccaagaatattgcaatgttgttcaagccacctcgaatcaaatgtccaagcgtgacccattaagaccttgcatggatatcatcaatgaaatactgactcaaatgctgcaagatgatccgtcattcaagccttctggtgggaaattaggggaacaggatatggactatgatactgataataaaacaatggctacactccgacgtcaacttaggaaagcccacgaagagtattataggcgtaaaagtgattatatgacttgtgttgtggaagcccttgaactagaagacactatcagaaactatgagcaacgtgatgctagtggatggaaatacatgtcaagtttcagggaaaatcgatcaggcacactgggttctttccttgactccacagagttcatttggcgctgtttactgagaaagcaacttatgagagtacttgctgttatccttggatgcatctcggcttccatactgttggctgaggccactttgcttccaagtgatgttgatctatcacttttctccaatcttataaatgctgtaggaaagcgagaagttctagtccaggttgctgcgtttgttcccttgatgtatatgtgcatctgcacatactattcactgattaggatagggatgatgctgttatattcgttgaccccaggacatactagttcagtcagcttgcttatgatctgctcaatggttgcaagatatgcaccacccatttcttacaacttcctgaatctcattcaccttggtggtaatgctaaaactacttttgaaaagagaatgggaaacattgatgacgttgctcctttctttgggagaaccttcaacaaaatctacccactcattatggttgtttatactctattggtcgccggaaatttcttcgagcatttgatagacttttttgggagcttgaaaaggttcaagtgttggactgaccaagaagatatggatgggttggatccatctggattatttattcttcagaaagagagaaactccatggaacaaggacgcaaagtcagtgagcatgcaactccactagcaagaaatttctactgtttaggcaaagacgtcgaatctggaaacataccacagggcgaggatacagtggagacgaagccggaacgaaccgcccagccgaagcacggtggcgatgttgctcacagatattcttcagttagggaacagtacagcagctcgaaaccagaggagcaagttcagaaggaaatttcaccggcctccatcaagctcgacaccggaaattctgaagagccggcggctccagattcaccggctgagacggcctcaaggtgggcctcaatgaagatgggtcttcagaacttcagagcaagcatgggctccaagaagttcctccgtttgggcctgtcttctagggccaccgggacgaatgaatctgctacggaaacactcgatgagatcttccggaaactgaaacggcattcgaacagcacggatgcggatcacctcgacgacgatggattgccttga

SEQ ID NO: 2546 - protein, 705 aa, Sorghum bicolor
  misc_feature: Ceres ANNOT ID no. 6025075
  misc_feature (2)..(496): Pfam Id: LMBR1 Pfam Desc: LMBR1-like membrane protein
  misc_feature (1)..(702): NCBI GI: 46805692 NCBI Desc: lmbr1 integral membrane protein-like [oryza sativa (japonica cultivar-group)]
  misc_feature (1)..(657): NCBI GI: 92893534 NCBI Desc: lmbr1-like conserved region [medicago truncatula]
  misc_feature (1)..(703): NCBI GI: 140039291 NCBI Desc: lmbr1-like conserved region [medicago truncatula]
  misc_feature (72)..(640): NCBI GI: 24645348 NCBI Desc: cg8135-pa [drosophila melanogaster]
  misc_feature (72)..(640): NCBI GI: 21428818 NCBI Desc: gh05505p [drosophila melanogaster]
MWVFYMISLPLTVGMVAATLRYFAGPAVPAHVLAVVGYAWLCSLSFVVLVPTDIWTAVSGNGDQKSDVRFFWSWSYWSTFILAWSIVPTLQGYEDSGDFTFRERLKASIHKNMTYYAIVGAIGLFGLILIIIMRHDWVRGILGFSMACSNTFGLVTGAFLLGFGLSEIPRNVWRSADWTRRLQFLSHRVSKMATKLDHAHQEYCNVVQATSNQMSKRDPLRPCMDIINEILTQMLQDDPSFKPSGGKLGEQDMDYDTDNKTMATLRRQLRKAHEEYYRRKSDYMTCVVEALELEDTIRNYEQRDASGWKYMSSFRENRSGTLGSFLDSTEFIWRCLLRKQLMRVLAVILGCISASILLAEATLLPSDVDLSLFSNLINAVGKREVLVQVAAFVPLMYMCICTYYSLIRIGMMLLYSLTPGHTSSVSLLMICSMVARYAPPISYNFLNLIHLGGNAKTTFEKRMGNIDDVAPFFGRTFNKIYPLIMVVYTLLVAGNFFEHLIDFFGSLKRFKCWTDQEDMDGLDPSGLFILQKERNSMEQGRKVSEHATPLARNFYCLGKDVESGNIPQGEDTVETKPERTAQPKHGGDVAHRYSSVREQYSSSKPEEQVQKEISPASIKLDTGNSEEPAAPDSPAETASRWASMKMGLQNFRASMGSKKFLRLGLSSRATGTNESATETLDEIFRKLKRHSNSTDADHLDDDGLP

SEQ ID NO: 2547 - DNA, 2073 bp, Sorghum bicolor
  misc_feature: Ceres ANNOT ID no. 6025076
  misc_feature: Encodes the peptide sequence at SEQ ID NO 2548
atgttctcgtcggaggaggacgagcccttcgcggcgcagacgcttgcggacttcctcttcgaatcctacgccgacgacattcaccgcatcctcctcgacgacgatccctccaagctccatttcccgcttgttattgagtgcgtcctcccgatcagttcctcccgttcccgttcccgttactgttcccgttccccttcaccaaaccctaaccccatctcctctcgcagattcgctgagcttatggagttcgaccccaagttcgccggcaagctctacttagatccctgtacgtacctgcccttcctcagagacgccgcacaatgggcccaggacaaggtgttgaagaaactggggaatttgaaaaccacagagacgaagaagtccgtgcatgtgcgtattgatgtcactggatcgccgctagaattccctgaggtctccccaagtattggaaaggtgagggtgaagcatatgaggaaattgattgctctgaagggaactgtgatcagatcaggtggtgtgaagatgattgagtatgagaggtgctacatgtgcaggaagtgcaaacacagctttgaggtctatcctgagctggaggctaggaatcgtataaatcttcctccattgtgcccaaaggcttcaagaggctgtacaagtgcttcttttcagttcgtagaaggtagcaccatttgccatgattaccaagaaatcaaaattcaagagaatgtacagcttcttggtattgggtctataccccgctccatgcctgtaattttgatggatgaccttgttgatagcattaaagctggagatgatgtcattattacgggtatattatctgccaaatggtctcctgatattaaggatgtgcggtccaaccttgatcctatgctgcttgctaattatgtgaggagaacaaatgagctgaagtctgatatagacattcctgcggaaactggagacaagtttgggtgtttctgggaagaccatgctcccctagaaggaagaaatttaatcttgaaaggcatctgtcctcaaatttatgggctattcacggtgaagcttgcagttgctcttacattaattggtggagtgcagcatgttgatgcttctggaacaaaggttcgtggagaatcccatatgcttcttgttggtgatccaggtactggtaaatcccagtttttgaagtttgctgctaaattgagcaaccgctctgtgatcacaactggtcttggaagcaccagtgctggtttaactgtcacagctgtcaaggatggaggggagtggatgcttgaggctggtgctcttgttttggctgatggtggtttatgctgcatagatgaatttgacagcatgcgagagcatgacagaacaacaatacatgaagccatggagcaacagacaataagtgttgcgaaggctggattagttacaacactcagtacaaggactactgtcttcggtgccacgaatccgaaagggcaatatgaccctgatgaaagtttgtctgtgaatacaacactttcagcaccactgttgagtagatttgatatagttcttgttcttctggatacacaaaatactgcttgggatgaaatagtttcatctcatatattggagaatttagatgaaaagaaagataagacaaatgcttctgatgtagagtggacactccccaagttgagaaggtacatcaattatgtaaggagacagtttaaaccagtgctgacaaaggaggcagaaagagttatctcgagctattatcagctacagagaaaatcaggaacacataatgcagcaaggacaacggtgcgcatgcttgaaagtttgataaggctagcacaagcacatgcaagactaatgttcagaaatgaggttagacaacttgatgccattgctgccatattgtgcatggaatcctccatgacaacatctccaatagtggacattgttggaaatgctctgcactcaaattttacagatgaccctgatgaagaatgtatcctaacatgtgattttgtagcctgcttattcaagaatatcaaggacttgagtcatttcttcagtaaaaactaa

SEQ ID NO: 2548 - protein, 690 aa, Sorghum bicolor
  misc_feature: Ceres ANNOT ID no. 6025076
  misc_feature (325)..(642): Pfam Id: MCM Pfam Desc: MCM2/3/5 family
  misc_feature (372)..(529): Pfam Id: Mg_chelatase Pfam Desc: Magnesium chelatase, subunit ChlI
  misc_feature (379)..(567): Pfam Id: AAA Pfam Desc: ATPase family associated with various cellular activities(AAA)
  misc_feature (379)..(523): Pfam Id: AAA_5 Pfam Desc: ATPase family associated with various cellular activities(AAA)
  misc_feature (77)..(668): NCBI GI: 42569019 NCBI Desc: minichromosome maintenance family protein / mcm family protein [arabidopsis thaliana]
  misc_feature (95)..(673): NCBI GI: 86198292 NCBI Desc: tpa: mini-chromosome maintenance deficient 9 [homo sapiens]
  misc_feature (113)..(673): NCBI GI: 86439953 NCBI Desc: minichromosome maintenance deficient domain containing 1 [mus musculus]
  misc_feature (95)..(673): NCBI GI: 86198290 NCBI Desc: tpa: mini-chromosome maintenance deficient 9 [xenopus laevis]
  misc_feature (95)..(426): NCBI GI: 119568577 NCBI Desc: minichromosome maintenance deficient domain containing 1, isoform cra_b [homo sapiens]
MFSSEEDEPFAAQTLADFLFESYADDIHRILLDDDPSKLHFPLVIECVLPISSSRSRSRYCSRSPSPNPNPISSRRFAELMEFDPKFAGKLYLDPCTYLPFLRDAAQWAQDKVLKKLGNLKTTETKKSVHVRIDVTGSPLEFPEVSPSIGKVRVKHMRKLIALKGTVIRSGGVKMIEYERCYMCRKCKHSFEVYPELEARNRINLPPLCPKASRGCTSASFQFVEGSTICHDYQEIKIQENVQLLGIGSIPRSMPVILMDDLVDSIKAGDDVIITGILSAKWSPDIKDVRSNLDPMLLANYVRRTNELKSDIDIPAETGDKFGCFWEDHAPLEGRNLILKGICPQIYGLFTVKLAVALTLIGGVQHVDASGTKVRGESHMLLVGDPGTGKSQFLKFAAKLSNRSVITTGLGSTSAGLTVTAVKDGGEWMLEAGALVLADGGLCCIDEFDSMREHDRTTIHEAMEQQTISVAKAGLVTTLSTRTTVFGATNPKGQYDPDESLSVNTTLSAPLLSRFDIVLVLLDTQNTAWDEIVSSHILENLDEKKDKTNASDVEWTLPKLRRYINYVRRQFKPVLTKEAERVISSYYQLQRKSGTHNAARTTVRMLESLIRLAQAHARLMFRNEVRQLDAIAAILCMESSMTTSPIVDIVGNALHSNFTDDPDEECILTCDFVACLFKNIKDLSHFFSKN

SEQ ID NO: 2549 - DNA, 1431 bp, Sorghum bicolor
  misc_feature: Ceres ANNOT ID no. 6025080
  misc_feature: Encodes the peptide sequence at SEQ ID NO 2550
atggatgtcatgcagacaagtgactcttcacatcatggaattgtagaaaatagcccatatagaatcccgtatggaagacatgcagaaggtggcaaacttggtaattcatggtattttagtagaaaagaaatagaagaaaactccatttcaaggaaagatggcattgatctgaagaaggagtcttattttcgcaaggcatactgcacttttctgcaggattttgggatgaggcttcaagtgcctcaagttacgattgctacagctatagtgttctgtcatcgttttttccttcgccaatctcatgcaaaaaatgacaggcagacaattgcaaccgtttgcatgttcttggcgggaaaagttgaagaaaccatcagatctctaagggatgtcgtactcctttcctatgagatcatcaacaaaaaggatcctgctgctttgcagcgaattaggcagaaggaagtatatgaacaacagaaggaacttattttacttggggaacgtgttgttcttgtaacacttggttttgacttgaacatccaacatccgtacaagcccttggttgaagcaataggtagattcaaggttgctcaaagtgcacttgctcaagttgcctggaactttgtcaatgatgggctccgtacttcactttgcctgcaatttaagccccaccaaattgcggccggtgcaatattcatggctgcgaaatttctcaaaatcaagcttccgtcaggtggtgagaaggtctggtggcaagagtttgatgttaccccacggcacttggaagagattagcaaccaaattttggagctctacgagcaaaatgttgttgcaccaccaccattgcaaggaaatgatactgacaggagccctgctagtgttcctaatcaacgtgctcctggaaaagttcctactgcccatgaacctcaagcatccagacaattgagccatcaaaacgtgccaggccaccatggctatgaccatgctcatcctgagaagcaacacccaaaccagaggacacctcggaatgaagcaagggatagcgttgtcaataccaacgatggacccaaaatatcatcctcaatgatggatgcaatgaggaagatagataaggataaagtgaaagcagccctggagaagcggaggaaatctaaaggtgatgttcctagaaaggttgacatcatggatgatgatgatctgatcgagagggagctggaacatggtgtggagttggctgctgaaggtgagaagatcaagcaggagagaaggcaaagctggccccatcctgcacacagggacgattcactaaaggctgctcgcatgataaaaaatacggagggcgagctatccactgacaagcaagggcaccgctccccagaccggaactggaaccacgatcgtggtgaaagggacattaaaaggctaaggtcatga

SEQ ID NO: 2550 - protein, 476 aa, Sorghum bicolor
  misc_feature: Ceres ANNOT ID no. 6025080
  misc_feature (35)..(178): Pfam Id: Cyclin_N Pfam Desc: Cyclin, N-terminal domain
  misc_feature (37)..(377): NCBI GI: 30694715 NCBI Desc: cyclin family protein [arabidopsis thaliana]
  misc_feature (37)..(417): NCBI GI: 145340421 NCBI Desc: cyclin-dependent protein kinase [arabidopsis thaliana]
  misc_feature (36)..(342): NCBI GI: 46805809 NCBI Desc: cyclin k-like [oryza sativa (japonica cultivar-group)]
  misc_feature (108)..(309): NCBI GI: 115444041 NCBI Desc: os02g0133000 [oryza sativa (japonica cultivar-group)]
  misc_feature (38)..(271): NCBI GI: 37703718 NCBI Desc: cyclin t1 [medicago truncatula]
MDVMQTSDSSHHGIVENSPYRIPYGRHAEGGKLGNSWYFSRKEIEENSISRKDGIDLKKESYFRKAYCTFLQDFGMRLQVPQVTIATAIVFCHRFFLRQSHAKNDRQTIATVCMFLAGKVEETIRSLRDVVLLSYEIINKKDPAALQRIRQKEVYEQQKELILLGERVVLVTLGFDLNIQHPYKPLVEAIGRFKVAQSALAQVAWNFVNDGLRTSLCLQFKPHQIAAGAIFMAAKFLKIKLPSGGEKVWWQEFDVTPRHLEEISNQILELYEQNVVAPPPLQGNDTDRSPASVPNQRAPGKVPTAHEPQASRQLSHQNVPGHHGYDHAHPEKQHPNQRTPRNEARDSVVNTNDGPKISSSMMDAMRKIDKDKVKAALEKRRKSKGDVPRKVDIMDDDDLIERELEHGVELAAEGEKIKQERRQSWPHPAHRDDSLKAARMIKNTEGELSTDKQGHRSPDRNWNHDRGERDIKRLRS

SEQ ID NO: 2551 - DNA, 1620 bp, Sorghum bicolor
  misc_feature: Ceres ANNOT ID no. 6025082
  misc_feature: Encodes the peptide sequence at SEQ ID NO 2552
atgggtggtcttggattgtctggcttcgtgctgttttcttgggtgcttttcttgtgctgcatcttctcagtggatggactgtctaaggtgaggggtgttaacttgggaggatggttggtcattgaagggtggattaagccatcactttttgacgggattccaaatggggatatgctcgtaggtggattgatcttagttattcactgtgtgttcttggatgggacacaggtgcagatccgctcagtggtattgaataagtatgttagtgcagccaatggtggtggctcaaatgtgacagtggaccgtgatgtggcctcaacgtgggagacattcaggctttggagggtgtcagataatgaatttcagcttcgatgccttggaggtcaatttttgacagtgaacagtgaagatggtttgatcttggctactgcaaagcatccattgtccaccgagactttcttcattgaaagaaatgctggaagggttcatatcagacctctgaatggaggctatgtgcaagcgacaaacaatcatctgcttatttccacttatcaattccaaccaggatgggataataatttagcgacgtttgaattggtgattgttgccaataacttgcatggggactaccagcttgccaatggttatggttccgagaaggcgaagatggtcttagaagagcacagaagaagtttcattacagcaaacgactttgatttcctatctcggcacggaattaatactgtgagaattcctgttggatggtggataacacaagatccttatccaccttctccatttgttggagggtctttggcagccctggacctagcattttcatgggcacaatcttacggtttgaaatgtataattgatcttcatgctgctcctggttctcaaaatggaatggaacatagtgcgagcagggatggttctgtggactggccctcgcctgaatatatctcacaaacactggaagttattgacttcctggcgacaaggtatggaggccatccttcccttttgggtattgagcttctgaacgaaccttctgcagctacagttcctttagatgttctagtgtcctactatatgaggggataccaaattgtgcgaaaccattcatcaactgcatatgttattctctgtcaaagaattgggaatgcagacccaatcgaactctttcaagctggtattggtctttcaaatgttgtagttgatttacactactacaacttgtttgatccatactttgccaccatgaattcctctcagaatattgaatttgtttacaaaatgagagcaccacagttacaagaccttaaggcaatgaatgggcctcttgtcttcattggtgaatgggttaatgaatgggacgtacaaaatgcatcacagtacgagtatcagaagtttggcagtgctcagttggatgtttatgctaacgctacctttggttggtcatactggacacttaagaatgacatgatccattgggacttcgagtggaatattcagaataaatacctattattcagtggttcatccatgctgaagacaccaagcttcctgctgctgctagcgttaggatggggaattcacctgatcatcatgccaagataa

SEQ ID NO: 2552 - protein, 539 aa, Sorghum bicolor
  misc_feature: Ceres ANNOT ID no. 6025082
  misc_feature (211)..(499): Pfam Id: Cellulase Pfam Desc: Cellulase (glycosyl hydrolase family 5)
  misc_feature (8)..(514): NCBI GI: 144923843 NCBI Desc: glycoside hydrolase, family 5 [medicago truncatula]
  misc_feature (9)..(509): NCBI GI: 144924149 NCBI Desc: glycoside hydrolase, family 5; n-6 adenine-specific dna methylase [medicago truncatula]
  misc_feature (31)..(516): NCBI GI: 144924148 NCBI Desc: glycoside hydrolase, family 5 [medicago truncatula]
  misc_feature (87)..(509): NCBI GI: 144924146 NCBI Desc: glycoside hydrolase, family 5; actin-crosslinking proteins [medicago truncatula]
  misc_feature (30)..(334): NCBI GI: 23396187 NCBI Desc: putataive glucan 1,3-beta-glucosidase precursor [oryza sativa (japonica cultivar-group)]
MGGLGLSGFVLFSWVLFLCCIFSVDGLSKVRGVNLGGWLVIEGWIKPSLFDGIPNGDMLVGGLILVIHCVFLDGTQVQIRSVVLNKYVSAANGGGSNVTVDRDVASTWETFRLWRVSDNEFQLRCLGGQFLTVNSEDGLILATAKHPLSTETFFIERNAGRVHIRPLNGGYVQATNNHLLISTYQFQPGWDNNLATFELVIVANNLHGDYQLANGYGSEKAKMVLEEHRRSFITANDFDFLSRHGINTVRIPVGWWITQDPYPPSPFVGGSLAALDLAFSWAQSYGLKCIIDLHAAPGSQNGMEHSASRDGSVDWPSPEYISQTLEVIDFLATRYGGHPSLLGIELLNEPSAATVPLDVLVSYYMRGYQIVRNHSSTAYVILCQRIGNADPIELFQAGIGLSNVVVDLHYYNLFDPYFATMNSSQNIEFVYKMRAPQLQDLKAMNGPLVFIGEWVNEWDVQNASQYEYQKFGSAQLDVYANATFGWSYWTLKNDMIHWDFEWNIQNKYLLFSGSSMLKTPSFLLLLALGWGIHLIIMPR

SEQ ID NO: 2553 - DNA, 1170 bp, Sorghum bicolor
  misc_feature: Ceres ANNOT ID no. 6025097
  misc_feature: Encodes the peptide sequence at SEQ ID NO 2554
atggagggcggcggcgcggaacaagcacccgaggcggcggcggaggtgaaaaatccgaggtgcttcatggacgtcaccatcggcggcgagatggaggggagaatcgttgtagagctctacgcgtccgtggcaccgcggacggcggagaacttccgcgcgctctgcaccggggagaagggcatcggcgccgccagcggcaagccgcttcactttaagggttcatgcttccaccgtgttattaaagggtttatggttcaagggggagacataactgctggagatggaacggggggagagtcaatttatgggtccaaatttgaggacgagaattttgttttaaagcatgagaggaaaggaatgctttcaatggctaattctggtcccaacacaaatggttctcagtttttcatcactaccacccggacacctcatttagatgggaaacatgttgtttttggtagagtgataaaagggatgggggtagttcgctctattgagcatgtcactgtcggagaatctgactgccccactcttgatgtcaaaattgttgattgtggggaacttcctgaaggtgctgatgatggagttgtaaactttttcaaagatggtgacacgtatccggattggcccaatgatcttgaagagaagcctgctgaggtttcatggtggatggatgctgtggagtctgctaaagcttatgggaatgacaatttcaagaaacaggactacaaagcagctctcagaaagtacaggaaagctctgcgctacttggatgtttgctgggagaaagaagagatagatgaagataagagcacagcactgcggaagaccaagtcaataatactcactaatagctctgcatgcaaattaaggttaggagattcaaagggtgctttattagacgcggattttgcactgcgtgaaacggagggaaatgctaaagcttttttccgacaaggacaggcacacattgcacttaatgacattgatgcagcagtggagagcttcaaacatgcattggagttggagccaaatgatgctggaatcaaaagagagctggctggtgcaaagaagaagattgctgacagaagagatcaggagcgaaaggcatttgctaggatgttccaaccttctggaaaatctgacaagagcaacgaagagaataattga

SEQ ID NO: 2554 - protein, 389 aa, Sorghum bicolor
  misc_feature: Ceres ANNOT ID no. 6025097
  misc_feature (20)..(188): Pfam Id: Pro_isomerase Pfam Desc: Cyclophilin type peptidyl-prolyl cis-trans isomerase/CLD
  misc_feature (313)..(346): Pfam Id: TPR_2 Pfam Desc: Tetratricopeptide repeat
  misc_feature (313)..(346): Pfam Id: TPR_1 Pfam Desc: Tetratricopeptide repeat
  misc_feature (16)..(376): NCBI GI: 144924501 NCBI Desc: peptidyl-prolyl cis-trans isomerase, cyclophilin type [medicago truncatula]
  misc_feature (16)..(375): NCBI GI: 109892831 NCBI Desc: peptidyl-prolyl cis-trans isomerase d (ppiase d) (rotamase d)
  misc_feature (10)..(375): NCBI GI: 50344784 NCBI Desc: zgc:86711 [danio rerio]
  misc_feature (9)..(375): NCBI GI: 27806463 NCBI Desc: peptidylprolyl isomerase d [bos taurus]
  misc_feature (17)..(375): NCBI GI: 49900877 NCBI Desc: peptidylprolyl isomerase d [rattus norvegicus]
  misc_feature (20)..(375): SWISSPROT Homolog: EC 5.2.1.8 Peptidyl-prolyl cis-trans isomerase CYP40
MEGGGAEQAPEAAAEVKNPRCFMDVTIGGEMEGRIVVELYASVAPRTAENFRALCTGEKGIGAASGKPLHFKGSCFHRVIKGFMVQGGDITAGDGTGGESIYGSKFEDENFVLKHERKGMLSMANSGPNTNGSQFFITTTRTPHLDGKHVVFGRVIKGMGVVRSIEHVTVGESDCPTLDVKIVDCGELPEGADDGVVNFFKDGDTYPDWPNDLEEKPAEVSWWMDAVESAKAYGNDNFKKQDYKAALRKYRKALRYLDVCWEKEEIDEDKSTALRKTKSIILTNSSACKLRLGDSKGALLDADFALRETEGNAKAFFRQGQAHIALNDIDAAVESFKHALELEPNDAGIKRELAGAKKKIADRRDQERKAFARMFQPSGKSDKSNEENN

SEQ ID NO: 2555 - DNA, 672 bp, Sorghum bicolor
  misc_feature: Ceres ANNOT ID no. 6025104
  misc_feature: Encodes the peptide sequence at SEQ ID NO 2556
atggcgcgcgagaggcgggagatacggcggatagagaacgcggcagcgcggcaggtgacctactccaagcgccggcgcgggctgttcaagaaggcggaggagctcgcggtgctctgcgacgccgacgtcgcgctcgtcgtcttctccgccaccggcaagctctcgcagttcgcgagcaccagtatgaatcatatcattgacaagtacagtacacattctaagaatctggggaaatcacatcagcagtctcctattgatttgaatatagagcagagcaagtacactggtttgaacgagcaacttgcagaagcaactcatggacttagacagatgagaggtgaaaaccttgagggattgagtgtcgaggaattgcaccaaatggaaaggaaacttgaagcaggattgcatagagtgcttagtactaaggaccagttattcacgcaacaaatcagcgaactacaacaaaagggaacacagctggaagatgagaacaggcgtctaaaagaacaaatgcctcaggtgttaacagctggcacaatggtggttggtgctggtgcagaaaatatcctcactgaagatggacagtcgtctgaatctgtaatgactgcattgcattcaggaagctcgctcgacaatgatgatggttctgatatatgcttgaagttatcgtga

SEQ ID NO: 2556 - protein, 223 aa, Sorghum bicolor
  misc_feature: Ceres ANNOT ID no. 6025104
  misc_feature (9)..(59): Pfam Id: SRF-TF Pfam Desc: SRF-type transcription factor (DNA-binding and dimerisationdomain)
  misc_feature (79)..(173): Pfam Id: K-box Pfam Desc: K-box region
  misc_feature (1)..(223): NCBI GI: 29372754 NCBI Desc: m21 [zea mays]
  misc_feature (1)..(223): NCBI GI: 120407344 NCBI Desc: mads-box protein 10 [hordeum vulgare subsp. vulgare]
  misc_feature (1)..(223): NCBI GI: 66271022 NCBI Desc: mads box protein vrt-2 [triticum aestivum]
  misc_feature (1)..(222): NCBI GI: 71025326 NCBI Desc: mads10 [lolium perenne]
  misc_feature (1)..(222): NCBI GI: 95981862 NCBI Desc: mads-box transcription factor taagl11 [triticum aestivum]
  misc_feature: Abnormal phyllotaxy, leaf number higher than wild-type
  misc_feature: The plant flowers significantly earllier than wild-type.
  misc_feature: The sequence is a functional homolog of SEQ ID NO 1453 in the 10/374,780US patent application
  misc_feature: The sequence is a functional homolog of SEQ ID NO 2064 in the 10/374,780US patent application
  misc_feature: The sequence is a functional homolog of SEQ ID NO 572 in the 10/412,699US patent application
  misc_feature: The sequence is a functional homolog of SEQ ID NO 816 in the 10/225,066US patent application
  misc_feature: Useful for making plants with altered Lignin content
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 12958
  misc_feature: Functional homolog of the protein sequence given in SEQ ID NO 13210
  misc_feature: The sequence is a functional homolog of SEQ ID NO 572 in the 20040045049 US patent application
  misc_feature: The sequence is a functional homolog of SEQ ID NO 1453 in the 20060162006 US patent application
  misc_feature: Useful for making plants with altered alkaloid content
  misc_feature: Functional homolog of the protein sequence given in SEQ ID NO 13063
  misc_feature: The sequence is a functional homolog of SEQ ID NO 1453 in the 10/374,780 US patent application
  misc_feature: The sequence is a functional homolog of SEQ ID NO. 359 in the 11/188,298 US application
  misc_feature: The sequence is a functional homolog of SEQ ID NO. 518 in the 11/188,298 US application
  misc_feature: The sequence is a functional homolog of SEQ ID NO. 361 in the 11/188,298 US application
  misc_feature: The sequence is a functional homolog of SEQ ID NO. 273 in the 11/188,298 US application
  misc_feature: The sequence is a functional homolog of SEQ ID NO. 420 in the 11/188,298 US application
  misc_feature: The sequence is a functional homolog of SEQ ID NO. 377 in the 11/188,298 US application
MARERREIRRIENAAARQVTYSKRRRGLFKKAEELAVLCDADVALVVFSATGKLSQFASTSMNHIIDKYSTHSKNLGKSHQQSPIDLNIEQSKYTGLNEQLAEATHGLRQMRGENLEGLSVEELHQMERKLEAGLHRVLSTKDQLFTQQISELQQKGTQLEDENRRLKEQMPQVLTAGTMVVGAGAENILTEDGQSSESVMTALHSGSSLDNDDGSDICLKLS

SEQ ID NO: 2557 - DNA, 750 bp, Sorghum bicolor
  misc_feature: Ceres ANNOT ID no. 6025105
  misc_feature: Encodes the peptide sequence at SEQ ID NO 2558
atgtcggcgacgccgctgcccccgccgggccccgacggcgcgggggcgctcccgcccccgccgggcacggacatgacggggatttgcttccgcgaccagctgtggctggacacctacccgctcgatcgcaacctcgtcttcgactacttcgcgctctcccccttctacgacatcacctgcaacaacgagtccctccgttcgcgccaaatccaccccctcgacatgtctcacctgacgaagatgaccgggatggagtaccttctgagcgaagtgatggagccgcacctgtttgtgatccggaagcagaagcgggagagccccgagaaatcaaaccctatgctcgcctactacatccttgacggctccatctaccaggcgccacagctctgcaatgtctttgcctcacgcataagtaggactatgcatcatatatcaaaagcctttaccatagcatgctcaaagttggagaagattggaaacgtggaaactgagtctgatgcagtagcctctgaatcaaagacccaaaaggaagcaatcgacctgaaggaactcaaacgaattgatcatatcctgtcatccttgaaacggaagataggggctgctcctccacctccaccttatcccgagggctatgtcccaccatcagcagaacaagagaaagcaccggatgatgtggcagcatcagaggcaccgcctcaacttgaccctatcattgatcaaggtccttctaaaagaccaagattccaatga

SEQ ID NO: 2558 - protein, 249 aa, Sorghum bicolor
  misc_feature: Ceres ANNOT ID no. 6025105
  misc_feature (68)..(167): Pfam Id: MED6 Pfam Desc: MED6 mediator sub complex component
  misc_feature (24)..(232): NCBI GI: 3329506 NCBI Desc: rna polymerase transcriptional regulation mediator [homo sapiens]
  misc_feature (24)..(249): NCBI GI: 62858787 NCBI Desc: loc549046 [xenopus tropicalis]
  misc_feature (24)..(233): NCBI GI: 62898253 NCBI Desc: mediator of rna polymerase ii transcription, subunit 6 homolog [homo sapiens]
  misc_feature (24)..(232): NCBI GI: 60652819 NCBI Desc: mediator of rna polymerase ii transcription subunit 6-like [synthetic construct]
  misc_feature (24)..(232): NCBI GI: 60655909 NCBI Desc: mediator of rna polymerase ii transcription subunit 6-like [synthetic construct]
MSATPLPPPGPDGAGALPPPPGTDMTGICFRDQLWLDTYPLDRNLVFDYFALSPFYDITCNNESLRSRQIHPLDMSHLTKMTGMEYLLSEVMEPHLFVIRKQKRESPEKSNPMLAYYILDGSIYQAPQLCNVFASRISRTMHHISKAFTIACSKLEKIGNVETESDAVASESKTQKEAIDLKELKRIDHILSSLKRKIGAAPPPPPYPEGYVPPSAEQEKAPDDVAASEAPPQLDPIIDQGPSKRPRFQ

SEQ ID NO: 2559 - DNA, 1134 bp, Sorghum bicolor
  misc_feature: Ceres ANNOT ID no. 6025122
  misc_feature: Encodes the peptide sequence at SEQ ID NO 2560
atggtgcaacatcatcaggaggccatgccgctgctgacgccgttcaagatggggcagtttgagctgtcccaccgggtggtgctcgcgccgatgacgaggtgccgctcctacggcaacgtgccgcagccgcacgccgccgtctactactcgcagcgcgccactaggggcggcctcctcatcacggaggccaccggtgtgtcggccaccgctcaggggtacccggagacccccggcgtctggacgcaggagcatgtccaagcgtggaagcccatcgtcgacgccgtccaccgcaagggcgccctcttcttctgccagatttggcatgtcggcagggtctccaccaacgatttccagcctgacgggcaggcgccaatctcgagcacggacaagcaaatctcccctgacgcagcagagcccggcatggtgtactccaagccaagacggctgcggaaggacgagatccctgggatcgtcgacgacttcaggcgcgccgcgcggaacgccgtcgaagccgggttcgacggggtggagatccacggcgcgaacgggtacctcctggagcagttcatgaaggacggcgccaacgaccgcgacgacgagtacggcgggagcctcgagaaccggtgccgcttcgccgtcgaggtggtggacgccgtggtccgcgaggtgggtgctcctcgcgtgggcatcaggctctcgccattcctcgacttcatggactgcgtcgactccgaccccgccgcgctcgccgactacatggttcggcagctcaacaggcacgagggtttcctgtactgtcacatggtggagccacggatggccgtcgttgatggacggcggcagatcccgcacaggcttttgccattccgggagacgttcaaggggatcttcatcgcagctggcgggtatgaccgtgaggaaggcaacaaggttgtagcggagggctacactgatctagtctcctatggaaggctctttttggcaaatccggatctgcccagaagatttgagcttggctcgtcactgaataagtatgatcgctccacgttctacacccaagaccctgttgttggttacacggactacccgtcccttgacgacgacaagaatgacgccactgctgatgatgcttag

SEQ ID NO: 2560 - protein, 377 aa, Sorghum bicolor
  misc_feature: Ceres ANNOT ID no. 6025122
  misc_feature (10)..(343): Pfam Id: Oxidored_FMN Pfam Desc: NADH:flavin oxidoreductase / NADH oxidase family
  misc_feature (5)..(377): NCBI GI: 89029801 NCBI Desc: 12-oxophytodienoic acid reductase 1 [setaria italica]
  misc_feature (1)..(371): NCBI GI: 63021719 NCBI Desc: 12-oxo-phytodienoic acid reductase [zea mays]
  misc_feature (8)..(373): NCBI GI: 60687503 NCBI Desc: cis-12-oxo-phytodienoic acid-reductase 1 - rice
  misc_feature (3)..(374): NCBI GI: 63021723 NCBI Desc: 12-oxo-phytodienoic acid reductase [zea mays]
  misc_feature (1)..(371): NCBI GI: 63021721 NCBI Desc: 12-oxo-phytodienoic acid reductase [zea mays]
  misc_feature (6)..(366): SWISSPROT Homolog: EC 1.3.1.42 12-oxophytodienoate reductase 1
  misc_feature: Useful for making plants with modulated water use efficiency
  misc_feature: Functional homolog of the protein sequence given in SEQ ID NO 13609
MVQHHQEAMPLLTPFKMGQFELSHRVVLAPMTRCRSYGNVPQPHAAVYYSQRATRGGLLITEATGVSATAQGYPETPGVWTQEHVQAWKPIVDAVHRKGALFFCQIWHVGRVSTNDFQPDGQAPISSTDKQISPDAAEPGMVYSKPRRLRKDEIPGIVDDFRRAARNAVEAGFDGVEIHGANGYLLEQFMKDGANDRDDEYGGSLENRCRFAVEVVDAVVREVGAPRVGIRLSPFLDFMDCVDSDPAALADYMVRQLNRHEGFLYCHMVEPRMAVVDGRRQIPHRLLPFRETFKGIFIAAGGYDREEGNKVVAEGYTDLVSYGRLFLANPDLPRRFELGSSLNKYDRSTFYTQDPVVGYTDYPSLDDDKNDATADDA

SEQ ID NO: 2561 - DNA, 2031 bp, Sorghum bicolor
  misc_feature: Ceres ANNOT ID no. 6025127
  misc_feature: Encodes the peptide sequence at SEQ ID NO 2562
  misc_feature: Up-regulated in root tissues in response to salicylic acid treatment
  misc_feature: Up-regulated in shoot tissues in response to salicylic acid treatment
atgcacccccgcgccgcctcaggcgccaccgggaagtcgaccgcgccgtacgggtcctgggagtcgccgatcagcgccgctgtcgtctccgccgccgggaggaccgccgaggggttcgccatcgccggcgacggccggctcgtctgggtggagacgcgccccgaggatggagggcgcgcggtcctcgtgaaggaagcggcagaaccaggcggcaaggctcttgatgtgactccgcaggggttcgcggtgcggtccttggcgcaggagtacggtggcggggcattcgcggtgcaaggggataccgttgtgttctctaactacactgaccagcgtctgtacaagcaaacaatcggagataattcaccactaccgctgacaccagattatgctggatcagtagtacgctatgctgatggtgtctttgatccccatttccatcgtttcgtaactataatggaagattatcggcacaatagctcaaatcccatcactacaatcgttgctgtaagaataagtgatcatgatgtcaaagaatctactatgctggtcagtggcaatgacttttatgccttcccacgtattgatccaactaaaaaacgtatggcatggattgagtggagtaacccaaacatgtcctgggacaaatcgcagttatgggttgggtatttcaatgagaaaggagagataaaagaaaagatctgcattgctggtggagacccaacaatagtagaatctcctactgaacccaagtggtcttcaaaaggggagttgttcttcataaccgatcgaaggagtgggttttggaatatttgtaaatgggatgagcagagcaatgcggtaacacctctgtattcacttgatgctgaattctccaagcccatgtggatttttggtgtcagctcctatgatttccttggaatagatgatacaagtcacaaaatcgtttgctgttacaggcagaatggaaagtcatatgtcggggtgcttgaccacaattccgagtccttttcgaaaatcgatattcccttctcttctgtaactaacatagtggtgtctggagatggatccttctatattgagggtgcatctgctactcttccagtatcaatagcaaaggtgacacttgataaaaagagaactatggcaactgatttctctattgtttggtcctcctcagaggatgtttcacaatatgaatcatacttcagcttgcctgaatttgtggagtttccaactgtggtcaatggtcagcatgcatatgcttatttttatgctccatataataatgttttccaaggtttatcagacgaaaagcctcccctacttgtcagaactcatggtggacccacagatgaagcacgagggattctggatcttagtgtgcagtactggacaagccgaggatgggcatttgttgatgttaactatgggggaagctcaggttatggaagagaatttcgagagagacttttagcacaatggggtgttgttgatgtaaatgattgctgcagttgtgctgcattcctggtggaaactggaagagtggatgggcagcggctttgtgtaactggagaatctgctggtggattcacaactttagcctgccttgctttcagacaaaccttcaaggctggttcgtctttatatgggatagctgatctagcatccttgagggcaggaatgcacaagtttgaagcatactacattgataaccttgtggggaataaacaagcttactttgagagatctccaataaactctgtcgaaaacttttcatgtccagtgattttgtttcaagggttggaagacacggttgtatcaccagatcaggcaacaaaaatatacaaggccataaaggacaagggccttcccgttgctttggttgagtacgaaggggaacaacatggtttccgcaaggctgagaacatcaaatttaccttggagcaggagatggtgttcctggcaagattagtgggaaagttcaaggtggctgatgacataactccaatcaagattgaaaactttgattag

SEQ ID NO: 2562 - protein, 676 aa, Sorghum bicolor
  misc_feature: Ceres ANNOT ID no. 6025127
  misc_feature (457)..(661): Pfam Id: Peptidase_S9 Pfam Desc: Prolyl oligopeptidase family
  misc_feature (477)..(639): Pfam Id: Abhydrolase_3 Pfam Desc: alpha/beta hydrolase fold
  misc_feature (3)..(676): NCBI GI: 145358557 NCBI Desc: serine-type peptidase [arabidopsis thaliana]
  misc_feature (3)..(676): NCBI GI: 9759033 NCBI Desc: acyl-peptide hydrolase-like [arabidopsis thaliana]
  misc_feature (162)..(674): NCBI GI: 113475094 NCBI Desc: peptidase s9, prolyl oligopeptidase active site region [trichodesmium erythraeum ims101]
  misc_feature (181)..(674): NCBI GI: 106889009 NCBI Desc: peptidase s9, prolyl oligopeptidase active site region [roseiflexus sp. rs-1]
  misc_feature (169)..(674): NCBI GI: 118063962 NCBI Desc: peptidase s9, prolyl oligopeptidase active site region [roseiflexus castenholzii dsm 13941]
  misc_feature: Up-regulated in root tissues in response to salicylic acid treatment
  misc_feature: Up-regulated in shoot tissues in response to salicylic acid treatment
MHPRAASGATGKSTAPYGSWESPISAAVVSAAGRTAEGFAIAGDGRLVWVETRPEDGGRAVLVKEAAEPGGKALDVTPQGFAVRSLAQEYGGGAFAVQGDTVVFSNYTDQRLYKQTIGDNSPLPLTPDYAGSVVRYADGVFDPHFHRFVTIMEDYRHNSSNPITTIVAVRISDHDVKESTMLVSGNDFYAFPRIDPTKKRMAWIEWSNPNMSWDKSQLWVGYFNEKGEIKEKICIAGGDPTIVESPTEPKWSSKGELFFITDRRSGFWNICKWDEQSNAVTPLYSLDAEFSKPMWIFGVSSYDFLGIDDTSHKIVCCYRQNGKSYVGVLDHNSESFSKIDIPFSSVTNIVVSGDGSFYIEGASATLPVSIAKVTLDKKRTMATDFSIVWSSSEDVSQYESYFSLPEFVEFPTVVNGQHAYAYFYAPYNNVFQGLSDEKPPLLVRTHGGPTDEARGILDLSVQYWTSRGWAFVDVNYGGSSGYGREFRERLLAQWGVVDVNDCCSCAAFLVETGRVDGQRLCVTGESAGGFTTLACLAFRQTFKAGSSLYGIADLASLRAGMHKFEAYYIDNLVGNKQAYFERSPINSVENFSCPVILFQGLEDTVVSPDQATKIYKAIKDKGLPVALVEYEGEQHGFRKAENIKFTLEQEMVFLARLVGKFKVADDITPIKIENFD

SEQ ID NO: 2563 - DNA, 2043 bp, Sorghum bicolor
  misc_feature: Ceres ANNOT ID no. 6025128
  misc_feature: Encodes the peptide sequence at SEQ ID NO 2564
atgtcctcctcttcagccgcctcctccgcgccgcccgctgcagcggcggcggccggcggcgagaagcctgcggtggcgccgtacgggtcttggaggtcgcccatcactgcggacgtcgtctccggcgcggataggcgtctcggcggtatcgccctcgctggggatgggcgccttctctggatcgagggccgccccgaggagaaagggcgtatggttattgtaaaggaggaagataatcctgtggatgtcatacctcaggaatttgcagcacgcaccctggctcaagaatatggaggtggtgcatttgcagttgacaagagtgttgttgtgttctcaaattacaaggatcaacgtctatacaagcaaacaataggaattggtgctccacctgtgcctcttacacccgattatggtgctccgagtgtcagttatgctgatggtgtatttgatcctcacttcagccgttatgttactgtgatggaagatcgtcgaaaggatagcttgaatcccaccacaacaattgctgctgtagacttgagtggcagtgatgttcatgaaccaaaggtgctgatcagtggcaatgatttctatgcatttcctcgcattgatcaaagtaaaaagcggatggcatggattgaatggagccatccaaacatgccctgggataaatcagagctctgggttggttactttgctgagaacggagacttgaccaaacgggtctgtattgccggtggcaatccactgctggttgaatctcctagtgaacctaaatggtctcccaaaggagaactgttttttgttactgacagagggagtggattttggaacatttataaatgggttgaacaaaccaatgagattgttccagtgtattcactagacgctgaatttacaactccattgtgggtttttggcatcagctcatatgattttcttggaaacagcaaccacattgttttcagttataggcagcaaggaaggtcacatcttggtgtgcttgattgtgattcagcttctgtttcattgcttgacacccctttctctgatttatctgatgtggttgctgcagatgattacttctatgttggaggtgcttctgcaagtattccacggtcaattgctaaggtgacattaaatgagagcaaaacaaaagtagtcaatttctcaatagtctggtcctcctcaccagacctcgtacaatatagacctttcttcagcacaccagaacttgttgagttccctacatccaaacctggccagaaagcttatgcctatttctacccaccgtcaaatcccaattttcaaggtttggctgatgaaaaacctccgttgcttgtcaaaacacatggaggacctactgctgaaacacgtgctattctggacctcaatgtccagtattggacaagtagaggttgggcatatgtggatgtcaactatggaggaagcactggttatggaagagagtatcgggagagactattggacaaatggggtattgtcgatgttgatgattgttgcagctgtgcgagattccttgtggagagtgggaaagtagatgggcaacgcctttgtattactggtagatcagcaggtggatacactactttagcttcactagcattcagagacatgttcaaggctggagcttctctgtatggtgttggggacttgactctgttgagagcagagacgcacaaatttgagtcccattatatggacaatcttgtaggaaatgaaagagcttactatgagagatcaccaatcaactttgtcaaccagtttacgtgtccagtcattttgtttcaagggttagaggataaggttgtgccaccagatcaggcacgcaaaatatacaatgccttgaaagagaaaggtttgcctgttgctttggtggaatatgaaggagagcagcatgggttccgcaaggccgagaacatcaagttcaccttggagcaaatgatggtgttctttgcgagactagttgggaaatttgaggtggcagacgatataactccaatcaagattgagaacttcgattga

SEQ ID NO: 2564 - protein, 680 aa, Sorghum bicolor
  misc_feature: Ceres ANNOT ID no. 6025128
  misc_feature (459)..(665): Pfam Id: Peptidase_S9 Pfam Desc: Prolyl oligopeptidase family
  misc_feature (2)..(680): NCBI GI: 145358557 NCBI Desc: serine-type peptidase [arabidopsis thaliana]
  misc_feature (7)..(680): NCBI GI: 9759033 NCBI Desc: acyl-peptide hydrolase-like [arabidopsis thaliana]
  misc_feature (189)..(678): NCBI GI: 37521039 NCBI Desc: probable peptidase [gloeobacter violaceus pcc 7421]
  misc_feature (25)..(669): NCBI GI: 119484305 NCBI Desc: peptidase s9, prolyl oligopeptidase active site region [lyngbya sp. pcc 8106]
  misc_feature (144)..(680): NCBI GI: 67922155 NCBI Desc: peptidase s9, prolyl oligopeptidase active site region [crocosphaera watsonii wh 8501]
MSSSSAASSAPPAAAAAAGGEKPAVAPYGSWRSPITADVVSGADRRLGGIALAGDGRLLWIEGRPEEKGRMVIVKEEDNPVDVIPQEFAARTLAQEYGGGAFAVDKSVVVFSNYKDQRLYKQTIGIGAPPVPLTPDYGAPSVSYADGVFDPHFSRYVTVMEDRRKDSLNPTTTIAAVDLSGSDVHEPKVLISGNDFYAFPRIDQSKKRMAWIEWSHPNMPWDKSELWVGYFAENGDLTKRVCIAGGNPLLVESPSEPKWSPKGELFFVTDRGSGFWNIYKWVEQTNEIVPVYSLDAEFTTPLWVFGISSYDFLGNSNHIVFSYRQQGRSHLGVLDCDSASVSLLDTPFSDLSDVVAADDYFYVGGASASIPRSIAKVTLNESKTKVVNFSIVWSSSPDLVQYRPFFSTPELVEFPTSKPGQKAYAYFYPPSNPNFQGLADEKPPLLVKTHGGPTAETRAILDLNVQYWTSRGWAYVDVNYGGSTGYGREYRERLLDKWGIVDVDDCCSCARFLVESGKVDGQRLCITGRSAGGYTTLASLAFRDMFKAGASLYGVGDLTLLRAETHKFESHYMDNLVGNERAYYERSPINFVNQFTCPVILFQGLEDKVVPPDQARKIYNALKEKGLPVALVEYEGEQHGFRKAENIKFTLEQMMVFFARLVGKFEVADDITPIKIENFD

SEQ ID NO: 2565 - DNA, 1638 bp, Sorghum bicolor
  misc_feature: Ceres ANNOT ID no. 6025135
  misc_feature: Encodes the peptide sequence at SEQ ID NO 2566
atgagctttcgcgcggcgccgtggagccgcccgtggcacatcgcagggccgtgtgtgcccaccgctgcgcggccgcgcttcgcacttggaagtaggaatctgtggaagaactcatggacaattggtgctggtgtttcaaatatgtttacactgccatcaaggctgtttaggtgcatggcttcaagtggctctggtgatggtggttttgctcagtctacatcgactgacgaagcagtaacaccgttgccgttatactcttggccagataagcagagaccacgcgtttgcattttaggtggtggatttggaggcctgtacactgctttaagacttgattctcttgtgtggcccaatgataagaggcctcaggttcttctggttgatcaatctgataaatttgtatttaaacccatgttgtatgagctattatcaggagaagtggatgtctgggagatagctccatcttttacagagttgctgaaaaacacaagtgttcaatttgtgagggatagtgtaaagctactgcgcccttctgatcactttagaagaggacctggagaaccatgcactggtggagttgttcatctggaaagtggcactgtcattgaatatgattggctcgttctagctttaggggctgaagctaaaattgatgttgttcctggttcagctgaatatgcacttcctttcacgacattagaggatgctttgagggttgaaagcaagttgaaaatgctagagaggaaaaggtttggtaagagttcccctactattgaggtggcaattgtggggttgggctattctggtgttgaattagctgcgactatatctgagagattaaaagacactgggactgtaaaggcaataaatgttcaaacaaccatatgtcccactgctccacaaggaaatcgtgatgctgctctgaaggttctcgagtctcggaatattcagcttttcttgggatattttgtgacctgcattaaagaggcttctacatctgatgattcaagtagcacagttacatatgctgaagttgacggtgattataggaaactaattttggaccttcaacctgctgaaagaggcctcaaaggccagactcttgaggccgatttggtgctgtggacagtgggttcaacatctcaaattccccggttacagcctcctgatgctccctatgttattcctctgaatggtcgggggcaggtggagacagacgaaacccttcaagtaaaaggccatccccggacatttgcgattggtgattcagcagctctaagggatccatctggcaaactcctcccggccactgcacaggttgcctttcaacaagcagattttgctggatggaatctctgggcggcaataaatgatcggcctctcctgccattcaggttccaaaaccttggtgagatgatgacgcttggcagaaatgacgccgcggtaacagcaagtttcattgaaggactgaccttggaaggacctctaggacatgctgctcggaagcttgtgtactgcctcagaatgcccacggatgaacacagggtaaaggttggaatcagctggttcacaaagaccgcagtcgatacacttgcctccgtgcaaaacgcagtaagtaacacgctcacaggctcatga

SEQ ID NO: 2566 - protein, 545 aa, Sorghum bicolor
  misc_feature: Ceres ANNOT ID no. 6025135
  misc_feature (94)..(428): Pfam Id: Pyr_redox_2 Pfam Desc: Pyridine nucleotide-disulphide oxidoreductase
  misc_feature (259)..(378): Pfam Id: Pyr_redox Pfam Desc: Pyridine nucleotide-disulphide oxidoreductase
  misc_feature (75)..(545): NCBI GI: 30682558 NCBI Desc: pyridine nucleotide-disulphide oxidoreductase family protein [arabidopsis thaliana]
  misc_feature (206)..(545): NCBI GI: 140069433 NCBI Desc: fad-dependent pyridine nucleotide-disulphide oxidoreductase [medicago truncatula]
  misc_feature (191)..(545): NCBI GI: 13548332 NCBI Desc: nadh dehydrogenase-like protein [arabidopsis thaliana]
  misc_feature (90)..(346): NCBI GI: 119511098 NCBI Desc: nadh dehydrogenase [nodularia spumigena ccy9414]
  misc_feature (90)..(346): NCBI GI: 23130291 NCBI Desc: cog1252: nadh dehydrogenase, fad-containing subunit [nostoc punctiforme pcc 73102]
MSFRAAPWSRPWHIAGPCVPTAARPRFALGSRNLWKNSWTIGAGVSNMFTLPSRLFRCMASSGSGDGGFAQSTSTDEAVTPLPLYSWPDKQRPRVCILGGGFGGLYTALRLDSLVWPNDKRPQVLLVDQSDKFVFKPMLYELLSGEVDVWEIAPSFTELLKNTSVQFVRDSVKLLRPSDHFRRGPGEPCTGGVVHLESGTVIEYDWLVLALGAEAKIDVVPGSAEYALPFTTLEDALRVESKLKMLERKRFGKSSPTIEVAIVGLGYSGVELAATISERLKDTGTVKAINVQTTICPTAPQGNRDAALKVLESRNIQLFLGYFVTCIKEASTSDDSSSTVTYAEVDGDYRKLILDLQPAERGLKGQTLEADLVLWTVGSTSQIPRLQPPDAPYVIPLNGRGQVETDETLQVKGHPRTFAIGDSAALRDPSGKLLPATAQVAFQQADFAGWNLWAAINDRPLLPFRFQNLGEMMTLGRNDAAVTASFIEGLTLEGPLGHAARKLVYCLRMPTDEHRVKVGISWFTKTAVDTLASVQNAVSNTLTGS

SEQ ID NO: 2567 - DNA, 1002 bp, Sorghum bicolor
  misc_feature: Ceres ANNOT ID no. 6025137
  misc_feature: Encodes the peptide sequence at SEQ ID NO 2568
atggcggcggacccggacacggaggtgcaggcggagttcccgccgctggtccgccagtacaagagcggccgcgtcgagcggttctttaacccgtccccgctcccggccggcaccgacccggccacgggcgtcgtgtccaaggacgtcgtcgtcgatccggccaccggcctctgggcgcgcctcttcctcccgcccagcagcagccacggcaagaagcagcagctccccatcgtcgtctactaccacggcggcgcctacgtgatcggctcggcggccgacccgtggacgcacacctacctcaacgggctcgtcgccaaggccggcgtcctcgccgtggcgctcgagtaccgcctcgcgccggagcacccgctcccggccgcctacgaggactcgtgggaggggctcaagtgggtggccacccacgccgccgccaccgccgccgcgggcgggggaccggagccgtggctgaccgagcacggcgacttctcccgcgtgttcctggccggagccagcgcgggcggcaccatcgcgcactacgtcgccgtccgtgccggcgagcagcagggccagggccagggcgacctcctcggggtgcgcgtcagggggctgctgatagtgcacccctacttcagcggcgcggcggacatcggcgacgaggggacgacggggaagcagcgcaaggcgcaggccgacgcgttctggcggttcctgtaccccggctcccccgggctcgacgacccgctttccaacccgttctcggaggccgccggcggcagcgcggcgcgcgtcgccgccgagcgagtgctcgtctgcgtcgccgagaaggatgacctcagggacaggggcgtctggtactacgagagcctcaaggccggcggctaccccggcgaggtggagctgctcgagtccaagggcgagggccacgtcttctactgcatgaacccgagctgcgacagggcgcgggagatggaggagcgcgtcctgagcttcctacgcaagtga

SEQ ID NO: 2568 - protein, 333 aa, Sorghum bicolor
  misc_feature: Ceres ANNOT ID no. 6025137
  misc_feature (78)..(312): Pfam Id: Abhydrolase_3 Pfam Desc: alpha/beta hydrolase fold
  misc_feature (8)..(333): NCBI GI: 82697943 NCBI Desc: cxe carboxylesterase [malus pumila]
  misc_feature (8)..(333): NCBI GI: 82697951 NCBI Desc: cxe carboxylesterase [malus pumila]
  misc_feature (8)..(331): NCBI GI: 92875385 NCBI Desc: esterase/lipase/thioesterase [medicago truncatula]
  misc_feature (8)..(331): NCBI GI: 56692178 NCBI Desc: 2-hydroxyisoflavanone dehydratase [glycyrrhiza echinata]
  misc_feature (2)..(333): NCBI GI: 115476872 NCBI Desc: os08g0475000 [oryza sativa (japonica cultivar-group)]
MAADPDTEVQAEFPPLVRQYKSGRVERFFNPSPLPAGTDPATGVVSKDVVVDPATGLWARLFLPPSSSHGKKQQLPIVVYYHGGAYVIGSAADPWTHTYLNGLVAKAGVLAVALEYRLAPEHPLPAAYEDSWEGLKWVATHAAATAAAGGGPEPWLTEHGDFSRVFLAGASAGGTIAHYVAVRAGEQQGQGQGDLLGVRVRGLLIVHPYFSGAADIGDEGTTGKQRKAQADAFWRFLYPGSPGLDDPLSNPFSEAAGGSAARVAAERVLVCVAEKDDLRDRGVWYYESLKAGGYPGEVELLESKGEGHVFYCMNPSCDRAREMEERVLSFLRK

SEQ ID NO: 2569 - DNA, 1023 bp, Sorghum bicolor
  misc_feature: Ceres ANNOT ID no. 6025138
  misc_feature: Encodes the peptide sequence at SEQ ID NO 2570
atggacatggacctggacggcgaggtgcagtacgacttcttccctttcatccgccagtacaagagcggccgcgtcgtccgcttcggcgccaccgacaccgtccctgccggcaccgacgacgacacggccggcggcacgggcgtgacgtctaaggacgtcgtgattaacccgagctcgggactctgggctcgcctctacctcccgtcgtcgctgctccccgccgccgggcgccgccaagacagcaagctccccgtcgtcgtctactaccacggcggcgccttcgtcatcgggtcaacggcgaaccggcccacgcacgagtacctcaaccgcctggcggccgacgccaacgtcctcgtcgtctcacccgagtaccgcctcgcgccggagcacccgctgccgacggcgcacgacgactcgtgggaggccctcaggtgggtggcgtcccactcgacgacgacgggggaggagaggccggacccggacccggagccctggctcgtcgagcacggggacctgacgcgcgtgttcctggtcggggtcagcgccgggggcaacatcgcgcacaacatggcggagcgcgccggcggcggggcgcagagcctcggcggcgtgcccatcagagggctgctgctcgtccacccctacttcaccagcggagcgcccgccggcaccgaagcgacgacggacacggcaaggaaggccatgtccgaggcgttctggcggtacctgtgccccggcacgctggggccagacgacccgctgggcaacccgttctcggaggccgcgggtggcagcgcggcgcgtgtcgccgccgagcgcgtgctcgtctgcgtcgcggagaaggactggctccgtggcaggggcgtctggtactacgagagcctcagggggagcggctacggcggcgaggtggagctgcacgagtccgtgggcgaggggcatgtcttccattacggcaacccggggtgcgaggaagcgcgggtgttgcaggcgcgcgtcctgcgtttcctccgtgcgcgatga

SEQ ID NO: 2570 - protein, 340 aa, Sorghum bicolor
  misc_feature: Ceres ANNOT ID no. 6025138
  misc_feature (86)..(318): Pfam Id: Abhydrolase_3 Pfam Desc: alpha/beta hydrolase fold
  misc_feature (6)..(337): NCBI GI: 115476870 NCBI Desc: os08g0474800 [oryza sativa (japonica cultivar-group)]
  misc_feature (8)..(337): NCBI GI: 82697943 NCBI Desc: cxe carboxylesterase [malus pumila]
  misc_feature (1)..(337): NCBI GI: 82697951 NCBI Desc: cxe carboxylesterase [malus pumila]
  misc_feature (3)..(316): NCBI GI: 115476872 NCBI Desc: os08g0475000 [oryza sativa (japonica cultivar-group)]
  misc_feature (8)..(337): NCBI GI: 82697937 NCBI Desc: cxe carboxylesterase [malus pumila]
MDMDLDGEVQYDFFPFIRQYKSGRVVRFGATDTVPAGTDDDTAGGTGVTSKDVVINPSSGLWARLYLPSSLLPAAGRRQDSKLPVVVYYHGGAFVIGSTANRPTHEYLNRLAADANVLVVSPEYRLAPEHPLPTAHDDSWEALRWVASHSTTTGEERPDPDPEPWLVEHGDLTRVFLVGVSAGGNIAHNMAERAGGGAQSLGGVPIRGLLLVHPYFTSGAPAGTEATTDTARKAMSEAFWRYLCPGTLGPDDPLGNPFSEAAGGSAARVAAERVLVCVAEKDWLRGRGVWYYESLRGSGYGGEVELHESVGEGHVFHYGNPGCEEARVLQARVLRFLRAR

SEQ ID NO: 2571 - DNA, 975 bp, Sorghum bicolor
  misc_feature: Ceres ANNOT ID no. 6025140
  misc_feature: Encodes the peptide sequence at SEQ ID NO 2572
atggcctcccgcgacgccgctaccgacgatgtcgccgtcgagctcctgccgttcatccgcctctacaagagcggccgcgttgagcgcctgatcggcaacgacacggcccccgcctccctcgacgacggtacttctaccggcggcgtcgcctccaaggacgtcaccatcgaccccgccaccaacctctccgtgcgcctgtaccttcccacggcggctggcgccggggacaagctgcccatcgtcgtgtacttccacggcggcggcttcatggtcgaatcggccagctccgccaagtaccaccgctacctcaacgcactcgccgcccgcgccggcgccgtcgcggtgtccgtggactaccgccgcgtgccggagcaccggctcccggcggcctacgacgactcgtgggcggcgctcgcgtgggccgtcggcgccgcctgcggcgacgagtccgagccggagccatggttgaccaagcacggggacccttcccgcgtgttcctggctggggacagcgcgggcgcgaacatcgcccacaacgtcgccatgcgcgcggccgtcgccgagggtctcccggcgatcaggatcaggggcgtgctgctgatgcacccgtacctctgggacgcgtccgacgccatgggacccgacctggaggagcgcatccgccgcgagtggcagctcatgacggggcgccctgacgcgcgggtggacgacccatggctgtcgccgacgtccgcacgggcgccgccactcgcgctgctgccgacgcagcgggtgctggttgccgtggccggggaggacttcctggcgcccaaggggcgagcctaccacgcggcgctgctgcacagtgggtggcccggcgaggccgagctggtggacactccgggcgagcagcacgtgttccacctcgaccagcccgggacggcggtggccgaggagttgatggatcgtgtggtggctttcattgctggagcttga

SEQ ID NO: 2572 - protein, 324 aa, Sorghum bicolor
  misc_feature: Ceres ANNOT ID no. 6025140
  misc_feature (81)..(302): Pfam Id: Abhydrolase_3 Pfam Desc: alpha/beta hydrolase fold
  misc_feature (9)..(321): NCBI GI: 115476870 NCBI Desc: os08g0474800 [oryza sativa (japonica cultivar-group)]
  misc_feature (10)..(321): NCBI GI: 115476872 NCBI Desc: os08g0475000 [oryza sativa (japonica cultivar-group)]
  misc_feature (3)..(322): NCBI GI: 38344841 NCBI Desc: osjnba0064h22.22 [oryza sativa (japonica cultivar-group)]
  misc_feature (1)..(322): NCBI GI: 82697977 NCBI Desc: cxe carboxylesterase [actinidia eriantha]
  misc_feature (9)..(321): NCBI GI: 115472471 NCBI Desc: os07g0527600 [oryza sativa (japonica cultivar-group)]
MASRDAATDDVAVELLPFIRLYKSGRVERLIGNDTAPASLDDGTSTGGVASKDVTIDPATNLSVRLYLPTAAGAGDKLPIVVYFHGGGFMVESASSAKYHRYLNALAARAGAVAVSVDYRRVPEHRLPAAYDDSWAALAWAVGAACGDESEPEPWLTKHGDPSRVFLAGDSAGANIAHNVAMRAAVAEGLPAIRIRGVLLMHPYLWDASDAMGPDLEERIRREWQLMTGRPDARVDDPWLSPTSARAPPLALLPTQRVLVAVAGEDFLAPKGRAYHAALLHSGWPGEAELVDTPGEQHVFHLDQPGTAVAEELMDRVVAFIAGA

SEQ ID NO: 2573 - DNA, 852 bp, Sorghum bicolor
  misc_feature: Ceres ANNOT ID no. 6025149
  misc_feature: Encodes the peptide sequence at SEQ ID NO 2574
atggcgccgcccgactccatctccacgcgctcctccctccccctcgccgctgcgcccatgtccgacccgaccccctccccctacgctgcgtcgccgccgcctccaaacccgctcgcggccgccgcgtccttcctccagcaccacctctcccgcttggcttcccacctgaacgccccgcgccccgccctcgctgccgcggccgcggccgctcgcacgccgggcccccagggcgcctccctatctctcgcgcttgcgcccgatgaggtcgcgcgcgctctcaccggcactcccgtcttcactgtctgcaactccagcaacgagttcgtgctcgtctccgaccctgccaccggcctccgctccctcggcctcctctgcttccgttccgaggacgccgacgccctcctgtcgcatgtgaggacgcggcaaccggtgctagggaagggggcaaaagtggtgcctattacacttgatcaggtctatatgttgaaggctgaaggtatcgcatttcggttcttacccgaccctcttcagataaagaatgcactggagatgaaatcgggcttaactgcttttgatggtgttcctgtttttcagtcagatcttctggttgtgaagaagcagaagaagcgctactgtccaatatattttcaaaaggaagacatagaaagagaacttacaagggcttccaaaggttcaagagggtcagtcttgtctaagcaaattatggttgggagtttggaggatgtcctgaagaaaatggagataaatgagagaaattctgggtgggatgatttaatctttataccccctgggaagaacctcaaccaacatatcaatgaggtatcagcgtga

SEQ ID NO: 2574 - protein, 283 aa, Sorghum bicolor
  misc_feature: Ceres ANNOT ID no. 6025149
  misc_feature (29)..(283): Pfam Id: Tic22 Pfam Desc: Tic22-like family
  misc_feature (36)..(283): NCBI GI: 3769671 NCBI Desc: tic22 [pisum sativum]
  misc_feature (226)..(283): NCBI GI: 115467056 NCBI Desc: os06g0213200 [oryza sativa (japonica cultivar-group)]
  misc_feature (122)..(280): NCBI GI: 113475327 NCBI Desc: tic22-like [trichodesmium erythraeum ims101]
  misc_feature (82)..(257): NCBI GI: 67925831 NCBI Desc: tic22-like [crocosphaera watsonii wh 8501]
  misc_feature (79)..(274): NCBI GI: 86607397 NCBI Desc: chloroplast envelope protein translocase (cept or tic-toc) family protein [cyanobacteria bacterium yellowstone a-prime]
MAPPDSISTRSSLPLAAAPMSDPTPSPYAASPPPPNPLAAAASFLQHHLSRLASHLNAPRPALAAAAAAARTPGPQGASLSLALAPDEVARALTGTPVFTVCNSSNEFVLVSDPATGLRSLGLLCFRSEDADALLSHVRTRQPVLGKGAKVVPITLDQVYMLKAEGIAFRFLPDPLQIKNALEMKSGLTAFDGVPVFQSDLLVVKKQKKRYCPIYFQKEDIERELTRASKGSRGSVLSKQIMVGSLEDVLKKMEINERNSGWDDLIFIPPGKNLNQHINEVSA

SEQ ID NO: 2575 - DNA, 1005 bp, Sorghum bicolor
  misc_feature: Ceres ANNOT ID no. 6025179
  misc_feature: Encodes the peptide sequence at SEQ ID NO 2576
atgtccacgggcgcggcgggcggcgtgcgacggcgccggcggacgtggcgcctgtactggtgctacgtgtgcggccgcgcggtgcgcgccgtctcgtacccgacctcggacgtcttctgcccgcgctgcttcggccgcttcctgcacgagatcgacctgccagcgccgcggcccgtggtcccgccggccgaccagttcttccagccgccgttcctcccgcacgacggtccccgccgctgggtcatatacaccggcgacgccagcgcggaccccacggccgacgacgcggacacgccgctccgtcgccgccgccggcgcgtcccgtccccgccgccggcgccggcgacgcggcgtccggacgaggacgaggacgactacgacgtcgacgcgccaccgccattgccaccacctcccgttggctgggacgagttcttcatcggggctaacctggacgctctcatcgagcggctcacgcaggacgaccgccctgggccggcgccggcgccggagtcagccatcgagtcgctccccacggtgcaggtctccccggcgaacctgtcggacggctcgcagtgccccgtgtgcaaggaggagttcgagctcggggaggccgcgagggagctgccgtgcaagcacgcgtaccacacggactgcatcgtgccgtggctccggctccacaattcgtgcccggtctgccgacaggagctgccgcagcagccggcggacggggcacaggatgacggcggacgcgaagaaggaagtggcgagatggagacggagacggaggcgccgccggggccggtggtgatggctggatggggtcccctggcttggctgccattgtcacgcgggccggacggggacggtcgggtgaggaatgaagcgaatgacggtgacggtgacggtgacgctgacgccgccggcggtggttcttgtgcaccggctatccttcagtcttttgtcgtcgtcgctgcttgctttgtcgtcctctcgttcttcgtttga

SEQ ID NO: 2576 - protein, 334 aa, Sorghum bicolor
  misc_feature: Ceres ANNOT ID no. 6025179
  misc_feature (192)..(232): Pfam Id: zf-C3HC4 Pfam Desc: Zinc finger, C3HC4 type (RING finger)
  misc_feature (1)..(334): NCBI GI: 51090501 NCBI Desc: zinc finger-like [oryza sativa (japonica cultivar-group)]
  misc_feature (5)..(332): NCBI GI: 46806079 NCBI Desc: zinc finger -like [oryza sativa (japonica cultivar-group)]
  misc_feature (107)..(237): NCBI GI: 3249088 NCBI Desc: contains similarity to goliath protein gbm97204 from d. melanogster. [arabidopsis thaliana]
  misc_feature (138)..(308): NCBI GI: 23308365 NCBI Desc: at3g19950/mpn9_19 [arabidopsis thaliana]
  misc_feature (141)..(237): NCBI GI: 115440527 NCBI Desc: os01g0802000 [oryza sativa (japonica cultivar-group)]
  misc_feature: The sequence is a functional homolog of SEQ ID NO 1201 in the 10/374,780US patent application
  misc_feature: The sequence is a functional homolog of SEQ ID NO 178 in the 10/374,780US patent application
  misc_feature: The sequence is a functional homolog of SEQ ID NO 896 in the 10/225,066US patent application
  misc_feature: Useful for making plants with altered Lignin content
  misc_feature: Useful for making plants with modulated growth and phenotype characteristics
  misc_feature: Functional homolog of the protein sequence given in SEQ ID NO 13302
  misc_feature: The sequence is a functional homolog of SEQ ID NO 896 in the 20050160493 US patent application
  misc_feature: The sequence is a functional homolog of SEQ ID NO 1201 in the 20060162006 US patent application
  misc_feature: The sequence is a functional homolog of SEQ ID NO. 271 in the 11/188,298 US application
  misc_feature: The sequence is a functional homolog of SEQ ID NO. 329 in the 11/188,298 US application
  misc_feature: The sequence is a functional homolog of SEQ ID NO. 424 in the 11/188,298 US application
MSTGAAGGVRRRRRTWRLYWCYVCGRAVRAVSYPTSDVFCPRCFGRFLHEIDLPAPRPVVPPADQFFQPPFLPHDGPRRWVIYTGDASADPTADDADTPLRRRRRRVPSPPPAPATRRPDEDEDDYDVDAPPPLPPPPVGWDEFFIGANLDALIERLTQDDRPGPAPAPESAIESLPTVQVSPANLSDGSQCPVCKEEFELGEAARELPCKHAYHTDCIVPWLRLHNSCPVCRQELPQQPADGAQDDGGREEGSGEMETETEAPPGPVVMAGWGPLAWLPLSRGPDGDGRVRNEANDGDGDGDADAAGGGSCAPAILQSFVVVAACFVVLSFFV

SEQ ID NO: 2577 - DNA, 1311 bp, Sorghum bicolor
  misc_feature: Ceres ANNOT ID no. 6025186
  misc_feature: Encodes the peptide sequence at SEQ ID NO 2578
atgccgccgcctctccgctgtctcctgctcgccttcgtcgtcctcctctccggcttcccccgtctcgcccaccccttcacggctctcgagtccgaccagatcgcccgcttccaggactacctccgcatccgaacggcgcacccgtcccccgactacgccggcgccgctgccttcctcctaccctacgccgcctcgctcggtctcgacaccaccacgctccacttcaccccgtgcaagaccaagccgctgctcctcctcacctggcggggctccgacccgtccctcccctccgtgctcctcaactcccacatcgactcggtccccgcggagcccgagcactgggcgcacccgccgttcgccgcgcaccgcgacgcggccacgggccgcgtctacgcgcgcggcgcgcaggacgacaagtgcctccccgtccagtacctcgaggcgatccggggcctccaggcggccgggttcgcgcccgcccgcaccgtccacatctcgctggtccccgacgaggagatcggcggcgcggatgggttcgacaagttcgcccagtcggaggagttccgcgccctcaacatcgggttcatgctcgacgaggggcaggcgtcgccgacggatgtgttcagggtcttttatgcggataggctggtgtggaggctcatcgtgaaggcggcgggggtgccggggcatgggtcgaggatgttcgacggcgccgccgtggacaatttgatggattgcgtggagaccatcgctgggttcagggatgcgcagttcaggatggtgaagtccggggagaggggtcccggcgaggtggtctcggtgaatcctgtgtacatgaaggccggcataccaagccccacgggttttgtgatgaatatgcaaccttcagaagcagaggttggctttgatctccgcctccctccaactgaagatattgaacagatcaaacgaagagtcaaagaggaatgggcaccagctcataaaaacttgacctaccagaaaggtccagtaacagatgtggctgggcgtcccatattcaccgcaacaaatgagtcgaacccatggtggtccatattcgagaaggccatcacctccgcgggaggaaagctatctaagcccgagatcttatcttcaaccacagattcacgctttgtgaggcagctgggcattcctgccctcgggttttctccgatgacaaatactccaatactactacatgaccataacgagtttctggaagataaggtgttcctgaggggcatcaaagtgtacgaacatgttattagagcactaagctcgttccaaggctga

SEQ ID NO: 2578 - protein, 436 aa, Sorghum bicolor
  misc_feature: Ceres ANNOT ID no. 6025186
  misc_feature (99)..(430): Pfam Id: Peptidase_M20 Pfam Desc: Peptidase family M20/M25/M40
  misc_feature (30)..(436): NCBI GI: 110735714 NCBI Desc: aminoacylase like protein [arabidopsis thaliana]
  misc_feature (137)..(435): NCBI GI: 115477240 NCBI Desc: os08g0511900 [oryza sativa (japonica cultivar-group)]
  misc_feature (9)..(434): NCBI GI: 140067419 NCBI Desc: peptidase dimerisation [medicago truncatula]
  misc_feature (8)..(434): NCBI GI: 92888203 NCBI Desc: peptidase dimerisation [medicago truncatula]
  misc_feature (27)..(433): NCBI GI: 50417585 NCBI Desc: acy1-prov protein [xenopus laevis]
MPPPLRCLLLAFVVLLSGFPRLAHPFTALESDQIARFQDYLRIRTAHPSPDYAGAAAFLLPYAASLGLDTTTLHFTPCKTKPLLLLTWRGSDPSLPSVLLNSHIDSVPAEPEHWAHPPFAAHRDAATGRVYARGAQDDKCLPVQYLEAIRGLQAAGFAPARTVHISLVPDEEIGGADGFDKFAQSEEFRALNIGFMLDEGQASPTDVFRVFYADRLVWRLIVKAAGVPGHGSRMFDGAAVDNLMDCVETIAGFRDAQFRMVKSGERGPGEVVSVNPVYMKAGIPSPTGFVMNMQPSEAEVGFDLRLPPTEDIEQIKRRVKEEWAPAHKNLTYQKGPVTDVAGRPIFTATNESNPWWSIFEKAITSAGGKLSKPEILSSTTDSRFVRQLGIPALGFSPMTNTPILLHDHNEFLEDKVFLRGIKVYEHVIRALSSFQG

SEQ ID NO: 2579 - DNA, 1188 bp, Sorghum bicolor
  misc_feature: Ceres ANNOT ID no. 6025190
  misc_feature: Encodes the peptide sequence at SEQ ID NO 2580
atgggcgtggggaagctgatgaacgacgtgaagccgtacctggcgatggtgctcctccaggttgggttctccgggatgtacatcgtctccgtcgcctccctcaagcgcggcatgaaccatttcgtcctcgtcgtctaccgcaacctcgtcgccaccgtcgtcatggcccccttcgccctcatcttcgagaggggtgtccgccccaagatgactcctctcatcttcctcaagatcatggggcttgccgtgctcgagcctgtgctggaccagaacatgtactacctgggcgcgaagctgacctcggccaccttcgggtcggccctcgtcaacatcctcccggccatcacgttcctgctggcgctcgtcatgaggatggagaagctgaggctccggagcctccacagccaggccaaggtcgtcggcacagtctgcaccgtcgccggagccgtgctgatgatcctctaccacggccccgtcgtgccgttcccgtggtccgcggccggccaccaccacgcctccgccgccgcggcggcggcggcgagccagagcagcgcctcctggctctacggcaccgtcatgatcattggtagctgcctgtgctggtccggcttcttcatcctccagtccaacacgctgcagagctaccctgcggagctgacgctggcgacgctgatctgcttcctgggctccgtgctcaccggcggtgtggcgctggtggcggagcgccacgacatgagcgcctgggtcattggcttcgacacccgcctcttcaccgccgtctactccgggatcgtgtgctccggcgtggccttctacgtgcaggggatcgtgacgcaggcgcgcggcccggtgttcgtgacggcgttccagcccctgtgcatgatcatcaccaccgtcctgggctccaccatactcaaagaggagaccaccctcggaagcgtgattggcgcggtgatcatagtggtggggctctactgcctcatctggggcaagagcaaggaccacctcggcagcaacggcaagcccggcgccgcggccgtcgccggcgagctgcccctgacctcggctcccacggccaacaacggtagttacggcaagcacgccgcgctcggcggcggccaccatgtcgtcaccggcgtcgagacgacgccgccgccgccgccgtgtgtgcccaagtgcgttcactga

SEQ ID NO: 2580 - protein, 395 aa, Sorghum bicolor
  misc_feature: Ceres ANNOT ID no. 6025190
  misc_feature (1)..(334): NCBI GI: 15219123 NCBI Desc: nodulin mtn21 family protein [arabidopsis thaliana]
  misc_feature (1)..(334): NCBI GI: 6552743 NCBI Desc: t26f17.11 [arabidopsis thaliana]
  misc_feature (2)..(380): NCBI GI: 7267470 NCBI Desc: nodulin-like protein [arabidopsis thaliana]
  misc_feature (7)..(380): NCBI GI: 21593603 NCBI Desc: nodulin-like protein [arabidopsis thaliana]
  misc_feature (4)..(362): NCBI GI: 30680708 NCBI Desc: nodulin mtn21 family protein [arabidopsis thaliana]
MGVGKLMNDVKPYLAMVLLQVGFSGMYIVSVASLKRGMNHFVLVVYRNLVATVVMAPFALIFERGVRPKMTPLIFLKIMGLAVLEPVLDQNMYYLGAKLTSATFGSALVNILPAITFLLALVMRMEKLRLRSLHSQAKVVGTVCTVAGAVLMILYHGPVVPFPWSAAGHHHASAAAAAAASQSSASWLYGTVMIIGSCLCWSGFFILQSNTLQSYPAELTLATLICFLGSVLTGGVALVAERHDMSAWVIGFDTRLFTAVYSGIVCSGVAFYVQGIVTQARGPVFVTAFQPLCMIITTVLGSTILKEETTLGSVIGAVIIVVGLYCLIWGKSKDHLGSNGKPGAAAVAGELPLTSAPTANNGSYGKHAALGGGHHVVTGVETTPPPPPCVPKCVH

SEQ ID NO: 2581 - DNA, 1224 bp, Sorghum bicolor
  misc_feature: Ceres ANNOT ID no. 6025214
  misc_feature: Encodes the peptide sequence at SEQ ID NO 2582
atgccgacgccggcgactgcgctgctgctgttcctcgcggcggcggcggcggcgttccgcggcgcgacggcgaagacgacgatcgagccgtgcgctggcgcggacgcgtgcccggctctgctgggctacacgctctacgcggacatgaaggtgtccgaggtggcggcgctcttcggcgccgacccggcggcggtgctggcagccaacgcgctcgacttcgcctctccgggcgccgccaaccgcatcctccccaaggggacgcccctccgcgtgcccacccgctgcgcctgcgccgacggcgtccgcaagtccgtcgccgtccgctacgccgcgcggccttccgacacgctcggctccatcgccgaggtcgtcttcgccggcctcccctccgccgaccagatccgcaccgccaacgggctcgccgccgaggaccccgacgcgccgctcagcccgggccagaagctcgtcgtcccgctcccctgcgtctgcttcaactccaccgacaacaacctccccgctgtctacctctcctatgtcgtgcaggtcggggacaccgtggaatccatcgccgccagccatacaaccaccgtcactgatatcagcaatgtgaacgcaatggggagccccattgtcgcaccaggcgacatccttgccataccattgcctgcttgcgcctcggcatttcctaactctgcttcggactatggattgcttgtggcaaatggaacctatgcactgactgctgggaactgtgtggagtgcagttgcgggccagcagatctcaatttgtattgcacaccggcttcactgacagcatcatgttcaagtatgcaatgctctaatagcagcctaattcttggtaatgtgaccacacaacccaccactggtggctgtggtgtctcgtcttgcaactatgctggctatgtcaatggaaccatcgcaacatcgctatcctcaggtcttcaacccatgtgtccaggaccacatcaattccccccactcacggcggttccaactgtggcaaaccatgggtcttattctccatcacctgcaccgggacctggagacgctggtggtgccatcccaggaggttccggcgtttcaccttcaaatgggcctgctgggaacgcctcgcaagcccctacgataaatcaaccatgccgtttcctcctcattttcattctttctctgacattgtccttgcagatgtggattcctgtgtag

SEQ ID NO: 2582 - protein, 407 aa, Sorghum bicolor
  misc_feature: Ceres ANNOT ID no. 6025214
  misc_feature (178)..(220): Pfam Id: LysM Pfam Desc: LysM domain
  misc_feature (2)..(403): NCBI GI: 51243456 NCBI Desc: lysm-domain gpi-anchored protein [oryza sativa (japonica cultivar-group)]
  misc_feature (4)..(403): NCBI GI: 53749174 NCBI Desc: at1g21880 [arabidopsis thaliana]
  misc_feature (8)..(407): NCBI GI: 144924297 NCBI Desc: peptidase s1 and s6, chymotrypsin/hap; peptidoglycan-binding lysm [medicago truncatula]
  misc_feature (4)..(315): NCBI GI: 6552732 NCBI Desc: t26f17.10 [arabidopsis thaliana]
  misc_feature (5)..(239): NCBI GI: 115448925 NCBI Desc: os02g0769200 [oryza sativa (japonica cultivar-group)]
MPTPATALLLFLAAAAAAFRGATAKTTIEPCAGADACPALLGYTLYADMKVSEVAALFGADPAAVLAANALDFASPGAANRILPKGTPLRVPTRCACADGVRKSVAVRYAARPSDTLGSIAEVVFAGLPSADQIRTANGLAAEDPDAPLSPGQKLVVPLPCVCFNSTDNNLPAVYLSYVVQVGDTVESIAASHTTTVTDISNVNAMGSPIVAPGDILAIPLPACASAFPNSASDYGLLVANGTYALTAGNCVECSCGPADLNLYCTPASLTASCSSMQCSNSSLILGNVTTQPTTGGCGVSSCNYAGYVNGTIATSLSSGLQPMCPGPHQFPPLTAVPTVANHGSYSPSPAPGPGDAGGAIPGGSGVSPSNGPAGNASQAPTINQPCRFLLIFILSLTLSLQMWIPV

SEQ ID NO: 2583 - DNA, 2502 bp, Sorghum bicolor
  misc_feature: Ceres ANNOT ID no. 6025229
  misc_feature: Encodes the peptide sequence at SEQ ID NO 2584
atgaagagcctgtggaagcagagcggcggcctggtgtgcgcggacgccgggccgctcagcccgctcggaggccgctcgcggcgccgcgcgaggctcacgctgtacgcgttcgcggccgccttcttcgcgttcaccgcctacgtcgccttcgccacgcctccttcctccgcgggcgccggcgccggagctggcgcctcgtggttcggcggagtgtacgcgtccacggcgccgtaccgctcgcagatttccagcctcttctcgtccatcttgcccgccaactcgccagagccgctgcgcgtaccgaccggcggatcgggcggcggtgggcaggtgacccgtgatgcgagcactgtgcaagtcgggagcgcggcggggagcaacagcagcagctctgccgcggctgggtctagtgagcagctgggaagtggaggcgccgctccgatcagcaatgcgagcgctgggagtgtgcctccggcagccgatttggccgctactggcattggcggaggcggagctccaacgaacagttccgcctcaagtgacggtgctccgaacgacgcggtggatctgaataaacgaagcggcggaggcgtttccacgggaggcggcagtggatccccggccaatagttcaggcgtacatggaaccgccgcggaggtcggcgagaatagcgtcgatgggtctaataagcagtcgggaagtggaagcggagccctgagcgatgctgctgccggacatggcagcactgtcagagctgaggccaacaaagttgcaagtgatgtttccaccaatagttctgcggggagtggcaacttggggaaggtggatttgagcaccggatcttctaataatccggcagggagtggaagtggcgtttcaggcagtgattcggatgctggaaatagcagcactgtaaagcctcatgctggagatgctgttggagctgggagcaggggttcttctggaaacggcactgataccaaggttaatctgaataaagatgctcaaccaaacagtggaagtggagatgcaagccataaatcacctggaagttctagtccagtaaagagcaatgctggagatggcgcaattgagggcagtaagggaaatgtgagtgttgttccaactaataatcaaactgggagtctggcattggcagggcagaaagatgttggatctcccaggaacaacaacacagttgtagcatctccctctgtaaagaatcaggagcagaccgggagccaagttgctcccagcgggagcactggtacagtgaataatccgaagggggatgctgctcagggcagtgctggttcatcagagaaccattcgacccaagcgaactcctcaaaatctggaaataacagtgagggtaacaggtcatcaataaaacaggatggtggttctggtggaaataagaaagttgattggttcaaggaagtggctagttgtgatatgttccatgggaattgggttagggatgactcataccctctctaccctgagggatcatgtccgcacattgatgagccctttgactgctatctcaacggtcggcgagatctagtttaccagaagctccgctggcaacccagtggatgcagtatcccaagattgaacccaaccgatatgttggagaggctgagaggaaaaagacttgttttcgttggtgattcactcaataggaacatgtgggaatcccttgtgtgtattttgaggaattccgtcaaagacaagaggaaggtttttgaggcatctggcaggcgtgagtttaagacggaaggctcatactctttcctattcacggactataactgcagcgtggagttcttccgctccccattcctagtccaggaatgggagatgaaagtgagcagtggaaagaaaaaggaaactctcaggcttgatctggtcgagcaatcgtcattgaagtacaaggatgcagactttctcattttcaatactgggcattggtggacacatgagaaaacttctcttgggaaggactactatcaggaaggtaaccatgtgtataatgagctaaacgtcatggatgcctttcataaagctcttctcacctggtccaagtggattgatgccaatgttaaccccagaaaaactgctgtgttattcagaggctactcagcatctcattttagtggtggccaatggaattcaggcggtagctgtgacaaggagagcgaaccaataaccaatgaacagtacctttcaacctacccaccaaagatgagcattctggaagatgtgatccacaagatgaaaactccggttgtttatttgaacataacgagaatgactgactacagaaaggatgcacacccttccatctaccgcaagcagaaccttactgatgaggagaggagatcgcccgaaagatatcaggactgcagccactggtgccttcctggagtaccagattcctggaatgaactggtttatgctcaacttttgatcaggcagcatcaaatgcgccaacaataa

SEQ ID NO: 2584 - protein, 833 aa, Sorghum bicolor
  misc_feature: Ceres ANNOT ID no. 6025229
  misc_feature (1)..(833): NCBI GI: 51091192 NCBI Desc: lustrin a-like [oryza sativa (japonica cultivar-group)]
  misc_feature (117)..(833): NCBI GI: 115467002 NCBI Desc: os06g0207500 [oryza sativa (japonica cultivar-group)]
  misc_feature (331)..(809): NCBI GI: 115448981 NCBI Desc: os02g0773600 [oryza sativa (japonica cultivar-group)]
  misc_feature (172)..(824): NCBI GI: 116310768 NCBI Desc: osigba0101p20.4 [oryza sativa (indica cultivar-group)]
  misc_feature (265)..(739): NCBI GI: 115452595 NCBI Desc: os03g0307700 [oryza sativa (japonica cultivar-group)]
  misc_feature: Useful for making plants with altered cell wall content and/or composition
  misc_feature: Functional homolog of the protein sequence given in SEQ ID NO 13772
MKSLWKQSGGLVCADAGPLSPLGGRSRRRARLTLYAFAAAFFAFTAYVAFATPPSSAGAGAGAGASWFGGVYASTAPYRSQISSLFSSILPANSPEPLRVPTGGSGGGGQVTRDASTVQVGSAAGSNSSSSAAAGSSEQLGSGGAAPISNASAGSVPPAADLAATGIGGGGAPTNSSASSDGAPNDAVDLNKRSGGGVSTGGGSGSPANSSGVHGTAAEVGENSVDGSNKQSGSGSGALSDAAAGHGSTVRAEANKVASDVSTNSSAGSGNLGKVDLSTGSSNNPAGSGSGVSGSDSDAGNSSTVKPHAGDAVGAGSRGSSGNGTDTKVNLNKDAQPNSGSGDASHKSPGSSSPVKSNAGDGAIEGSKGNVSVVPTNNQTGSLALAGQKDVGSPRNNNTVVASPSVKNQEQTGSQVAPSGSTGTVNNPKGDAAQGSAGSSENHSTQANSSKSGNNSEGNRSSIKQDGGSGGNKKVDWFKEVASCDMFHGNWVRDDSYPLYPEGSCPHIDEPFDCYLNGRRDLVYQKLRWQPSGCSIPRLNPTDMLERLRGKRLVFVGDSLNRNMWESLVCILRNSVKDKRKVFEASGRREFKTEGSYSFLFTDYNCSVEFFRSPFLVQEWEMKVSSGKKKETLRLDLVEQSSLKYKDADFLIFNTGHWWTHEKTSLGKDYYQEGNHVYNELNVMDAFHKALLTWSKWIDANVNPRKTAVLFRGYSASHFSGGQWNSGGSCDKESEPITNEQYLSTYPPKMSILEDVIHKMKTPVVYLNITRMTDYRKDAHPSIYRKQNLTDEERRSPERYQDCSHWCLPGVPDSWNELVYAQLLIRQHQMRQQ

SEQ ID NO: 2585 - DNA, 1992 bp, Sorghum bicolor
  misc_feature: Ceres ANNOT ID no. 6025233
  misc_feature: Encodes the peptide sequence at SEQ ID NO 2586
atgggcgaggcgacgggccacggtgacggcgtcggcgtcggcgtcgacctctcgggcgccgagatccgcgggggcctcgaggatcgcaacccgcccatcttcctcccgcgccagcccgccgcgtcgccgctcctcgccctcgacatcggagggactctgatcaagctggtgtacacggcgagctgcggcggcggggccgacggggcggacctgcgcttcgccaagttcgagaggcgacgcctccaggagtgcttcgacttcatacgggctgaggggctcctcgcctgcaatggtgggacgaggccaggcggagaaaacgtgaccctgaaggcgacgggtggtggagcatataaatttgctgatgatttcctggagaagctaggtgtttgtcttgacaagcttgatgaaatggatagtgtcgtttctggagcaaactttttgttgcagaatattcctggtgcagccttcacacacatgaatggacagaggaatccagtagatgtttccccaaacaatttgtttccttatcttcttgtcaacattggatcaggagttagtatactgaaggtcactggaaataaaaagtttgaaagggtaactgggacgcacattggtggtggtaccatgtttggtttagcaaaacttttaacaggctgtaagagctatgatgagttcttgcaattaagccagaaaggggacaactttgttcttgatctaattgtcaaggatatatgtggagagcttgtctgccagaaacaaggactttcaacatcaactcttgcttctagctttgggaaagttattacttctgagaagaagctgacagattacaagcctgaagacattgcatctacattgttgagtgcctttacctacaacattgcgcaaattgctttccttgttgcgtcacttttgggcctccgaagggtcttcttcggtggatcatatatacggggacacaaaagcacgatggaaaatatttcttatgcaattgatttctggtcacagagccaaatgcaagcagtatttttgcgacatgaagggtatttgggagcacttggtgccttgatgagttatggggatcccagtggtgaaaatcttacccttgaggagaaggagcctcatcacgaatcagcacctgttgatgggacatcagcggatgaagagaatgatagcaacatatttccttacctccttgtaaatatcggatcaggtgtcagcatgatagaggtaattggtaagggaaggtttgaaagaattataggatcccatctaggcggcggtactatccttggtcttgccaggcttttgactggttgttcaagttacgaagaattcttggagttgagccagaggggcaataatttgtctgtcgatttgactgttggggacatatatgggggagaaggttatccaaagattggtcttccagcatccactactgcggctagctttggaaaagtgaactcaagcaaactttcggagtacaaagtagaggatcttgctgcagctctactgaattctttcacgtacaacattggacagatagcctactttgtggctaatctttcaggcctgaagagaattttcttccgaggtgcttacgtctgtggtcatgaaaagactatggataagatatctcgttccctaaaatattggtccaaaggtgaagtccagacgacatttctatgtcatgaagggttcttgggaacactaggtgcattttggagttatgagaacatggggatcgacagcttggcggcacatgaagtcatcagggaggtcttgcttggtgcgccatacactgggcagttcccatctttacctgtcactcaacaacaggagaatggagaacatagtactctcgaaggggaagtagaaaacttacggcatgacaatgccgtgctgaaggctgaggttgagcgattacaaagggagaacgcagagctaagagcaaagttggtaagatcaggcgagacttcaaccttgtga

SEQ ID NO: 2586 - protein, 663 aa, Sorghum bicolor
  misc_feature: Ceres ANNOT ID no. 6025233
  misc_feature (43)..(360): Pfam Id: Fumble Pfam Desc: Fumble
  misc_feature (361)..(579): Pfam Id: Fumble Pfam Desc: Fumble
  misc_feature (12)..(662): NCBI GI: 51091158 NCBI Desc: pantothenate kinase 1-like [oryza sativa (japonica cultivar-group)]
  misc_feature (68)..(359): NCBI GI: 30689295 NCBI Desc: eukaryotic pantothenate kinase family protein [arabidopsis thaliana]
  misc_feature (68)..(359): NCBI GI: 79326098 NCBI Desc: atp binding / pantothenate kinase [arabidopsis thaliana]
  misc_feature (68)..(383): NCBI GI: 140043833 NCBI Desc: eukaryotic pantothenate kinase [medicago truncatula]
  misc_feature (71)..(367): NCBI GI: 62751101 NCBI Desc: partially similar to pantothenate kinase family protein [lycopersicon esculentum]
  misc_feature (45)..(378): SWISSPROT Homolog: EC 2.7.1.33 Pantothenate kinase 1
MGEATGHGDGVGVGVDLSGAEIRGGLEDRNPPIFLPRQPAASPLLALDIGGTLIKLVYTASCGGGADGADLRFAKFERRRLQECFDFIRAEGLLACNGGTRPGGENVTLKATGGGAYKFADDFLEKLGVCLDKLDEMDSVVSGANFLLQNIPGAAFTHMNGQRNPVDVSPNNLFPYLLVNIGSGVSILKVTGNKKFERVTGTHIGGGTMFGLAKLLTGCKSYDEFLQLSQKGDNFVLDLIVKDICGELVCQKQGLSTSTLASSFGKVITSEKKLTDYKPEDIASTLLSAFTYNIAQIAFLVASLLGLRRVFFGGSYIRGHKSTMENISYAIDFWSQSQMQAVFLRHEGYLGALGALMSYGDPSGENLTLEEKEPHHESAPVDGTSADEENDSNIFPYLLVNIGSGVSMIEVIGKGRFERIIGSHLGGGTILGLARLLTGCSSYEEFLELSQRGNNLSVDLTVGDIYGGEGYPKIGLPASTTAASFGKVNSSKLSEYKVEDLAAALLNSFTYNIGQIAYFVANLSGLKRIFFRGAYVCGHEKTMDKISRSLKYWSKGEVQTTFLCHEGFLGTLGAFWSYENMGIDSLAAHEVIREVLLGAPYTGQFPSLPVTQQQENGEHSTLEGEVENLRHDNAVLKAEVERLQRENAELRAKLVRSGETSTL

SEQ ID NO: 2587 - DNA, 465 bp, Sorghum bicolor
  misc_feature: Ceres ANNOT ID no. 6025257
  misc_feature: Encodes the peptide sequence at SEQ ID NO 2588
atgacatccaccgtcaccaccaccgtcgggtgcggggggctccccgtccgcccgtcgtcgtcgtcgacggcgcgtagaggacgtccccgcagatgcgccgtccgagctcaagccgcaggagcggatgcctccaacgacaagtcagtggaggtcatgcgtaagttctccgagcagtacgcccgccgctccaacaccttcttctgcgccgacaagacagtcactgccgtcgtcatcaagggacttgcggatcacagagacactctcggagctcctctatgcccttgtaggcattatgatgacaaagctgcggaggtagcacaaggattttggaactgtccatgcgtcccgatgcgtgagaggaaggaatgccactgtatgctttttcttactccggataatgactttgctgggaaggaccaggttatctccttggaggagatcaaagaggcgacatcgaagttctaa

SEQ ID NO: 2588 - protein, 154 aa, Sorghum bicolor
  misc_feature: Ceres ANNOT ID no. 6025257
  misc_feature (47)..(151): Pfam Id: FeThRed_B Pfam Desc: Ferredoxin thioredoxin reductase catalytic beta chain
  misc_feature (1)..(154): NCBI GI: 729535 NCBI Desc: ferredoxin-thioredoxin reductase catalytic chain, chloroplast precursor (ftr-c) (ferredoxin-thioredoxin reductase subunit b) (ftr-b)
  misc_feature (40)..(154): NCBI GI: 3928501 NCBI Desc: ferredoxin-thioredoxin reductase [zea mays]
  misc_feature (41)..(154): NCBI GI: 1076805 NCBI Desc: ferredoxin-thioredoxin reductase (ec 1.18.-.-) catalytic chain - maize
  misc_feature (5)..(152): NCBI GI: 2765445 NCBI Desc: ferredoxin thioredoxin reductase precursor [glycine max]
  misc_feature (18)..(152): NCBI GI: 1103726 NCBI Desc: ferredoxin-thioredoxin reductase (ftr) [spinacia oleracea]
  misc_feature: Useful for making plants with high aluminum sensitivity
  misc_feature: Useful for making plants with modulated high pH sensitivity
  misc_feature: Useful for making plants with modulated low iron sensitivity
  misc_feature: Useful for making plants with modulated phosphate use efficiency
  misc_feature: GREAT-hit functional homolog of the protein sequence given in SEQ ID NO 13427
  misc_feature: Useful for making plants with high aluminum sensitivity
  misc_feature: Useful for making plants with modulated high pH sensitivity
  misc_feature: Useful for making plants with modulated low iron sensitivity
  misc_feature: Useful for making plants with modulated phosphate use efficiency
  misc_feature: Functional homolog of the protein sequence given in SEQ ID NO 13427
MTSTVTTTVGCGGLPVRPSSSSTARRGRPRRCAVRAQAAGADASNDKSVEVMRKFSEQYARRSNTFFCADKTVTAVVIKGLADHRDTLGAPLCPCRHYDDKAAEVAQGFWNCPCVPMRERKECHCMLFLTPDNDFAGKDQVISLEEIKEATSKF

SEQ ID NO: 2589 - DNA, 1236 bp, Sorghum bicolor
  misc_feature: Ceres ANNOT ID no. 6025258
  misc_feature: Encodes the peptide sequence at SEQ ID NO 2590
atgaagcccagtcagttgattctatccaatcttgatatagacaggggatacccatacaagttccaaccagagtttccaatgtctcatgatcttggattgaatttgttttcacaagctggtacagtgctgggtacttctttaagacatcataggaagatttgttcttcaggaaatgtaatggtccatggagctttcaatcgcctcaacaagctttcccgagctctctatttctggctttctagaccatctgatcctaagagtttgcgctggctggcagctgtagcagcgaccagttctagatcttgtcagttgcgtttcaaccaaatgggttctcacatgcagaagttgactagactgcagttcagctttctagtgagacaagagcaagcaatacaactaattttagctaggcttgcaagtggaacgattgggcgactattgaatgagcagcaacatgcctccaatcttcttactctagccggcgctgctgctatcgtaccaccacttgaaaatatatctccaatgatgcttgccgagtcaatcgcatcgcgaaatattgatagtgatatccgaagacttgttgatcagccttatgtagaaggaaaaggcctaagttgtgcttgcccttctgtgcctagtactatatttcaagaagatccaattgaaccaaaaactggaatcaaattcccagcatttctggaagatgactccagtccatctgcagcggtccttgttgggataggtttcaaaggcatgagagtaatgagggtcaaaaatctgaacctgtatgcttttggtttatatatgcaaccgacttctatccaggagaagctgggtcctaagtatgcttcatttccaacggacaagctgatggacaaccctgatttctatagcgatcttctcagggaaaaccttgatatgagggttaggttggtggttaactacaatggccttagcgttggtgcagtgcgagacgtgtttgagaagtcccttggcctgcgtctgcagaagataaatcctaacactgactttcactgcttgaagacctttggttctcacttcacagaagatatcgccataccttcgggtacaaagattgacttctgtcaaacatcagatgggaaactaataacagaaaaggctttcttcgacatgtatattggtgattcaccgatttcaatggaggccaaaaaagttgttgcccagaacgtggccggactcattggaagacgctga

SEQ ID NO: 2590 - protein, 411 aa, Sorghum bicolor
  misc_feature: Ceres ANNOT ID no. 6025258
  misc_feature (244)..(408): NCBI GI: 115472907 NCBI Desc: os07g0571600 [oryza sativa (japonica cultivar-group)]
  misc_feature (222)..(396): NCBI GI: 113202134 NCBI Desc: chalcone isomerase [camellia sinensis]
  misc_feature: Useful for making plants with modulated salt sensitivity
  misc_feature: Useful for making plants with modulated salt sensitivity
  misc_feature: Functional homolog of the protein sequence given in SEQ ID NO 13296
  misc_feature: The sequence is a functional homolog of SEQ ID NO. 383 in the 11/188,298 US application
MKPSQLILSNLDIDRGYPYKFQPEFPMSHDLGLNLFSQAGTVLGTSLRHHRKICSSGNVMVHGAFNRLNKLSRALYFWLSRPSDPKSLRWLAAVAATSSRSCQLRFNQMGSHMQKLTRLQFSFLVRQEQAIQLILARLASGTIGRLLNEQQHASNLLTLAGAAAIVPPLENISPMMLAESIASRNIDSDIRRLVDQPYVEGKGLSCACPSVPSTIFQEDPIEPKTGIKFPAFLEDDSSPSAAVLVGIGFKGMRVMRVKNLNLYAFGLYMQPTSIQEKLGPKYASFPTDKLMDNPDFYSDLLRENLDMRVRLVVNYNGLSVGAVRDVFEKSLGLRLQKINPNTDFHCLKTFGSHFTEDIAIPSGTKIDFCQTSDGKLITEKAFFDMYIGDSPISMEAKKVVAQNVAGLIGRR

SEQ ID NO: 2591 - DNA, 966 bp, Sorghum bicolor
  misc_feature: Ceres ANNOT ID no. 6025298
  misc_feature: Encodes the peptide sequence at SEQ ID NO 2592
atggctccggccgtggccggggcggcgtcggtggcgatgagccaggcactgcgggaccgccagatcctcgacgccgtgggcaccggcgccgccgcgctctcgctggcgggctcctccttcatcgtgctctgctacctcctcttccgcgagctccgcaagttctccttcaagctcgtcttctacctagccgtctcggatatgttttgcagcttattcactatactgggggggccatcgaatgcattttactgctttgcacatgactacagtgctcatttcttctgtgtggcttcttttctatggacaaccaccatagcattcactctgcatcgcacagttgtaaaacacaaaactgatgttgaagaatttggatctattttccacttatatgtgtggggaacttcactagctaccactgtactacgttcgataggaagtgactatggaagaccaggttcatggtgctggatccagcagggaagcatggcaaaggtcctgcacttagtaactttttatcttccactttggggtgccattttgtacaatgggtttacatactatgaagtaaaccgcatgctgaacaatgcaacacggatggctgctggcataagtgatcgatcaaaccagtctgatattagggcagacaggaaggcatttaaccgatggggttattaccctctaattctaatcggttcatgggcatttgcaactatcaatcgtctttatgactttgccaatccagggcacaagatattttggctctcctttcttgatgttgggttcgctggacttatgggcctattcaattccattgcttatgggctaaactcttctgtgcgccgagctatttcagaaagaatcgacatgttcctacctgagagaatcaaaaggagcctccctactttctcacgattgaggagtcaacaggaaaatgaactgacttctcttattgtcgagggtaactga

SEQ ID NO: 2592 - protein, 321 aa, Sorghum bicolor
  misc_feature: Ceres ANNOT ID no. 6025298
  misc_feature (14)..(322): Pfam Id: Dicty_CAR Pfam Desc: Slime mold cyclic AMP receptor
  misc_feature (4)..(321): NCBI GI: 51090976 NCBI Desc: g protein coupled receptor-related-like [oryza sativa (japonica cultivar-group)]
  misc_feature (1)..(309): NCBI GI: 86560264 NCBI Desc: g-protein coupled receptor [pisum sativum]
  misc_feature (22)..(292): NCBI GI: 89291822 NCBI Desc: slime mold cyclic amp receptor [tetrahymena thermophila sb210]
  misc_feature (23)..(175): NCBI GI: 60468788 NCBI Desc: camp receptor-like protein [dictyostelium discoideum]
  misc_feature (31)..(289): NCBI GI: 89302999 NCBI Desc: oxidoreductase, zinc-binding dehydrogenase family protein [tetrahymena thermophila sb210]
MAPAVAGAASVAMSQALRDRQILDAVGTGAAALSLAGSSFIVLCYLLFRELRKFSFKLVFYLAVSDMFCSLFTILGGPSNAFYCFAHDYSAHFFCVASFLWTTTIAFTLHRTVVKHKTDVEEFGSIFHLYVWGTSLATTVLRSIGSDYGRPGSWCWIQQGSMAKVLHLVTFYLPLWGAILYNGFTYYEVNRMLNNATRMAAGISDRSNQSDIRADRKAFNRWGYYPLILIGSWAFATINRLYDFANPGHKIFWLSFLDVGFAGLMGLFNSIAYGLNSSVRRAISERIDMFLPERIKRSLPTFSRLRSQQENELTSLIVEGN

SEQ ID NO: 2593 - DNA, 663 bp, Sorghum bicolor
  misc_feature: Ceres ANNOT ID no. 6025302
  misc_feature: Encodes the peptide sequence at SEQ ID NO 2594
  misc_feature: Up-regulated in shoot tissues in response to methyl jasmonate treatment
  misc_feature: Up-regulated in root tissues in response to methyl jasmonate treatment
atggctacatcagagccagtacaagagaatttggcgatggactactcacaacctagtaagcctcgggtactccttgctgcttcaggaagtgtagccgctataaaatttgagaacctttgtcgtagtttctctgagtgggcggatgtccgagccgtggccaccgcatcatctttgcactttattgatagatcatctcttccaagtgacattgttctttacactgatgatgatgagtggtctacctggaagaagataggagatgaagttttacacattgagctgcgtaaatgggcagatattatggtgattgctccgttatcagcaaataccctggctaagatcgccggtgggttatgtgacaacctcttaacatgcatcgtgagagcgtgggactacagcaaaccgctctttgttgccccagctatgaacacattaatgtggaacaacccattcacagagcgtcatcttcaaacgatcaaccaactgggcataatcttgatccccccagttaccaaaaggttggcttgtggcgatcacgggaatggtgcaatggctgaaacctcgcagatctatacttctgtgaggcttgcatggaagacgcaaccacatgatgcaagcagttcacttgtggttcctgtcagtaataaccgcccatctagctga

SEQ ID NO: 2594 - protein, 220 aa, Sorghum bicolor
  misc_feature: Ceres ANNOT ID no. 6025302
  misc_feature (21)..(141): Pfam Id: Flavoprotein Pfam Desc: Flavoprotein
  misc_feature (18)..(203): NCBI GI: 52218792 NCBI Desc: at3g18030 [arabidopsis thaliana]
  misc_feature (18)..(203): NCBI GI: 28948674 NCBI Desc: chain a, ppc decarboxylase mutant c175s complexed with pantothenoylaminoethenethiol
  misc_feature (4)..(201): NCBI GI: 8778701 NCBI Desc: t1n15.24 [arabidopsis thaliana]
  misc_feature (10)..(201): NCBI GI: 2047324 NCBI Desc: hal3b protein [arabidopsis thaliana]
  misc_feature (1)..(196): NCBI GI: 92886295 NCBI Desc: flavoprotein [medicago truncatula]
  misc_feature (18)..(203): SWISSPROT Homolog: EC 4.1.1.36 Phosphopantothenoylcysteine decarboxylase
  misc_feature: The plant flowers significantly late compared to wild-type.
  misc_feature: Useful for making plants with modulated flowering time
  misc_feature: GREAT-hit functional homolog of the protein sequence given in SEQ ID NO 13537
  misc_feature: Useful for making plants with modulated flowering time
  misc_feature: Functional homolog of the protein sequence given in SEQ ID NO 13537
  misc_feature: Up-regulated in shoot tissues in response to methyl jasmonate treatment
  misc_feature: Up-regulated in root tissues in response to methyl jasmonate treatment
MATSEPVQENLAMDYSQPSKPRVLLAASGSVAAIKFENLCRSFSEWADVRAVATASSLHFIDRSSLPSDIVLYTDDDEWSTWKKIGDEVLHIELRKWADIMVIAPLSANTLAKIAGGLCDNLLTCIVRAWDYSKPLFVAPAMNTLMWNNPFTERHLQTINQLGIILIPPVTKRLACGDHGNGAMAETSQIYTSVRLAWKTQPHDASSSLVVPVSNNRPSS

SEQ ID NO: 2595 - DNA, 639 bp, Sorghum bicolor
  misc_feature: Ceres ANNOT ID no. 6025303
  misc_feature: Encodes the peptide sequence at SEQ ID NO 2596
atggctacatcagagccggtacaagagaatttggcgatggactactcacaacctagtaagcctcgggtactccttgctgcttcgggaagtgtagccactataaaatttgagaacctttgtcgttgtttctctgagtgggcggatgttcatgccgtggccaccgcatcatctttgcactttattgataaattgtctctaccaagtgacattgttctttacacggatgacgatgagtggtctacctggaagaagataggagatgaagttttacacattgagctgtgtaaatgggcagatattatggtcattgctcaattatcagcaaataccctggctatgatcgccggtgggttatgtgacaacctcttaacatgcattgtgagagcgtgggactacaacaaaccgctctttgttgccccagctatgaacacattaatgtggaacaacccatttagagagcatcatcttcagacgatcaaccaactgggcataatcttgatcccccagttaccaaaagattggcttgcggcgatcacgggaatgatctatacttctgtgaggcttgcatggaagacgcaaccacatgatgcaagcagttcacttgtggttcctgtcagtaataaccgcccatctagctga

SEQ ID NO: 2596 - protein, 212 aa, Sorghum bicolor
  misc_feature: Ceres ANNOT ID no. 6025303
  misc_feature (21)..(141): Pfam Id: Flavoprotein Pfam Desc: Flavoprotein
  misc_feature (18)..(195): NCBI GI: 52218792 NCBI Desc: at3g18030 [arabidopsis thaliana]
  misc_feature (18)..(195): NCBI GI: 28948674 NCBI Desc: chain a, ppc decarboxylase mutant c175s complexed with pantothenoylaminoethenethiol
  misc_feature (4)..(193): NCBI GI: 8778701 NCBI Desc: t1n15.24 [arabidopsis thaliana]
  misc_feature (10)..(193): NCBI GI: 2047324 NCBI Desc: hal3b protein [arabidopsis thaliana]
  misc_feature (1)..(168): NCBI GI: 92886295 NCBI Desc: flavoprotein [medicago truncatula]
  misc_feature (18)..(195): SWISSPROT Homolog: EC 4.1.1.36 Phosphopantothenoylcysteine decarboxylase
  misc_feature: The plant flowers significantly late compared to wild-type.
  misc_feature: Useful for making plants with modulated flowering time
  misc_feature: GREAT-hit functional homolog of the protein sequence given in SEQ ID NO 13537
  misc_feature: Useful for making plants with modulated flowering time
  misc_feature: Functional homolog of the protein sequence given in SEQ ID NO 13537
MATSEPVQENLAMDYSQPSKPRVLLAASGSVATIKFENLCRCFSEWADVHAVATASSLHFIDKLSLPSDIVLYTDDDEWSTWKKIGDEVLHIELCKWADIMVIAQLSANTLAMIAGGLCDNLLTCIVRAWDYNKPLFVAPAMNTLMWNNPFREHHLQTINQLGIILIPQLPKDWLAAITGMIYTSVRLAWKTQPHDASSSLVVPVSNNRPSS

SEQ ID NO: 2597 - DNA, 1599 bp, Sorghum bicolor
  misc_feature: Ceres ANNOT ID no. 6025306
  misc_feature: Encodes the peptide sequence at SEQ ID NO 2598
atgagttcactaaataaagttgtttcaaatagtggagatgcgtgttcagtgttacctagtaaagtcacatcattaaatcccaatgcagccgagtttgtaccttcatttgttaaaccatctcttggaagtactacagttccagatgtaactaagtcagattttagggtttcttctggaaaaacaatcctagataggtccgagtcatcaaagtctaataactcggatgatgaggcacaccagttttggcgtaagcagctacccgatgacattattccagacttcacttcttttgagaaagttgaacaagggcctgaagaactgtcccttgttggattgtccttgaatgcaccccccttttatgggacaacatccagtcgcttctcaagagaacatcacgaattatcttctccagctaccaagggcctggaactggaacatacgaatctgctgtatgaagataattatctgggttcaaccaactgggagcaaaattatattggtgatcttcatattgctaatggaaatcaggaccttcattatgattctgaaactggtgtaagctttgctgatagttttgctagtgagtatgctgcctcatcagatggccttgttgctcccctggagtacttagcatctcagttccctggattttcagcagagagccttgcagagctgtactacgcaaatgggtgtgatttcaaccataccattgaaatcctcacccagctagagatgcaagttgatgctacacccaatcacacactgagtctggcccacagcacaccaaactttagcactggggatttccctgcacttccaggtgtcgagaaccaaaatggtttcagtaagggtaacgtggatgtacttggcatgtttaatgggcgtggttcatctgcaatgcctactggagctggtgattttgtttcagctgttcgcaaacttgcgtcgcagaattctggccagtggaagtttaaaaaaggtcctgaatatggtaatggtgtttcagctctttctgtacccaaacagtacagttctagcactaagcaatcatctgggaataagtttcaaagtatcagcagtgcaagagttgccccatggcttgagactggcgatgcagtggcaaatatgtactcagaatcaagaggagaagctcgtgattttgctagggtccgaaatgcgtgcttcgagcaggctagacaggcttacttggttggcaacaaggctcttgcgaaggaactcagcatgaaggggcaggcatacaatgcgcaaatgaaatcagctcatgagaaagctagagaagctatttaccgacaaaggaatcctgtttcttcccaacgtgggggtgaccgcctgattgatttacatgggttgcatgtgaatgaagcaatccacatcctgaagggtgagctcactgccttgaagagcgcagcgagggcagcaggggagaggatgcaagtcatggtttgcgttggaacgggccaccacaccaagggctctcgcactgcgaggttgcctatagctgtggagcagttcctcctggatgaaggcctccagtacacgcagccacaggcgggtctgctccgagtgatggtgtactaa

SEQ ID NO: 2598 - protein, 532 aa, Sorghum bicolor
  misc_feature: Ceres ANNOT ID no. 6025306
  misc_feature (452)..(532): Pfam Id: Smr Pfam Desc: Smr domain
  misc_feature (20)..(37): Pfam Id: PAM2 Pfam Desc: Ataxin-2 C-terminal region
  misc_feature (174)..(501): NCBI GI: 47497475 NCBI Desc: smr (small muts related) domain-containing protein -like [oryza sativa (japonica cultivar-group)]
  misc_feature (216)..(531): NCBI GI: 115451121 NCBI Desc: os03g0180300 [oryza sativa (japonica cultivar-group)]
  misc_feature (371)..(529): NCBI GI: 119397087 NCBI Desc: smr domain protein [aspergillus clavatus nrrl 1]
  misc_feature (368)..(529): NCBI GI: 119495315 NCBI Desc: smr domain protein [neosartorya fischeri nrrl 181]
  misc_feature (323)..(512): NCBI GI: 119499970 NCBI Desc: ccch zinc finger and smr domain protein [neosartorya fischeri nrrl 181]
MSSLNKVVSNSGDACSVLPSKVTSLNPNAAEFVPSFVKPSLGSTTVPDVTKSDFRVSSGKTILDRSESSKSNNSDDEAHQFWRKQLPDDIIPDFTSFEKVEQGPEELSLVGLSLNAPPFYGTTSSRFSREHHELSSPATKGLELEHTNLLYEDNYLGSTNWEQNYIGDLHIANGNQDLHYDSETGVSFADSFASEYAASSDGLVAPLEYLASQFPGFSAESLAELYYANGCDFNHTIEILTQLEMQVDATPNHTLSLAHSTPNFSTGDFPALPGVENQNGFSKGNVDVLGMFNGRGSSAMPTGAGDFVSAVRKLASQNSGQWKFKKGPEYGNGVSALSVPKQYSSSTKQSSGNKFQSISSARVAPWLETGDAVANMYSESRGEARDFARVRNACFEQARQAYLVGNKALAKELSMKGQAYNAQMKSAHEKAREAIYRQRNPVSSQRGGDRLIDLHGLHVNEAIHILKGELTALKSAARAAGERMQVMVCVGTGHHTKGSRTARLPIAVEQFLLDEGLQYTQPQAGLLRVMVY

SEQ ID NO: 2599 - DNA, 741 bp, Sorghum bicolor
  misc_feature: Ceres ANNOT ID no. 6025314
  misc_feature: Encodes the peptide sequence at SEQ ID NO 2600
atgtcgtccgtgcagctctctggtgccggagtcgcggctgtggccttcacgaacaagagcctcgtctctcagcccgcagctctccgggtctgctcgtcaaggcgctcggtccgtagcctggtcgtgaaggctgccaccgtcgtcaccccaaagtacacttcactgaaacctctgggagatagggtgcttgtgaagcttggtgccgcagaggagaagacagttggtggcatcttgcttccatctaccgcccagaccaaaccacaaggaggtgaggttgttgctgttggagagggaaggaccattggagacaagaaagtagcggttgatataaagactggagcacaagtagtatactcaaagtatgctggcactgaggttgaattcaatgactcaaagcatcttattctcaaggaagacgatgtcatcggtattcttgagacagatgatgcgaaggatatgaagcctctcaatgaccgtgttctcatcaaggttgcagaagctgaagagaaaactcctgggggccttatcctcactgaaacagctaaagagaagccgtccatcggaacggttgtagctgttggcccgggtcctctggacgaggaaggcaagaggcagccactgtcagtgccggcgggcagcacggtactgtactccaagtatgcagggagcgagttcaagggcgctgatggcacgggctacattgtgttgagagcgtcggatgtgatggctgtcctgtcttaa

SEQ ID NO: 2600 - protein, 246 aa, Sorghum bicolor
  misc_feature: Ceres ANNOT ID no. 6025314
  misc_feature (54)..(145): Pfam Id: Cpn10 Pfam Desc: Chaperonin 10 Kd subunit
  misc_feature (152)..(245): Pfam Id: Cpn10 Pfam Desc: Chaperonin 10 Kd subunit
  misc_feature (1)..(215): NCBI GI: 115466912 NCBI Desc: os06g0196900 [oryza sativa (japonica cultivar-group)]
  misc_feature (33)..(246): NCBI GI: 50660327 NCBI Desc: chloroplast chaperonin 21 [vitis vinifera]
  misc_feature (1)..(246): NCBI GI: 7331143 NCBI Desc: chaperonin 21 precursor [lycopersicon esculentum]
  misc_feature (6)..(246): NCBI GI: 21780187 NCBI Desc: cp10-like protein [gossypium hirsutum]
  misc_feature (2)..(246): NCBI GI: 3057150 NCBI Desc: chaperonin 10 [arabidopsis thaliana]
MSSVQLSGAGVAAVAFTNKSLVSQPAALRVCSSRRSVRSLVVKAATVVTPKYTSLKPLGDRVLVKLGAAEEKTVGGILLPSTAQTKPQGGEVVAVGEGRTIGDKKVAVDIKTGAQVVYSKYAGTEVEFNDSKHLILKEDDVIGILETDDAKDMKPLNDRVLIKVAEAEEKTPGGLILTETAKEKPSIGTVVAVGPGPLDEEGKRQPLSVPAGSTVLYSKYAGSEFKGADGTGYIVLRASDVMAVLS

SEQ ID NO: 2601 - DNA, 3162 bp, Sorghum bicolor
  misc_feature: Ceres ANNOT ID no. 6025316
  misc_feature: Encodes the peptide sequence at SEQ ID NO 2602
atgaaggatcagggatcgggcggcgtcactcccagccccgccgaaggggaaaagaaacccatcaactcggagttgtggcatgcttgtgccgggcccctggtgtcgttgcccccggtgggtagtctcgtcgtgtacttcccgcagggccatagcgagcaggttgctgcttcaatgcataaggagctggacaccatccccagctacccatctctgccttctaagttgatctgcaagctcttaagtctcaccttacatgcagattctgaaaccgatgaagtttatgcccagatgacgcttcagcctgtgaacaaatatgatcgagacgcaatgctggcatctgaactgggtctgaagcaaaacaaacaaccaacagaattcttttgcaagacgctgacagcaagcgacacaagtacgcatgggggattctcagtgccacgccgtgcagctgagaagatatttccaccactagactttacgatgcaaccaccagcccaagagctcattgccaaggatctgcatgatatttcatggaaatttcgacatatctaccgaggtcaaccgaagaggcatcttttgacaaccggttggagtgtcttcgtcagtacaaaaaggttgttagctggtgattcagttctctttataagggatgagaaatctcagcttctcttaggtataaggcgtgctagcagaccccaaccagctctgtcatcatcagttttatcatgcgacagcatgcacattggaatcctggcagcagcagcccatgctgctgcaaatagtagcccatttactattttctataacccaagggcaagcccatcggaatttgtcatccctttagcaaaatacaataaggctctgtatacacaagtgtcccttggaatgcgattcagaatgctctttgagacagaggattcaggggtaagaagatacatgggcacgatcacaggcattggcgacttagatccactgcggtggaagaattctcattggcgaaaccttcaggttggttgggatgaatcaactgcatctgagaggcgcacccgtgtttcgatatgggagattgaaccagttgctacaccattttatatatgcccaccaccatttttcaggccaaagcttcctaagcagccaggaatgccagatgatgaaagcgaggttgagagtgctttcaaaagagcgatgccatggcttgctgatgactttgccctgaaagatgtccaaaatgcattatttccaggcctgagcctagttcaatggatggctatgcagcaaaatcctcagatgctagcaactgctgcccctgctgtacagtcgcagtacttgacctctaatgcactgggtatgcaggatgggataggcagtgtcagtgaagatccaacaaaaagattgagtatgcaggcccaaaatattggcttacctaatttacaggctggttcgaaagtggaccaccctgcaattaactcattagctcaacaccagcaacagcctcaccatgtattgcaacaacagcaggtccaaccgctgcagcaaagttctgcgattctacagcaacagcaagcccagctgttgcagcaaaatgccattcacttgcagcagcagcaagaacaactccaacggcaacaatcacagccgcagcaacagttgaaagctactgcatgtcttcagtcatcggaccagcacaagctgaaagagcaacagccttcaggtggacaagctgtctcacaagcacaattgttaaaccatattttgcaaccatcttcatctcagctacaacagttgggtttacccaagtcacctacccagcgcccagggttaccaggtctaacagcgatgggttctttgcagcaatcacaattaactcagacttcacagctgcaacaaacagcagaataccagcaggcactcctacaaagtcaacaacctcaactacaacagctatcacaatcagaactgcagctgcagctgcttcaaaagattcaacaacaaaatctgctatctcaactgaacccacagcatcagtcccagctgatccaacaattgtctcagaaaagccaggaaattctccagcaacaagttcttcaacatcaggtgggtggtgctgatgccatgggtcagctcaaacatttgcagcaaacacctttgaaccatacgacgggatccctgacaccccagcaacttgtaagatcacactcagcactcgctgagagtgaagaaccatccagctcaacagctccatctggcagccgtatctccccaataaattcattgagtagagcacaccaaggaagcagaaacttgcctgagatgccagcaacaccccaaattgagcacttgcttcaggaaattcaatgtaaatcagataatcgaatcaagaatgatatacaaggtagtaaagaaacggttcatgcacctaatcgtcatctagcttcagatcaacttgatgcgtcatctgctacctccttttgtttagatgagagcccacgagaaggcttttcctttcctccagtttgtttggataacaatgttcaagttgatccaagagagaattttcttattgcggaaaatgtggatacattaatgcccgatgccctgttgtcaagagggatgtcgtctggaaagggtatatgcaatctacctactggacaaagggatcatagggatgtggagaacgagctatcctctgctgcattcagctcccagtcatttggtgtgcctgacatgtctttcaagcctggatgttcaagtgatgttgctgttgctgatggtggaatggcaagccaaggtttgtggaatagtcaaacacaacggatgagaaccttcaccaaggttcaaaagcgtggatctgttgggagatcaattgatataacacgatatcgaggttatgaagatcttcggcatgatcttgcatgcatgtttggtattcaagggcagcttgaagacccctacagaacggattggaagctggtctatgttgatcatgaaaatgacatccttcttgtcggggatgacccctgggaggagtttgtaagctgtgtcaagagcattaaaatattatcatctgctgaagtacaacaaatgagcttggatggtgaccttggttgcatccctcaaactcaagcctgtagtgcttctgatgacgcaaatgcatggagggcctga

SEQ ID NO: 2602 - protein, 1053 aa, Sorghum bicolor
  misc_feature: Ceres ANNOT ID no. 6025316
  misc_feature (253)..(335): Pfam Id: Auxin_resp Pfam Desc: Auxin response factor
  misc_feature (126)..(231): Pfam Id: B3 Pfam Desc: B3 DNA binding domain
  misc_feature (267)..(1052): NCBI GI: 115466910 NCBI Desc: os06g0196700 [oryza sativa (japonica cultivar-group)]
  misc_feature (118)..(819): NCBI GI: 8954059 NCBI Desc: contains similarity to a non-phototropic hypocotyl 4 (nph4) protein from arabidopsis thaliana gbaf186466
  misc_feature (3)..(747): NCBI GI: 92891032 NCBI Desc: transcriptional factor b3; auxin response factor; aux/iaa_arf_dimerisation [medicago truncatula]
  misc_feature (6)..(819): NCBI GI: 15221978 NCBI Desc: transcriptional factor b3 family protein / auxin-responsive factor aux/iaa-related [arabidopsis thaliana]
  misc_feature (6)..(766): NCBI GI: 92891805 NCBI Desc: transcriptional factor b3; auxin response factor; aux/iaa_arf_dimerisation [medicago truncatula]
  misc_feature: The sequence is a functional homolog of SEQ ID NO 1001 in the 10/666,642US patent application
  misc_feature: The sequence is a functional homolog of SEQ ID NO 1003 in the 10/666,642US patent application
  misc_feature: The sequence is a functional homolog of SEQ ID NO 1004 in the 10/666,642US patent application
  misc_feature: The sequence is a functional homolog of SEQ ID NO 16 in the 10/412,699US patent application
  misc_feature: The sequence is a functional homolog of SEQ ID NO 1621 in the 10/374,780US patent application
  misc_feature: The sequence is a functional homolog of SEQ ID NO 1623 in the 10/374,780US patent application
  misc_feature: The sequence is a functional homolog of SEQ ID NO 1624 in the 10/374,780US patent application
  misc_feature: The sequence is a functional homolog of SEQ ID NO 1654 in the 10/412,699US patent application
  misc_feature: The sequence is a functional homolog of SEQ ID NO 1656 in the 10/412,699US patent application
  misc_feature: The sequence is a functional homolog of SEQ ID NO 1657 in the 10/412,699US patent application
  misc_feature: The sequence is a functional homolog of SEQ ID NO 186 in the 11/375,241US patent application
  misc_feature: The sequence is a functional homolog of SEQ ID NO 202 in the 10/225,066US patent application
  misc_feature: The sequence is a functional homolog of SEQ ID NO 2342 in the 10/374,780US patent application
  misc_feature: The sequence is a functional homolog of SEQ ID NO 2380 in the 10/374,780US patent application
  misc_feature: The sequence is a functional homolog of SEQ ID NO 2846 in the 10/374,780US patent application
  misc_feature: The sequence is a functional homolog of SEQ ID NO 286 in the 10/412,699US patent application
  misc_feature: The sequence is a functional homolog of SEQ ID NO 96 in the 10/225,066US patent application
  misc_feature: The sequence is a functional homolog of SEQ ID NO 962 in the 10/225,066US patent application
  misc_feature: Useful for making plants with modulated growth and phenotype characteristics
  misc_feature: The sequence is a functional homolog of SEQ ID NO 16 in the 20040045049 US patent application
  misc_feature: The sequence is a functional homolog of SEQ ID NO 1654 in the 20040045049 US patent application
  misc_feature: The sequence is a functional homolog of SEQ ID NO 1656 in the 20040045049 US patent application
  misc_feature: The sequence is a functional homolog of SEQ ID NO 1657 in the 20040045049 US patent application
  misc_feature: The sequence is a functional homolog of SEQ ID NO 286 in the 20040045049 US patent application
  misc_feature: The sequence is a functional homolog of SEQ ID NO 96 in the 20050160493 US patent application
  misc_feature: The sequence is a functional homolog of SEQ ID NO 962 in the 20050160493 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 100 in the 10/666,642 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
MKDQGSGGVTPSPAEGEKKPINSELWHACAGPLVSLPPVGSLVVYFPQGHSEQVAASMHKELDTIPSYPSLPSKLICKLLSLTLHADSETDEVYAQMTLQPVNKYDRDAMLASELGLKQNKQPTEFFCKTLTASDTSTHGGFSVPRRAAEKIFPPLDFTMQPPAQELIAKDLHDISWKFRHIYRGQPKRHLLTTGWSVFVSTKRLLAGDSVLFIRDEKSQLLLGIRRASRPQPALSSSVLSCDSMHIGILAAAAHAAANSSPFTIFYNPRASPSEFVIPLAKYNKALYTQVSLGMRFRMLFETEDSGVRRYMGTITGIGDLDPLRWKNSHWRNLQVGWDESTASERRTRVSIWEIEPVATPFYICPPPFFRPKLPKQPGMPDDESEVESAFKRAMPWLADDFALKDVQNALFPGLSLVQWMAMQQNPQMLATAAPAVQSQYLTSNALGMQDGIGSVSEDPTKRLSMQAQNIGLPNLQAGSKVDHPAINSLAQHQQQPHHVLQQQQVQPLQQSSAILQQQQAQLLQQNAIHLQQQQEQLQRQQSQPQQQLKATACLQSSDQHKLKEQQPSGGQAVSQAQLLNHILQPSSSQLQQLGLPKSPTQRPGLPGLTAMGSLQQSQLTQTSQLQQTAEYQQALLQSQQPQLQQLSQSELQLQLLQKIQQQNLLSQLNPQHQSQLIQQLSQKSQEILQQQVLQHQVGGADAMGQLKHLQQTPLNHTTGSLTPQQLVRSHSALAESEEPSSSTAPSGSRISPINSLSRAHQGSRNLPEMPATPQIEHLLQEIQCKSDNRIKNDIQGSKETVHAPNRHLASDQLDASSATSFCLDESPREGFSFPPVCLDNNVQVDPRENFLIAENVDTLMPDALLSRGMSSGKGICNLPTGQRDHRDVENELSSAAFSSQSFGVPDMSFKPGCSSDVAVADGGMASQGLWNSQTQRMRTFTKVQKRGSVGRSIDITRYRGYEDLRHDLACMFGIQGQLEDPYRTDWKLVYVDHENDILLVGDDPWEEFVSCVKSIKILSSAEVQQMSLDGDLGCIPQTQACSASDDANAWRA

SEQ ID NO: 2603 - DNA, 576 bp, Sorghum bicolor
  misc_feature: Ceres ANNOT ID no. 6025323
  misc_feature: Encodes the peptide sequence at SEQ ID NO 2604
atgttccccaggatctcccggctcggggcgcgcctcctgcgcgagtctagagccgagacgagagctggaaatttgctaagcagtcgaggcattttgtatcaaggtcatgttaaccggcattcgaccccagtgatgacccctactgtattatcgttgcggaatgtccttttgtcaactgcaacaagtggtgagcaggatgaaagcagtcagccaaaagataaaatctcagtaacatttgtcaacaaggatggctcagaaaagacaataagtgttccagttggcatgtccatgttagaagctgctcatgaaaacgacatagagcttgaaggagcatgtgagggctcacttgcgtgttctacttgtcatgtaatagtaatggatgtaaactattataacaagttagaagatccagcagatgaagaaaatgatatgcttgaccttgcatttgggctcacagaaacatcacgccttggttgccaagtgatcgcgaagcctgaacttgatggtatgcggctggcattacctgtagccacaagaaactttgcagtagatggctatgtaccgaaaccacactga

SEQ ID NO: 2604 - protein, 191 aa, Sorghum bicolor
  misc_feature: Ceres ANNOT ID no. 6025323
  misc_feature (80)..(165): Pfam Id: Fer2 Pfam Desc: 2Fe-2S iron-sulfur cluster binding domain
  misc_feature (1)..(191): NCBI GI: 79325201 NCBI Desc: electron carrier/ electron transporter/ iron ion binding [arabidopsis thaliana]
  misc_feature (54)..(191): NCBI GI: 92867560 NCBI Desc: adrenodoxin [medicago truncatula]
  misc_feature (52)..(191): NCBI GI: 37653251 NCBI Desc: ferredoxin precursor [digitalis lanata]
  misc_feature (59)..(191): NCBI GI: 17481347 NCBI Desc: mfdx2 [arabidopsis thaliana]
  misc_feature (4)..(191): NCBI GI: 21553832 NCBI Desc: mfdx2 precursor [arabidopsis thaliana]
MFPRISRLGARLLRESRAETRAGNLLSSRGILYQGHVNRHSTPVMTPTVLSLRNVLLSTATSGEQDESSQPKDKISVTFVNKDGSEKTISVPVGMSMLEAAHENDIELEGACEGSLACSTCHVIVMDVNYYNKLEDPADEENDMLDLAFGLTETSRLGCQVIAKPELDGMRLALPVATRNFAVDGYVPKPH

SEQ ID NO: 2605 - DNA, 1065 bp, Sorghum bicolor
  misc_feature: Ceres ANNOT ID no. 6025344
  misc_feature: Encodes the peptide sequence at SEQ ID NO 2606
atggctgctgaatcagagaacagcaactgcaacgcttgggcagcgagagatccttctggagttctgtcaccttacagctttaaccgcagagcagtgcaaagcaacgatgttgcgctgaagattatatactgtggagtctgttatgctgacgttgcttggacaaggaacgtgctcaatgattcaaaatatcctttggttcctgggcacgagatagctggagttgtaactcaggttggtgcagatgtcaaaggatttaaagtgggtgaccatgtaggtgttggaacatatgtgaactcatgccgagattgtgagaactgcaatagctctctagagaaccactgcccaaaagcagtttatactttcaatggcattgatacagatggaactgtcacaatgggaggttattccacgcacattgtagtccatgcaaggtattgcttccaaatacctgatggctaccctttggcaaaggcagcacctcttctgtgtgctgggataactgtgtatactccaatgatgcgacacaatatgaaccaacctggaaagtcacttggggtcattggactcggtggtctgggtcacatggctgtgaaatttggtaaagcatttggtctgaaggtcacagttttcagtacaagtgaatccaagagagatgaagccatcaacctccttggagcagataattttgttatatcatcggacacacagcagatggagtccctgaagaactccctgcacttcatagttgacaccgcttctggtgaccatccgtttgatccatttctctctctccttaaggctggtggtgtgatgacagtagtgggctctcccagtgagatcaaaatgcagcctgcaagccttattcttggtgcgcggaccttgtcaggcagtcttgttggaggtacaaaagacatccaagaaatggttaacttttgtgcagcgaacaaaatctatccaaagattgaggtcattaggatagattatatcaatgaggctttggcaaggcttgttaatcgagatgtgaaataccgctttgtaattgacatcgagaactctttcaagtag

SEQ ID NO: 2606 - protein, 354 aa, Sorghum bicolor
  misc_feature: Ceres ANNOT ID no. 6025344
  misc_feature (34)..(149): Pfam Id: ADH_N Pfam Desc: Alcohol dehydrogenase GroES-like domain
  misc_feature (180)..(314): Pfam Id: ADH_zinc_N Pfam Desc: Zinc-binding dehydrogenase
  misc_feature (1)..(340): NCBI GI: 115486319 NCBI Desc: os11g0622800 [oryza sativa (japonica cultivar-group)]
  misc_feature (1)..(354): NCBI GI: 77552036 NCBI Desc: oxidoreductase, zinc-binding dehydrogenase family [oryza sativa (japonica cultivar-group)]
  misc_feature (1)..(354): NCBI GI: 92877704 NCBI Desc: alcohol dehydrogenase superfamily, zinc-containing; d-isomer specific 2-hydroxyacid dehydrogenase, nad-binding [medicago truncatula]
  misc_feature (2)..(352): NCBI GI: 115482132 NCBI Desc: os10g0430200 [oryza sativa (japonica cultivar-group)]
  misc_feature (13)..(353): NCBI GI: 17028156 NCBI Desc: cinnamyl-alcohol dehydrogenase [medicago sativa]
  misc_feature: Useful for making plants with altered cell wall content and/or composition
  misc_feature: GREAT-hit functional homolog of the protein sequence encoded by LOCUS at1g72680
  misc_feature: Useful for making plants with altered cell wall content and/or composition
  misc_feature: Functional homolog of the protein sequence given in SEQ ID NO 13798
  misc_feature: The sequence is a functional homolog of SEQ ID NO 2 in US patent 7288696
  misc_feature: The sequence is a functional homolog of SEQ ID NO. 530 in the 11/188,298 US application
MAAESENSNCNAWAARDPSGVLSPYSFNRRAVQSNDVALKIIYCGVCYADVAWTRNVLNDSKYPLVPGHEIAGVVTQVGADVKGFKVGDHVGVGTYVNSCRDCENCNSSLENHCPKAVYTFNGIDTDGTVTMGGYSTHIVVHARYCFQIPDGYPLAKAAPLLCAGITVYTPMMRHNMNQPGKSLGVIGLGGLGHMAVKFGKAFGLKVTVFSTSESKRDEAINLLGADNFVISSDTQQMESLKNSLHFIVDTASGDHPFDPFLSLLKAGGVMTVVGSPSEIKMQPASLILGARTLSGSLVGGTKDIQEMVNFCAANKIYPKIEVIRIDYINEALARLVNRDVKYRFVIDIENSFK

SEQ ID NO: 2607 - DNA, 1029 bp, Sorghum bicolor
  misc_feature: Ceres ANNOT ID no. 6025346
  misc_feature: Encodes the peptide sequence at SEQ ID NO 2608
atggccgctgaatcagagaacggcaactgcaatgcatgggcagcgagagatccttccggagttctctcaccatacacgtttaaccgcagagcagtgcaaagcagcgatgttgcgctgaagatcatatactgtggagtctgttatgctgacgttaaatggacacggaatatgcagcatgattcaaaatatcctctggttccagggcatgagatagctggagttgtaactcaggttggtgcagatgtcaaaggctttaaagtgggtgaccatgtaggtgttggaacatatgtgaactcatgccgagattgtgagaactgcaatctctctctagaaaaccactgcccaaaaggagtttatactttcaatggcatcgacgcagatggaactgtcacaaaggggggttactccactcacattgtagtccatgaaaggtattgcttccaaatacccgatggctaccctttggcaaaggcagcacctcttctgtgtgctggaataactgtgtatactccaatgatgcgacacaacatgtaccaacctgggaagtcacttggggtcattggacttggtggtctgggtcacatggctgtgaaatttggtaaagcatttggtcttaaggtcacagttttgagtacaagtgaatcaaagagagatgaagccatcaccctccttggagcagataattttgttatatcatcagacacacaacagatggagtccctgaaaaactccctgcacttcatagttgacaccgcttctggtgaccatccatttgatccatatctctctctccttaaggttggtggtgtgatggcaatagtgggttttccaagtgcgcggaccttgtctggtagtcttgttggaggtacaaaagacatccaagaaatggttaacttctgtgcagagaacaaaatctatccggagatcgagatcattaagatagattacatcaatgaggctttggcaaggcttgtgaatcgagatgtgaaataccgctttgtaattgacatcgagaactctttcaagtag

SEQ ID NO: 2608 - protein, 342 aa, Sorghum bicolor
  misc_feature: Ceres ANNOT ID no. 6025346
  misc_feature (34)..(149): Pfam Id: ADH_N Pfam Desc: Alcohol dehydrogenase GroES-like domain
  misc_feature (180)..(302): Pfam Id: ADH_zinc_N Pfam Desc: Zinc-binding dehydrogenase
  misc_feature (1)..(328): NCBI GI: 115486319 NCBI Desc: os11g0622800 [oryza sativa (japonica cultivar-group)]
  misc_feature (1)..(342): NCBI GI: 77552036 NCBI Desc: oxidoreductase, zinc-binding dehydrogenase family [oryza sativa (japonica cultivar-group)]
  misc_feature (1)..(342): NCBI GI: 92877704 NCBI Desc: alcohol dehydrogenase superfamily, zinc-containing; d-isomer specific 2-hydroxyacid dehydrogenase, nad-binding [medicago truncatula]
  misc_feature (2)..(340): NCBI GI: 115482132 NCBI Desc: os10g0430200 [oryza sativa (japonica cultivar-group)]
  misc_feature (13)..(341): NCBI GI: 17028156 NCBI Desc: cinnamyl-alcohol dehydrogenase [medicago sativa]
  misc_feature: Useful for making plants with altered cell wall content and/or composition
  misc_feature: GREAT-hit functional homolog of the protein sequence encoded by LOCUS at1g72680
  misc_feature: Useful for making plants with altered cell wall content and/or composition
  misc_feature: Functional homolog of the protein sequence given in SEQ ID NO 13798
  misc_feature: The sequence is a functional homolog of SEQ ID NO 2 in US patent 7288696
  misc_feature: The sequence is a functional homolog of SEQ ID NO. 530 in the 11/188,298 US application
MAAESENGNCNAWAARDPSGVLSPYTFNRRAVQSSDVALKIIYCGVCYADVKWTRNMQHDSKYPLVPGHEIAGVVTQVGADVKGFKVGDHVGVGTYVNSCRDCENCNLSLENHCPKGVYTFNGIDADGTVTKGGYSTHIVVHERYCFQIPDGYPLAKAAPLLCAGITVYTPMMRHNMYQPGKSLGVIGLGGLGHMAVKFGKAFGLKVTVLSTSESKRDEAITLLGADNFVISSDTQQMESLKNSLHFIVDTASGDHPFDPYLSLLKVGGVMAIVGFPSARTLSGSLVGGTKDIQEMVNFCAENKIYPEIEIIKIDYINEALARLVNRDVKYRFVIDIENSFK

SEQ ID NO: 2609 - DNA, 1023 bp, Sorghum bicolor
  misc_feature: Ceres ANNOT ID no. 6025348
  misc_feature: Encodes the peptide sequence at SEQ ID NO 2610
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
atggctgctgaatcagagaacggcaactgcaatgcttgggcagcgagagatccttctggagttctctcaccatacaagtttaaccgcatgcaaagcagcgatgttgcgctgaagatcatatactgtggagtctgttatgctgacgttggttggacacggaacatgctcaatgattcaaaatatcctttggttcctgggcatgagatagctggagttgtaactcaggttggtgcagatgtcaaagcctttaaagtgggtgaccatgtaggtgttggaacatatgtgaactcatgccgagattgtgagaactgcaatagctctctagagaaccactgcccagaaagagtttttactttcaatggcattgatacagatggaactgtcacaaaggggggttactccactcacattgtagtccatgaaaggtattgcttcaaaatacccgatggctaccctttggcaaaggcagcacctcttctatgcgctggaataactgtgtatactccaatgatgcaacacaacatgaaccaacctggaaagtcacttggggtcattggactcggtggcctaggtcacatggcggtgaaatttggtaaagcgtttggtcttaaggtcacagttttgagtacaagtgaatcaaagagacatgaagccatcagcctacttggagcagataattttgttatatcatcagacacacagcagatggagtccctgaaaaactccctgcacttcatagttgacaccgcttctggtgaccatccgtttgatccatatctctctctccttaaggttggtggtgtgatgacactgctgggctttccaagtgcgcgggccttgtctggtagtgttgttggaggtacaaaagacatccaagaaatggttaacttctgtgcagagaacaaaatctatccagagatcgagatcattaagatagattacatcaatgaggctttggcaaggcttgttaatcgagatgtgaaataccgctttgtaattgacatcgagaactctttcaagtag

SEQ ID NO: 2610 - protein, 340 aa, Sorghum bicolor
  misc_feature: Ceres ANNOT ID no. 6025348
  misc_feature (32)..(147): Pfam Id: ADH_N Pfam Desc: Alcohol dehydrogenase GroES-like domain
  misc_feature (178)..(300): Pfam Id: ADH_zinc_N Pfam Desc: Zinc-binding dehydrogenase
  misc_feature (1)..(326): NCBI GI: 115486319 NCBI Desc: os11g0622800 [oryza sativa (japonica cultivar-group)]
  misc_feature (1)..(340): NCBI GI: 77552036 NCBI Desc: oxidoreductase, zinc-binding dehydrogenase family [oryza sativa (japonica cultivar-group)]
  misc_feature (1)..(340): NCBI GI: 92877704 NCBI Desc: alcohol dehydrogenase superfamily, zinc-containing; d-isomer specific 2-hydroxyacid dehydrogenase, nad-binding [medicago truncatula]
  misc_feature (2)..(338): NCBI GI: 115482132 NCBI Desc: os10g0430200 [oryza sativa (japonica cultivar-group)]
  misc_feature (13)..(339): NCBI GI: 17028156 NCBI Desc: cinnamyl-alcohol dehydrogenase [medicago sativa]
  misc_feature: Useful for making plants with altered cell wall content and/or composition
  misc_feature: GREAT-hit functional homolog of the protein sequence encoded by LOCUS at1g72680
  misc_feature: Useful for making plants with altered cell wall content and/or composition
  misc_feature: Functional homolog of the protein sequence given in SEQ ID NO 13798
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature: The sequence is a functional homolog of SEQ ID NO. 530 in the 11/188,298 US application
MAAESENGNCNAWAARDPSGVLSPYKFNRMQSSDVALKIIYCGVCYADVGWTRNMLNDSKYPLVPGHEIAGVVTQVGADVKAFKVGDHVGVGTYVNSCRDCENCNSSLENHCPERVFTFNGIDTDGTVTKGGYSTHIVVHERYCFKIPDGYPLAKAAPLLCAGITVYTPMMQHNMNQPGKSLGVIGLGGLGHMAVKFGKAFGLKVTVLSTSESKRHEAISLLGADNFVISSDTQQMESLKNSLHFIVDTASGDHPFDPYLSLLKVGGVMTLLGFPSARALSGSVVGGTKDIQEMVNFCAENKIYPEIEIIKIDYINEALARLVNRDVKYRFVIDIENSFK

SEQ ID NO: 2611 - DNA, 1056 bp, Sorghum bicolor
  misc_feature: Ceres ANNOT ID no. 6025350
  misc_feature: Encodes the peptide sequence at SEQ ID NO 2612
atgtgcggcggcgccatcctgtcggacatcatcccgccgccgccgcggcgggtcacggcgggccacctctggccggagagcaagaagccgaggaggggcgccggggccggaaggaggagggccgggccccccgtggaggaggaggaggaggaggaggacttcgaggccgacttcgaggtgttcgaggtggagtccggcgagtcggagctcgagtccgaggatgaggccaagcccttcgccgcccccaggaccaggagcgcgctccccagagttgttgttgatggccctgctgcaaattcagttaaaaggaagaggaagaaccagtttaggggtatccgccggcgcccatggggtaaatgggctgctgagatcagagatcctcgcaaaggtgttcgtgtttggcttggtactttcaactctcccgaagaagctgccagggcttatgatgctgaggcacgcaggatccgtggcaagaaggctaaagtcaacttcccagatgaggtttcgacgattcctcagaagcaccgtgctggtcctacccctctgaaagtgcctgagatggactttgaagagaagccgattatcaagccggcagtcaacaacatgaccaactcaaatgcatatcactaccctgttgtcgaccacaacatacccgagccatttatgcatactcaaaacatgtcatttgctcctttcgtgaattctgctgctcccattcaggaacctttcgtgaacctgtcctcagaccaaggtagcaactccttcagttgctcagacttcagcctcgagaatgacaccaggacccctgacataacgtcggtagttgttggtgagtctgcgttcgtccagaacactggtcctgctgtggtgcctccgttgatggggaatgctagtgttgatctcacagagttggatccatatatgaatttcctgatggacagtggttcagaggactcaatcaacactcttttgagctgtgatggatcccaggatgtggttagcaacatggacctttggagctttgatgacatgcccatgtctgctggtttctactga

SEQ ID NO: 2612 - protein, 351 aa, Sorghum bicolor
  misc_feature: Ceres ANNOT ID no. 6025350
  misc_feature (107)..(158): Pfam Id: AP2 Pfam Desc: AP2 domain
  misc_feature (1)..(351): NCBI GI: 111054074 NCBI Desc: ethylene-responsive factor 15 [oryza sativa (indica cultivar-group)]
  misc_feature (1)..(351): NCBI GI: 6176534 NCBI Desc: erebp-like protein [oryza sativa]
  misc_feature (1)..(351): NCBI GI: 115466890 NCBI Desc: os06g0194000 [oryza sativa (japonica cultivar-group)]
  misc_feature (1)..(351): NCBI GI: 75261388 NCBI Desc: ethylene-responsive transcription factor 1 (ethylene-responsive element-binding factor 1) (erebp-1) (oserebp1)
  misc_feature (1)..(351): NCBI GI: 6689918 NCBI Desc: transcription factor erebp1 [oryza sativa]
  misc_feature: Useful for making plants with altered alkaloid content
  misc_feature: Useful for making plants with altered terpenoid content
  misc_feature: Functional homolog of the protein sequence given in SEQ ID NO 12996
  misc_feature: GREAT-hit functional homolog of the protein sequence given in SEQ ID NO 13188
MCGGAILSDIIPPPPRRVTAGHLWPESKKPRRGAGAGRRRAGPPVEEEEEEEDFEADFEVFEVESGESELESEDEAKPFAAPRTRSALPRVVVDGPAANSVKRKRKNQFRGIRRRPWGKWAAEIRDPRKGVRVWLGTFNSPEEAARAYDAEARRIRGKKAKVNFPDEVSTIPQKHRAGPTPLKVPEMDFEEKPIIKPAVNNMTNSNAYHYPVVDHNIPEPFMHTQNMSFAPFVNSAAPIQEPFVNLSSDQGSNSFSCSDFSLENDTRTPDITSVVVGESAFVQNTGPAVVPPLMGNASVDLTELDPYMNFLMDSGSEDSINTLLSCDGSQDVVSNMDLWSFDDMPMSAGFY

SEQ ID NO: 2613 - DNA, 1470 bp, Sorghum bicolor
  misc_feature: Ceres ANNOT ID no. 6025353
  misc_feature: Encodes the peptide sequence at SEQ ID NO 2614
atggacttctcagctggttcctacttctcatcatggcctgtcaattctggttctgagagctacagtttggctgatggttcagtggaatcatatggaggagaaggaagcatggcaccttcaagctatttcatgacagctagatcagatcacaatttaaaattcagtgtgcatgaacaggattccactatgcttccaaatgaacagttgacctatgctggtgctggccagactgatctgttacctggtgatactctatctagggataagctttgtgaaaatcttctggagcttcaacgactgcagaataacagcaatctgcagagtaatttagtggccccaggagtgcttcagcacaattcaacacctggggtctttcatccacagttgaatactcctggactttcagaactgcctcatgccttatctagttcaattgatagtaatggaagtgaagtttctgcttttcttgctgatgtaaatgctgtttcttcagccccaactttgtgttcagcattccaaaatgcttcttcgttcatggaaccagtgaatctagaagctttcagttttcaaggagcacaaagtgattctgttttgaacaaaacaagccattcaaatgggaatatctcagtgtttgacagtgctaccttggcatcacttcatgacagcaaagaatttatcactggtaggctcccctcatttgctagtgtcaaggaagcaaacctagcttctagtggtttcaagactcagaagcaggagcaaaatgcaatgtgcaacgttcctctccctgctttcactgcacgtaatcaaatgtcagttgctgcaacgcaaggagcactgatccctcaaaagattccttcatggatcaatgaaaacaaaagtgagggtcctgttagccatccttctgatgtacaaacccaaccaaattcggctggaaatggtgttggcgtgaagccacgagtaagggctcgtcgtggacaggcaactgatcctcacagtattgctgaacggcttcgcagagagaaaatttcagataggatgaaaagtctgcaagatctcgtcccgaattccaataaggcagacaaggcatccatgctggatgaaataattgattatgtgaaatttcttcagcttcaggtcaaggtcttgagcatgagtaggctaggagctccaggagcagttcttccccttctcacagaatctcagactgagggttaccatggtcaacctctgtcggctccaaccaacacacaaggattactggatgcactagactcggaagacgccttcgtctttgaggaagaggttgtgaagctaatggaaaccagcatcaccagcgcaatgcagtaccttcagaacaaggggctctgcttgatgccagttgcccttgcttccgccatatccacccagaaaggtgtgtccgctgctgcaatccctcctgaacggcgaaataaagacatgctcctcccatga

SEQ ID NO: 2614 - protein, 489 aa, Sorghum bicolor
  misc_feature: Ceres ANNOT ID no. 6025353
  misc_feature (327)..(376): Pfam Id: HLH Pfam Desc: Helix-loop-helix DNA-binding domain
  misc_feature (1)..(481): NCBI GI: 93359745 NCBI Desc: bhlh transcription factor ptf1 [zea mays]
  misc_feature (1)..(481): NCBI GI: 29424047 NCBI Desc: bhlh transcription factor ptf1 [oryza sativa]
  misc_feature (195)..(485): NCBI GI: 115446765 NCBI Desc: os02g0564700 [oryza sativa (japonica cultivar-group)]
  misc_feature (308)..(468): NCBI GI: 140070464 NCBI Desc: steroid nuclear receptor, ligand-binding; helix-loop-helix dna-binding [medicago truncatula]
  misc_feature (295)..(468): NCBI GI: 50253024 NCBI Desc: bhlh transcription factor ptf1-like protein [oryza sativa (japonica cultivar-group)]
  misc_feature: The sequence is a functional homolog of SEQ ID NO 1488 in the 11/479,226US patent application
  misc_feature: The sequence is a functional homolog of SEQ ID NO 198 in the 10/714,887US patent application
  misc_feature: The sequence is a functional homolog of SEQ ID NO 198 in the 11/435,388US patent application
  misc_feature: The sequence is a functional homolog of SEQ ID NO 712 in the 10/412,699US patent application
  misc_feature: Useful for making plants with modulated growth and phenotype characteristics
  misc_feature: The sequence is a functional homolog of SEQ ID NO 712 in the 20040045049 US patent application
  misc_feature: The sequence is a functional homolog of SEQ ID NO 198 in the 20060015972 US patent application
  misc_feature: The sequence is a functional homolog of SEQ ID NO 1211 in the 11/479,226 US patent application
  misc_feature: The sequence is a functional homolog of SEQ ID NO 546 in the 10/412,699 US patent application
  misc_feature: The sequence is a functional homolog of SEQ ID NO. 414 in the 11/188,298 US application
MDFSAGSYFSSWPVNSGSESYSLADGSVESYGGEGSMAPSSYFMTARSDHNLKFSVHEQDSTMLPNEQLTYAGAGQTDLLPGDTLSRDKLCENLLELQRLQNNSNLQSNLVAPGVLQHNSTPGVFHPQLNTPGLSELPHALSSSIDSNGSEVSAFLADVNAVSSAPTLCSAFQNASSFMEPVNLEAFSFQGAQSDSVLNKTSHSNGNISVFDSATLASLHDSKEFITGRLPSFASVKEANLASSGFKTQKQEQNAMCNVPLPAFTARNQMSVAATQGALIPQKIPSWINENKSEGPVSHPSDVQTQPNSAGNGVGVKPRVRARRGQATDPHSIAERLRREKISDRMKSLQDLVPNSNKADKASMLDEIIDYVKFLQLQVKVLSMSRLGAPGAVLPLLTESQTEGYHGQPLSAPTNTQGLLDALDSEDAFVFEEEVVKLMETSITSAMQYLQNKGLCLMPVALASAISTQKGVSAAAIPPERRNKDMLLP

SEQ ID NO: 2615 - DNA, 1074 bp, Sorghum bicolor
  misc_feature: Ceres ANNOT ID no. 6025367
  misc_feature: Encodes the peptide sequence at SEQ ID NO 2616
atgatcccccagacgtcctcggtctcttcgtcggcgtcggcgtcggcggcgcccacgccgccggtgtggcccagccccagcggcagcggcggcgacgggatgttccctggctcggtcagcaactcggggggccagcagcagctggccatcagcaacggggtgctcctggccgcggtcatcttcctcttcatggtcgtcgtcttcgtcttcctgctctacctctacgccaagcgctacctgggtgcgaacccgctgctggcgccgacctcgccgtcgtcgcggttcctcttcgtcgccgcgtcgccgctcccgcagcgcggcctgccggcctccgtcctgcgctccctccccgtcaccgtctacgccgccgccggtgccggctcccccagggacaaggagaaggcggacgcgctggagtgcgcggtgtgcctgtcggaggtggccgacggcgagaaggtgcggacgctgcccaagtgcgggcacgggttccacgtggagtgcatcgacatgtggttccactcccacgacacctgcccgctctgccgcgcccccgtcggcggcgccggtgccggcgaactcgacgcgctgccgcgggaggagccctcgggcgcgtcgctggagttccccgtgttccccaccaacgtcctcttctggggcaccaacgacgaggtcaccaacgccggcctcgccactcccccacccccgccgccgcaccccatcgccagcgccgccgcgtccgcgagctcctcggcctcctccgggcgaaggaaggagaaccagctggtcatcgacatcccgacgcggcccgtggccctgaacacaccgcccatgaactccccgctgccggcgagccgcatgcccgggaccgccgacgacatgcggtcccctgtctccgccaggctgcggtcgctgcgccggttgctcagcagaggcaagcaggccgtggtcggcacctcctcttacagcccgagcccgcgcggcggcgccggtggtgacatcgagcaggggatcgccggagccgacgccgcccgcgctcccaagacgcccaagacgcctccgtcgtcggcgaactga

SEQ ID NO: 2616 - protein, 357 aa, Sorghum bicolor
  misc_feature: Ceres ANNOT ID no. 6025367
  misc_feature (140)..(181): Pfam Id: zf-C3HC4 Pfam Desc: Zinc finger, C3HC4 type (RING finger)
  misc_feature (38)..(353): NCBI GI: 115466878 NCBI Desc: os06g0192800 [oryza sativa (japonica cultivar-group)]
  misc_feature (1)..(349): NCBI GI: 55741078 NCBI Desc: znf [zea mays]
  misc_feature (34)..(349): NCBI GI: 99866723 NCBI Desc: ring-h2 zinc finger protein [zea mays]
  misc_feature (34)..(349): NCBI GI: 21645888 NCBI Desc: ring-h2 zinc finger protein [zea mays]
  misc_feature (34)..(349): NCBI GI: 99866708 NCBI Desc: ring-h2 zinc finger protein [zea mays]
  misc_feature: The sequence is a functional homolog of SEQ ID NO 1134 in the 10/666,642US patent application
  misc_feature: The sequence is a functional homolog of SEQ ID NO 1285 in the 11/479,226US patent application
  misc_feature: The sequence is a functional homolog of SEQ ID NO 984 in the 11/479,226US patent application
  misc_feature: Useful for making plants with modulated growth and phenotype characteristics
  misc_feature: The sequence is a functional homolog of SEQ ID NO 1285 in the 20070022495 US patent application
  misc_feature: The sequence is a functional homolog of SEQ ID NO 984 in the 20070022495 US patent application
  misc_feature: The sequence is a functional homolog of SEQ ID NO 1134 in the 20070033671 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 468 in the 11/188,298 US application
  misc_feature: The sequence is a functional homolog of SEQ ID NO. 350 in the 11/188,298 US application
MIPQTSSVSSSASASAAPTPPVWPSPSGSGGDGMFPGSVSNSGGQQQLAISNGVLLAAVIFLFMVVVFVFLLYLYAKRYLGANPLLAPTSPSSRFLFVAASPLPQRGLPASVLRSLPVTVYAAAGAGSPRDKEKADALECAVCLSEVADGEKVRTLPKCGHGFHVECIDMWFHSHDTCPLCRAPVGGAGAGELDALPREEPSGASLEFPVFPTNVLFWGTNDEVTNAGLATPPPPPPHPIASAAASASSSASSGRRKENQLVIDIPTRPVALNTPPMNSPLPASRMPGTADDMRSPVSARLRSLRRLLSRGKQAVVGTSSYSPSPRGGAGGDIEQGIAGADAARAPKTPKTPPSSAN

SEQ ID NO: 2617 - DNA, 1026 bp, Sorghum bicolor
  misc_feature: Ceres ANNOT ID no. 6025369
  misc_feature: Encodes the peptide sequence at SEQ ID NO 2618
atgtcgtacctcaagaagctgtccccctacaccgtctccctcatcgtcctcctccctctcaccctcatcttatgcttcacctttctccttccgttgttatccgcctacctcagcaacccgcttgctgccacagcggcagtggctacaactaccagcgcctgcgtcggcaccaccgccggggcagtcgtccgcgctgcggcgccagctgcagcagccaaggacgacgacgacggcgacgacggtgtcggtggtagccagcgcccggccccggcggagccgatgagcgtcctcgtcggcgtgcacaccatgcccggcaagcactcccggcggcacctcatccgcatggcgtacgtgctgcagcagcagcagcagacgtcgcccgcgctccgcgtcgacgtccggttcgtgctctgcgcgcgcccgatgccgcccgagcaccgcgcgttcgtggcgctcgaggcgcgcgcctacggcgacgtgctggtcctcgactgcgccgagaacgcagaggacgggaagacgtacacgtacttcgccagcctccccgccatgctcggctccggcggcggcgggccgccgtacgactacgtgatgaaggtggacgacgacacgttcctccggctggacgcgctggtggacaccctgcggtcggcgccgagggaggacatgtactggggcgtggggctcccgttccagaaccgggagttcccgccgttcatgctcggcatgggctacctgctgtcctgggacctcgtcgaatggatcgccacctccgacatggtcagaagggaggccaagggtgccgaagatctgaccacaggcaaatggctgaacatgggcaacaaggccaagaaccgggtgaacattttccccaggatgtatgactacaagagtgccaaagctgaggacttcttggagaacaccattggggtgcatcagctgaagcaggacctaaggtgggcacacacactggagcacttcaatgtcacccggttggagccctctagcaagctacacaacttctag

SEQ ID NO: 2618 - protein, 341 aa, Sorghum bicolor
  misc_feature: Ceres ANNOT ID no. 6025369
  misc_feature (63)..(334): NCBI GI: 115479301 NCBI Desc: os09g0433500 [oryza sativa (japonica cultivar-group)]
  misc_feature (55)..(226): NCBI GI: 61211870 NCBI Desc: beta-1,3-galactosyltransferase-6 (beta 3galt6) (galactosylxylosylprotein 3-beta-galactosyltransferase) (udp-gal:betagal beta 1,3-galactosyltransferase polypeptide 6)
  misc_feature (55)..(226): NCBI GI: 61211870 (continued) (galactosyltransferase ii) (gag galtii)
  misc_feature (55)..(226): NCBI GI: 16024928 NCBI Desc: beta-1,3-galactosyltransferase-6 [homo sapiens]
  misc_feature (96)..(277): NCBI GI: 89269053 NCBI Desc: udp-gal:betagal beta 1,3-galactosyltransferase polypeptide 6 [xenopus tropicalis]
  misc_feature (173)..(315): NCBI GI: 74625883 NCBI Desc: beta-1,3-galactosyltransferase pvg3 (pyruvylated gal-beta-1,3-epitope synthesis protein 3) (pvgal synthesis protein 3)
  misc_feature: The sequence is a functional homolog of SEQ ID NO. 346 in the 11/188,298 US application
MSYLKKLSPYTVSLIVLLPLTLILCFTFLLPLLSAYLSNPLAATAAVATTTSACVGTTAGAVVRAAAPAAAAKDDDDGDDGVGGSQRPAPAEPMSVLVGVHTMPGKHSRRHLIRMAYVLQQQQQTSPALRVDVRFVLCARPMPPEHRAFVALEARAYGDVLVLDCAENAEDGKTYTYFASLPAMLGSGGGGPPYDYVMKVDDDTFLRLDALVDTLRSAPREDMYWGVGLPFQNREFPPFMLGMGYLLSWDLVEWIATSDMVRREAKGAEDLTTGKWLNMGNKAKNRVNIFPRMYDYKSAKAEDFLENTIGVHQLKQDLRWAHTLEHFNVTRLEPSSKLHNF

SEQ ID NO: 2619 - DNA, 1044 bp, Sorghum bicolor
  misc_feature: Ceres ANNOT ID no. 6025387
  misc_feature: Encodes the peptide sequence at SEQ ID NO 2620
atggaggtgggcgaccttcacaaggtgtgggaggtccgtgcgctcaagaccaagcccgacgcggccgccgcccgggcgacgctcgaccgagtcgccaggcaggtccagcccatcatgcgccgccacaagtggcgcgtcaaggtcctctccgagttctcgccgcggaacccgaggctgctggggctcaatgtcggcggcggcgtcgaggtcaagctgcggctgcggcgcgccggccgtgaccatgacttcatcccctacgaggaggtgctcgacaccatgctccacgagctctgccacaaccagcgcgggccccacgatgcgcagttctacaaactctgggacgagctccgcaaggaatgcgaagaacttgtttcaaagggtatcactggaacaggacaagggtttgatggtacaggaaggcgagtaggtggatttacagtacatccaccaccaccatctctgcggcaagctacgttagctgctgcacagaagcgggcaaggaacggagctctattgccttctggaccaagaaagttggggggaaacagtgaaattatgagtgcacttagtccagtacaagctgctgcaatggctgctgaaaggagaatgtatgatgatttgtggtgtggatcgcatgatcaatctggtattgatgattcagatgatgttattattcttcaagaaccgccaaatttggtgacaagggatggaaaacacacgaaggctagctgctccaacacttttgcagagcccagcacttcttctggaattcacatagcagcacgagatgataggacaagtgatgcacttgatagttcaaagtgggaatgtggtgcttgcactcttcttaaccagcccctggcaccaatctgtgaagtttgtggtacagcaaaacctaaaattgcaaaggcaaagtacatgacttggtcttgtaaattttgtactctagagaacagcactaagcttgacaaatgctcggcatgcgatcaatggagatactcatatgggccacctgtagccacacatggcccaagctatgattga

SEQ ID NO: 2620 - protein, 347 aa, Sorghum bicolor
  misc_feature: Ceres ANNOT ID no. 6025387
  misc_feature (7)..(204): Pfam Id: WLM Pfam Desc: WLM domain
  misc_feature (270)..(300): Pfam Id: zf-RanBP Pfam Desc: Zn-finger in Ran binding protein and others
  misc_feature (5)..(328): NCBI GI: 8778309 NCBI Desc: f14j16.17 [arabidopsis thaliana]
  misc_feature (11)..(166): NCBI GI: 44984511 NCBI Desc: afr042cp [eremothecium gossypii]
  misc_feature (11)..(166): NCBI GI: 45198560 NCBI Desc: afr042cp [eremothecium gossypii]
  misc_feature (36)..(189): NCBI GI: 9957265 NCBI Desc: orf556 [trypanosoma brucei]
  misc_feature (35)..(126): NCBI GI: 3790252 NCBI Desc: spcc1442.07c [schizosaccharomyces pombe]
MEVGDLHKVWEVRALKTKPDAAAARATLDRVARQVQPIMRRHKWRVKVLSEFSPRNPRLLGLNVGGGVEVKLRLRRAGRDHDFIPYEEVLDTMLHELCHNQRGPHDAQFYKLWDELRKECEELVSKGITGTGQGFDGTGRRVGGFTVHPPPPSLRQATLAAAQKRARNGALLPSGPRKLGGNSEIMSALSPVQAAAMAAERRMYDDLWCGSHDQSGIDDSDDVIILQEPPNLVTRDGKHTKASCSNTFAEPSTSSGIHIAARDDRTSDALDSSKWECGACTLLNQPLAPICEVCGTAKPKIAKAKYMTWSCKFCTLENSTKLDKCSACDQWRYSYGPPVATHGPSYD

SEQ ID NO: 2621 - DNA, 627 bp, Sorghum bicolor
  misc_feature: Ceres ANNOT ID no. 6025388
  misc_feature: Encodes the peptide sequence at SEQ ID NO 2622
atggtgtccttgaagctccagaagcggctggcagcgagtgtgctcaagtgcgggaaaggcaaagtatggctcgatccgaacgaggtctccgagatctccatggcaaactcccgccagaatatccgaaagctggtgaaggatggcttcatcataaagaagccacagaagattcactcaaggtcccgcgcaaggagggcccatgaggccaagcagaagggcaggcactcaggatatggcaagcgccgcggtacccgggaggctaggctccccaccaagatcctttggatgcgcaggatgcgtgttctcaggcgcctgctgcggaagtacagggaggcgaaaaagatcgacaagcacatgtaccatgcaatgtacatgaaagtgaaaggtaacatgtttaagaacaagagagtgctcatggagagcatccacaagactaaggctgagaagaccagagagaagactctctctgatcagttcgaggctaagcgggcaaagagcaaggcctctcgtgaaaggaaaattgcgaggagggaggagaggttagcacagggcccaagggaacccacggcagcaccagcagcagctcctgccccagctgcagctgcaccaaagaaggcgaagaagtga

SEQ ID NO: 2622 - protein, 208 aa, Sorghum bicolor
  misc_feature: Ceres ANNOT ID no. 6025388
  misc_feature (2)..(149): Pfam Id: Ribosomal_L19e Pfam Desc: Ribosomal protein L19e
  misc_feature (1)..(185): NCBI GI: 32401377 NCBI Desc: ribosomal protein l19 [triticum aestivum]
  misc_feature (1)..(208): NCBI GI: 92878290 NCBI Desc: ribosomal protein l19e [medicago truncatula]
  misc_feature (1)..(202): NCBI GI: 40287526 NCBI Desc: 60s ribosomal protein l19 [capsicum annuum]
  misc_feature (1)..(203): NCBI GI: 83284003 NCBI Desc: 60s ribosomal protein l19-like protein [solanum tuberosum]
  misc_feature (1)..(187): NCBI GI: 47026900 NCBI Desc: ribosomal protein l19 [hyacinthus orientalis]
MVSLKLQKRLAASVLKCGKGKVWLDPNEVSEISMANSRQNIRKLVKDGFIIKKPQKIHSRSRARRAHEAKQKGRHSGYGKRRGTREARLPTKILWMRRMRVLRRLLRKYREAKKIDKHMYHAMYMKVKGNMFKNKRVLMESIHKTKAEKTREKTLSDQFEAKRAKSKASRERKIARREERLAQGPREPTAAPAAAPAPAAAAPKKAKK

SEQ ID NO: 2623 - DNA, 972 bp, Sorghum bicolor
  misc_feature: Ceres ANNOT ID no. 6025399
  misc_feature: Encodes the peptide sequence at SEQ ID NO 2624
atgggggcggaggccggcgagcccagctccatcctcagcttagctgctgccttttcctatggagtcgcatctatggcaatggttttcgtgaacaaagcagttcttatgcagtatgtccactccatgaccctcctcactttacagcaaatagcgacggcacttctgatacattttggtcaagttctagggatgtctaaaagaaaagacttcagcttggtaaccgcgaagaagcttcttccagtgtcaattttctacaatgcaaatgtgggatttgctctggcaagcttgaaaggggttaacatcccaatgtatattgcaatcaagaggatcactcctcttgctgtgctggtggctgggtgcatgaggggaaaggggaagccaccaacacaggtcattctttcagttatctgcactgccactggtgtcctcattgcagcacttggagatttttcctttgacctatatggatactgcatggctctaacatcagtcttcttccagactatgtatttgattctggtggagaaatcaggtgctgaggatggtctttcctcagtggacttaatgttttacaacagcatattgtcacttccatttctgtttttcctcattatagcaacaggagaattcccccattctcttacagtattatctgcaaaggcagactctctgacattcagtgttattcttgctatctcactggtgatgggaatcgttctcaatttcactatgttctggtgcacaattgtgaattctgctctgactacaacaatagtaggagttctcaagggtgtcggatctacgaccctcggtttcgttctgttgggaggtgtcgaagtgcacgccctgaatattactggactggtgatcaacacatttggcggtgtatggtactcttatgccaagtataagcagaaaaagaaaaccccacggaaaattcaacatgatgtagagtcgcatgcccacaagtag

SEQ ID NO: 2624 - protein, 323 aa, Sorghum bicolor
  misc_feature: Ceres ANNOT ID no. 6025399
  misc_feature (156)..(300): Pfam Id: TPT Pfam Desc: Triose-phosphate Transporter family
  misc_feature (21)..(306): Pfam Id: UAA Pfam Desc: UAA transporter family
  misc_feature (15)..(313): NCBI GI: 145346808 NCBI Desc: dmt family transporter: udp-glucuronic acid/udp-n-acetylgalactosamine [ostreococcus lucimarinus cce9901]
  misc_feature (11)..(315): NCBI GI: 14971008 NCBI Desc: udp-sugar transporter [drosophila melanogaster]
  misc_feature (11)..(315): NCBI GI: 125979525 NCBI Desc: ga17742-pa [drosophila pseudoobscura]
  misc_feature (11)..(315): NCBI GI: 17647441 NCBI Desc: cg3874-pa [drosophila melanogaster]
  misc_feature (1)..(307): NCBI GI: 108795331 NCBI Desc: solute carrier family 35 member d1 [sus scrofa]
  misc_feature: The sequence is a functional homolog of SEQ ID NO. 360 in the 11/188,298 US application
  misc_feature: The sequence is a functional homolog of SEQ ID NO. 484 in the 11/188,298 US application
MGAEAGEPSSILSLAAAFSYGVASMAMVFVNKAVLMQYVHSMTLLTLQQIATALLIHFGQVLGMSKRKDFSLVTAKKLLPVSIFYNANVGFALASLKGVNIPMYIAIKRITPLAVLVAGCMRGKGKPPTQVILSVICTATGVLIAALGDFSFDLYGYCMALTSVFFQTMYLILVEKSGAEDGLSSVDLMFYNSILSLPFLFFLIIATGEFPHSLTVLSAKADSLTFSVILAISLVMGIVLNFTMFWCTIVNSALTTTIVGVLKGVGSTTLGFVLLGGVEVHALNITGLVINTFGGVWYSYAKYKQKKKTPRKIQHDVESHAHK

SEQ ID NO: 2625 - DNA, 2043 bp, Sorghum bicolor
  misc_feature: Ceres ANNOT ID no. 6025402
  misc_feature: Encodes the peptide sequence at SEQ ID NO 2626
atgaggttcggctccgggagggtggaggacgagatggcgctcacgaggcagaggactgtgagattccatgatgagaggccaaaggcaaccatacccattcaccagaagcagcatgggctggctgttagcaggctcggtttgggaagttcagggaaaaacaaggtctttgtggcaggagatgacttgtggtacaacaagattattgacccgtcaagtgacttcatcttgatatggatatacgtcttccgtgtctcatgcttcattgctctgttcatggaccctctgtatttctatgtgcctgaaatcgattacaagcaaaccaatcattgtgtcaggaaggatacacgcctagccatcatcgttactgtattccgatcaattgtcgacctcttttatgtcatccagatgataattaagttcaggactgcataccttaatccaagctcaaacttaggggtctttggtcgaggagatctcatcacagatcctaaggaaatcgcaaagcagtacttgagatctgactttgcagttgatttggtggcttctttgcctttaccacagatcattgtttggtctgtgataccagctatcaaatattcttcgtctgagcatggcaatgacatgctgcttctggttgcccttttccagtatatcctaagattatacctcatcttttccttgaatgataaaatagtcaaaattactggagtttttgcaaagactgcttggcaaggagctgcatacaatctgctgttatacatgattgctagccatgttttaggagcgctgtggtaccttctatctgttgatcgccaggtcgcatgctggaaaagtttttgcaatgaaactgattgccacactcggtatctgtattgtgatgtaaaaccagattcaagttggaatgggaccgtagtcttttctagttgtgatgctaagaacactaccaaatttgactttggtatgttcgagccattgttatcaaacaaaactcctaatgagagcttcctgaagaagtatatctattgcctttggtggggcttgcagaatctaagttgctatggccagacattgagtgtgagcacctttattggtgagacactgtatgctatactcttggcagtggttggtctagtcttgtttgcgcatctgattggaaaagttcagacctacctgcaatcaatcaccgctagggttgaggagtggaggctaaaacagagagatactgaggagtggatgagacataggcaactgccccatgacctacgggaaagagtgagaagatttgttcattacaagtggctcgcaactcgaggtgtggacgaagaatctatattgaatgccctacctacagatctttgccgtgacatcaagcgacacctttgcctggatctcgttcgtagggtcccatttttctcccagatggacgatcaacttctagacgccatatgtgagcgtcttgtatcttccttgagcacagagggcacatatattgtccgtgaaggcgatccagtgactgagatgctgttcatcattcgtggtaaactggaaagctccaccacagatggtggacggacaggtttcttcaattcaatcaccctcaaacctggtgatttctgtggcgaagagctcctcggatgggctctcgttcccaagcctaccgtcaacctgccattatccacacggacagtgagggcgattgtcgaagttgaggcatttgctctccaagctgatgatctcaagttcgtcgccagccaattcaggcgcctccacagcaggaagctgcagcacacgttccgatactactctcaccactggaggacctgggccgcgtgcttcatccagcatgcttggcgccgccagaaaaggaggaagatggccaaggacctgagtatgagggagtcgttctcctccatgagatcattcgaaggcgacaactcccctgaacagaatcaagcacttaggagaggagccagcatcatcagagagctacctaagttcaggaaaccatcggagccggatttctcagcagagcatgatgactga

SEQ ID NO: 2626 - protein, 680 aa, Sorghum bicolor
  misc_feature: Ceres ANNOT ID no. 6025402
  misc_feature (124)..(387): Pfam Id: Ion_trans Pfam Desc: Ion transport protein
  misc_feature (488)..(588): Pfam Id: cNMP_binding Pfam Desc: Cyclic nucleotide-binding domain
  misc_feature (389)..(677): NCBI GI: 115449143 NCBI Desc: os02g0789100 [oryza sativa (japonica cultivar-group)]
  misc_feature (63)..(648): NCBI GI: 7269936 NCBI Desc: cyclic nucleotide and calmodulin-regulated ion channel-like protein [arabidopsis thaliana]
  misc_feature (114)..(633): NCBI GI: 91806544 NCBI Desc: cyclic nucleotide-regulated ion channel [arabidopsis thaliana]
  misc_feature (12)..(646): NCBI GI: 92887759 NCBI Desc: cyclic nucleotide-binding; ion transport protein [medicago truncatula]
  misc_feature (39)..(633): NCBI GI: 20197298 NCBI Desc: cyclic nucleotide and calmodulin-regulated ion channel [arabidopsis thaliana]
  misc_feature: The sequence is a functional homolog of SEQ ID NO. 503 in the 11/188,298 US application
MRFGSGRVEDEMALTRQRTVRFHDERPKATIPIHQKQHGLAVSRLGLGSSGKNKVFVAGDDLWYNKIIDPSSDFILIWIYVFRVSCFIALFMDPLYFYVPEIDYKQTNHCVRKDTRLAIIVTVFRSIVDLFYVIQMIIKFRTAYLNPSSNLGVFGRGDLITDPKEIAKQYLRSDFAVDLVASLPLPQIIVWSVIPAIKYSSSEHGNDMLLLVALFQYILRLYLIFSLNDKIVKITGVFAKTAWQGAAYNLLLYMIASHVLGALWYLLSVDRQVACWKSFCNETDCHTRYLYCDVKPDSSWNGTVVFSSCDAKNTTKFDFGMFEPLLSNKTPNESFLKKYIYCLWWGLQNLSCYGQTLSVSTFIGETLYAILLAVVGLVLFAHLIGKVQTYLQSITARVEEWRLKQRDTEEWMRHRQLPHDLRERVRRFVHYKWLATRGVDEESILNALPTDLCRDIKRHLCLDLVRRVPFFSQMDDQLLDAICERLVSSLSTEGTYIVREGDPVTEMLFIIRGKLESSTTDGGRTGFFNSITLKPGDFCGEELLGWALVPKPTVNLPLSTRTVRAIVEVEAFALQADDLKFVASQFRRLHSRKLQHTFRYYSHHWRTWAACFIQHAWRRQKRRKMAKDLSMRESFSSMRSFEGDNSPEQNQALRRGASIIRELPKFRKPSEPDFSAEHDD

SEQ ID NO: 2627 - DNA, 543 bp, Sorghum bicolor
  misc_feature: Ceres ANNOT ID no. 6025403
  misc_feature: Encodes the peptide sequence at SEQ ID NO 2628
atggcccgcttgtacgtcggcaacctggatccccgggtgaccgctcgggagctggaggacgagttccgcacgttcggggttcttcgcagtgtttgggtggctcggaaaccacctggctttgcatttattgattttgatgataagagggatgctgaggatgcaatccgtgacctagatggcaagaatggatggagagttgagctatctcgtaatgccagcagtggtcgtggtggccgtgaccgatatggtggttctgagtccaagtgttacgagtgtggtgagactggccactttgctcgtgagtgccgtttgaggattggttctggaggtctaggcagtggaaggcgccgaagccgtagccgcagccgcagccgcagtcgtagtcccagatatcgccggagtccaagttatggtagaaggagttacagtcctgcagcacgctctccaaggcgtcgtagcgtgtcaccagctcgtgggcgcagctatagcaggtcaccacagtacaaacgtgcacgagaagactctccctatgataatgggtaa

SEQ ID NO: 2628 - protein, 180 aa, Sorghum bicolor
  misc_feature: Ceres ANNOT ID no. 6025403
  misc_feature (4)..(70): Pfam Id: RRM_1 Pfam Desc: RNA recognition motif. (a.k.a. RRM, RBD, or RNP domain)
  misc_feature (87)..(104): Pfam Id: zf-CCHC Pfam Desc: Zinc knuckle
  misc_feature (1)..(166): NCBI GI: 68035449 NCBI Desc: pre-mrna processing factor [triticum aestivum]
  misc_feature (1)..(180): NCBI GI: 68035360 NCBI Desc: pre-mrna processing factor [triticum aestivum]
  misc_feature (1)..(180): NCBI GI: 2582645 NCBI Desc: rszp22 protein [arabidopsis thaliana]
  misc_feature (1)..(176): NCBI GI: 3435096 NCBI Desc: srz21 [arabidopsis thaliana]
  misc_feature (1)..(176): NCBI GI: 9369411 NCBI Desc: t23e23.2 [arabidopsis thaliana]
  misc_feature: The plant flowers significantly late compared to wild-type.
  misc_feature: Useful for making plants with modulated flowering time
  misc_feature: GREAT-hit functional homolog of the protein sequence given in SEQ ID NO 13547
  misc_feature: Useful for making plants with modulated flowering time
  misc_feature: Functional homolog of the protein sequence given in SEQ ID NO 13547
  misc_feature: The sequence is a functional homolog of SEQ ID NO. 339 in the 11/188,298 US application
  misc_feature: The sequence is a functional homolog of SEQ ID NO. 458 in the 11/188,298 US application
MARLYVGNLDPRVTARELEDEFRTFGVLRSVWVARKPPGFAFIDFDDKRDAEDAIRDLDGKNGWRVELSRNASSGRGGRDRYGGSESKCYECGETGHFARECRLRIGSGGLGSGRRRSRSRSRSRSRSPRYRRSPSYGRRSYSPAARSPRRRSVSPARGRSYSRSPQYKRAREDSPYDNG

SEQ ID NO: 2629 - DNA, 1341 bp, Sorghum bicolor
  misc_feature: Ceres ANNOT ID no. 6025407
  misc_feature: Encodes the peptide sequence at SEQ ID NO 2630
atggacgcttctcctgcaccgccgccgccggggtctccggccatcgagcggaagctgagcccgggggtgctgctcctcatcgcgatcctggccatggtcttcttcatcttcggcctgctcaacctgctggcgcagaacctgctgcgcctgcgtcgggcgcgccggcgccggcgccgggtcggggacgcggccgcggccacggcgcccgacggcagcagccccacggcgttccagggcgagctccggcagctgttccacctccacgacgcgggcgtcgaccagtccttcatcgacgcgctgcccgtcttcccctaccgcgccgtcgccgtggtccgccgcgcccgcgccgccgccaaggacggcgacgacggcgagccgttcgactgcgccgtgtgcctctgcgagttcgcggacgacgacaagctccggctgctcccgacgtgcggccacgcgttccacgtgccctgcatcgacgcctggctgctctcgcactccacgtgcccgctctgccgcggcagcatcctcgccgccgaggccgactactcctactccagcccgtccccgtcgtcggcgtcgtccttgctcctgctccaccaccactcgtatggcctcgccgagacgacggccaccggagacggcggtgattgtgatccgggagccggagacggcggcgacgagtcaaacaaggacgacgcggtggaggagatcgtggaggtgaagctcggcaagctcaggtgcgtcgacggcggcaatgccagtgccagggacctcgcgcccgacggcacaggtagcagcggtggcaatggcaggggaagcctcgggcagaggcggtgcctgtccatgggatcctacgagtacgtcatggacgaccacgccgcgctccgcgtcaccatcaaggcgacccccaagaggaggcccgcgagctcgagatcgtcgtcgcgccgccgccacgcgctgtcggcgtgcgatctcggatgccccaagaaggcgggcgcgtgggagacggccgtcacggaggccgccgccgcgagcctgagcagggacagcttctccacgtccaagatctggatggcgtcggtcgccaggagagaggaggacggtcgccgccccggccccgcgtgggagatggcccctgccggggagagacgcgcggcgtcgttccggtggccggcgatagcctcaggctgcaagaggtaccgccgggacgaggagccttgcgacgtcgaggcaggtggctccggggacagtgccgtctcgtctttagaagaagagaggccgccgtcggtggctagagcggcaatgctctgggtcgccggcgggaggcagggaagccattcgtga

SEQ ID NO: 2630 - protein, 446 aa, Sorghum bicolor
  misc_feature: Ceres ANNOT ID no. 6025407
  misc_feature (129)..(170): Pfam Id: zf-C3HC4 Pfam Desc: Zinc finger, C3HC4 type (RING finger)
  misc_feature (5)..(186): NCBI GI: 68565290 NCBI Desc: ring-h2 finger protein atl5i
  misc_feature (17)..(183): NCBI GI: 9369405 NCBI Desc: t23e23.15 [arabidopsis thaliana]
  misc_feature (1)..(210): NCBI GI: 49389042 NCBI Desc: ring finger 1 [oryza sativa (japonica cultivar-group)]
  misc_feature (75)..(267): NCBI GI: 18417587 NCBI Desc: zinc finger (c3hc4-type ring finger) family protein [arabidopsis thaliana]
  misc_feature (75)..(267): NCBI GI: 21655299 NCBI Desc: at4g30400/f17i23_260 [arabidopsis thaliana]
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
MDASPAPPPPGSPAIERKLSPGVLLLIAILAMVFFIFGLLNLLAQNLLRLRRARRRRRRVGDAAAATAPDGSSPTAFQGELRQLFHLHDAGVDQSFIDALPVFPYRAVAVVRRARAAAKDGDDGEPFDCAVCLCEFADDDKLRLLPTCGHAFHVPCIDAWLLSHSTCPLCRGSILAAEADYSYSSPSPSSASSLLLLHHHSYGLAETTATGDGGDCDPGAGDGGDESNKDDAVEEIVEVKLGKLRCVDGGNASARDLAPDGTGSSGGNGRGSLGQRRCLSMGSYEYVMDDHAALRVTIKATPKRRPASSRSSSRRRHALSACDLGCPKKAGAWETAVTEAAAASLSRDSFSTSKIWMASVARREEDGRRPGPAWEMAPAGERRAASFRWPAIASGCKRYRRDEEPCDVEAGGSGDSAVSSLEEERPPSVARAAMLWVAGGRQGSHS

SEQ ID NO: 2631 - DNA, 2433 bp, Sorghum bicolor
  misc_feature: Ceres ANNOT ID no. 6025411
  misc_feature: Encodes the peptide sequence at SEQ ID NO 2632
atggatctcgccgccaccccctccaggtcaaaatccaagcccagatcctcgccggcgaagcccgccgccgctgccgctaagtccaggatggacctctgcaccccgtccaagcctacgcccaggcggaagtccaaatcgacagcctcgccggcgccgatgtctccggcgacgccatccaccatccggcgctcgcgccgcctcctcgaaacccccaccaaagcagccctggaggttcaggtgaaggctacgccgacccctacctccaaggccaagcgcgccgcgccgtcacctaaaacccctgctcagcgcgagcccaagaggcagaagcgacacccgagaaagagggcatactaccggaaggtggtgtacgacggcggagagttcgaggtcggtgatgacgtgtacgtgaagcggcgggaggcggcggagtctgacggggaggaccctgaggtggaggagtgccgcgtatgcttccgcaccggtggcggggttatggtggagtgcgacgcgtgcctcggcggattccacctccgttgcgtgcgaccgccgcttcggagggtgcctgaaggtgactgggcgtgtccgtactgcgaggccgagcgcgccggaaagttggtcgagcggcccaggccgcctgaggggaagcgcatcgtgaggacctccaaggagaaactcctttccggtgatctgtgggctgcacgcatcgagagtttatggagggagcctgatggcacgttttgggcaaagatcaggtggtacattatccccgaagagactgcagcaggaaggcagccgcataatttgagaagagagctgtatcgtaccaatgatcttggagacattgagatggaaacaatccttagacattgttctgtaatgagccccaaagactttagggatgctaatgatggaggagatgatgtattttattgtgaatatgagtatgatatacattggcataattttaagcgtcttgcagatattgatgatgagctggagacaaaggaagatcccaacgacgagccttacaatgccggagatgattataacagtgacagtgatgaagattcagagtatgatgaggaggaagaacctacgtcatctttctctgccagaaggaatcaatcacatgaattggcagcgaattcaaggaaaggtagaatatatggcctacaaaaaattgggataagaaaaattcctgagcatgttcggtgccaccaaaagactgagctggagaaggcaaaagcaaccctgttattggcaactcttcctaagtcattgccttgcagggataaagaaatggaggagatatctatatttgtaaaggatgcaatctgcaatgaccaatgcctgggacgctgcctttatatacatggtgtacccggtactggcaagactatgagtgtacttgccgttatgaggaggctgagatctgaatttgattctggaactctgaggccatactgttttattgaaattaatggtcttaaattagcatctccagagaatatctacaaggttgtatatgaacagttgagtgggcatagggttgggtggaaaaaggctcttcactatttaacagaacatttttcaggtggcactaaaattggaaagcaggcaaaccagccaattattttgctcattgatgagcttgatcttcttttgacacgaaaccaatcggtgctgtataacattcttgattggcccaccaaaccaaattcaaatctagttgttataggtatagcaaacactatggatcttccagaaaagttattgcctcgtatatcaagtcggatgggtatccaacgactgtgtttcggtccatacaattataggcaactgcaggaaattataacaagccgtctaaagggtattgatgcctttgaggaacaggctattgaatttgcttctagaaaggtagctgctatgtcaggtgatgctaggcgagctttagagatttgtagacgggcagcagagtttgcagattaccgtgttaaacaatctcgacagtctgcacagagtactgtttctgcaaataaaggtgacggtgttgtttccatgggtgacatagaagctgcaattcaggaagtcttccaggcaccacatattcaagtgatgaagaattgcccaaagtttggaaaagttatattggttgccttagttcatgagctgtacaaaagtggactaggtgaaataatgtttgataagttagcaacaacagttttctcctggtgccttgccaacagagaagtagtgcctggttacgacacacttgtgaaaatttgctgcaagcttggtgaaagtaagatcatcctctgtgaagagggtagtaagcacaagttgcagaagctgcagcttaactatccaagtgacgatgtgacatttgccctcaaggaatccacagatcttccttggatatccaagtacttgtga

SEQ ID NO: 2632 - protein, 810 aa, Sorghum bicolor
  misc_feature: Ceres ANNOT ID no. 6025411
  misc_feature (126)..(326): Pfam Id: BAH Pfam Desc: BAH domain
  misc_feature (454)..(663): Pfam Id: AAA Pfam Desc: ATPase family associated with various cellular activities(AAA)
  misc_feature (153)..(200): Pfam Id: PHD Pfam Desc: PHD-finger
  misc_feature (1)..(810): NCBI GI: 15866773 NCBI Desc: origin recognition complex subunit 1 [zea mays]
  misc_feature (1)..(810): NCBI GI: 115466830 NCBI Desc: os06g0187000 [oryza sativa (japonica cultivar-group)]
  misc_feature (1)..(810): NCBI GI: 20269233 NCBI Desc: origin recognition complex 1 [oryza sativa (japonica cultivar-group)]
  misc_feature (3)..(809): NCBI GI: 14582312 NCBI Desc: origin recognition complex 1 [arabidopsis thaliana]
  misc_feature (257)..(810): NCBI GI: 7268176 NCBI Desc: replication control protein 1 like [arabidopsis thaliana]
MDLAATPSRSKSKPRSSPAKPAAAAAKSRMDLCTPSKPTPRRKSKSTASPAPMSPATPSTIRRSRRLLETPTKAALEVQVKATPTPTSKAKRAAPSPKTPAQREPKRQKRHPRKRAYYRKVVYDGGEFEVGDDVYVKRREAAESDGEDPEVEECRVCFRTGGGVMVECDACLGGFHLRCVRPPLRRVPEGDWACPYCEAERAGKLVERPRPPEGKRIVRTSKEKLLSGDLWAARIESLWREPDGTFWAKIRWYIIPEETAAGRQPHNLRRELYRTNDLGDIEMETILRHCSVMSPKDFRDANDGGDDVFYCEYEYDIHWHNFKRLADIDDELETKEDPNDEPYNAGDDYNSDSDEDSEYDEEEEPTSSFSARRNQSHELAANSRKGRIYGLQKIGIRKIPEHVRCHQKTELEKAKATLLLATLPKSLPCRDKEMEEISIFVKDAICNDQCLGRCLYIHGVPGTGKTMSVLAVMRRLRSEFDSGTLRPYCFIEINGLKLASPENIYKVVYEQLSGHRVGWKKALHYLTEHFSGGTKIGKQANQPIILLIDELDLLLTRNQSVLYNILDWPTKPNSNLVVIGIANTMDLPEKLLPRISSRMGIQRLCFGPYNYRQLQEIITSRLKGIDAFEEQAIEFASRKVAAMSGDARRALEICRRAAEFADYRVKQSRQSAQSTVSANKGDGVVSMGDIEAAIQEVFQAPHIQVMKNCPKFGKVILVALVHELYKSGLGEIMFDKLATTVFSWCLANREVVPGYDTLVKICCKLGESKIILCEEGSKHKLQKLQLNYPSDDVTFALKESTDLPWISKYL

SEQ ID NO: 2633 - DNA, 1632 bp, Sorghum bicolor
  misc_feature: Ceres ANNOT ID no. 6025412
  misc_feature: Encodes the peptide sequence at SEQ ID NO 2634
atgtcgccgcagccggcccccgacgacctcgccgaggacaaggagagggagaccaatgtcctcatcgaggcggcggccccggggccaccagcgaaggcggccgaggacggcgacggccacggcaggcccgcgccgtcgccggtggcgtggttccggatgctggccagggagctgcactggagcttcgtcttcggcgtggtggccacgtacggcatcagccagggcctcggcggcggcatcacgcgcgtcgcgtccgactactactggaaggacgtgcagcgggtgcagccgtccgtggcgcaggtgtaccagggcgtcacctccatcccctggatggtcaagccgctctggggcctgctcaccgacgtgctccccgtcgccggataccgccgccggccctactttattcttgcaggcttcatcggagtgattgcaatgcttatactcgctctccacagcaagcttcatgcattgttcgctctgttggcattgatgactggaagtgctagtgtggcgatagctgatgttactatagatgcttgcgtggcggaaaacagtatagtgtaccctcatcttgctgctgacatgataagcttaaatggattctgttcttctgttggaggtcttattggattctcaataagtggttttcttgttcatgcaataggggctcaaggtgcccttggactgttaaccataccctctgccttagtgattttatccggagcactgctgaaggaggttcatatccccaactttccatacgagcaggcccacaagaagtttgtagaagcaagtggaaaaatgttaacagctttgaaatgccctgaagtatggcgaccatgtgtttacatgtacgtatcacttgcgttgagtgtcgacatccaagaaggaatgttcttctggtacacggaccgaagcgcagggttatcttttcatgagggatttattggctttatgttcgctattggatcagttggttctcttgtgggtgttatactttatcaaaacattcttaaggaccattcatttcgcagccttcttttttcgagccagctgttgctaagcttggcaggaatgcttgatctgatcttggtgctccgactaaaccttaaaatggggataccagattactactttgcggtgatcgatgagggggtctccaaaatgatcaaccgtatcaaatggatgcctcttctggtacttagctcaaagctttgccccactggcattgaaggcacattctacgcattgctcatgtctatcgacaacattggctccttaactggatcatgggttggtgggttgctccttcatttgttgagaatcacaagaacagaattcaagaacctctgggccgcgatcttaattcgaaatattatgagactgctaccactggcgctgctgttcttggtcccaagaagtgatccgaattccactcttcttccatccgatttgctgaatgaggcagatgacgatgaagctcagcgagtagagaatgtcgagttaacctccctccctgcaaacagagattcttgcaatgataaatctctccatgactgtgagaaccgcgagggccttgacggagaacgagacgacgacgaagcttcacttcttgccaacaggagttga

SEQ ID NO: 2634 - protein, 543 aa, Sorghum bicolor
  misc_feature: Ceres ANNOT ID no. 6025412
  misc_feature (74)..(486): Pfam Id: BT1 Pfam Desc: BT1 family
  misc_feature (1)..(543): NCBI GI: 55773865 NCBI Desc: integral membrane transporter-like protein [oryza sativa (japonica cultivar-group)]
  misc_feature (41)..(514): NCBI GI: 70663896 NCBI Desc: osjnba0029h02.8 [oryza sativa (japonica cultivar-group)]
  misc_feature (47)..(506): NCBI GI: 92897812 NCBI Desc: biopterin transport-related protein bt1; major facilitator superfamily mfs_1 [medicago truncatula]
  misc_feature (47)..(506): NCBI GI: 15238691 NCBI Desc: integral membrane transporter family protein [arabidopsis thaliana]
  misc_feature (34)..(534): NCBI GI: 50726132 NCBI Desc: integral membrane transporter-like protein [oryza sativa (japonica cultivar-group)]
MSPQPAPDDLAEDKERETNVLIEAAAPGPPAKAAEDGDGHGRPAPSPVAWFRMLARELHWSFVFGVVATYGISQGLGGGITRVASDYYWKDVQRVQPSVAQVYQGVTSIPWMVKPLWGLLTDVLPVAGYRRRPYFILAGFIGVIAMLILALHSKLHALFALLALMTGSASVAIADVTIDACVAENSIVYPHLAADMISLNGFCSSVGGLIGFSISGFLVHAIGAQGALGLLTIPSALVILSGALLKEVHIPNFPYEQAHKKFVEASGKMLTALKCPEVWRPCVYMYVSLALSVDIQEGMFFWYTDRSAGLSFHEGFIGFMFAIGSVGSLVGVILYQNILKDHSFRSLLFSSQLLLSLAGMLDLILVLRLNLKMGIPDYYFAVIDEGVSKMINRIKWMPLLVLSSKLCPTGIEGTFYALLMSIDNIGSLTGSWVGGLLLHLLRITRTEFKNLWAAILIRNIMRLLPLALLFLVPRSDPNSTLLPSDLLNEADDDEAQRVENVELTSLPANRDSCNDKSLHDCENREGLDGERDDDEASLLANRS

SEQ ID NO: 2635 - DNA, 699 bp, Sorghum bicolor
  misc_feature: Ceres ANNOT ID no. 6025423
  misc_feature: Encodes the peptide sequence at SEQ ID NO 2636
atggctcccgcgttcactagcctcctccccgccgcgacctccgccgccgccgcgaccgcctcgcggctcccctctgccgccgccggagcggcatccaccttcgcgcgtctcccgcatcacccgacgggctgggctggggcctccgtcgcggcgccgcgtacggcggcggcgcgcaggcgggcgcccggcgtcgcctacgccaccgccgccaccgacaagagcatctacgactacaccgttaaggacattgatggaaaagatgttcctcttaaaaagttcaagaataaggtgttgctgattgttaacgttgcttctcaatgtgggttgacaacagcaaattacactgaactatcccatatctatgagaagtacaagactcaagggtttgagattctggcatttccttgcaatcaatttggtgcacaagaacctggatcaaatactcagattaagcagtttgcatgtacaagattcaaagctgaatttcctatttttgacaaggttgatgtcaatggacctaatacagcccccatctataaatttctgaagtccagtgctggaggatttttaggtgatctagtcaagtggaattttgagaagttcttagtggacaagaatggcaaagttattgagagatatccaccaacaacttcaccattccagattgagaaggacatccagaaactccttgcggcataa

SEQ ID NO: 2636 - protein, 232 aa, Sorghum bicolor
  misc_feature: Ceres ANNOT ID no. 6025423
  misc_feature (75)..(183): Pfam Id: GSHPx Pfam Desc: Glutathione peroxidase
  misc_feature (6)..(223): NCBI GI: 115466814 NCBI Desc: os06g0185900 [oryza sativa (japonica cultivar-group)]
  misc_feature (7)..(232): NCBI GI: 2982362 NCBI Desc: glutathione peroxidase [zantedeschia aethiopica]
  misc_feature (5)..(231): NCBI GI: 1061036 NCBI Desc: glutathione peroxidase [arabidopsis thaliana]
  misc_feature (1)..(232): NCBI GI: 92897807 NCBI Desc: glutathione peroxidase [medicago truncatula]
  misc_feature (5)..(230): NCBI GI: 116174033 NCBI Desc: glutathione peroxidase [medicago sativa]
  misc_feature (5)..(232): SWISSPROT Homolog: EC 1.11.1.12 Phospholipid hydroperoxide glutathione peroxidase 1, chloroplast precursor
  misc_feature (73)..(230): SWISSPROT Homolog: EC 1.11.1.9 Glutathione peroxidase 1
  misc_feature (78)..(230): SWISSPROT Homolog: EC 1.11.1.15 Peroxiredoxin HYR1
  misc_feature: Useful for making plants with modulated nitrogen use efficiency
  misc_feature: Functional homolog of the protein sequence given in SEQ ID NO 13071
  misc_feature: Useful for making plants with modulated flowering time
  misc_feature: Functional homolog of the protein sequence given in SEQ ID NO 12921
MAPAFTSLLPAATSAAAATASRLPSAAAGAASTFARLPHHPTGWAGASVAAPRTAAARRRAPGVAYATAATDKSIYDYTVKDIDGKDVPLKKFKNKVLLIVNVASQCGLTTANYTELSHIYEKYKTQGFEILAFPCNQFGAQEPGSNTQIKQFACTRFKAEFPIFDKVDVNGPNTAPIYKFLKSSAGGFLGDLVKWNFEKFLVDKNGKVIERYPPTTSPFQIEKDIQKLLAA

SEQ ID NO: 2637 - DNA, 2052 bp, Sorghum bicolor
  misc_feature: Ceres ANNOT ID no. 6025425
  misc_feature: Encodes the peptide sequence at SEQ ID NO 2638
atgcataacccagcccacgtactgtttgcctctgccgccgacgccgccgcgctctgcgtccaaaacctggcgcgtgcactctccgccggcgatctcctacgtctcctcccttcatgcggcaccctcccctccctccgcgtcctccacgcgcgcctcctcacacacacccagggcctcctccttggcagcctccgcgcaaggaccaagctgctcagctgctatgcggcactgggcgacctcgcctccgcgcggatggtgttcgacggcaccccacgcccggacgcgtactcctacggggtcatgctctggtgtctggtccaagcggagcgccacgcagaagctgtcgcgctgcaccaggacatgaggcggcggcgcccctgccccgaggcgcaggacgacttcgtgctgtcgctcgcgctcaaggcctgtatcaggtccgcggattacgggtacggtacgaggctgcactgcgacgccgtcaaagtcggcggcgcggacggtttcgtgatgaacagcttggttgacatgtacgcgaaagctggggacttggaatgcgcccggaaggtgtttgagagaattcccggacgaaatgtggtgtcgtggacctcgatgctcagcgggtgcgttcagaatggttttgctgcagatggactccttctgttcaacaagatgaggcaggacaatgtgcctcccagtgagtacaccatagcaactgttatcacagcttgttctgcactcattggtctgcaccaagggaggtggatgcatggatcagtgatcaaacaaggcttaatgtctaactcatttatcagtgcagccttgctggatatgtatgtcaagtgtggggagctagaggatgctcagtgtgtgtttgatgagctcagctacattgaccttgttctttggacgacgatgattgtggggtacacacagaatgggaaccctcttgatgcattacggctgtttcttgacaagaagtttgcaaacattgttccgaattcagttaccatagcaacagttctttcagcttctgctcaattacgtgacttgtctctaggaaggtctattcatgggatagctgttaagttaggtctggttgagtatactgtggtggtgaatgcgttagttgacatgtacgcgaagtgtcaagctgtgtcagaggccaatagaatatttggaagcatttcaaacaaggatgttgttgcatggaattcaatgttatcaggttatgctgagaataacatgtgcaatgatgctctgatgctcttcaaacaaatgagtctgaagggcccttcacctgatgccatctctgtggtgcatgccctgtcagcttctgtttgtctgggtgatctacttattggtaaatccttccatggttatgctgttaagcatgcatttctgtccaatatttatgtcagcactgctctgctgaatctgtacaacaagtgtggcgatctcccatctgctcgtagggtgttcgatgagatgaatgaccgtaattctgtgacttggtgtgctatgattggtggttatggaatgcaaggcgattctgcaggttccattgatcttttcggtgaaatgctgaaagatggtgtccacccaaatgatgtagcattcacaagcatcttatccacttgcagccatactgggatggttactgcagcgaaaaggtattttgatagcatggcacaacatttcaacatcacaccttccatgaaacattacgcttgtatggtcgatgtgctagcccgtgcaggaaatctagaggaggcattggagtttatagataatatgccaatgcaagcagacactagtgtctggggagcgtttctccatggatgtgagctccactcaaggttacagtttggagaagaagctatcaagaggatgatggtgcttcatcctgaaagaccagatttatatgtgctgatatcaaacctgtatacctcaaatggaatgtgggaaaaatctcaagctatccggagatggatgcaggagaaaggactagtcaagttacctgggtacagctccattggtcgtgaaaatggatga

SEQ ID NO: 2638 - protein, 683 aa, Sorghum bicolor
  misc_feature: Ceres ANNOT ID no. 6025425
  misc_feature (199)..(233): Pfam Id: PPR Pfam Desc: PPR repeat
  misc_feature (300)..(334): Pfam Id: PPR Pfam Desc: PPR repeat
  misc_feature (401)..(435): Pfam Id: PPR Pfam Desc: PPR repeat
  misc_feature (502)..(536): Pfam Id: PPR Pfam Desc: PPR repeat
  misc_feature (35)..(682): NCBI GI: 15220337 NCBI Desc: pentatricopeptide (ppr) repeat-containing protein [arabidopsis thaliana]
  misc_feature (31)..(678): NCBI GI: 124360536 NCBI Desc: tetratricopeptide-like helical [medicago truncatula]
  misc_feature (70)..(678): NCBI GI: 53791352 NCBI Desc: pentatricopeptide (ppr) repeat-containing protein-like [oryza sativa (japonica cultivar-group)]
  misc_feature (70)..(676): NCBI GI: 47848643 NCBI Desc: pentatricopeptide (ppr) repeat-containing protein-like [oryza sativa (japonica cultivar-group)]
  misc_feature (9)..(682): NCBI GI: 18418348 NCBI Desc: pentatricopeptide (ppr) repeat-containing protein [arabidopsis thaliana]
MHNPAHVLFASAADAAALCVQNLARALSAGDLLRLLPSCGTLPSLRVLHARLLTHTQGLLLGSLRARTKLLSCYAALGDLASARMVFDGTPRPDAYSYGVMLWCLVQAERHAEAVALHQDMRRRRPCPEAQDDFVLSLALKACIRSADYGYGTRLHCDAVKVGGADGFVMNSLVDMYAKAGDLECARKVFERIPGRNVVSWTSMLSGCVQNGFAADGLLLFNKMRQDNVPPSEYTIATVITACSALIGLHQGRWMHGSVIKQGLMSNSFISAALLDMYVKCGELEDAQCVFDELSYIDLVLWTTMIVGYTQNGNPLDALRLFLDKKFANIVPNSVTIATVLSASAQLRDLSLGRSIHGIAVKLGLVEYTVVVNALVDMYAKCQAVSEANRIFGSISNKDVVAWNSMLSGYAENNMCNDALMLFKQMSLKGPSPDAISVVHALSASVCLGDLLIGKSFHGYAVKHAFLSNIYVSTALLNLYNKCGDLPSARRVFDEMNDRNSVTWCAMIGGYGMQGDSAGSIDLFGEMLKDGVHPNDVAFTSILSTCSHTGMVTAAKRYFDSMAQHFNITPSMKHYACMVDVLARAGNLEEALEFIDNMPMQADTSVWGAFLHGCELHSRLQFGEEAIKRMMVLHPERPDLYVLISNLYTSNGMWEKSQAIRRWMQEKGLVKLPGYSSIGRENG

SEQ ID NO: 2639 - DNA, 2640 bp, Sorghum bicolor
  misc_feature: Ceres ANNOT ID no. 6025450
  misc_feature: Encodes the peptide sequence at SEQ ID NO 2640
atggagacgctgaaccctgacgccgctggtaaggcgggggccggggcggcggttgggagcagcgagggggaggcgacgaggtcggagaaggcggacgccggcgggattgatccggagctcagcgtcgccaggatctacctagggagaattggtgctggtttggaaaatcttgggaatacctgctacctcaactcagttctgcaatgcttgacgtacacggagccgttcgcagcctatctgcagagcgggaagcacaagtcctcatgtcgcgcatctggattttgcgcattatgtgctcttcagaaccatgtcaagactgctctagaatcaactggaaaaatagtgacaccatttcgtattgtcaagaacttgcgctgcatttctcgcactttccgcaattcaagacaagaagatgcacatgagttaatggttaatttgcttgaatccatgcataaatgctgtttaccttctggggtaccgagtgagtctcaaagtgcttatgacaaaagcttagttcacaaaatatttggtggtcgccttagaagtcaggtcaaatgcacgcgttgctcacattgctccaataaatttgatcctttcttggacctcagtcttgatattgccaaggccaccactttagtgcgggcacttgaaaattttactgaggatgagctactagacgggggtcaaaagcaataccagtgtgaacgctgcaggcagaaagttgtagcaaagaaacggtttaccattgataaggcacccaatgtcttgacaattcatctgaagcgcttcagccctttcaatcctcgtgagaagattgacaaaaaagtggacttccaaccaagtctcgatttgaaaccatttgttagtgactctaaaggtacagattttaaatacagcctttatggtgtcctagtccatacaggttggaacactcaatcaggtcattactattgcttcgttcgtacatccagcgggatgtggcacaatcttgatgataacaaggtgcgccaagttcgtgaggcagacgtattgaagcaaaaggcttatatgttattttatgtacgtaacagtattggaaagtcagtggcccacaaagagaacatcactgctaatttgcccatgaagaaaacccctgaaaagatctcaagtctgaatggtattacccaaagcagcgtaaaagcacaaaatttgaatggtgtgtctcggtttggcgataaggcgcacaacacaatcattggctactctacaattttcagcaagactacaacaggccattgttcaaagaatgaggtcaaagctgaagatgctccagcctctcaaaacaatgccctgccttccagacaagcccctggaactcaaaatgatggtggtaccttgcgaactaaaccgatgcagtttgatgtaaatagtcaggagacagcttcctcccaccaacctgcaccatttacaaatacttgtggtgaacaaacagttgttgggaagccctcgcaggagatggaacctaaggctggtgcggggaaagatacttctgttgtctctgccattgctaatggtgccgctacattgtccaaggcagacaaactgacttctcagcctcaaacaactccattttccgaggtagctccccatgtaaatggcacagctgcagagtttgctgcacggtctttatcaaagaaggattctgttgtttcaaatggtgttgtgcctggcattggatgtctcacttccagtgagaaagcaaggaactttccagaatctgtggatcaagctaatgaaatctcgaaggcacttcctatgagtcagaacaatattgcgccagtaattgctcaagcagactgtggagtagagatcagctctggtggtattatgcaggttgctgtggctgcttcatgcaatggaactacagcgaaaaaggtgaatgtgaagtcgtcgaagaagcttgtgaggtaccctgttgtgaacatgtggttagggtccagacaactgttgttcacttcgcgaaagccagggaagaaagcgaaacataagagaagtagaactgtaagacgtgttgtaggttgcaaggacgcagcaaatgtatcttgtttgaatgagcagctgacatcaacatcggccactgcacgctctgaaactgtagaatgtacctccagccgtcagaaacgatcacatgctagtgcaaggtccaaagatgacacccagtcctccaaaaacaagcagaaggttgatggagctagtgttggtgctggcacaagtgcaccttctagcagtgctgacattccaaagtctgatccaagctcttccataggtgctaagttggtagcagcccagcctgtcagtattcgtgcaacggacctgatggaagctactgttccgtgctgggatgatgtagacgtgccaaatacaaaggttgctgcgggccaacactccaaacgcaagagcattggttacatcttagatgagtgggacgaggagtacgacaaagggaagacaaagaaagtacggaaatcaaagcaagactttggcgggccgaaccccttccaggaggaggcagactacatatcagagcggaggatgaaacagaaatcctaccagggcaagtcttggaacaagcctaacactatagaggagttgagaatatga

SEQ ID NO: 2640 - protein, 879 aa, Sorghum bicolor
  misc_feature: Ceres ANNOT ID no. 6025450
  misc_feature (49)..(353): Pfam Id: UCH Pfam Desc: Ubiquitin carboxyl-terminal hydrolase
  misc_feature (1)..(497): NCBI GI: 11993486 NCBI Desc: ubiquitin-specific protease 23 [arabidopsis thaliana]
  misc_feature (49)..(541): NCBI GI: 123237380 NCBI Desc: novel protein [mus musculus]
  misc_feature (49)..(582): NCBI GI: 7959165 NCBI Desc: kiaa1453 protein [homo sapiens]
  misc_feature (49)..(606): NCBI GI: 119609939 NCBI Desc: ubiquitin specific peptidase 36, isoform cra_a [homo sapiens]
  misc_feature (49)..(356): NCBI GI: 34785787 NCBI Desc: wu:fi15g04 protein [danio rerio]
METLNPDAAGKAGAGAAVGSSEGEATRSEKADAGGIDPELSVARIYLGRIGAGLENLGNTCYLNSVLQCLTYTEPFAAYLQSGKHKSSCRASGFCALCALQNHVKTALESTGKIVTPFRIVKNLRCISRTFRNSRQEDAHELMVNLLESMHKCCLPSGVPSESQSAYDKSLVHKIFGGRLRSQVKCTRCSHCSNKFDPFLDLSLDIAKATTLVRALENFTEDELLDGGQKQYQCERCRQKVVAKKRFTIDKAPNVLTIHLKRFSPFNPREKIDKKVDFQPSLDLKPFVSDSKGTDFKYSLYGVLVHTGWNTQSGHYYCFVRTSSGMWHNLDDNKVRQVREADVLKQKAYMLFYVRNSIGKSVAHKENITANLPMKKTPEKISSLNGITQSSVKAQNLNGVSRFGDKAHNTIIGYSTIFSKTTTGHCSKNEVKAEDAPASQNNALPSRQAPGTQNDGGTLRTKPMQFDVNSQETASSHQPAPFTNTCGEQTVVGKPSQEMEPKAGAGKDTSVVSAIANGAATLSKADKLTSQPQTTPFSEVAPHVNGTAAEFAARSLSKKDSVVSNGVVPGIGCLTSSEKARNFPESVDQANEISKALPMSQNNIAPVIAQADCGVEISSGGIMQVAVAASCNGTTAKKVNVKSSKKLVRYPVVNMWLGSRQLLFTSRKPGKKAKHKRSRTVRRVVGCKDAANVSCLNEQLTSTSATARSETVECTSSRQKRSHASARSKDDTQSSKNKQKVDGASVGAGTSAPSSSADIPKSDPSSSIGAKLVAAQPVSIRATDLMEATVPCWDDVDVPNTKVAAGQHSKRKSIGYILDEWDEEYDKGKTKKVRKSKQDFGGPNPFQEEADYISERRMKQKSYQGKSWNKPNTIEELRI

SEQ ID NO: 2641 - DNA, 3174 bp, Sorghum bicolor
  misc_feature: Ceres ANNOT ID no. 6025464
  misc_feature: Encodes the peptide sequence at SEQ ID NO 2642
atggcgactgtagaaacgaatagagaagcaagaaaatcccttctccagtacttgtgtatgcttttacccatggcaatcgtcggagtcgtcatggtactcagccttgtggtgcttttgctctccttgagggaaaccacgagagctatagatgaagccaacgtagagaccatggatctggcgctccggcacgtcgccggcaacatgcagccgctcctggaagccaaccgctccgccgtcgccatcgccgacgtgaggcccaagatgttcatggccttcgccatgcagccgctgctggcgcaggtgtcgtactacgccggcggcgccgacggccacgcgttcgccttctaccgcacggagtgcggcgaggcgagagcgctgttcacggactcgcagaagaggtggtgcacccaggcggtggacccggcgaccggccgcctggtcggcagcgccgccgccgcggccacagacgggtttttcgtgccgaacagtacgacgacgccggcggcggcgccccccgtcgagggcaagaacaacgcctcgccgccgccagcagcgtctctctgggaagggtgggcgcgcccgggcgtccggatgctcttcttctccgcgcccgtcggcggtggcgacgccggcgtcggcgtggtctcggcagcggtctccgtccacgacgtcttcgaggccgccggcaaccgcatcggcgtccaggacggcctggacgtgtactacgcggtcggcgacgacaaggacgacgacgtcacgtcagcgtccgccatctacgaacctctgctgcttggctaccagcaccgcaccgccgacgacacggcggaggacgcgctcacgttctccgagctgaagtgcgccgcctccgccattgacgacgccgcgcccgagctcggccaggtcgtctccgggggacccaagcacaaccggtacaaagccgcgtgcgccatgctcgacgtctccggagtacaagtggcgctgtgcgtcgccgtgatcgtcctcgcgtgcgcactgctggtgctggccgtggtgtcgtgcgccttcgcggtgcgggcgctgcggcgagcgtcggcgcgggagatggcgctgaacgccgacctggtccggcagaaggaggcgctgcggcaggcggagcgcaagagcatgaacaagagcaacgccttcgccagcgccagccacgacatccggtccgcgctggcagccatcgccggcctcgtggacatgtcccgtccggaggcgcagtcgctccccgccccaggcatcgtggaaaacctcgaccagatgggcgtctgcaccaacaagctcttcgatatactgaactcgatcctagacacaagcaaggtggagtcggggaagatgcagctggaggaagccgagttcagcatgtccgacgtcctgcaggagtcggtggacatggccaacgtgacgggcgtccggcgaggggtcgaggtgatctgggacccctgcgacttctcggtgctgcgatgcgcggccgtcctcggggacagcaagcgcctcaagcagatcctggacaacctgctcggcaacgccctcaagttcacccacgaaggccacgtcctcctccggggctgggcgacccggccgatcgccgggagcggcgtcggaactccgtcaaggtttgcgcacccaaggcgcagcgccggcggttcattggcacgcttgttcagaggaagggcggaggatcctgatggccaggatcatgtgcagaatgaccccaatttggttgagttttactttgaagtggttgataccggcattgggatccccaaggagaagaggatgtctgtctttgagaactatgttcaggtgaacaatggccaaggcggcacaggcttggggcttggaatcgtgcagtcctttgtacgtttgatgggaggagaaatttgcatcaaggacaaagagcccggggaaagagggacatgcttcgcattcaacgtgctgctgaagatgagtgaggtgcaacagactcatcaagacatagaagaagggccgtcagttccattaggcacactgaacggctccaactacagagcctcagcgtttcaagaagccagcagcttcaagggcgtgcactgcgttctctacgttcatgggtctgaaaccaggaggatcctgcagacatggatggagagcatgggagtcaaggtctggttggtccggcaagccgagtttatcagcgccacgctggagaaggtgcagagcagtagcgtggccaccgctgccgctgactgcggcggcggcgaccggtgcttcagctcaaaggagatggtgaaccaattgaggaacaacactggtcccaagagagccagccttggggggattccttctggtatccttcttgtcatcgacgtgtccggtggtgcactggaagaaatttaccaggacatggccaaacttgccaggaccaagcaacaggctccatgcaaagttgttctactggaggatatcaagaccccttccaatgagctgaggaggctcaaggagcaggggtgctatctcgtcctgcgaaagccggtgcacggctctcgcctgttcactctccttatgaccctgagagacctccaggcttcagatgcacatgcacaatcttctcaagttggtcctgagattgctgggaacaacagccagcagcaaggcttgccagatgttgttgttccttgtgtgcaggaggctgctgcatcagctgaagctccatgcttggttcagaagcagaagcctgaagatgataagcctcttgctgggatgcagatcttgctggctgaagacacttttgtgctgcaaacaatccaaaggaaaatcctcaaccagcttggtgcaactgtcacagtagctgtagatggatcggtggctgtgaacttgctcaaacaagctcttgagcaggccaatgtgtcaggagaggaaatagtacccttgccctaccatgtcatcttcatggattgccagatgcccaatatggatggctatgaagcaacgaaactcatccgcgaggaagaacagcgctatggaattcacactccgatcatcgcattgaccgcgcatgacacacaggaggatctgcagaaggctattgatgccgggatggatctgcacctgacaaagccaatattagggaagaagatagtggaagctgttcgcacgtttgcaagtgtgtga

SEQ ID NO: 2642 - protein, 1057 aa, Sorghum bicolor
  misc_feature: Ceres ANNOT ID no. 6025464
  misc_feature (922)..(1052): Pfam Id: Response_reg Pfam Desc: Response regulator receiver domain
  misc_feature (501)..(656): Pfam Id: HATPase_c Pfam Desc: Histidine kinase-, DNA gyrase B-, and HSP90-like ATPase
  misc_feature (383)..(451): Pfam Id: HisKA Pfam Desc: His Kinase A (phosphoacceptor) domain
  misc_feature (331)..(643): NCBI GI: 144922836 NCBI Desc: histidine kinase related protein, c-terminal; tripartite hybrid signal transduction histidine kinase, bara type [medicago truncatula]
  misc_feature (331)..(643): NCBI GI: 140063590 NCBI Desc: histidine kinase related protein, c-terminal; tripartite hybrid signal transduction histidine kinase, bara type [medicago truncatula]
  misc_feature (331)..(743): NCBI GI: 60545052 NCBI Desc: cold inducible histidine kinase 1 [catharanthus roseus]
  misc_feature (331)..(684): NCBI GI: 18398532 NCBI Desc: histidine kinase 1 [arabidopsis thaliana]
  misc_feature (331)..(684): NCBI GI: 4586626 NCBI Desc: histidine kinase 1 [arabidopsis thaliana]
  misc_feature: The plant flowers significantly late compared to wild-type.
  misc_feature: The plant is abnormally large.
  misc_feature: The plant is abnormally small.
  misc_feature: Useful for making plants with modulated biomass
  misc_feature: Useful for making plants with modulated flowering time
  misc_feature: Useful for making plants with modulated drought sensitivity
  misc_feature: Functional homolog of the protein sequence given in SEQ ID NO 13265
  misc_feature: Functional homolog of the protein sequence given in SEQ ID NO 13269
  misc_feature: The sequence is a functional homolog of SEQ ID NO. 378 in the 11/188,298 US application
MATVETNREARKSLLQYLCMLLPMAIVGVVMVLSLVVLLLSLRETTRAIDEANVETMDLALRHVAGNMQPLLEANRSAVAIADVRPKMFMAFAMQPLLAQVSYYAGGADGHAFAFYRTECGEARALFTDSQKRWCTQAVDPATGRLVGSAAAAATDGFFVPNSTTTPAAAPPVEGKNNASPPPAASLWEGWARPGVRMLFFSAPVGGGDAGVGVVSAAVSVHDVFEAAGNRIGVQDGLDVYYAVGDDKDDDVTSASAIYEPLLLGYQHRTADDTAEDALTFSELKCAASAIDDAAPELGQVVSGGPKHNRYKAACAMLDVSGVQVALCVAVIVLACALLVLAVVSCAFAVRALRRASAREMALNADLVRQKEALRQAERKSMNKSNAFASASHDIRSALAAIAGLVDMSRPEAQSLPAPGIVENLDQMGVCTNKLFDILNSILDTSKVESGKMQLEEAEFSMSDVLQESVDMANVTGVRRGVEVIWDPCDFSVLRCAAVLGDSKRLKQILDNLLGNALKFTHEGHVLLRGWATRPIAGSGVGTPSRFAHPRRSAGGSLARLFRGRAEDPDGQDHVQNDPNLVEFYFEVVDTGIGIPKEKRMSVFENYVQVNNGQGGTGLGLGIVQSFVRLMGGEICIKDKEPGERGTCFAFNVLLKMSEVQQTHQDIEEGPSVPLGTLNGSNYRASAFQEASSFKGVHCVLYVHGSETRRILQTWMESMGVKVWLVRQAEFISATLEKVQSSSVATAAADCGGGDRCFSSKEMVNQLRNNTGPKRASLGGIPSGILLVIDVSGGALEEIYQDMAKLARTKQQAPCKVVLLEDIKTPSNELRRLKEQGCYLVLRKPVHGSRLFTLLMTLRDLQASDAHAQSSQVGPEIAGNNSQQQGLPDVVVPCVQEAAASAEAPCLVQKQKPEDDKPLAGMQILLAEDTFVLQTIQRKILNQLGATVTVAVDGSVAVNLLKQALEQANVSGEEIVPLPYHVIFMDCQMPNMDGYEATKLIREEEQRYGIHTPIIALTAHDTQEDLQKAIDAGMDLHLTKPILGKKIVEAVRTFASV

SEQ ID NO: 2643 - DNA, 918 bp, Sorghum bicolor
  misc_feature: Ceres ANNOT ID no. 6025468
  misc_feature: Encodes the peptide sequence at SEQ ID NO 2644
atggactctgctgccggcgcaggccgcaaccgcgtccgaatcgcagtcgtcggcgacgtgcacaatgattgggccctagaggaagattcaaaggcgctccaatttcttcagccggatttagtgctttttacaggtgattatggaaatgagaatgttgaacttgtcagaagcatttcagatcttcagttaccaaaggcggcaattcttggcaatcatgattgctggcacacacatcaattctcagagaaccttggtgagcagcatgttggatacaaatgtctggacttcccgtcaattaagctgagcattgttggtggacggccattttcctgtgggggtgataggctatttagaccaaagcttctgtcaaaatgttacggtgttaatgatatggctggaagtgcaaagaagatatacgatgctgctgcaggtgcactagagggacattctgttgtattgcttgcacataatggaccaacaggtctaggttcaagaatggatgatttctgtgggcgggattgggtacctggtggcggtgaccatggcgatccagatcttgagcgagccatctccgatatgcaaggggaagccagagtttccatcccactggtcgtttttggtcacatgcacaagagcctagcctacgggagaggcttgaggaagatgatcgcctctggagccaaccacaccatatatctgaacggagcagttgtgcctagagtgaaattttccaaaacaattcctagatatgagcaaaatcaacccgaaggaccaggatccgtagctccaacattgcgcgcgttcaccattgcggatctctctgaagggcgtgtggagaagatctctgaggtctgggtgctggtgagtggtgccaggactgaggtcgaggaggaaatcgtcttgtataaacatccttga

SEQ ID NO: 2644 - protein, 305 aa, Sorghum bicolor
  misc_feature: Ceres ANNOT ID no. 6025468
  misc_feature (12)..(212): Pfam Id: Metallophos Pfam Desc: Calcineurin-like phosphoesterase
  misc_feature (3)..(305): NCBI GI: 55771368 NCBI Desc: diadenosine tetraphosphatase and related serine/threonine protein phosphatases-like [oryza sativa (japonica cultivar-group)]
  misc_feature (75)..(291): NCBI GI: 67920574 NCBI Desc: metallophosphoesterase [crocosphaera watsonii wh 8501]
  misc_feature (75)..(291): NCBI GI: 126659796 NCBI Desc: metallophosphoesterase [cyanothece sp. ccy0110]
  misc_feature (75)..(286): NCBI GI: 23124236 NCBI Desc: cog0639: diadenosine tetraphosphatase and related serine/threonine protein phosphatases [nostoc punctiforme pcc 73102]
  misc_feature (75)..(286): NCBI GI: 75908211 NCBI Desc: metallophosphoesterase [anabaena variabilis atcc 29413]
MDSAAGAGRNRVRIAVVGDVHNDWALEEDSKALQFLQPDLVLFTGDYGNENVELVRSISDLQLPKAAILGNHDCWHTHQFSENLGEQHVGYKCLDFPSIKLSIVGGRPFSCGGDRLFRPKLLSKCYGVNDMAGSAKKIYDAAAGALEGHSVVLLAHNGPTGLGSRMDDFCGRDWVPGGGDHGDPDLERAISDMQGEARVSIPLVVFGHMHKSLAYGRGLRKMIASGANHTIYLNGAVVPRVKFSKTIPRYEQNQPEGPGSVAPTLRAFTIADLSEGRVEKISEVWVLVSGARTEVEEEIVLYKHP

SEQ ID NO: 2645 - DNA, 2625 bp, Sorghum bicolor
  misc_feature: Ceres ANNOT ID no. 6025478
  misc_feature: Encodes the peptide sequence at SEQ ID NO 2646
atggcgtccatctccccggagaccatcggcggggacgtcaatctgtccaagattccggtggaggaggtgttcaagacgctgaaatgcgaccgcaaggggctgtccagcacggagggcgagaataggctcaggacgttcggacccaacaagctggaggagaagaaggagaacaacctgctcaagttcctgggcttcatgtggaacccgctctcttgggtcatggagatggcggccatcatggccatcgcgctcgccaacggcggcggcaggccgcccgactggcaggacttcgtcgggatcgtctctctgctcttcatcaactccacaatcagctacatcgaggaggccaacgccgggaacgccgccgcggcgctcatggctgggctggcgcccaagaccaagctgctgagggacggcaggtgggaggagcaggacgcggcgatcctcgtgcccggtgacatcatcagcatcaagctcggcgacatcatccccgccgacgccaggctgctcgagggcgacccgctcaagatcgaccagtcggcgctcaccggcgagtcgctccccgtgaacaagcaccctgggcaggaggtgttctcgggctcaacggtgaagcagggtgagatcgaggccgtcgtcatcgccaccggcgtccgcaccttcttcggcaaggcggcgcacctcgtcgacagcaccaacaacgtcggccacttccagcaggtgctcacggccatcggcaacttctgcatcatctccatcgccgccggcatgctggtcgaggtcgtcgtcatgtacccgatccagcaccgcgcctaccgcgacggcatcgacaacctcctcgtgctgctcatcggcgggatccccatcgccatgcccaccgtgctctcggtcaccatggccatcggctcccaccgcctgtcgcagcagggggccatcaccaagcgcatgacggccatcgaggagatggccggcatggacatgctctgcagcgacaagaccggcaccctcaccctcaacaagctcaccgtcgacaagtccctcatcgaggtctactccaagggcgtcgacaaggacatggtgctcctctacgccgcgagggcctcccgcgtcgagaaccaggacgccatcgacacctgtatcgtgaacatgctcgccgaccccaaggaggcccgcgctggcatccaggaagtccacttcctccccttcaacccggtcgagaagcgcacggccatcacctacatcgacggcaacggcgactggcacagggtcagcaagggcgctcccgagcagatcatcgagctctgcaacatgggcgccgaggccgagaagaaggtccatgccctgatcgacgggtacgccgaccgcggcctccggtcgctcggcgtgtcgtaccagcaggtgccggagaagagcaaggagagcgctggcgagccgtggcagttcatcggcctcctgcccctgttcgacccgccgaggcacgacagcgcagagaccatccgccgcgcgctccacctgggcgtcaacgtgaagatgatcaccggtgaccagctcgccatcggcaaggagaccggccgccggctcggcatgggcaccaacatgtacccttccaccacgctcctgggcgacaagaacagcacggtgaacggcatgcacatcgacgagctcatcgagaaggccgacggcttcgcgggtgtcttccccgagcacaagtacgagatcgtgaagcggctgcaggaccggaaccacatctgcggcatgaccggcgacggcgtgaacgacgcgccggcgctgaagaaggcggacatcggcatcgccgtggacgacgcgacggacgcggcgcggagcgcgtcggacatcgtgctgacggagcccgggctgagcgtgatcgtgagcgccgtgctgacgagccgctccatcttccagcgcatgaagaactacaccatctacgccgtgtccatcaccatccgcatcgtgctgggcttcctcctcatcgcgctcatctggaagttcgacttcgcgcccttcatggtgctcatcatcgccatcctcaacgacggcaccatcatgaccatctccaaggaccgcgtgaagccatcgcccacacccgactcgtggaagctcgacgagatcttcgccaccggcatcgtgctcggaacctacatggccatcgtcaccgccatcttcttctacctcgcccacgacaccgatttcttcacggccgtgttcggcgtgcagtcgatcaaggagaacgacagggagctgatggcggcgctgtacctgcaagtgagcatcatcagccaggcgctcatcttcgtgacgcggtcccggagctggtcgttcgtggagcggccgggattcctcctgctcttcgccttcttcgccgcccagctggtggcgacgtgcatcgcggtgtacgccaactgggacttctgccgcatgcaggggatcggctgggcgtggggcggcgccatctggatcttcagcatcgtcacctacatcccgctcgacgtgctcaagttcatgatccgcgccgcgctcagaggcaaggccgcgggcagcaacgtccagaacaaggcaagctttttgcccactctcactcagcaaactgctccattgttgttgtcttga

SEQ ID NO: 2646 - protein, 874 aa, Sorghum bicolor
  misc_feature: Ceres ANNOT ID no. 6025478
  misc_feature (99)..(320): Pfam Id: E1-E2_ATPase Pfam Desc: E1-E2 ATPase
  misc_feature (5)..(87): Pfam Id: Cation_ATPase_N Pfam Desc: Cation transporter/ATPase, N-terminus
  misc_feature (324)..(609): Pfam Id: Hydrolase Pfam Desc: haloacid dehalogenase-like hydrolase
  misc_feature (2)..(866): NCBI GI: 55773788 NCBI Desc: plasma membrane h+-atpase [oryza sativa (japonica cultivar-group)]
  misc_feature (2)..(857): NCBI GI: 55773787 NCBI Desc: plasma membrane h+-atpase [oryza sativa (japonica cultivar-group)]
  misc_feature (2)..(866): NCBI GI: 20302449 NCBI Desc: plasma membrane h+-atpase [oryza sativa (japonica cultivar-group)]
  misc_feature (1)..(861): NCBI GI: 20302441 NCBI Desc: plasma membrane h+-atpase [oryza sativa (japonica cultivar-group)]
  misc_feature (66)..(861): NCBI GI: 115449231 NCBI Desc: os02g0797300 [oryza sativa (japonica cultivar-group)]
  misc_feature (2)..(860): SWISSPROT Homolog: EC 3.6.3.6 ATPase 6, plasma membrane-type
MASISPETIGGDVNLSKIPVEEVFKTLKCDRKGLSSTEGENRLRTFGPNKLEEKKENNLLKFLGFMWNPLSWVMEMAAIMAIALANGGGRPPDWQDFVGIVSLLFINSTISYIEEANAGNAAAALMAGLAPKTKLLRDGRWEEQDAAILVPGDIISIKLGDIIPADARLLEGDPLKIDQSALTGESLPVNKHPGQEVFSGSTVKQGEIEAVVIATGVRTFFGKAAHLVDSTNNVGHFQQVLTAIGNFCIISIAAGMLVEVVVMYPIQHRAYRDGIDNLLVLLIGGIPIAMPTVLSVTMAIGSHRLSQQGAITKRMTAIEEMAGMDMLCSDKTGTLTLNKLTVDKSLIEVYSKGVDKDMVLLYAARASRVENQDAIDTCIVNMLADPKEARAGIQEVHFLPFNPVEKRTAITYIDGNGDWHRVSKGAPEQIIELCNMGAEAEKKVHALIDGYADRGLRSLGVSYQQVPEKSKESAGEPWQFIGLLPLFDPPRHDSAETIRRALHLGVNVKMITGDQLAIGKETGRRLGMGTNMYPSTTLLGDKNSTVNGMHIDELIEKADGFAGVFPEHKYEIVKRLQDRNHICGMTGDGVNDAPALKKADIGIAVDDATDAARSASDIVLTEPGLSVIVSAVLTSRSIFQRMKNYTIYAVSITIRIVLGFLLIALIWKFDFAPFMVLIIAILNDGTIMTISKDRVKPSPTPDSWKLDEIFATGIVLGTYMAIVTAIFFYLAHDTDFFTAVFGVQSIKENDRELMAALYLQVSIISQALIFVTRSRSWSFVERPGFLLLFAFFAAQLVATCIAVYANWDFCRMQGIGWAWGGAIWIFSIVTYIPLDVLKFMIRAALRGKAAGSNVQNKASFLPTLTQQTAPLLLS

SEQ ID NO: 2647 - DNA, 1317 bp, Sorghum bicolor
  misc_feature: Ceres ANNOT ID no. 6025479
  misc_feature: Encodes the peptide sequence at SEQ ID NO 2648
  misc_feature: Down-regulated in shoot tissues in response to salicylic acid treatment
atgttgcccccgctttcttcggctccttcccgtctgctccccaggcgaactgtcgcttccgccaccgcctcctcgccctcgccttcgccttcgccttcgccttcgcgcgcaggagggcacggccgccgccccctgcgctacgctgtcctgggcgccggcttcgcgggtctctccgtcgcgtggcacctcctcaagcatagcccgagggattctcgcgtgtcggtggacatctacgacgagaacggggtcgggggaggtgcgtcgggcgtctcgggagggcttctccatccctactcgcctaaagtgaagcttctctggaggggtgctgagttctggaaagagagcatggatctccttcgaagcgcagagcaagcaaacagaaccacgggggcagatataactaatgaagatgataaccttatctggagaaggggaattgtacggccgcctacaactgagaaggctgcagacatattgctggagagttgcctcgagagttgcagccttcaactgcttgattctgatgccgcacagcgtctgatccctgggttgcgtaccccatttgactttgcagtttacatgccactggcactgaacgtcaaccctaagaaatatctacaggcactgttctctgcatgccaaaatctggcagatgaagcatcctcattaccaagtgagcagaaagagttcaagctatacaagcaacatgttgatgatctacaccatttggcaggaaattatgattcggtgatcgtctgccttggggccaaggttcgctcacttcctgaacttgcaaataagttgcctcttaggacctgtagaggagttatcgctgaatttaagttgccatccgatacaatagaagagtatggcagtcaaagcccttcaatcttatctgatgcatggctggcattccaaggtccccgatctgtttctatcggatcaacttggcaatggaagtctgagaacgattcttcaactgtatctgatgaagaatctcttactgcaatggaagagttgctcccaaaagcttctggcgtatatccaagaataaataaatgggattttgtaggtgcaagagctggaattcgagccatgcctccacttacagctaatgggtcgttgccactgttgggttgtttggacgatttactaggcaagaagagcaactgcacattttggatagttggtggacttggtgcaagaggtcttctgtatcatggtttagttggaaagttgactgccaaagctgtgatttcctgtgatgaaaacataataccttctgagttcacatgctggaatacaattaagccttag

SEQ ID NO: 2648 - protein, 438 aa, Sorghum bicolor
  misc_feature: Ceres ANNOT ID no. 6025479
  misc_feature (46)..(417): Pfam Id: DAO Pfam Desc: FAD dependent oxidoreductase
  misc_feature (171)..(421): NCBI GI: 115466760 NCBI Desc: os06g0181400 [oryza sativa (japonica cultivar-group)]
  misc_feature (45)..(219): NCBI GI: 15835269 NCBI Desc: oxidoreductase, dada family [chlamydia muridarum]
  misc_feature (45)..(219): NCBI GI: 29840489 NCBI Desc: oxidoreductase, dada family [chlamydophila caviae gpic]
  misc_feature (45)..(219): NCBI GI: 89331463 NCBI Desc: glycine dehyrogenase [chlamydophila felis fe/c-56]
  misc_feature (45)..(219): NCBI GI: 76789105 NCBI Desc: d-amino acid oxidase family [chlamydia trachomatis a/har-13]
  misc_feature: Down-regulated in shoot tissues in response to salicylic acid treatment
MLPPLSSAPSRLLPRRTVASATASSPSPSPSPSPSRAGGHGRRPLRYAVLGAGFAGLSVAWHLLKHSPRDSRVSVDIYDENGVGGGASGVSGGLLHPYSPKVKLLWRGAEFWKESMDLLRSAEQANRTTGADITNEDDNLIWRRGIVRPPTTEKAADILLESCLESCSLQLLDSDAAQRLIPGLRTPFDFAVYMPLALNVNPKKYLQALFSACQNLADEASSLPSEQKEFKLYKQHVDDLHHLAGNYDSVIVCLGAKVRSLPELANKLPLRTCRGVIAEFKLPSDTIEEYGSQSPSILSDAWLAFQGPRSVSIGSTWQWKSENDSSTVSDEESLTAMEELLPKASGVYPRINKWDFVGARAGIRAMPPLTANGSLPLLGCLDDLLGKKSNCTFWIVGGLGARGLLYHGLVGKLTAKAVISCDENIIPSEFTCWNTIKP

SEQ ID NO: 2649 - DNA, 1263 bp, Sorghum bicolor
  misc_feature: Ceres ANNOT ID no. 6025480
  misc_feature: Encodes the peptide sequence at SEQ ID NO 2650
atgccgcgggtgacgccggtcggcgcgagtctcatcctggagcacgtcctggccgacccctcggtccccgccgccgtggtcaacaagctcctcgtcgcgctccccgtcccctcccacccgaccccgcgcctccgccgcgcggtcctcctccgccgcctcgccgccgacccggtctccgaatcctccctcgacacgctccagctcctggccgcgctccccgcccccgcatccccaatcgccgccgcccacatcgccgtcgcggcctacctcgcagtctccgcgtccgacttcgacgacgccgcgggggcgctcttcgcgcgtcccaacggccgcgtgcgcctcgcggtcgacgagggagggtcctccgcgctcgcatccgatgagatcatgaccacagtggaccagttcgaggccgccgtcgggaactccttctctcaggccgtcctcaggggcctgtggggcgaccggtccgccacggaggagcgggtcagggacctcctcgccgccgagtgggctgccattgggccgtcgctgctcgtgcaggcggctgagcggatcgtcggggatggggccgtcgagacatggcgtgccgcggatgaggccacccgtgccaagctccgcattttggctggggaagaaagaacacatgagattctcagcaaacttgaagaacctacctccagtgcaaatccaatttcaacaccagctgttgagaaggtaattaactcgctcaaaacaagctgtgctgagcttcacagtgttgtggaggatccgcttccagctgcgaaggcagttgcagatgaggtattggctgcaaggatggagaaaagcgttagtttggatgctgaagaagcaagaggtcaaccaacaacttgtggcactgcaggcccgagcgctcctaatgataaaggcaagggtccaagtacaggtaaacctcacagccttatggattggaacccaacagcacgcacctttcagtgggaggaatcacctggtcctgagagttcagaaccgtcattacgcagaccacacttgcctagcccaaggagagcaccagtttctcctttgccaccgggagaaaacaaaaataggcgtagaagggctaggaagtggtgcttgttagaagaagaagcactaagacagggtgttgaacagtatggtagtggcaattggaaggacattttaaataacaaccctgacgtttttatcggcagaacaccggtggacttgaaggataagtggaggaatatgatcaaccgttag

SEQ ID NO: 2650 - protein, 420 aa, Sorghum bicolor
  misc_feature: Ceres ANNOT ID no. 6025480
  misc_feature (368)..(418): Pfam Id: Myb_DNA-binding Pfam Desc: Myb-like DNA-binding domain
  misc_feature (1)..(420): NCBI GI: 54111435 NCBI Desc: terminal acidic sant 1 [zea mays]
  misc_feature (1)..(418): NCBI GI: 40388419 NCBI Desc: anther indehiscence1 [oryza sativa (japonica cultivar-group)]
  misc_feature (365)..(420): NCBI GI: 56404263 NCBI Desc: terminal acidic sant 1 [zea mays]
  misc_feature (302)..(352): NCBI GI: 56404262 NCBI Desc: terminal acidic sant 1 [zea mays]
  misc_feature (257)..(420): NCBI GI: 22329375 NCBI Desc: myb family transcription factor [arabidopsis thaliana]
  misc_feature: The sequence is a functional homolog of SEQ ID NO 1220 in the 10/666,642US patent application
  misc_feature: Useful for making plants with modulated growth and phenotype characteristics
  misc_feature: The sequence is a functional homolog of SEQ ID NO 1220 in the 20070033671 US patent application
MPRVTPVGASLILEHVLADPSVPAAVVNKLLVALPVPSHPTPRLRRAVLLRRLAADPVSESSLDTLQLLAALPAPASPIAAAHIAVAAYLAVSASDFDDAAGALFARPNGRVRLAVDEGGSSALASDEIMTTVDQFEAAVGNSFSQAVLRGLWGDRSATEERVRDLLAAEWAAIGPSLLVQAAERIVGDGAVETWRAADEATRAKLRILAGEERTHEILSKLEEPTSSANPISTPAVEKVINSLKTSCAELHSVVEDPLPAAKAVADEVLAARMEKSVSLDAEEARGQPTTCGTAGPSAPNDKGKGPSTGKPHSLMDWNPTARTFQWEESPGPESSEPSLRRPHLPSPRRAPVSPLPPGENKNRRRRARKWCLLEEEALRQGVEQYGSGNWKDILNNNPDVFIGRTPVDLKDKWRNMINR

SEQ ID NO: 2651 - DNA, 1101 bp, Sorghum bicolor
  misc_feature: Ceres ANNOT ID no. 6025499
  misc_feature: Encodes the peptide sequence at SEQ ID NO 2652
atggccgcaccgtgcggccgcggcacgctgacgctgttcctcgtgtccctctccgcggcgttcctcacctacaacgtgctcgtctccttccgctcctccctccagcccctcccttcctccttccccaccgcctcctcctcctcctcctcctcctcctcctcctcctcccgccgcttcggcgccgccaggcggagggcgttccacaccgcggtgaccgcgtcggggaacgcgtacaacacgtggcaatgccgcgtcatgtaccactggttcaaggaggcgcgccgggcgcccggcggcgccgagatgggtgggttcaccagggtcctgcactccgggaaacccgacgagttcatggacgagatccccacattcgtcgccgacccactccccgatggggatcagggatacattgttctcaataggccatgggcatttgttcagtggctccagaaggcagacataaaggaagactatatcttgatggcagagccagatcatataattgtcaagcctatcccaaacttgtcgagagatggtcaggcagcagctttccatttcttttatattgagcctgaaaagtatgagaatgtgttgcgtaagttcttccctgaagacaaggggccaatcactaagattgatcctataggaaattctcccgtcattattgagaaggaatctcttggaagaattgccccaacatggatgaatgtttcaatagcaatgaaaaatgatcctgatgctgataaatcttttggctgggttcttgaaatgtatgcctatgctgtggcatctgctcttcatggagtgggcaacatcttacacaaggagtttatgattcagccaccttgggacttggaagttggtgatgcttttattatacattatacttatgggtgtgattatgacatgaagggtaagtcgacttatggcaaaattggagaatggagatttgacaagagatcttatgatgataaacctccgcctagaaatttgccattaccgccaaatggtgtgcctcagagtgtggtgacgcttgtgaaaatggtcaatgaagcaacaggcagcataccaaactgggactcttatgccgctagttattaa

SEQ ID NO: 2652 - protein, 366 aa, Sorghum bicolor
  misc_feature: Ceres ANNOT ID no. 6025499
  misc_feature (48)..(365): NCBI GI: 115466750 NCBI Desc: os06g0180000 [oryza sativa (japonica cultivar-group)]
  misc_feature (12)..(360): NCBI GI: 115463637 NCBI Desc: os05g0386000 [oryza sativa (japonica cultivar-group)]
  misc_feature (287)..(342): NCBI GI: 115457362 NCBI Desc: os04g0226400 [oryza sativa (japonica cultivar-group)]
  misc_feature: Useful for making plants with modulated drought sensitivity
  misc_feature: Functional homolog of the protein sequence given in SEQ ID NO 13235
MAAPCGRGTLTLFLVSLSAAFLTYNVLVSFRSSLQPLPSSFPTASSSSSSSSSSSSRRFGAARRRAFHTAVTASGNAYNTWQCRVMYHWFKEARRAPGGAEMGGFTRVLHSGKPDEFMDEIPTFVADPLPDGDQGYIVLNRPWAFVQWLQKADIKEDYILMAEPDHIIVKPIPNLSRDGQAAAFHFFYIEPEKYENVLRKFFPEDKGPITKIDPIGNSPVIIEKESLGRIAPTWMNVSIAMKNDPDADKSFGWVLEMYAYAVASALHGVGNILHKEFMIQPPWDLEVGDAFIIHYTYGCDYDMKGKSTYGKIGEWRFDKRSYDDKPPPRNLPLPPNGVPQSVVTLVKMVNEATGSIPNWDSYAASY

SEQ ID NO: 2653 - DNA, 1665 bp, Sorghum bicolor
  misc_feature: Ceres ANNOT ID no. 6025532
  misc_feature: Encodes the peptide sequence at SEQ ID NO 2654
atggccgccgcggggacgcggcagcagctgggtcggcttctcggcggtctctggttcctcctggccgcgttgtcgctgcgtgccgcggccgggcagccggcggtggccaccgtcgatgcgcggcgcgccgtcgcggcgaccggggaggacttcgtgtgcgcgacattggactggtggccgccggacaagtgcgactacggcacctgcgcctggggccgcgccggcctgctcaacctggatctctccaacaaggtcctgctcaatgccgtcagagccttctcgccgccgctggtgctccgcctgggagggtcgctgcagaacaaggtggtgtacggcacggcggacctcggcggccggccgtgcgcgccgttcgccaagaacgcgtcggagatgcacggcttcacgcagggctgcctgcccctgcgcaggtgggacgagctcaacgccttcttccagaaatctggtgccaagattgtgttcgggctcaacgcgctgaatggccgcgttccattgccggataaatccatgggagggccatgggattacaccaatgcggccgcactgattcggtatagcgtgaacaagggctaccggattcatgggtgggagctcggaaatgaactcagtggtactggagtcggaactcgagttggcgcagaacaatatgctacagatgtgatcgccctaaaaaaactagtcgacgacatataccgaagcaatcaaacaaaaccattggtgcttgctcctggaggattctttgaccaagcctggtttagccaacttattgccaaaaccaagccaaatctactgaatgtgatcacccaccacatctacaatttaggaccaggaaaagacacacatctgattgacaagatcttcaatccatcaatcctcgatggaatgaaaggtacattcagcagccttcaggggatgctgaaatctgcaggaacatcgactgtcgcatgggttggggaagctggaggcgcttacaacagtggccggcaccttgtcactgatgcatttgtattcagcttctggtttttagatcagcttgggatgtcagcaaagtatgacacaaagagctactgcagacagagtttgattggtggcaactacggcctgctaaataccacaacgttccaaccaaaccctgactattacagtgctttactgtggcatcgcctcatgggaaccaaagttctagcaacaacattcaacggcacgaacaagatccgcgcatatgcgcactgcgcaagagattcaccaggaatcactctactgctgatcaacctcagcggcaacacgacgacccaggtctcagtgacggtgacgacccaaggccaaggggccgtggcggcgcacaagcatggcgcgaggaagcacgtcggcggcaggaagttcgggcacgtccacggccccaggttcaccggcgtcgacgaggcggcggccggcgccgtgagagacgagtaccatctcacccccaaggacggcaacctgaggagccaggtcatgctgctcaacggcaaggcgttggccaccgacgcggcagggaacatcccggcactggaggctgtcaaggtggacgcggcacagcccatcgctgtggcgccctactccatcgtgttcgctcgcatttcacatttcaatgccccggcgtgtagttag

SEQ ID NO: 2654 - protein, 554 aa, Sorghum bicolor
  misc_feature: Ceres ANNOT ID no. 6025532
  misc_feature (31)..(352): Pfam Id: Glyco_hydro_79n Pfam Desc: Glycosyl hydrolase family 79, N-terminal domain
  misc_feature (35)..(443): NCBI GI: 92896668 NCBI Desc: glycoside hydrolase family 79, n-terminal [medicago truncatula]
  misc_feature (141)..(554): NCBI GI: 30692666 NCBI Desc: glycosyl hydrolase family 79 n-terminal domain-containing protein [arabidopsis thaliana]
  misc_feature (7)..(387): NCBI GI: 30692673 NCBI Desc: glycosyl hydrolase family 79 n-terminal domain-containing protein [arabidopsis thaliana]
  misc_feature (44)..(447): NCBI GI: 8918740 NCBI Desc: beta-glucuronidase precursor [scutellaria baicalensis]
  misc_feature (165)..(421): NCBI GI: 92884256 NCBI Desc: glycoside hydrolase family 79, n-terminal [medicago truncatula]
MAAAGTRQQLGRLLGGLWFLLAALSLRAAAGQPAVATVDARRAVAATGEDFVCATLDWWPPDKCDYGTCAWGRAGLLNLDLSNKVLLNAVRAFSPPLVLRLGGSLQNKVVYGTADLGGRPCAPFAKNASEMHGFTQGCLPLRRWDELNAFFQKSGAKIVFGLNALNGRVPLPDKSMGGPWDYTNAAALIRYSVNKGYRIHGWELGNELSGTGVGTRVGAEQYATDVIALKKLVDDIYRSNQTKPLVLAPGGFFDQAWFSQLIAKTKPNLLNVITHHIYNLGPGKDTHLIDKIFNPSILDGMKGTFSSLQGMLKSAGTSTVAWVGEAGGAYNSGRHLVTDAFVFSFWFLDQLGMSAKYDTKSYCRQSLIGGNYGLLNTTTFQPNPDYYSALLWHRLMGTKVLATTFNGTNKIRAYAHCARDSPGITLLLINLSGNTTTQVSVTVTTQGQGAVAAHKHGARKHVGGRKFGHVHGPRFTGVDEAAAGAVRDEYHLTPKDGNLRSQVMLLNGKALATDAAGNIPALEAVKVDAAQPIAVAPYSIVFARISHFNAPACS

SEQ ID NO: 2655 - DNA, 219 bp, Sorghum bicolor
  misc_feature: Ceres ANNOT ID no. 6025560
  misc_feature: Encodes the peptide sequence at SEQ ID NO 2656
atggggaagatgccggtgcggatgaaggcggtggtgtatgcgctgtcgcctttccagcagaaggtgatgccggggctgtggaaggacatcaccaccaagatccaccacaaggtcaccgagaactggatctccgccacgctcctcgtcacccccgtcgtcggcacctaccaatacgccatgtggtacaaagagcaggagaagctttcccacagatattaa

SEQ ID NO: 2656 - protein, 72 aa, Sorghum bicolor
  misc_feature: Ceres ANNOT ID no. 6025560
  misc_feature (1)..(72): NCBI GI: 633687 NCBI Desc: ubiquinol--cytochrome c reductase [solanum tuberosum]
  misc_feature (1)..(71): NCBI GI: 106879619 NCBI Desc: ubiquinol-cytochrome c reductase [plantago major]
  misc_feature (1)..(72): SWISSPROT Homolog: EC 1.10.2.2 Ubiquinol-cytochrome c reductase complex ubiquinone-binding proteinQP-C
  misc_feature: Useful for making plants with modulated nitrogen use efficiency
  misc_feature: GREAT-hit functional homolog of the protein sequence given in SEQ ID NO 12989
  misc_feature: Useful for making plants with modulated nitrogen use efficiency
  misc_feature: Functional homolog of the protein sequence given in SEQ ID NO 12989
MGKMPVRMKAVVYALSPFQQKVMPGLWKDITTKIHHKVTENWISATLLVTPVVGTYQYAMWYKEQEKLSHRY

SEQ ID NO: 2657 - DNA, 1413 bp, Sorghum bicolor
  misc_feature: Ceres ANNOT ID no. 6025561
  misc_feature: Encodes the peptide sequence at SEQ ID NO 2658
atggccgccgccgtcccaaccgctcccgcccgcctcttcctcctccagtccaccccgtccccgaaccctagcagcgcggccgccgccgctcaagctccagtcctccgcgtaccgcccctccgcctctcgctatcccggcgcatggctgggcgcccgctgacggtgatcgcgggcgcctccggcgactccgaacgggacatcagcgcctccgcggtctccctggaggccctggactccgtcgcctccgattccgacctggaggcgaaggagccgagcgtggcgacgatgctgacgagcttcgagaactcgttcgataagtatggggctctgagcacaccgctgtaccagaccgccacctttaagcagccttcagctacagattatggaccttatgattatactagaagtggtaaccccactcgtgatgttctccagagccttatggctaagcttgagaaggcagatcaagcattctgcttcaccagtgggatggcagcattagctgcagtaacacacctccttaaggctggacaagaaatagttgctggtgaggacatatatggtggctctgatcgtcttctctcgcaagttgtcccgagaaatggaatagttgtaaaccgagtagatacaacgaatattagtgatgtggtgtctgcaattggaccctccactagactagtttggcttgaaagtcccacaaaccctcgtcagcaaattactgacattaagacaatctcagagatagcacattctcatggtgctcttgttttggtagacaacagcatcatgtctccagtgctctcccgtcctatagaactgggagctgatatcgtgatgcactcagctaccaaatttgtagctggacatagtgatcttatggctggaattcttgcagtaaagggtgaaagcttggctaaagagatagcatttctgcaaaatgctgaagggacaggtttggcaccttttgactgctggctttgcttgaggggaatcaaaaccatggctttgcgggtggagaaacaacaggctaatgcccagaagattgctgaattcctagcgtctcacccgagggtcaagcaagtgaactacgccgggcttcctgaccatcctgggcggtctttacactattctcaggcaaagggagcgggctctgttctcagtttcctcaccggttcattggctctctcaaagcacgtcgtcgagaccaccaagcacttcagcgtaacagtcagcttcgggagcgtgaagtccctcatcagcctgccgtgcttcatgtcccacgcagcaatccctgctgcggtccgcgaggagcgcggcctgaccgacgacctcgtccggatatcggtcggcatcgaggacgtcgaggacctcatcgccgatctggaccgcgcgctcagaaccagcccagcatag

SEQ ID NO: 2658 - protein, 470 aa, Sorghum bicolor
  misc_feature: Ceres ANNOT ID no. 6025561
  misc_feature (94)..(466): Pfam Id: Cys_Met_Meta_PP Pfam Desc: Cys/Met metabolism PLP-dependent enzyme
  misc_feature (135)..(382): Pfam Id: Beta_elim_lyase Pfam Desc: Beta-eliminating lyase
  misc_feature (60)..(470): NCBI GI: 8439539 NCBI Desc: cystathionine beta-lyase [solanum tuberosum]
  misc_feature (89)..(469): NCBI GI: 6911875 NCBI Desc: cystathionine beta-lyase precursor (cbl) [arabidopsis thaliana]
  misc_feature (122)..(430): NCBI GI: 48093935 NCBI Desc: chloroplast cystathionine beta lyase [medicago sativa]
  misc_feature (89)..(378): NCBI GI: 30694567 NCBI Desc: cystathionine beta-lyase, chloroplast / beta-cystathionase / cysteine lyase (cbl) [arabidopsis thaliana]
  misc_feature (87)..(464): NCBI GI: 145350362 NCBI Desc: cystathione beta lyase [ostreococcus lucimarinus cce9901]
  misc_feature (89)..(469): SWISSPROT Homolog: EC 4.4.1.8 Cystathionine beta-lyase, chloroplast precursor
MAAAVPTAPARLFLLQSTPSPNPSSAAAAAQAPVLRVPPLRLSLSRRMAGRPLTVIAGASGDSERDISASAVSLEALDSVASDSDLEAKEPSVATMLTSFENSFDKYGALSTPLYQTATFKQPSATDYGPYDYTRSGNPTRDVLQSLMAKLEKADQAFCFTSGMAALAAVTHLLKAGQEIVAGEDIYGGSDRLLSQVVPRNGIVVNRVDTTNISDVVSAIGPSTRLVWLESPTNPRQQITDIKTISEIAHSHGALVLVDNSIMSPVLSRPIELGADIVMHSATKFVAGHSDLMAGILAVKGESLAKEIAFLQNAEGTGLAPFDCWLCLRGIKTMALRVEKQQANAQKIAEFLASHPRVKQVNYAGLPDHPGRSLHYSQAKGAGSVLSFLTGSLALSKHVVETTKHFSVTVSFGSVKSLISLPCFMSHAAIPAAVREERGLTDDLVRISVGIEDVEDLIADLDRALRTSPA

SEQ ID NO: 2659 - DNA, 1695 bp, Sorghum bicolor
  misc_feature: Ceres ANNOT ID no. 6025562
  misc_feature: Encodes the peptide sequence at SEQ ID NO 2660
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
atggctgttggtggaactcaaccggtcctcaggaagtacctaggtgccctcaaggacacaacgactgtgagcttggcaaaagtgaacagtgattataaggaattggacattgcaattgtcaaggccacaaaccatgttgagcgtccatcaaaggagaagtacataagagaaatttttcattccatttctgctgctaggccacgagcagatgtagcttattgcattcatgcccttgctagacgtctttcaaagacacgcaattgggcggttgcgctaaagacattgattgtcattcatcgtgcccttcgggaagttgatcccacttttcgtgaagagcttatcaattatggcagatctaggtcccatatgttgaacatggcctactttaaagatgactctagtgcagaagcttgggattattctgcatgggtgcgcatttatgctttatatttagaggagaggctcgaatgtttccgagtgttgaaatatgatgtagaaactgatcctccgaggactaaggatcttgatactgttgctttgcttgatcatctgccaccattgcagcaactcctttttcggcttcttgcttgccagccacaaggagcatcgtcttacaatgttataatccagcatgcactctcgatggttgctttagagagtgttaagatctacactgcgattagtgatggaacaatcaatctggttgacaagttctttgagatgcaaagaaatgatgctgttagggcacttgatgtatacaaaagagcaactaaccaggctgaacgactttcagaattttatgaagtgtgtaaaactatacacattgggcgtggtgagaaattccagaagattgagcagcctccagcgtcattcttgcagactatggaggagtatgtaagagatgctccgacaggtcaaaaagaaaaggctgtactagcgatagaatataaaaaagagccagaggaggaagaaaaaccggcttcacctcctccggctccggagccagaaccggaacaagaacctgagccagaacccgaaccagtgaaagaggaagcacctgaagctgaaccagatttgctgggtctaaatgaaccaaaccctgctgcgactgcgatagaagagcagaatgctttggcactagcaattgttccgatagatgatgttccgaaagctgctcctacctttgaaaatggagtcacaggctgggaactagcccttgtgactgcaccaagttcaaatgagaccgccgttgccccaagcaagaaactggccggtggtctggacttgctgaccctggacagcctctacgacgaggcgaaccggagagcgagccagccggcggcaagctacaacccctgggatgcgaccccggccaccgccgcgcctgtcccgatgctgaccatggcgccggccatgcacgacccgttctacgcctcgaacgggtacgcggcgcctcacggcgtgcagatggcggcgatggcgcagcagcagcaggccttcatgttgcagcagcagatgatgacaatggccccggcgccggcaccggtggtccaccacccgatgcagatgcagcagaaccccgcgaacccgttcggcaaccccttcgcggccgccggcgcgcacccttacggcgccgccgccgccggcatgccgctccacgctggccccggcaacgtctacacggggctgatctag

SEQ ID NO: 2660 - protein, 564 aa, Sorghum bicolor
  misc_feature: Ceres ANNOT ID no. 6025562
  misc_feature (32)..(302): Pfam Id: ANTH Pfam Desc: ANTH domain
  misc_feature (32)..(161): Pfam Id: ENTH Pfam Desc: ENTH domain
  misc_feature (1)..(562): NCBI GI: 51090587 NCBI Desc: clathrin assembly protein ap180 short form-like [oryza sativa (japonica cultivar-group)]
  misc_feature (4)..(554): NCBI GI: 144925059 NCBI Desc: anth [medicago truncatula]
  misc_feature (11)..(511): NCBI GI: 50251206 NCBI Desc: synaptosomal-associated protein 91-like [oryza sativa (japonica cultivar-group)]
  misc_feature (11)..(548): NCBI GI: 52077380 NCBI Desc: phosphoprotein-like [oryza sativa (japonica cultivar-group)]
  misc_feature (5)..(559): NCBI GI: 140067274 NCBI Desc: carbamoyl-phosphate synthase l chain, atp-binding; anth [medicago truncatula]
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
MAVGGTQPVLRKYLGALKDTTTVSLAKVNSDYKELDIAIVKATNHVERPSKEKYIREIFHSISAARPRADVAYCIHALARRLSKTRNWAVALKTLIVIHRALREVDPTFREELINYGRSRSHMLNMAYFKDDSSAEAWDYSAWVRIYALYLEERLECFRVLKYDVETDPPRTKDLDTVALLDHLPPLQQLLFRLLACQPQGASSYNVIIQHALSMVALESVKIYTAISDGTINLVDKFFEMQRNDAVRALDVYKRATNQAERLSEFYEVCKTIHIGRGEKFQKIEQPPASFLQTMEEYVRDAPTGQKEKAVLAIEYKKEPEEEEKPASPPPAPEPEPEQEPEPEPEPVKEEAPEAEPDLLGLNEPNPAATAIEEQNALALAIVPIDDVPKAAPTFENGVTGWELALVTAPSSNETAVAPSKKLAGGLDLLTLDSLYDEANRRASQPAASYNPWDATPATAAPVPMLTMAPAMHDPFYASNGYAAPHGVQMAAMAQQQQAFMLQQQMMTMAPAPAPVVHHPMQMQQNPANPFGNPFAAAGAHPYGAAAAGMPLHAGPGNVYTGLI

SEQ ID NO: 2661 - DNA, 1137 bp, Sorghum bicolor
  misc_feature: Ceres ANNOT ID no. 6025563
  misc_feature: Encodes the peptide sequence at SEQ ID NO 2662
atggcgcgcgggctgcgcggcgtccgcgacgacctctccgagctggggcggcacctgctggacatcgcctgcttcctgcacccgctcctcaacccggcgcacaccgactcgccgccgccaaccccgacgggcccgggcccgcgccaccgccgcgcgcgccgctcaccgtccccgcacccgccgtcgtccccgtcgctcctcgcgggcatcctctccgacctcgccgagatcggcggctccttccgcggcggcttctctggcgcagccgccgccgccccgtcctcgccgccgccgcccgctgcggtcgagtcgcagcaggccgccgcgtccccgccttcgcctgcggctgctgccgaccagatcgcagttgatgtcgtgggagcagcgcgtgccctcgccgcgcgccccgaggcgtggatcgacttccccgtgctcgccctagatgaggattctgtaatctctgatatccaaagagatcatatggaatccattgaaaaacttgttccagatttagcatctctacggggtaggctctgtccttcttacatggatgaagacatattctggaagatttactttaggttgcttgagtcaaacataattgagcatagttctgaggaagatacccagagtgtgccaaattctgtacatcacaacaatgagatagagtcagattctccacctcacgtctgtgagatagaaagtgtgaaaagcaaccaagaagggtatcaatcttcggatggtcgtgctttgcccaagacaagatccgagcgaagcattgaccaatgggtatttgcaaagtcgaaatctgaggaaagcatggatcagtggtctgaaataccttcagatgtggaatccttcagagaaggtaaaagatacctcagtagcgaggagctgagcgacgttgatagtgccaacgtcgttgtcatggacaaatacatggattcgcttctctcggaccggaggcacctcccctatgctagctcctcagtgcgccaggattcagtcagacgaaaacctgcttcatccactgattacagccatcggcctccacagccaactccacctgcatcactgtcaaagaaggaatcatgggatgtcattgaagactcggagtttgatatacttgacagttag

SEQ ID NO: 2662 - protein, 378 aa, Sorghum bicolor
  misc_feature: Ceres ANNOT ID no. 6025563
  misc_feature (140)..(206): Pfam Id: BSD Pfam Desc: BSD domain
  misc_feature (1)..(337): NCBI GI: 115466700 NCBI Desc: os06g0175400 [oryza sativa (japonica cultivar-group)]
  misc_feature (7)..(227): NCBI GI: 115440155 NCBI Desc: os01g0766600 [oryza sativa (japonica cultivar-group)]
  misc_feature (55)..(242): NCBI GI: 115485895 NCBI Desc: os11g0557300 [oryza sativa (japonica cultivar-group)]
  misc_feature (153)..(205): NCBI GI: 6573740 NCBI Desc: f20b24.15 [arabidopsis thaliana]
  misc_feature (55)..(206): NCBI GI: 144925057 NCBI Desc: bsd [medicago truncatula]
MARGLRGVRDDLSELGRHLLDIACFLHPLLNPAHTDSPPPTPTGPGPRHRRARRSPSPHPPSSPSLLAGILSDLAEIGGSFRGGFSGAAAAAPSSPPPPAAVESQQAAASPPSPAAAADQIAVDVVGAARALAARPEAWIDFPVLALDEDSVISDIQRDHMESIEKLVPDLASLRGRLCPSYMDEDIFWKIYFRLLESNIIEHSSEEDTQSVPNSVHHNNEIESDSPPHVCEIESVKSNQEGYQSSDGRALPKTRSERSIDQWVFAKSKSEESMDQWSEIPSDVESFREGKRYLSSEELSDVDSANVVVMDKYMDSLLSDRRHLPYASSSVRQDSVRRKPASSTDYSHRPPQPTPPASLSKKESWDVIEDSEFDILDS

SEQ ID NO: 2663 - DNA, 666 bp, Sorghum bicolor
  misc_feature: Ceres ANNOT ID no. 6025568
  misc_feature: Encodes the peptide sequence at SEQ ID NO 2664
atggcgatcctgtacgcgctggtggcgcgcggcacggtggtgctggcggagcacagcgcggcggccaccaacgcgggcgccatcgcgcgccaggtcctcgagcgcctccccgacggcggcgccgacagccacgtctcctacacgcaggaccgctacgtcttccacgccaagcgcaccgacggcatcaccgcgctctgcatggccgacgactccgccggaagacggattcccttcgcatttttggaagatattcacggaaggtttgtcaagacatatggccgggctgcgctgacggctcttgcatatgcaatgaatgatgaattctcaagggtcttgagccaacaaatggactactattcaaatgaccctaatgcagatagaataaaccgcatgagaggtgaaatcaatcaggtccgtagtgttatgattgataacattgataaggtccttgaaagaggtgatcgtttggaactgctggttgacaagactgcgaatatgcaaggaaatacagttcgattcaaaagacaagctcggcggttcagaaacactacttggtggagaaatgtcaaactcacggccgcattgatacttctcctcctggtaataatatatgtcgttcttgtgttcatgtgccatggtttcaccctaccaacttgcataaggtaa

SEQ ID NO: 2664 - protein, 221 aa, Sorghum bicolor
  misc_feature: Ceres ANNOT ID no. 6025568
  misc_feature (124)..(212): Pfam Id: Synaptobrevin Pfam Desc: Synaptobrevin
  misc_feature (1)..(220): NCBI GI: 21593706 NCBI Desc: synaptobrevin-like protein [arabidopsis thaliana]
  misc_feature (1)..(219): NCBI GI: 92874038 NCBI Desc: longin-like [medicago truncatula]
  misc_feature (1)..(221): NCBI GI: 144925056 NCBI Desc: longin-like [medicago truncatula]
  misc_feature (1)..(219): NCBI GI: 9757817 NCBI Desc: synaptobrevin-like protein [arabidopsis thaliana]
  misc_feature (1)..(219): NCBI GI: 126009434 NCBI Desc: synaptobrevin-like protein [brassica juncea]
  misc_feature: Useful for making plants with modulated heat sensitivity
  misc_feature: Useful for making plants with modulated heat sensitivity
  misc_feature: GREAT-hit functional homolog of the protein sequence given in SEQ ID NO 13180
  misc_feature: Useful for making plants with modulated heat sensitivity
  misc_feature: Functional homolog of the protein sequence given in SEQ ID NO 13180
MAILYALVARGTVVLAEHSAAATNAGAIARQVLERLPDGGADSHVSYTQDRYVFHAKRTDGITALCMADDSAGRRIPFAFLEDIHGRFVKTYGRAALTALAYAMNDEFSRVLSQQMDYYSNDPNADRINRMRGEINQVRSVMIDNIDKVLERGDRLELLVDKTANMQGNTVRFKRQARRFRNTTWWRNVKLTAALILLLLVIIYVVLVFMCHGFTLPTCIR

SEQ ID NO: 2665 - DNA, 738 bp, Sorghum bicolor
  misc_feature: Ceres ANNOT ID no. 6025591
  misc_feature: Encodes the peptide sequence at SEQ ID NO 2666
atggcgcctctcctcctccttttcctcctcggcagcatctgcgccctcttctccctcaccacctcctcgcgcgccagcggtaagaagagcgacggcaaggagcccagatgcagggacggctgcgtgccggaggagacgacgcagcagcagcaggaggaggaggaagggaagaagaagcaggcgcgggccgacccggagaaggacctgggcatcgtcttctccacgttcgaccacgacggcgacggcttcatcacggcggtcgagctggaggagtcgctgcgccgcctcggcatcgccgtgtccgccgacgaggccgcggccatggtcgcgcgcgtcgacgccaacagcgacgggctcatcgacatccacgagttccgcgagctctacgactccatacccaagaagaggaagcaccagcaccctgccgccgatttcagtggggcggcaagggaggtgccggttgagggcgacgacgaagaggccgagggggaggaggaggatgaggagagggacctgcgggaggcgttcgacgtgttcgacggcaacaaagacgggctcatctccgccgaggagctcggcaccgtgctgggctcgctcggcctgcgccgccagggcaacggccggaccgccgtcgccgactgccgcgacatgatacgcctcgtcgacagcgacggcgacggcatggtgtcctttgaggagttcaagcgcatgatgaccgtcgtcaacgtcaaggcctag

SEQ ID NO: 2666 - protein, 245 aa, Sorghum bicolor
  misc_feature: Ceres ANNOT ID no. 6025591
  misc_feature (171)..(199): Pfam Id: efhand Pfam Desc: EF hand
  misc_feature (213)..(241): Pfam Id: efhand Pfam Desc: EF hand
  misc_feature (1)..(241): NCBI GI: 55773691 NCBI Desc: calmodulin-like protein [oryza sativa (japonica cultivar-group)]
  misc_feature (68)..(238): NCBI GI: 115487906 NCBI Desc: os12g0228800 [oryza sativa (japonica cultivar-group)]
  misc_feature (169)..(239): NCBI GI: 6901652 NCBI Desc: calcium-binding protein [olea europaea]
  misc_feature (40)..(245): NCBI GI: 116643154 NCBI Desc: ca2+-binding protein [citrus sinensis]
  misc_feature (66)..(206): NCBI GI: 140067900 NCBI Desc: parvalbumin [medicago truncatula]
MAPLLLLFLLGSICALFSLTTSSRASGKKSDGKEPRCRDGCVPEETTQQQQEEEEGKKKQARADPEKDLGIVFSTFDHDGDGFITAVELEESLRRLGIAVSADEAAAMVARVDANSDGLIDIHEFRELYDSIPKKRKHQHPAADFSGAAREVPVEGDDEEAEGEEEDEERDLREAFDVFDGNKDGLISAEELGTVLGSLGLRRQGNGRTAVADCRDMIRLVDSDGDGMVSFEEFKRMMTVVNVKA

SEQ ID NO: 2667 - DNA, 1374 bp, Sorghum bicolor
  misc_feature: Ceres ANNOT ID no. 6025608
  misc_feature: Encodes the peptide sequence at SEQ ID NO 2668
atggcggcgagcgcgcgggatagcgcggatgcggcggagcgagttgtcgatgaccacgacggttgggtgtcggacggcgagatggacgtggagatggatgtggaaggcgagttccaagacctcgacgccgaccggagggacggcggcgcggatggtgatgatgagtacttgctgctcactaggataagggacacgtcggcagctgaagcaagggcaggaaaggatatacaaggtataccatgggagaggatacacatagccaggcaagattaccgaaaagctaggttggaacagtataagaactatgaaaatttccctcaatcaggagagctcatggataagttgtgcaagcaagtggagaagagcagcaagtattatgagtttcagcacaacacacgatcagtgaagccatcaattctccattttcagcttaggaatttgctatgggcaacctcgaagcatgatgtctatttcatgtcaaattctacagtaagccactggtcagcattgtctcacaaattatcagaggttctcgacttctctgggcacgttgctccagcggagaagcatcctggcagtttactagaaggtttctctggggttcaagttagcacacttgctgtgaatgagggtttgttggtagctggtggttttcaaggagaactaattggcaaggatttggaaggccgtaatgtaaaattctgtgcaaggacaactttgagtgacaatgctataacaaacgccatagatatacacagatcgacaagtggaagcttgcgcattacagtatctaacaacgattgtggtgttcgtgaatatgatatggagagatttcagctcttgaaccactaccgttataactggccggttaatcacacatccgtgagcccggataagaaacttttggctgtggttggagatgatcgggatgctcttcttgtggattcacgaaatggaaaggtaacctctaccctagttggccatctggactactcatttgctacggcatggcacccggatagccagacctttgcgaccgggaaccaggacaaaacctgccgcatctgggacacccgcaacttgtcgacctcgcttgcggttttgcggggcaacatcggtgcgatccgttgcatccgctactcctccgacgggcggttcctggtgttctcggagcctgccgactttgttcatgtgtacagcgtggcagcagactacaagaaacgacaagagatcgatttctttggtgaggtgtctgggatcacgctcagcccggacgatgagtccctgttcgtcggagtgtgcgaccgtgtctatgccagcctgttgcagtacaggatgatccatgcattcgactatcttgactcgtacgtgtga

SEQ ID NO: 2668 - protein, 457 aa, Sorghum bicolor
  misc_feature: Ceres ANNOT ID no. 6025608
  misc_feature (319)..(357): Pfam Id: WD40 Pfam Desc: WD domain, G-beta repeat
  misc_feature (79)..(457): NCBI GI: 27948448 NCBI Desc: gamyb-binding protein [hordeum vulgare subsp. vulgare]
  misc_feature (17)..(455): NCBI GI: 18423837 NCBI Desc: wd-40 repeat family protein [arabidopsis thaliana]
  misc_feature (32)..(456): NCBI GI: 92880690 NCBI Desc: wd-40 repeat [medicago truncatula]
  misc_feature (17)..(455): NCBI GI: 21536732 NCBI Desc: wd-repeat protein-like [arabidopsis thaliana]
  misc_feature (17)..(455): NCBI GI: 9758639 NCBI Desc: wd-repeat protein-like [arabidopsis thaliana]
  misc_feature: The sequence is a functional homolog of SEQ ID NO. 502 in the 11/188,298 US application
MAASARDSADAAERVVDDHDGWVSDGEMDVEMDVEGEFQDLDADRRDGGADGDDEYLLLTRIRDTSAAEARAGKDIQGIPWERIHIARQDYRKARLEQYKNYENFPQSGELMDKLCKQVEKSSKYYEFQHNTRSVKPSILHFQLRNLLWATSKHDVYFMSNSTVSHWSALSHKLSEVLDFSGHVAPAEKHPGSLLEGFSGVQVSTLAVNEGLLVAGGFQGELIGKDLEGRNVKFCARTTLSDNAITNAIDIHRSTSGSLRITVSNNDCGVREYDMERFQLLNHYRYNWPVNHTSVSPDKKLLAVVGDDRDALLVDSRNGKVTSTLVGHLDYSFATAWHPDSQTFATGNQDKTCRIWDTRNLSTSLAVLRGNIGAIRCIRYSSDGRFLVFSEPADFVHVYSVAADYKKRQEIDFFGEVSGITLSPDDESLFVGVCDRVYASLLQYRMIHAFDYLDSYV

SEQ ID NO: 2669 - DNA, 2853 bp, Sorghum bicolor
  misc_feature: Ceres ANNOT ID no. 6025610
  misc_feature: Encodes the peptide sequence at SEQ ID NO 2670
atgctgaccgggcgggagagcctggtccgcctcatcggccggcgccgccgctccgctctcccctcctcgctcgccgacgatgtgggcggctcgggagaagcggctggagctgaggctggttcgacgtctggaggaagcggcgtcgtcggcctgggcgcggagtgggtggtctgccccgtctgcggcgactcgatccgagggtccgactactgcgtcaacactcacctcgatatgtgccttacaagaggaaccaaaaggaagttaacacagagcacccttcttaatttcagattcagtaaaaaggtttccgctgagcctacagcaaacaatttgaacaatgagatcgagacagaaaatatgaaacagattgttgcagatttgtcgagtgaccaagcattctttgcatcagatagtgagattgggagttcaaagtccggcactactatttcatcgcctacctgtctgaatggctcacttggcacttctgagactattacgtcctacacaccttcaaatattgtcttaccaaatgtaaaggatgctgtaaatgatggcacaggggaacttccaacagtggcaacttcttgcagttttgatgaatgcacagttatggattctagcaccattgtagcggttgacactgtcatagttggccggaggttccatgagaacattgaattgagagaagattcagtcattacctttctaagagatcctctgaatgctaaggaccctgatgctataaaggtgctttatgcagcgtctgaatatgaggagatacttggatacttgcctcgagatcttgctaaagttttggctcctttaatggacaaacattacgttgaatgcgagggatttgtggttggtttgcatgaacaacactttggcaatgttcccatccagattactatccagaaatgtaaagctgacagtcagagaaatgatgatacatattattgccagtccttatgggaaaatttcgttagcactgttaaaagtgaaaattttcggcaacctcgcaatgcaagatatcagataaattttaatttgatgatagctgatgttattgctacccatgcacatgttcttatcgatgtagaaaaaacatttttagcttcttttaagtcattatcagatgatgggcaacatctttttgttaggatctacactcgaaaagggccatggttccggaagagcagcatctcatatcatgaaatatcagatctggagcatgcagtcatggagttgaagttggcaggttatattgacatgctttcttgcactgttgatccttctgaatatgatattaaggagattcttgatgtgttaactgttcctgaaatgaaagaaattctcaaggagcttcctaaggataacacaagctgcacacgtcgacatgagcttgttagcacccttctgtcttcatatcataatggtacctgtgcatcattaccaaagcgaatcctaaaatggactggaacctgtataagaatttctaagatggcagatgaacttctgtggcgtatccagaggctcttttttctaaatggtgatcaagatctttcttcctttctattagtggagtttggtgttgtgaagtttccagactatgcctgcagtatctctcaccacatttttcaacaaagaagtgatctacttgagtatgaagatgctattcgagttgctcaggtgatggatgaatccctcgataataataacatggacctggtgacaagatgcatcgatttatctgagaatcgattatgcactatgccaaaacaagaaaatgcaactccacctaaacatctcccatcattcttttctcgcttttcagcttcctgggtctattcaaaaatactcacattaggtgtctctgtttatgaacgagaccgcaggtatgaagatgcaataaggattctaaagatactacttagtaaagttgcttgtgatagacggcgaggatattggacattgaggctatccgttgatttggagcatatgggtcgtccaaatgagagcctttccacagctgaagaaggagcaattgatccatgggtccgtgctggctcaaagttcgcgctgcaaaggagagtgctgcgtttaagcaaacctccacgacgctggaaagttcccagttatgctgattatgttaagagaaatataagagaggtaagtattgaaggaaggccgttaaattgtgagacaggagcaaagaatgtattttatggttacgatggggaactttgtggggtagaacagttggctttacaatattatgctgatgaaggtggtggttggcaaggtacccattcagaaggtgacatttggatgactatctttggccttctaatgtgggatgtaatgttttcagacatacaagacgttttccagtctaaattccagacagccccccttgatctggaaacagatgatttttacaaatctaggaaggacattgcagaatctcagttgaggaagatacaagacggaatggctgaagagatgctaatcagctcctgggaactgcatcaggggacatcctgccaaggtgttaactgggtccgttattcgttaactgatctgcgagctgtcgttgcatgcattggtggccatcgcttggcatcgctcctccgccatctagcggttgattacaggagctggtcgagtggaatgcctgatctgctgctatggcgtttccttgatgaaagaggtggcggtgaggctaaacttgtggaagtcaaaggaccaagggaccagctgtcagagcaacagcgtgcatggattcttgttctcatggattttggattcgatgtggaagtttgcaaagtaagcccggttaccaagcggagatag

SEQ ID NO: 2670 - protein, 950 aa, Sorghum bicolor
  misc_feature: Ceres ANNOT ID no. 6025610
  misc_feature (827)..(945): Pfam Id: VRR_NUC Pfam Desc: VRR-NUC domain
  misc_feature (209)..(309): Pfam Id: HIRAN Pfam Desc: HIRAN domain
  misc_feature (204)..(947): NCBI GI: 8778959 NCBI Desc: contains similarity to kiaa1018 protein from homo sapiens gbab023235. [arabidopsis thaliana]
  misc_feature (517)..(946): NCBI GI: 60685229 NCBI Desc: kiaa1018 protein [homo sapiens]
  misc_feature (517)..(946): NCBI GI: 119581661 NCBI Desc: kiaa1018 [homo sapiens]
  misc_feature (517)..(946): NCBI GI: 58257674 NCBI Desc: kiaa1018 protein [homo sapiens]
  misc_feature (594)..(949): NCBI GI: 5441488 NCBI Desc: spbc146.06c [schizosaccharomyces pombe]
MLTGRESLVRLIGRRRRSALPSSLADDVGGSGEAAGAEAGSTSGGSGVVGLGAEWVVCPVCGDSIRGSDYCVNTHLDMCLTRGTKRKLTQSTLLNFRFSKKVSAEPTANNLNNEIETENMKQIVADLSSDQAFFASDSEIGSSKSGTTISSPTCLNGSLGTSETITSYTPSNIVLPNVKDAVNDGTGELPTVATSCSFDECTVMDSSTIVAVDTVIVGRRFHENIELREDSVITFLRDPLNAKDPDAIKVLYAASEYEEILGYLPRDLAKVLAPLMDKHYVECEGFVVGLHEQHFGNVPIQITIQKCKADSQRNDDTYYCQSLWENFVSTVKSENFRQPRNARYQINFNLMIADVIATHAHVLIDVEKTFLASFKSLSDDGQHLFVRIYTRKGPWFRKSSISYHEISDLEHAVMELKLAGYIDMLSCTVDPSEYDIKEILDVLTVPEMKEILKELPKDNTSCTRRHELVSTLLSSYHNGTCASLPKRILKWTGTCIRISKMADELLWRIQRLFFLNGDQDLSSFLLVEFGVVKFPDYACSISHHIFQQRSDLLEYEDAIRVAQVMDESLDNNNMDLVTRCIDLSENRLCTMPKQENATPPKHLPSFFSRFSASWVYSKILTLGVSVYERDRRYEDAIRILKILLSKVACDRRRGYWTLRLSVDLEHMGRPNESLSTAEEGAIDPWVRAGSKFALQRRVLRLSKPPRRWKVPSYADYVKRNIREVSIEGRPLNCETGAKNVFYGYDGELCGVEQLALQYYADEGGGWQGTHSEGDIWMTIFGLLMWDVMFSDIQDVFQSKFQTAPLDLETDDFYKSRKDIAESQLRKIQDGMAEEMLISSWELHQGTSCQGVNWVRYSLTDLRAVVACIGGHRLASLLRHLAVDYRSWSSGMPDLLLWRFLDERGGGEAKLVEVKGPRDQLSEQQRAWILVLMDFGFDVEVCKVSPVTKRR

SEQ ID NO: 2671 - DNA, 585 bp, Sorghum bicolor
  misc_feature: Ceres ANNOT ID no. 6025612
  misc_feature: Encodes the peptide sequence at SEQ ID NO 2672
atggtgatggtgtcaggcggtggggggaacgcgtgggcgaaggagatgaccgtccgccgcaggatagccagcatattcaataagacgcaggaacacttccctagtctgaaggactacaacgattatctggaagaagttgaggatatgactttcaacctgatcgaagggatagatgtcgaggtgattgaagcaaaaattgcaagataccaacaggaaaatgtggagcagatatacttgtccagagctaaaagggcggaagatcttgcagcagcacttaaagcaagcaggatgaaccctataaaggccgaggtcaatgatacggctgctgggagttctcagggtattagtggtggggcaggagttcagggccagtatgcacctgccgctgttcttgggggagtggctcagcctcgccccacaggtatggctccccaactaatgggcagtcggtcagatcctcttcaaggagatgacgaggagaccaggagactacgtgcagagcgagtagcacgagctggtggatggactgctgaattgagtaagagaagagcactggaggaggcgtttagcgccatattcatctag

SEQ ID NO: 2672 - protein, 194 aa, Sorghum bicolor
  misc_feature: Ceres ANNOT ID no. 6025612
  misc_feature (14)..(193): Pfam Id: MAT1 Pfam Desc: CDK-activating kinase assembly factor MAT1
  misc_feature (10)..(194): NCBI GI: 92877889 NCBI Desc: cdk-activating kinase assembly factor (mat1) [medicago truncatula]
  misc_feature (26)..(194): NCBI GI: 7269983 NCBI Desc: puative protein [arabidopsis thaliana]
  misc_feature (14)..(96): NCBI GI: 7444286 NCBI Desc: cyclin g1 interacting protein - human
  misc_feature (14)..(96): NCBI GI: 119601194 NCBI Desc: menage a trois homolog 1, cyclin h assembly factor (xenopus laevis), isoform cra_b [homo sapiens]
  misc_feature (14)..(89): NCBI GI: 1708933 NCBI Desc: cdk-activating kinase assembly factor mat1 (ring finger protein mat1) (menage a trois) (cdk7/cyclin h assembly factor)
MVMVSGGGGNAWAKEMTVRRRIASIFNKTQEHFPSLKDYNDYLEEVEDMTFNLIEGIDVEVIEAKIARYQQENVEQIYLSRAKRAEDLAAALKASRMNPIKAEVNDTAAGSSQGISGGAGVQGQYAPAAVLGGVAQPRPTGMAPQLMGSRSDPLQGDDEETRRLRAERVARAGGWTAELSKRRALEEAFSAIFI

SEQ ID NO: 2673 - DNA, 1770 bp, Sorghum bicolor
  misc_feature: Ceres ANNOT ID no. 6025613
  misc_feature: Encodes the peptide sequence at SEQ ID NO 2674
atggcgcttgcggttcgcctcatcggccgccgccggctcctcccgccgcctctcgccgccgccgttgctcacctctctgctgcttcccagagcccgtgctgccaccacccacttcctatccccgcgctcccgttgccccctcgtgagctccctccttttgctttccattcgcgaagcttctcgtggtactcccgctccgggtccgggtctggttccagtcccgtcaccgctgccgcggacgctcccggagaggatgtatacaccgagaaggaaagcgtgtacttggatggcgtgacaatcgttgatgacggggaaggggtcgccagcggagcgggtgctgcggcggatgccgtgggaggtgccgccggcgccacggccgacggcgttgggggagtgtcggaattggctgttagcacaattttggacctcatggacgggttccatagcctcaccggactgccgtggtggatgacaatctccttttctactgtggccatgagactgttgatacttcctgccctcatagtgcagcttcagaagactgctaaaattggtgaagtattccgaagattgtccacttcattacccactcctcagcctggaaataacttccgtgaagagtatgctttgttccagaagaaaaagaaggagcttggttgtccctcatttctttggaattttgcctatttttcggtacagttcccttgctttattctttggatgatgagtatacggagcatgtgcttgaataatcaccctggatttgataatggtgggattctgtggttccataacttgactgagtttccacatggcactttaggtcccacctttcctatcttagttgctggtctgcattacctaaatgttcagggctcccagatcaaggatcatccaggaatttttggcttgctggctaagtactatagaatataccttgatgtcctgactatccctttgtttcttattgcatacgtggttcctcagggaagcctggtctactggactacaaatggtttattttctgtagctcagcaattgttcttgagaaatgatgctttccgcaagctgttgggattgccggatactagagcccacgttggttacagagcagaaaagtcacctcttgagaggacacagctagaagatgctgacttgcaaatgaaatcgatgtcttctgataagggaactgccagtgagagtacaactcctaattttgcagtggaaagtttggaaggaaatatatctgtgtccagctcacctgaggagctacttgaacaagcattacattatctggggactggctgccgagatcaagcgcttccactgatcaggacagcagtagagagaaacccagatctgtctacagcgttgattgcaatgggacaaaccctgttctcaaataaattgtttcctgaagctgcagtttgttttgaacatgctataccaaagattcaagaagatgatcctcttctcgtgcttgcatattttggggcaggtctttcaaacgagcgtcagggggataatgagacggcaatcaaactcctgcagagattagcagagctcaaggaacccaaaaagcccatcaacaaaacctgctacttccaagggatgcttactttgggaagtatattatctagagaaggccggaattctgaggctgccaaatacctgcggatggctattgcttatgatgatcctgctgtagaaagacttcttaaagaatgcgaggaaggaatggatgatcaaccaaagccagaggagaaatga

SEQ ID NO: 2674 - protein, 589 aa, Sorghum bicolor
  misc_feature: Ceres ANNOT ID no. 6025613
  misc_feature (155)..(354): Pfam Id: 60KD_IMP Pfam Desc: 60Kd inner membrane protein
  misc_feature (258)..(588): NCBI GI: 55773648 NCBI Desc: inner membrane albino3-like protein [oryza sativa (japonica cultivar-group)]
  misc_feature (133)..(578): NCBI GI: 38372237 NCBI Desc: inner membrane albino3-like protein 2, chloroplast precursor (ath5)
  misc_feature (241)..(581): NCBI GI: 140040116 NCBI Desc: helix-turn-helix, fis-type [medicago truncatula]
  misc_feature (458)..(582): NCBI GI: 32815947 NCBI Desc: at3g44360 [arabidopsis thaliana]
  misc_feature (79)..(362): NCBI GI: 30387505 NCBI Desc: at5g62050 [arabidopsis thaliana]
MALAVRLIGRRRLLPPPLAAAVAHLSAASQSPCCHHPLPIPALPLPPRELPPFAFHSRSFSWYSRSGSGSGSSPVTAAADAPGEDVYTEKESVYLDGVTIVDDGEGVASGAGAAADAVGGAAGATADGVGGVSELAVSTILDLMDGFHSLTGLPWWMTISFSTVAMRLLILPALIVQLQKTAKIGEVFRRLSTSLPTPQPGNNFREEYALFQKKKKELGCPSFLWNFAYFSVQFPCFILWMMSIRSMCLNNHPGFDNGGILWFHNLTEFPHGTLGPTFPILVAGLHYLNVQGSQIKDHPGIFGLLAKYYRIYLDVLTIPLFLIAYVVPQGSLVYWTTNGLFSVAQQLFLRNDAFRKLLGLPDTRAHVGYRAEKSPLERTQLEDADLQMKSMSSDKGTASESTTPNFAVESLEGNISVSSSPEELLEQALHYLGTGCRDQALPLIRTAVERNPDLSTALIAMGQTLFSNKLFPEAAVCFEHAIPKIQEDDPLLVLAYFGAGLSNERQGDNETAIKLLQRLAELKEPKKPINKTCYFQGMLTLGSILSREGRNSEAAKYLRMAIAYDDPAVERLLKECEEGMDDQPKPEEK

SEQ ID NO: 2675 - DNA, 2475 bp, Sorghum bicolor
  misc_feature: Ceres ANNOT ID no. 6025624
  misc_feature: Encodes the peptide sequence at SEQ ID NO 2676
atgtacgtcgtcaaacgggacggccgccaggagacggtgcacttcgacaagatcacggcgcgcctcaagaagctcagctacggcctcagccaggaccactgcgaccccgtcctcgtcgcgcagaaggtctgcgcgggggtctacaagggcgtcaccactagccagctcgatgagctcgccgccgagaccgccgcggccatgaccgcgtcccaccccgactacgcctcgctggcggcgaggattgctgtgtcgaacctgcacaagaacacaaagaagtccttctcggagacgattaaggacatgtacatgcacttcaacgagagatctgggctgatggcacctctagtcgctgaagatgtttatgaaatcatcatgaagaatgctgctcgcttggacagcgagataatttatgatagggatttcgactatgattactttggcttcaaaactctggagaggtcttacctcttgaagcttggtgggaaggttgtcgaaaggccacagcacatgctcatgagggtgtcagtgggtatacacaaggaagacattgagtctgccatcaggacgtaccatctgatgtcccagcgctggtttacacatgcttcacctacccttttcaacgctggcacaccgaggccccaattaagcagctgttttcttatatgcatgaaagatgacagcattgagggaatctatgaaaccctgaaggagtgtgctgtaataagcaaatctgctggaggaattggtgtctcagttcataatatccgtgctactgggagttatattcgaggaacaaatggaacatcgaatggaattgttcctatgttacgcgtctttaatgatactgctcgctatgttgatcagggtggtggcaaaagaaaggaagttcttacaagcttctacaacttaggtgcttttgctgtatacttggagccttggcatgctgatatttttgagttccttgatctgagaaagaaccatgggaaggaggaaaatcgtgcaagggatcttttctatgcgctatgggttcctgatctattcatgcaaagagtccagaataatggagaatggtcattattttgccctaatgaagctccagggttggctgattgctggggtgaggagtttgataatttgtacaagaaatatgagagccaaggcaaggcaaagaaagttgttccagcacagaccctctggtttgacattttgaaggcacaaatagagaccggtacaccatatatgctttacaaggatacttgcaataggaaaagtaatcagcagaatctgggcacaattaaatcgtcaaacttgtgcactgagataattgaatttacaagccctaatgaaactgctgtctgcaacctagcatctattgctttacctcgttttgtccgggaaaagggtgttcctttagagtcccatccatctaagcttgtgggtagcagtgattcaaaaaatagatattttgattttgagaagctagctgaggttacctcaactgttacttacaatcttaacaaaattatcgatattaactactatcctgttgagacagcaaagagatcaaatatgcggcaccggccaattggtataggtgttcaaggcctggcagatactttcatattactgggcatgccatttgattcaccagaggctcaacagttgaacaaggatatatttgaaactatctactatcattctctgaaagcttctgctgaacttgctgctaaagaaggtccctatgaaacatatgaagggagccctgtcagcaagggcattctccaacctgacatgtgggatgtagtgccatctaacagatggaactggccatctctaagggagaccatttctaaagttgggataagaaattctcttcttgttgctccaatgcccactgcttccactagtcagattcttggcaacaatgagtgctttgaaccctacacgtctaatatatacagccgacgggttctaagtggggaatttgttgtggttaacaagcatcttcttcatgatctgactgaaatgggcatttggactcctactctgaaaaaccagataatatatgatgatggttctgtccaaaagatagcagaaataccagatgatcttaaagcaatctacaagactgtctgggagatcaagcagaaaactttagttgatatggcggttgaccgtggatgctatattgaccagagccagagcctcaatgtccacatggagcaagcaaactttgggaagctaacatcacttcacttccatgcttggtccaagggcctgaaaactggaatgtactatctacgcacacgagctgctgctgatgcgatcaagtttacagttgataccacacttctaaaggagaatgggaatgtggtgagtaatggaaagcccacagaggaagacgtagaagctaaaatggcacaaatggtctgttctttgaacaaccgggaagagtgcatggcgtgtggaagctag

SEQ ID NO: 2676 - protein, 824 aa, Sorghum bicolor
  misc_feature: Ceres ANNOT ID no. 6025624
  misc_feature (215)..(771): Pfam Id: Ribonuc_red_lgC Pfam Desc: Ribonucleotide reductase, barrel domain
  misc_feature (141)..(213): Pfam Id: Ribonuc_red_lgN Pfam Desc: Ribonucleotide reductase, all-alpha domain
  misc_feature (1)..(91): Pfam Id: ATP-cone Pfam Desc: ATP cone domain
  misc_feature (1)..(824): NCBI GI: 27261142 NCBI Desc: ribonucleotide reductase large subunit a [glycine max]
  misc_feature (1)..(824): NCBI GI: 4151068 NCBI Desc: ribonucleotide reductase [nicotiana tabacum]
  misc_feature (1)..(824): NCBI GI: 4151066 NCBI Desc: ribonucleotide reductase [nicotiana tabacum]
  misc_feature (1)..(824): NCBI GI: 3661603 NCBI Desc: ribonucleoside-diphosphate reductase large subunit [arabidopsis thaliana]
  misc_feature (1)..(824): NCBI GI: 27261144 NCBI Desc: ribonucleotide reductase large subunit b [glycine max]
  misc_feature (1)..(824): SWISSPROT Homolog: EC 1.17.4.1 Ribonucleoside-diphosphate reductase large subunit
MYVVKRDGRQETVHFDKITARLKKLSYGLSQDHCDPVLVAQKVCAGVYKGVTTSQLDELAAETAAAMTASHPDYASLAARIAVSNLHKNTKKSFSETIKDMYMHFNERSGLMAPLVAEDVYEIIMKNAARLDSEIIYDRDFDYDYFGFKTLERSYLLKLGGKVVERPQHMLMRVSVGIHKEDIESAIRTYHLMSQRWFTHASPTLFNAGTPRPQLSSCFLICMKDDSIEGIYETLKECAVISKSAGGIGVSVHNIRATGSYIRGTNGTSNGIVPMLRVFNDTARYVDQGGGKRKEVLTSFYNLGAFAVYLEPWHADIFEFLDLRKNHGKEENRARDLFYALWVPDLFMQRVQNNGEWSLFCPNEAPGLADCWGEEFDNLYKKYESQGKAKKVVPAQTLWFDILKAQIETGTPYMLYKDTCNRKSNQQNLGTIKSSNLCTEIIEFTSPNETAVCNLASIALPRFVREKGVPLESHPSKLVGSSDSKNRYFDFEKLAEVTSTVTYNLNKIIDINYYPVETAKRSNMRHRPIGIGVQGLADTFILLGMPFDSPEAQQLNKDIFETIYYHSLKASAELAAKEGPYETYEGSPVSKGILQPDMWDVVPSNRWNWPSLRETISKVGIRNSLLVAPMPTASTSQILGNNECFEPYTSNIYSRRVLSGEFVVVNKHLLHDLTEMGIWTPTLKNQIIYDDGSVQKIAEIPDDLKAIYKTVWEIKQKTLVDMAVDRGCYIDQSQSLNVHMEQANFGKLTSLHFHAWSKGLKTGMYYLRTRAAADAIKFTVDTTLLKENGNVVSNGKPTEEDVEAKMAQMVCSLNNREECMACGS

SEQ ID NO: 2677 - DNA, 273 bp, Sorghum bicolor
  misc_feature: Ceres ANNOT ID no. 6025652
  misc_feature: Encodes the peptide sequence at SEQ ID NO 2678
atggatggaatcaaatacgcagtatttatagaaaagagtcttcatttattgggaaagaatcaatatacttttaatgtcgagtcgggattcactaagacagaaataaagcattgggtcgaactcttctttggtgttaaggtagtagttgtgaatagccatcgactaccaggaaagggtagaagaataggacctattctgggacatacaatgcacttcacgaaaatgctcgagttgtctataatgcgaactaaaatggttatggagggagtatga

SEQ ID NO: 2678 - protein, 90 aa, Sorghum bicolor
  misc_feature: Ceres ANNOT ID no. 6025652
  misc_feature (1)..(85): Pfam Id: Ribosomal_L23 Pfam Desc: Ribosomal protein L23
  misc_feature (1)..(76): NCBI GI: 62288908 NCBI Desc: chloroplast 50s ribosomal protein l23
  misc_feature (1)..(76): NCBI GI: 118430429 NCBI Desc: ribosomal protein l23 [hordeum vulgare subsp. vulgare]
  misc_feature (1)..(76): NCBI GI: 118430344 NCBI Desc: ribosomal protein l23 [agrostis stolonifera]
  misc_feature (1)..(76): NCBI GI: 42795533 NCBI Desc: ribosomal protein l23 [oryza sativa (indica cultivar-group)]
  misc_feature (1)..(76): NCBI GI: 75291231 NCBI Desc: chloroplast 50s ribosomal protein l23
MDGIKYAVFIEKSLHLLGKNQYTFNVESGFTKTEIKHWVELFFGVKVVVVNSHRLPGKGRRIGPILGHTMHFTKMLELSIMRTKMVMEGV

SEQ ID NO: 2679 - DNA, 591 bp, Sorghum bicolor
  misc_feature: Ceres ANNOT ID no. 6025654
  misc_feature: Encodes the peptide sequence at SEQ ID NO 2680
atggagctggagctcgggctcgcgctgccaaacccgtaccagtcgccgatggccgccggcggggagctcgtcggtctgctcagcggctcggcgggcgcgtgcgggaagaagagggtgttcggcgacgcgttcggggccgccgccaaggccacgcttcttccgctcttcgtgcacgaggatggtgacggcggcagcggcgaccacgacgatgtcgaccatgatccaagcaacaagaagaagaggctggttgggtggccgccggtgaagtgcgcgcgcaggcggagctgcggcggcggcggtggttacgtgaaggtcaagatggaaggggtggccatcgggcggaaggtggacgtgtccctccacggctcgtaccaggagctgctccgcacgctcgagcgcatgttcccctcggctaaccaacaaggtcatgcagaagaagaggaggtggtggcctcgcacgcagagcgccgccgtcgccatccgtacgtggtcacctacgaggacggcgaaggggactggttgctcgtcggagatgatgtgccgtgggaggtctttgtgaagtcagtgaagcggctcaagatacttgcgtag

SEQ ID NO: 2680 - protein, 196 aa, Sorghum bicolor
  misc_feature: Ceres ANNOT ID no. 6025654
  misc_feature (1)..(197): Pfam Id: AUX_IAA Pfam Desc: AUX/IAA family
  misc_feature (1)..(195): NCBI GI: 75252070 NCBI Desc: auxin-responsive protein iaa20 (indoleacetic acid-induced protein 20)
  misc_feature (1)..(195): NCBI GI: 115466632 NCBI Desc: os06g0166500 [oryza sativa (japonica cultivar-group)]
  misc_feature (1)..(195): NCBI GI: 75261405 NCBI Desc: auxin-responsive protein iaa9 (indoleacetic acid-induced protein 9)
  misc_feature (101)..(195): NCBI GI: 29028860 NCBI Desc: at2g33310 [arabidopsis thaliana]
  misc_feature (101)..(195): NCBI GI: 12083208 NCBI Desc: auxin-regulated protein iaa13 [arabidopsis thaliana]
  misc_feature: The sequence is a functional homolog of SEQ ID NO 1149 in the 10/412,699US patent application
  misc_feature: The sequence is a functional homolog of SEQ ID NO 178 in the 10/412,699US patent application
  misc_feature: The sequence is a functional homolog of SEQ ID NO 1780 in the 10/412,699US patent application
  misc_feature: The sequence is a functional homolog of SEQ ID NO 2008 in the 10/374,780US patent application
  misc_feature: The sequence is a functional homolog of SEQ ID NO 389 in the 11/479,226US patent application
  misc_feature: The sequence is a functional homolog of SEQ ID NO 678 in the 11/479,226US patent application
  misc_feature: The sequence is a functional homolog of SEQ ID NO 736 in the 10/374,780US patent application
  misc_feature: The sequence is a functional homolog of SEQ ID NO 737 in the 10/374,780US patent application
  misc_feature: The sequence is a functional homolog of SEQ ID NO 738 in the 10/374,780US patent application
  misc_feature: The sequence is a functional homolog of SEQ ID NO 739 in the 10/374,780US patent application
  misc_feature: The sequence is a functional homolog of SEQ ID NO 742 in the 10/374,780US patent application
  misc_feature: Useful for making plants with modulated growth and phenotype characteristics
  misc_feature: The sequence is a functional homolog of SEQ ID NO 1149 in the 20040045049 US patent application
  misc_feature: The sequence is a functional homolog of SEQ ID NO 178 in the 20040045049 US patent application
  misc_feature: The sequence is a functional homolog of SEQ ID NO 1780 in the 20040045049 US patent application
  misc_feature: The sequence is a functional homolog of SEQ ID NO 736 in the 20060162006 US patent application
  misc_feature: The sequence is a functional homolog of SEQ ID NO 737 in the 20060162006 US patent application
  misc_feature: The sequence is a functional homolog of SEQ ID NO 738 in the 20060162006 US patent application
  misc_feature: The sequence is a functional homolog of SEQ ID NO 739 in the 20060162006 US patent application
MELELGLALPNPYQSPMAAGGELVGLLSGSAGACGKKRVFGDAFGAAAKATLLPLFVHEDGDGGSGDHDDVDHDPSNKKKRLVGWPPVKCARRRSCGGGGGYVKVKMEGVAIGRKVDVSLHGSYQELLRTLERMFPSANQQGHAEEEEVVASHAERRRRHPYVVTYEDGEGDWLLVGDDVPWEVFVKSVKRLKILA

SEQ ID NO: 2681 - DNA, 684 bp, Sorghum bicolor
  misc_feature: Ceres ANNOT ID no. 6025659
  misc_feature: Encodes the peptide sequence at SEQ ID NO 2682
atggacccggagaagcagcgccagcacgacggcgacggcgacggcgatggcgccgccgcggcggaggcggacatcgagcggctccccgtcgacctcctcgcgcacatcctctccctcctgtcttccttccgcgacctggctgggggagcgagccggaggtggcgctgtgccgtggagcgggcactggcgtcgcggcggcggctgagcttcgcgggccagcgcaccggcaacgacaccgccgcttcacgaagctgctggggctgccatattaccgacgaaggcttgatcaagatttcctccgcggattgcgtcggcaatctgacctccatatcgctctggggattggccggcatcaccgacaagggcgtcgttcatctggtttcaagggcttattctttgcagcacctgaacattggtgggacattcatcacagatgaatccctgtatgcggttgcaaacagctgcacaaatctgaagagcatcatcctgtggagctgccgccacgtgacggaggccgggctggtggcgctggtgaacaagtgccggcggctggagtgcatcaacgtcggcgggatgcgggtgccgccggagagcttcgtgggcctcctctccatcagccccgccctccagatcaggtccatccaccgcatcctcaacgccggcgtcggcgtgcaggtctcttga

SEQ ID NO: 2682 - protein, 227 aa, Sorghum bicolor
  misc_feature: Ceres ANNOT ID no. 6025659
  misc_feature (18)..(224): NCBI GI: 55296142 NCBI Desc: f-box family protein-like [oryza sativa (japonica cultivar-group)]
  misc_feature (18)..(224): NCBI GI: 115466624 NCBI Desc: os06g0166000 [oryza sativa (japonica cultivar-group)]
  misc_feature (90)..(215): NCBI GI: 55562898 NCBI Desc: mgc105998 protein [rattus norvegicus]
  misc_feature (93)..(189): NCBI GI: 6164721 NCBI Desc: f-box protein fbl2 [homo sapiens]
  misc_feature (91)..(189): NCBI GI: 21618736 NCBI Desc: f-box and leucine-rich repeat protein 2 [homo sapiens]
MDPEKQRQHDGDGDGDGAAAAEADIERLPVDLLAHILSLLSSFRDLAGGASRRWRCAVERALASRRRLSFAGQRTGNDTAASRSCWGCHITDEGLIKISSADCVGNLTSISLWGLAGITDKGVVHLVSRAYSLQHLNIGGTFITDESLYAVANSCTNLKSIILWSCRHVTEAGLVALVNKCRRLECINVGGMRVPPESFVGLLSISPALQIRSIHRILNAGVGVQVS

SEQ ID NO: 2683 - DNA, 786 bp, Sorghum bicolor
  misc_feature: Ceres ANNOT ID no. 6025660
  misc_feature: Encodes the peptide sequence at SEQ ID NO 2684
atggccaccacggcgaccgaggcggccaaggccgcgccggcggagcaggccaacggcaacgccaacggcgagcagaagacgcgccactccgaggtcggacacaagagcctgctcaagagcgacgacctctaccagtacatcctggacacgagcgtgtacccgcgggagccggagagcatgaaggagctccgcgagatcaccgccaagcacccatggaacctgatgacgacctccgccgacgaggggcagttcctcaacatgctcatcaagctcatcggcgccaagaagaccatggagatcggcgtctacaccggctactccctcctcgccaccgcgctcgctctcccggaggacggcacgatcttggccatggacatcaaccgcgagaactacgagctgggcctgccctgcatcgagaaggccggcgtcgcccacaagatcgacttccgcgagggccccgcgctccccgtcctcgacgacctcatcgccgacgagaagaaccacgggtcgttcgacttcgtcttcgtggacgccgacaaggacaactacctcaactaccacgaccggctgctcaagctggtgaagctggggggcctcatcggctacgacaacacgctgtggaacggctctgtcgtgctccccgacgacgcccccatgcgcaagtacatccgcttctaccgcgacttcgtgctcgtcctcaacaaggcgctcgccgccgacgagcgcgtcgagatctgccagctccccgtcggcgacggcgtcaccctctgccgccgcgtcaagtga

SEQ ID NO: 2684 - protein, 261 aa, Sorghum bicolor
  misc_feature: Ceres ANNOT ID no. 6025660
  misc_feature (48)..(260): Pfam Id: Methyltransf_3 Pfam Desc: O-methyltransferase
  misc_feature (1)..(261): NCBI GI: 37221605 NCBI Desc: caffeoyl-coa 3-o-methyltransferase 1 [zea mays]
  misc_feature (1)..(261): NCBI GI: 5101868 NCBI Desc: caffeoyl coa o-methyltransferase [zea mays]
  misc_feature (1)..(261): NCBI GI: 32347473 NCBI Desc: caffeoyl coa 3-o-methyltransferase [zea mays]
  misc_feature (1)..(261): NCBI GI: 32347487 NCBI Desc: caffeoyl coa 3-o-methyltransferase [zea mays]
  misc_feature (1)..(261): NCBI GI: 32347461 NCBI Desc: caffeoyl coa 3-o-methyltransferase [zea mays]
  misc_feature (1)..(261): SWISSPROT Homolog: EC 2.1.1.104 Caffeoyl-CoA O-methyltransferase 1
  misc_feature: Useful for making plants with altered Lignin content
  misc_feature: Useful for making plants with altered cell wall content and/or composition
  misc_feature: GREAT-hit functional homolog of the protein sequence given in SEQ ID NO 13248
  misc_feature: Functional homolog of the protein sequence encoded by LOCUS at1g24735
  misc_feature: Functional homolog of the protein sequence encoded by LOCUS at1g67980
  misc_feature: Functional homolog of the protein sequence encoded by LOCUS at1g67990
  misc_feature: Functional homolog of the protein sequence encoded by LOCUS at4g26220
  misc_feature: Functional homolog of the protein sequence encoded by LOCUS at4g34050
  misc_feature: Useful for making plants with altered carbohydrate content
  misc_feature: Functional homolog of the protein sequence given in SEQ ID NO 13799
  misc_feature: Useful for making plants with altered cell wall content and/or composition
  misc_feature: Useful for making plants with altered lignin content
  misc_feature: Functional homolog of the protein sequence given in SEQ ID NO 13248
MATTATEAAKAAPAEQANGNANGEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCIEKAGVAHKIDFREGPALPVLDDLIADEKNHGSFDFVFVDADKDNYLNYHDRLLKLVKLGGLIGYDNTLWNGSVVLPDDAPMRKYIRFYRDFVLVLNKALAADERVEICQLPVGDGVTLCRRVK

SEQ ID NO: 2685 - DNA, 975 bp, Sorghum bicolor
  misc_feature: Ceres ANNOT ID no. 6025670
  misc_feature: Encodes the peptide sequence at SEQ ID NO 2686
atggacgaggcggcggtcgacgacttgatccggcggctcctcgaggcccgcggcgggcgcaccccgcggaacgcgcaggtgaccgacgccgacatccggcgcctctgcgccgccgccaaggatgtgttcctccaacaacccaacctcctggagctcgaggcccccatcaagatatgcggggatgtccatggacaatattcagatcttcttcgattatttgagtatggtggctatccaccagacgcaaattatctgttcttgggtgactatgttgatagggggaaacagagcatagaaacaatatgccttctgttggcgtacaagttaaagtatccagaaaacttcttcctcctcaggggaaaccatgaatgcgcctcgatcaaccggatatatgggttctttgatgagtgcaagaggagattcaatgtccgtatctggaagatattcactgagtgctttaattgcctccctgtggctgcgcttattgatgataagatcttttgcatgcatggggggttgtctcctgaacttaagaacatggatcagatacgtaacatttctcgtccggtggatgttcctgacgttggtctcctttgtgatttgctatggtcggaccccgagaaagagcttgatgggtggggtgagaatgacaggggtgtttcctacacatttggagctgatatagttgccgagttccttcagaaacatgatctagatttgatctgcagggcccaccaggttgtggaggatgggtatgaattttttgcaaaccgccagcttgtaacaatattctcagcaccaaactactgtggagagttcgacaatgctggtgcactgatgagcattgatgactccctagtatgttcgttccagattctcaagccttcagaaaagaaaggaaaagcaggaacttccaacatgtcaaaacctggaacacctcccaggaagataaaaataagtgttactcgaatttag

SEQ ID NO: 2686 - protein, 324 aa, Sorghum bicolor
  misc_feature: Ceres ANNOT ID no. 6025670
  misc_feature (54)..(249): Pfam Id: Metallophos Pfam Desc: Calcineurin-like phosphoesterase
  misc_feature (1)..(316): NCBI GI: 114213454 NCBI Desc: catalytic subunit of protein phosphatase 1 [vicia faba]
  misc_feature (1)..(316): NCBI GI: 575672 NCBI Desc: potentially catalitic subunit of the ser /thr protein phosphatase 1 [medicago sativa subsp. x varia]
  misc_feature (1)..(317): NCBI GI: 7267823 NCBI Desc: protein phosphatase type 1 pp1bg [arabidopsis thaliana]
  misc_feature (1)..(316): NCBI GI: 21554190 NCBI Desc: protein phosphatase type 1 pp1bg [arabidopsis thaliana]
  misc_feature (1)..(316): NCBI GI: 829255 NCBI Desc: protein phosphatase type 1 [arabidopsis thaliana]
  misc_feature (1)..(316): SWISSPROT Homolog: EC 3.1.3.16 Serine/threonine-protein phosphatase PP1
MDEAAVDDLIRRLLEARGGRTPRNAQVTDADIRRLCAAAKDVFLQQPNLLELEAPIKICGDVHGQYSDLLRLFEYGGYPPDANYLFLGDYVDRGKQSIETICLLLAYKLKYPENFFLLRGNHECASINRIYGFFDECKRRFNVRIWKIFTECFNCLPVAALIDDKIFCMHGGLSPELKNMDQIRNISRPVDVPDVGLLCDLLWSDPEKELDGWGENDRGVSYTFGADIVAEFLQKHDLDLICRAHQVVEDGYEFFANRQLVTIFSAPNYCGEFDNAGALMSIDDSLVCSFQILKPSEKKGKAGTSNMSKPGTPPRKIKISVTRI

SEQ ID NO: 2687 - DNA, 2580 bp, Sorghum bicolor
  misc_feature: Ceres ANNOT ID no. 6025675
  misc_feature: Encodes the peptide sequence at SEQ ID NO 2688
atggcgaccgccgcagctacggcgcctcacccgactccgccgacgccgctccagcagcaacagcatcagcaggacaaggaccagaagcagcagaaggcgctgtccatgaacgcaatccgcctgaaggcgatcggcgaccgcctcaaggcccacctgcgcggcatgaacgtccctccaatcgccgagttcgcccacctcgtctacgcgttcgccagagggattgacttcgcggtctcagctggcgacattcctcagatggccggtgacatacccgacattctgagaaaggtatatgacctgaggagagaaatgtttatacaatcatcgcttatggtactagtgatatcttgcaagaatgcttgttccaataattggtttcaacctgcagattctagagacattttcagaatggctaatgagctctctggcaacttctgcacatccacaggccaggcagctagtgacagcactgtgcttgaaattatatcacaaataatgccaaggtattaccctcggttgaagtttgagcgcctaatcacttctattgaagcaaaggttggctatgatatactaatggctgacttctttattgagaggaacctatctcgagatgaaaagattagactaattgtcgtacaaaaggaaaatttagatgcctcgtcttgtgtttcaagcccaccacatgtgagctttttggtcaatgggaggggtgtggacaggaggactaatgtttcaatggaaccaggaccccagttccctactgatatcaccaaaatgctcaaatatggggctaacattatccaagctgttggatattttaatgctaattatatcatagctgtagcatttgtgaacaatttgacatccttcagtgctccaaaactggatgactatgcacaacctatcactgtttatcctgcagattctgatgtacttgagggaccatcaagagtttccctaaattgccctataagtattaggcgcataaaaactcctatcaaagggcgcctttgcaagcactatcagtgttttgattatgataattacatggatatgaactcgagaaagccaaactggcgctgtccatactgtaacacctcttcaagcttcactgacctacgtattgaccaaaagatgatgaagatactagaagagactggagatgatgtcactgatgtccttgtattcgctgatggatcttggaaagctgctccagctcaggatgaaaaatctgatagacatagaggtgatgccattcagcagactggagattctacagaaactgattcgccttcttcagatgtcatagatctgataaatggcaatgacgatggtgatatgcaaatggattgggtatcggctccagaagatactaagcctctgttgaatagtcaagatttgtctgtatcagactatcttacagatcttcctatggcagtccagacaggagatctgtatcgaggggatggaaataatgggggaagcaacatggctttcacttctcgtcaaaatttgttactaccacctactagtgggctgggctcaagttcatttggtaccttggaatctattctacctcaaaatgttctgcgccctgtcatcacagatgctgtctctccttctcttgaaacctctacttcaacatctggcatgcaacatgtttcacaggaaacacattgtggaactgtacagttgcaggcacaaataggtcccgtacatggatctgaattgagaaggcttcctatacctagaaatcccaggagagagccagtaggagtccaggcattggcagttccaccacagaatcctgggtcatcaacaaggttgcagccaaatatcctcaattgtccacctcctatcccgctatctagtccatcttcttccacttaccaaacacatcaagtgacgaatccagacagtgtcattgctccaatgaacagtggtagtgggccattaccaaggactgctgcatcattgcacctacagtcaacagcacgggaaattcgcaacacatcaagccatctacccagtcgacttgttggtctgcctgctccacacctcatgggtgcacgaccaccaccaggaatttcaggacaggctggaggagcgaacgcctacagacctatacaacagactccgactctcgatcaactgaggcacacacggatgaacatgaaccaaacggcactggctgctgcagcccaaaccacctctgcggcacatgttcgaccaacccaagcagacatccaaagccatctctttcccacgcagcaaagccaggcaccgagatcgcaaccagtgccacgggcagcaagtccttcgcctctacagcgggcgccaccacatctgcaaccccccagtgtaccacccactgttccaagcacacctcaggttggatctccacatggtcttccaccagagctccctgtggatgagagctggcgccccacaggacagatgagagggagtctaacaggcaatgcttacagttctgcgattcggcactatcggggccggtctgagcagcagcagggccagcctcggcctcccagcacttctggcgcgcgaaggcctcagtag

SEQ ID NO: 2688 - protein, 859 aa, Sorghum bicolor
  misc_feature: Ceres ANNOT ID no. 6025675
  misc_feature (318)..(367): Pfam Id: zf-MIZ Pfam Desc: MIZ/SP-RING zinc finger
  misc_feature (36)..(769): NCBI GI: 2104683 NCBI Desc: transcription factor [vicia faba]
  misc_feature (29)..(781): NCBI GI: 110738352 NCBI Desc: transcription factor like protein [arabidopsis thaliana]
  misc_feature (29)..(781): NCBI GI: 79527303 NCBI Desc: zinc ion binding [arabidopsis thaliana]
  misc_feature (74)..(356): NCBI GI: 42561833 NCBI Desc: zinc finger (miz type) family protein [arabidopsis thaliana]
  misc_feature (29)..(480): NCBI GI: 10178012 NCBI Desc: transcription factor-like protein [arabidopsis thaliana]
MATAAATAPHPTPPTPLQQQQHQQDKDQKQQKALSMNAIRLKAIGDRLKAHLRGMNVPPIAEFAHLVYAFARGIDFAVSAGDIPQMAGDIPDILRKVYDLRREMFIQSSLMVLVISCKNACSNNWFQPADSRDIFRMANELSGNFCTSTGQAASDSTVLEIISQIMPRYYPRLKFERLITSIEAKVGYDILMADFFIERNLSRDEKIRLIVVQKENLDASSCVSSPPHVSFLVNGRGVDRRTNVSMEPGPQFPTDITKMLKYGANIIQAVGYFNANYIIAVAFVNNLTSFSAPKLDDYAQPITVYPADSDVLEGPSRVSLNCPISIRRIKTPIKGRLCKHYQCFDYDNYMDMNSRKPNWRCPYCNTSSSFTDLRIDQKMMKILEETGDDVTDVLVFADGSWKAAPAQDEKSDRHRGDAIQQTGDSTETDSPSSDVIDLINGNDDGDMQMDWVSAPEDTKPLLNSQDLSVSDYLTDLPMAVQTGDLYRGDGNNGGSNMAFTSRQNLLLPPTSGLGSSSFGTLESILPQNVLRPVITDAVSPSLETSTSTSGMQHVSQETHCGTVQLQAQIGPVHGSELRRLPIPRNPRREPVGVQALAVPPQNPGSSTRLQPNILNCPPPIPLSSPSSSTYQTHQVTNPDSVIAPMNSGSGPLPRTAASLHLQSTAREIRNTSSHLPSRLVGLPAPHLMGARPPPGISGQAGGANAYRPIQQTPTLDQLRHTRMNMNQTALAAAAQTTSAAHVRPTQADIQSHLFPTQQSQAPRSQPVPRAASPSPLQRAPPHLQPPSVPPTVPSTPQVGSPHGLPPELPVDESWRPTGQMRGSLTGNAYSSAIRHYRGRSEQQQGQPRPPSTSGARRPQ

SEQ ID NO: 2689 - DNA, 1575 bp, Sorghum bicolor
  misc_feature: Ceres ANNOT ID no. 6025676
  misc_feature: Encodes the peptide sequence at SEQ ID NO 2690
atggccgcagcaagactccggtgcgcggccgccatcgccatcgccacagctgtccccgccgccgcggcgctcccgctcccgctcgcgcttcgccgccaccgggccttccgccgcgtccccgcggcggccgtttgcctccggttctcgtcgtgccggatcccggcgccgccgaggagagcagccgcggccatgtcgtcgttagcggcggcggcgcagaggacggagcacgaggccggcgcgtggtttgcggtgccgggcctcagcctccgcgaccaccggttcgccgtcccgctcgaccactccagtcccgaccgcggggacaccatcaccgtcttcgcgcgcgaggtcgtcgccgctgggaaagaagacgtatctctgccttatttgttgtacctccaaggagggcctggatttgagagcccccgtcccacggaagcaggtgggtggttaaagaaagcttgtgaagaccaccgtgttgtgctgctagatcagcggggaacaggattgtccacaccgttgactccatcatctctttcgcaaattacatctcctgcaaagcaggtggagtacctgaagcatttcagggcggataatatagttaaggatgcagaaattattcgtctacgtcttgtaccagatgctaaaccttggacagtcctaggacagagttatggtgggttttgtgccgttacatatttgagttttgctccagaaggcctgaaatctgttcttttgactggagggcttccaccactgggcgagccttgcactgcagatacggtgtacagagcctgctttaaacaggttcaacaacaaaacgagaagtactataagaggtatccccaagatatagaagtcgttcatgaggttgtaagatacttaagtgaatctgaagggggaggggttcttcttccatctggtggccgattaacccctaagatgctgcagtgtcttggattgtcaggtctgggttctggtagtggatttgaaaggctgcattatctgcttgagagggtgtgggatcctgcacttgttgctggagctaaaaagagcattagctattacttcttaaaagagtttgaaatgtggttaggttttgatcaaaatcctctttatgccctcctgcatgagtctatctactgtgagggctcttcatcaaaatggtctgctgaaaagattcatggtgaatatggaagtttgtttgatcctattaaagctacagaagaaggccgtgctgtgtattttactggagagatggtgtttccttgcttgtttgatgagatccctgctctacgagacctaaaagaggctgcccatttgttggctgagaaggaagactggcctcccctatatgatgtcagcgtgttgaacaataataaggttccagtcgcggctgcagtatactacgaggacatgtacgttaacttcaacatcgccaaggagaccgcctcccagataagggggatccggctctgggtgaccaacgagtacatgcactcgggcatccgcgacggcggctcacatgtcttcgagcatctcatgggtcttctgaacggcaagaagcctttgttttag

SEQ ID NO: 2690 - protein, 524 aa, Sorghum bicolor
  misc_feature: Ceres ANNOT ID no. 6025676
  misc_feature (157)..(416): Pfam Id: Abhydrolase_1 Pfam Desc: alpha/beta hydrolase fold
  misc_feature (10)..(524): NCBI GI: 6850845 NCBI Desc: prolyl aminopeptidase-like protein [arabidopsis thaliana]
  misc_feature (104)..(520): NCBI GI: 133912614 NCBI Desc: alpha/beta hydrolase fold [saccharopolyspora erythraea nrrl 2338]
  misc_feature (106)..(521): NCBI GI: 127513198 NCBI Desc: alpha/beta hydrolase fold [shewanella loihica pv-4]
  misc_feature (109)..(519): NCBI GI: 119775278 NCBI Desc: alpha/beta hydrolase fold [shewanella amazonensis sb2b]
  misc_feature (107)..(521): NCBI GI: 91793579 NCBI Desc: alpha/beta hydrolase fold [shewanella denitrificans os217]
MAAARLRCAAAIAIATAVPAAAALPLPLALRRHRAFRRVPAAAVCLRFSSCRIPAPPRRAAAAMSSLAAAAQRTEHEAGAWFAVPGLSLRDHRFAVPLDHSSPDRGDTITVFAREVVAAGKEDVSLPYLLYLQGGPGFESPRPTEAGGWLKKACEDHRVVLLDQRGTGLSTPLTPSSLSQITSPAKQVEYLKHFRADNIVKDAEIIRLRLVPDAKPWTVLGQSYGGFCAVTYLSFAPEGLKSVLLTGGLPPLGEPCTADTVYRACFKQVQQQNEKYYKRYPQDIEVVHEVVRYLSESEGGGVLLPSGGRLTPKMLQCLGLSGLGSGSGFERLHYLLERVWDPALVAGAKKSISYYFLKEFEMWLGFDQNPLYALLHESIYCEGSSSKWSAEKIHGEYGSLFDPIKATEEGRAVYFTGEMVFPCLFDEIPALRDLKEAAHLLAEKEDWPPLYDVSVLNNNKVPVAAAVYYEDMYVNFNIAKETASQIRGIRLWVTNEYMHSGIRDGGSHVFEHLMGLLNGKKPLF

SEQ ID NO: 2691 - DNA, 1734 bp, Sorghum bicolor
  misc_feature: Ceres ANNOT ID no. 6025678
  misc_feature: Encodes the peptide sequence at SEQ ID NO 2692
atgatctcgtggcacgacctgtacacggtgctttgcgcggtggtgccgctgtacgtggcgatggtcctggcgtacggctccgtgcggtggtggggcgtgctgacgccggaccagtgcgccggcatcaaccgcttcgtcgccgtcttcgccgtgccgctcctctccttccactgcatctccaccagcgacccctacgtgatgaacctccgcttcatcgccgccgacacgctgcagaaggtcctcgtcctcgccgcgctcgccgtctggtcgtacctcccgaccgcgcgccgcggcggcgccgccgccgatgcggcggccggcgggacgaataataagcgggagccgttggactggtccatcacgctcttctccctgtccacgctgcccaacacgctcatcatggggatcccgctcctggtcgccatgtacgggcagtactcgggcgacctcctggtgcaggtggtggtgctccagtgcatcgtgtggtacaccctcctgctcgtcctctacgagttccgcgccgcgcgggtgctcatcgcggggcagttcccggccggcaccgcggccgcggcgtgcatcatcgccgacgtgcgcgtggacccggacgtggtgtcgctggccggcagccaggcggaggcgcaggccgaggtggcgcccgacggcaggatgcgcctcgtcgtgcgccggtccacgtcggcgccgtcacggcggtccctggcggcggccaccgccgcgacgccgcggccgtccaacctgacaggcgtggagatctactcgatgagctcgtcgcggaacgccaccccgagagggtccagcggcatcgcgcacgccgacataggctggcccgccgccgcgccgctgcacggcgcgtcgtcgctgcgcatgtcgagcttcggcgcggcggacctcttctccctgcacccgacgccgcggccgtctagcttcgacgagcaagctgtgcgggcaagatcggccgccacggtggcgcccagcaacgaccccagggacgtgcacatgatcgagtggagctccggcgcgtccacgacgtcggaggtgcgcggcttgccggtgttccacggcggcgacctccaccgcggcatggattcccgccggctggtcccctccgaggacgcgctgacgaagctggagtccgggtcgacggaggaggagcggaaggacgacaaggacgccggcgccggagcgggagggcagcaaacggcggcggcggcaccggccggcgtgatgatgcggctgatcgtcacgatggtgtggcgccggctgatccgcaacccaaacacgtacgccagcgttgtcggcctcacttggtcgctcatctcgttccgattccacgtcgcaatgccagtcctagtgaagaactccatcagcatactctccgatgcagggctagggatggccatgtttagcttagggctgttcatggccacgcagcccaagatcattgcctgcggaaacaaagtcgcggccatcaccatggcaattcgcttcctcttcggccccgccgtcatggccgccacgtccgccgccatcggcctccgaggcacgctcctgcgcgtcgccattgttcaggctgctctgccgcaaggaattgtgccatttgtgttcggcaaggagtacaatctgcacgccgccattctttgcaccggggtgatttttggcatgctaatcgctcttcccatcaccttggtctactatattattctcggactattgtga

SEQ ID NO: 2692 - protein, 577 aa, Sorghum bicolor
  misc_feature: Ceres ANNOT ID no. 6025678
  misc_feature (9)..(571): Pfam Id: Mem_trans Pfam Desc: Membrane transport protein
  misc_feature (365)..(576): NCBI GI: 15485155 NCBI Desc: efflux carrier, pin3 [brassica juncea]
  misc_feature (379)..(576): NCBI GI: 21435938 NCBI Desc: pin1-like auxin transport protein [populus tremula x populus tremuloides]
  misc_feature (365)..(576): NCBI GI: 15485153 NCBI Desc: efflux carrier, pin2 [brassica juncea]
  misc_feature (397)..(576): NCBI GI: 33339152 NCBI Desc: auxin efflux carrier [momordica charantia]
  misc_feature (1)..(272): NCBI GI: 75114357 NCBI Desc: probable auxin efflux carrier component 2 (ospin2)
MISWHDLYTVLCAVVPLYVAMVLAYGSVRWWGVLTPDQCAGINRFVAVFAVPLLSFHCISTSDPYVMNLRFIAADTLQKVLVLAALAVWSYLPTARRGGAAADAAAGGTNNKREPLDWSITLFSLSTLPNTLIMGIPLLVAMYGQYSGDLLVQVVVLQCIVWYTLLLVLYEFRAARVLIAGQFPAGTAAAACIIADVRVDPDVVSLAGSQAEAQAEVAPDGRMRLVVRRSTSAPSRRSLAAATAATPRPSNLTGVEIYSMSSSRNATPRGSSGIAHADIGWPAAAPLHGASSLRMSSFGAADLFSLHPTPRPSSFDEQAVRARSAATVAPSNDPRDVHMIEWSSGASTTSEVRGLPVFHGGDLHRGMDSRRLVPSEDALTKLESGSTEEERKDDKDAGAGAGGQQTAAAAPAGVMMRLIVTMVWRRLIRNPNTYASVVGLTWSLISFRFHVAMPVLVKNSISILSDAGLGMAMFSLGLFMATQPKIIACGNKVAAITMAIRFLFGPAVMAATSAAIGLRGTLLRVAIVQAALPQGIVPFVFGKEYNLHAAILCTGVIFGMLIALPITLVYYIILGLL

SEQ ID NO: 2693 - DNA, 630 bp, Sorghum bicolor
  misc_feature: Ceres ANNOT ID no. 6025686
  misc_feature: Encodes the peptide sequence at SEQ ID NO 2694
atgaagctgaagcagctggagggcctcttgggtggcctgacccagttccccaacccgaaggtggagctggagcagtatccgacgggccctcacatcgcgtcgcggatgctctacacggcggagaatagttttgatgacataactggcaaagtggtagctgactttggctgtggttgtggcactctggctgtggggagtgctctactggaagctgaacatgttcttggtattgatattgacccacagtcacttgaacttgctcaagaaaatgctgctgatctggagctggatatcgacttagtttggtctgacataaagaacttaaatttgaaaggcgtccatgttgacactgttgtcatgaatcctccctttggtacaagaaggaatggagcagacatggagttcctctctatgggcttgaaggttgcttctcaagctgtctattctctacacaagacttccactagagaacatatcaagaagatggccttgcgtggctgcaacgcccgcagtgcggaggttctatgcgagctgcgttacggtctaccgcagacgtacaagttccacaagaaaaaggaggttgacattgccgtcgacttgtggcgttttgttcctaaagctcaacagtag

SEQ ID NO: 2694 - protein, 209 aa, Sorghum bicolor
  misc_feature: Ceres ANNOT ID no. 6025686
  misc_feature (34)..(149): Pfam Id: MTS Pfam Desc: Methyltransferase small domain
  misc_feature (58)..(209): NCBI GI: 32400877 NCBI Desc: early nodule-specific-like protein enod8 gene [triticum aestivum]
  misc_feature (1)..(205): NCBI GI: 53734163 NCBI Desc: zgc:103655 [danio rerio]
  misc_feature (1)..(203): NCBI GI: 123236681 NCBI Desc: methyltransferase like 5 [mus musculus]
  misc_feature (1)..(194): NCBI GI: 119631658 NCBI Desc: methyltransferase like 5, isoform cra_b [homo sapiens]
  misc_feature (1)..(203): NCBI GI: 48096120 NCBI Desc: similar to dc3 [apis mellifera]
MKLKQLEGLLGGLTQFPNPKVELEQYPTGPHIASRMLYTAENSFDDITGKVVADFGCGCGTLAVGSALLEAEHVLGIDIDPQSLELAQENAADLELDIDLVWSDIKNLNLKGVHVDTVVMNPPFGTRRNGADMEFLSMGLKVASQAVYSLHKTSTREHIKKMALRGCNARSAEVLCELRYGLPQTYKFHKKKEVDIAVDLWRFVPKAQQ

SEQ ID NO: 2695 - DNA, 2004 bp, Sorghum bicolor
  misc_feature: Ceres ANNOT ID no. 6025706
  misc_feature: Encodes the peptide sequence at SEQ ID NO 2696
atggacgcagcggcggaggtggaccaccacgcggccgagagggccgccgtgcgcttcgacgtcgaggcgatgaaggttgcgtgggctggctcgcggcacgccgtcgaagtcggcgaccgcatggcccgactcgtcgcgtccgaccctgtcttccgcaaggataacaggaccatgctctctaggaaggacttgtttaaggacactctaagaaaggcagcccatgcatggaagcgtattgtcgaactacgtcttacagaggaggaagcaggtatgctgaggctatacgtagatcagcctggttatgttgatctgcattggggcatgtttgttcctgctataaaaggtcaaggtactgaggagcagcagaagaagtggttacctatggcttacaagttccaaataattgggtgctatgctcagactgaacttggtcacggctcaaacgttcagggccttgaaacaactgctacatttgatccaaagactgatgagtttgtcattcacagtccaactctgacctccagcaaatggtggcctggtggcttggggaaagcttccactcatgcagtggtgtatgctcggctgataactgaaggaaaggactatggtatacatggttttattgtgcaactgcgaagcttagaggatcactccccgcttcctggtgttaccctgggtgatattggtggaaaatttggtagcggtgcatataacagtatggacaatggtgttctgcgatttgaccatgtgcgcataccaagggatcaaatgttgatgaggctttcacaagttactagggaggggaaatatgttaattcagatgtcccaaagcagctgctttatgggactatggtttttgttcgtcagacaatagtcgcagatgcttctaaggctttgtcccgtgctgtttgcattgctgtacgatacagcgccatccgaaagcagtttggctctcaagatggtggccctgagactaaggtccttgattacaagactcaacaaagcagactctttccattgctggcttcagcatatgcatttagattcgtgggtgactggctcaagtggctatacatggatgtcactcagaaactggaagctaaagactactcaacactgcaagaaacccatgcctgtactgctggtttgaaggctgtgacaacatctgcaacagctgatgccattgaagaatgcagaaagctctgtggtggacatggttacttgaacagcagtgggcttcctgaattgtttgctgtctatgttcctgcttgcacttatgaaggagacaatattgttctgcttctgcaggttgcaaggattctaatgaagactgtatctcaattggcatctggaaaacaacctgttggtacaatggcttacatgggcaatgtacaatatctgatgcaatgcaaatgtgctgttaacacagccgaagattggcttaaccctgttgccatacaagaggcatttgaagccagggctctcaggatggcagtaaactgtgcccagaacataggccaagcagcaagccaagaagaaggtttctctgagcggtccccagatttgctagaggctgcagtagctcacatccagttgatcattgtaaccaagttcattgcaaaggtacagcaggacattcctggacatggagtgaaggaacagctccagaacctttgcaatgtttatgccctctacattcttcacaagcacctgggcgacttcctggcaactgggtgcatcacaccgaagcagggagcgttggcaaatgagcaacttggcaagctttacgcacaggtgcgtccaaatgctgttgctctggtggatgcgttcaactacacagaccactacctggggtcggtgctggggcggtatgacgggaatgtgtacccggcactgtatgaggaggcgtggaaggaccctttgaatgagacggtggtgcctgaggggtaccatgagtacctccggcccttgctcaagcagcagctcaagctctccaggctctga

SEQ ID NO: 2696 - protein, 667 aa, Sorghum bicolor
  misc_feature: Ceres ANNOT ID no. 6025706
  misc_feature (479)..(661): Pfam Id: ACOX Pfam Desc: Acyl-CoA oxidase
  misc_feature (137)..(197): Pfam Id: Acyl-CoA_dh_M Pfam Desc: Acyl-CoA dehydrogenase, middle domain
  misc_feature (7)..(667): NCBI GI: 24111395 NCBI Desc: at4g16760/dl4405c [arabidopsis thaliana]
  misc_feature (7)..(667): NCBI GI: 15553480 NCBI Desc: acyl-coa oxidase [glycine max]
  misc_feature (7)..(667): NCBI GI: 58531948 NCBI Desc: peroxisomal acyl-coa oxidase 1a [lycopersicon esculentum]
  misc_feature (7)..(667): NCBI GI: 109157678 NCBI Desc: chain c, x-ray crystal structure of leacx1, an acyl-coa oxidase from lycopersicon esculentum (tomato)
  misc_feature (7)..(667): NCBI GI: 58531952 NCBI Desc: peroxisomal acyl-coa oxidase 1a [lycopersicon cheesmaniae]
  misc_feature (7)..(667): SWISSPROT Homolog: EC 1.3.3.6 Acyl-coenzyme A oxidase 1, peroxisomal
MDAAAEVDHHAAERAAVRFDVEAMKVAWAGSRHAVEVGDRMARLVASDPVFRKDNRTMLSRKDLFKDTLRKAAHAWKRIVELRLTEEEAGMLRLYVDQPGYVDLHWGMFVPAIKGQGTEEQQKKWLPMAYKFQIIGCYAQTELGHGSNVQGLETTATFDPKTDEFVIHSPTLTSSKWWPGGLGKASTHAVVYARLITEGKDYGIHGFIVQLRSLEDHSPLPGVTLGDIGGKFGSGAYNSMDNGVLRFDHVRIPRDQMLMRLSQVTREGKYVNSDVPKQLLYGTMVFVRQTIVADASKALSRAVCIAVRYSAIRKQFGSQDGGPETKVLDYKTQQSRLFPLLASAYAFRFVGDWLKWLYMDVTQKLEAKDYSTLQETHACTAGLKAVTTSATADAIEECRKLCGGHGYLNSSGLPELFAVYVPACTYEGDNIVLLLQVARILMKTVSQLASGKQPVGTMAYMGNVQYLMQCKCAVNTAEDWLNPVAIQEAFEARALRMAVNCAQNIGQAASQEEGFSERSPDLLEAAVAHIQLIIVTKFIAKVQQDIPGHGVKEQLQNLCNVYALYILHKHLGDFLATGCITPKQGALANEQLGKLYAQVRPNAVALVDAFNYTDHYLGSVLGRYDGNVYPALYEEAWKDPLNETVVPEGYHEYLRPLLKQQLKLSRL

SEQ ID NO: 2697 - DNA, 1005 bp, Sorghum bicolor
  misc_feature: Ceres ANNOT ID no. 6025727
  misc_feature: Encodes the peptide sequence at SEQ ID NO 2698
atggtggaagcagcagctgtggtccacaaggcggccgcggccgtgatgagatcgtcgtcacagaagaagatcaagcaggagcctgcagagacgacgacgatccgcaaactagttcgcgtcttctgcgaggaccgtgacgccacggactcctccggcgacgaggctgctgccggtgacggtgcttctggagcgcgcggggtgcgtaagtttgtcaaagagatcgtcttggaggagcgtcgcccttgttgcgatgtcacggcgaacccggtgcctgccgggaggatcgccggcggtggcaagaggaaagcgccggccggcgcgggggcggagccgaggtacaggggcgtgcggagaaggccgtgggggaagtacgcggcggagatccgcgacccgcacaagggcgagcgggtgtggctgggcaccttcgacaccgccgaggaggcggccaggaagtacgacagcgaggcccgccgactccgcgggccatcggcgacaaccaactttcccgcagcgccaacgacgcggcctgatcgtgttccacttccaccgtcgtcgccgcacgccgttcctgccgtgggcgagctctcctccgccgaagagtccagcgacgagtcccagctggtggtgggctcgccggtgtccgtcctccgggcaatgcctggcgagacgacgcctctgacgacgctgaagcccaccgacgccgccgattccacagccaagaaagacgcggcgcccggcgggggcgccggcctctccccgttctccgccgacgcgctcctgcctgatcagctcggcggcgaggacgtgttctccttcacccctttcggcggcgatccggactttggcggcgtcccgttcgacgactcgcccacgccgccactcatcgactacctcgccgacgacccgacgctcgacctcggcagcctcccgatgtggccaggagtcgacggctgccgcttcagcgacatcggcgacgacgacctcttctccctccccccgctctga

SEQ ID NO: 2698 - protein, 334 aa, Sorghum bicolor
  misc_feature: Ceres ANNOT ID no. 6025727
  misc_feature (111)..(162): Pfam Id: AP2 Pfam Desc: AP2 domain
  misc_feature (38)..(302): NCBI GI: 56784079 NCBI Desc: pti6 -like [oryza sativa (japonica cultivar-group)]
  misc_feature (36)..(310): NCBI GI: 33440022 NCBI Desc: ap24 [oryza sativa (japonica cultivar-group)]
  misc_feature (36)..(310): NCBI GI: 33087077 NCBI Desc: tsi-1-like protein [oryza sativa (japonica cultivar-group)]
  misc_feature (88)..(259): NCBI GI: 90421306 NCBI Desc: root abundant factor [hordeum vulgare]
  misc_feature (106)..(214): NCBI GI: 38345793 NCBI Desc: osjnba0085i10.10 [oryza sativa (japonica cultivar-group)]
  misc_feature: The sequence is a functional homolog of SEQ ID NO 1157 in the 10/374,780US patent application
  misc_feature: The sequence is a functional homolog of SEQ ID NO 1158 in the 10/374,780US patent application
  misc_feature: The sequence is a functional homolog of SEQ ID NO 12 in the 10/225,068US patent application
  misc_feature: The sequence is a functional homolog of SEQ ID NO 1247 in the 11/479,226US patent application
  misc_feature: The sequence is a functional homolog of SEQ ID NO 136 in the 10/412,699US patent application
  misc_feature: The sequence is a functional homolog of SEQ ID NO 1360 in the 10/412,699US patent application
  misc_feature: The sequence is a functional homolog of SEQ ID NO 1361 in the 10/412,699US patent application
  misc_feature: The sequence is a functional homolog of SEQ ID NO 1427 in the 11/479,226US patent application
  misc_feature: The sequence is a functional homolog of SEQ ID NO 168 in the 10/374,780US patent application
  misc_feature: The sequence is a functional homolog of SEQ ID NO 1778 in the 10/412,699US patent application
  misc_feature: The sequence is a functional homolog of SEQ ID NO 18 in the 10/412,699US patent application
  misc_feature: The sequence is a functional homolog of SEQ ID NO 1872 in the 10/412,699US patent application
  misc_feature: The sequence is a functional homolog of SEQ ID NO 1884 in the 10/374,780US patent application
  misc_feature: The sequence is a functional homolog of SEQ ID NO 2000 in the 10/374,780US patent application
  misc_feature: The sequence is a functional homolog of SEQ ID NO 2076 in the 10/374,780US patent application
  misc_feature: The sequence is a functional homolog of SEQ ID NO 290 in the 10/374,780US patent application
  misc_feature: The sequence is a functional homolog of SEQ ID NO 324 in the 10/374,780US patent application
  misc_feature: The sequence is a functional homolog of SEQ ID NO 325 in the 11/479,226US patent application
  misc_feature: The sequence is a functional homolog of SEQ ID NO 503 in the 10/374,780US patent application
  misc_feature: The sequence is a functional homolog of SEQ ID NO 544 in the 11/435,388US patent application
  misc_feature: The sequence is a functional homolog of SEQ ID NO 574 in the 10/412,699US patent application
  misc_feature: The sequence is a functional homolog of SEQ ID NO 6 in the 10/225,066US patent application
  misc_feature: The sequence is a functional homolog of SEQ ID NO 608 in the 11/435,388US patent application
  misc_feature: The sequence is a functional homolog of SEQ ID NO 616 in the 10/225,066US patent application
  misc_feature: The sequence is a functional homolog of SEQ ID NO 624 in the 11/479,226US patent application
  misc_feature: The sequence is a functional homolog of SEQ ID NO 628 in the 11/435,388US patent application
  misc_feature: The sequence is a functional homolog of SEQ ID NO 720 in the 10/225,066US patent application
  misc_feature: The sequence is a functional homolog of SEQ ID NO 732 in the 10/225,066US patent application
  misc_feature: The sequence is a functional homolog of SEQ ID NO 78 in the 10/225,066US patent application
  misc_feature: Useful for biocontainment applications
  misc_feature: Useful for making plants with altered alkaloid content
  misc_feature: Useful for making plants with altered sugar content
  misc_feature: Useful for making plants with altered terpenoid content
  misc_feature: Useful for making plants with modulated cold sensitivity
  misc_feature: Useful for making plants with modulated growth and phenotype characteristics
  misc_feature: Useful for making plants with modulated seed size
  misc_feature: Functional homolog of the protein sequence given in SEQ ID NO 12980
  misc_feature: Functional homolog of the protein sequence given in SEQ ID NO 13513
  misc_feature: Functional homolog of the protein sequence given in SEQ ID NO 13515
  misc_feature: The sequence is a functional homolog of SEQ ID NO 136 in the 20040045049 US patent application
  misc_feature: The sequence is a functional homolog of SEQ ID NO 1360 in the 20040045049 US patent application
  misc_feature: The sequence is a functional homolog of SEQ ID NO 1361 in the 20040045049 US patent application
  misc_feature: The sequence is a functional homolog of SEQ ID NO 1778 in the 20040045049 US patent application
  misc_feature: The sequence is a functional homolog of SEQ ID NO 18 in the 20040045049 US patent application
  misc_feature: The sequence is a functional homolog of SEQ ID NO 1872 in the 20040045049 US patent application
  misc_feature: The sequence is a functional homolog of SEQ ID NO 574 in the 20040045049 US patent application
  misc_feature: The sequence is a functional homolog of SEQ ID NO 6 in the 20050160493 US patent application
  misc_feature: The sequence is a functional homolog of SEQ ID NO 616 in the 20050160493 US patent application
  misc_feature: The sequence is a functional homolog of SEQ ID NO 1884 in the 20060162006 US patent application
  misc_feature: The sequence is a functional homolog of SEQ ID NO 503 in the 20060162006 US patent application
  misc_feature: Useful for making plants with altered lignin content
  misc_feature: Functional homolog of the protein sequence given in SEQ ID NO 13219
  misc_feature: The sequence is a functional homolog of SEQ ID NO 160 in the 10/714,887 US patent application
  misc_feature: The sequence is a functional homolog of SEQ ID NO 160 in the 11/435,388 US patent application
  misc_feature: The sequence is a functional homolog of SEQ ID NO 28 in the 10/903,236 US patent application
  misc_feature: The sequence is a functional homolog of SEQ ID NO 22 in the 10/903,236 US patent application
  misc_feature: The sequence is a functional homolog of SEQ ID NO 2215 in the 10/666,642 US patent application
  misc_feature: The sequence is a functional homolog of SEQ ID NO 82 in the 10/714,887 US patent application
  misc_feature: The sequence is a functional homolog of SEQ ID NO 82 in the 11/435,388 US patent application
  misc_feature: The sequence is a functional homolog of SEQ ID NO 1464 in the 10/666,642 US patent application
  misc_feature: The sequence is a functional homolog of SEQ ID NO 170 in the 10/225,066 US patent application
  misc_feature: The sequence is a functional homolog of SEQ ID NO 2 in the 10/903,236 US patent application
  misc_feature: The sequence is a functional homolog of SEQ ID NO 278 in the 10/666,642 US patent application
  misc_feature: The sequence is a functional homolog of SEQ ID NO 332 in the 10/374,780 US patent application
  misc_feature: The sequence is a functional homolog of SEQ ID NO 46 in the 10/225,068 US patent application
  misc_feature: The sequence is a functional homolog of SEQ ID NO 8 in the 10/714,887 US patent application
  misc_feature: The sequence is a functional homolog of SEQ ID NO 8 in the 11/435,388 US patent application
  misc_feature: Useful for making plants with modulated biomass
  misc_feature: Useful for making plants with modulated flowering time
  misc_feature: Functional homolog of the protein sequence given in SEQ ID NO 13801
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: The sequence is a functional homolog of SEQ ID NO. 274 in the 11/188,298 US application
MVEAAAVVHKAAAAVMRSSSQKKIKQEPAETTTIRKLVRVFCEDRDATDSSGDEAAAGDGASGARGVRKFVKEIVLEERRPCCDVTANPVPAGRIAGGGKRKAPAGAGAEPRYRGVRRRPWGKYAAEIRDPHKGERVWLGTFDTAEEAARKYDSEARRLRGPSATTNFPAAPTTRPDRVPLPPSSPHAVPAVGELSSAEESSDESQLVVGSPVSVLRAMPGETTPLTTLKPTDAADSTAKKDAAPGGGAGLSPFSADALLPDQLGGEDVFSFTPFGGDPDFGGVPFDDSPTPPLIDYLADDPTLDLGSLPMWPGVDGCRFSDIGDDDLFSLPPL

SEQ ID NO: 2699 - DNA, 1119 bp, Sorghum bicolor
  misc_feature: Ceres ANNOT ID no. 6025729
  misc_feature: Encodes the peptide sequence at SEQ ID NO 2700
atgaggaccgtatggccgctgctcctcgtggcggcggcgctgtgctgcgcctccccggcggcgagtgccgggaccgggcgctgcaagttccctgccgtcttcaacttcggcgactccaactccgacaccggcggcttctgggccgccttcccggcgcagcagggcccgttcggcatgacatacttcggcaggcccgccggccgcgcctccgacggccgcctcgtcatcgacttcataggcccgtacctcctgcagtacacgcatcgctccatcgggtcggactaccggcacggcgccaactccgcgacgctggcgtcgacggtgctgctgcccaacacgtcggtgttcgtcaccgggatcagccccttctccctcggcatccagctcaaccagatgaaagagttcaggaacagagtgctctcctccaatggcaacaatggccaactccctcgcccggatatcttcggcaaagctctgtatacaattgacattggacagaacgattttacctcaaaccttggatccctcggcgtcgaaagcgtcaagcgaagtctaccttcaattgtcaaccagatctcctggacaatacaggacatgtataacattggagctcgccacttcatggtgttcaacatggcgcccataggatgctacccggcattcctcacggagcttcctcataacagcaacgacttggatgaatttggatgcatgaaaagctacaacagtggagtgacatactacaacgagttactgaacaacagcttagccgaggtcagaaagaagctgcaggatgcgtcgatcttgtatgtcgacaagcataccgtaacgcttgagctgttccagcaccctactgctcacgggctcaagtacgggactagagcttgttgtggatatggcggtggaacttacaatttcaatcaagatgtttactgcggaaacagcaaggtagtgaacggcaaaactgcaacggcaggggcttgtggagacccccaaaactatgtcagctgggacggaatacacgccactgaagctgcaaactacaagatagcttatgcagtgatcagcggctcctattcgtatccacctttcgatctttcaaagctatgtagcccttag

SEQ ID NO: 2700 - protein, 372 aa, Sorghum bicolor
  misc_feature: Ceres ANNOT ID no. 6025729
  misc_feature (33)..(354): Pfam Id: Lipase_GDSL Pfam Desc: GDSL-like Lipase/Acylhydrolase
  misc_feature (27)..(370): NCBI GI: 3688284 NCBI Desc: lanatoside 15'-o-acetylesterase [digitalis lanata]
  misc_feature (27)..(370): NCBI GI: 65336668 NCBI Desc: lanatoside 15'-o-acetylesterase [digitalis lanata]
  misc_feature (27)..(370): NCBI GI: 64165009 NCBI Desc: lanatoside 15-o-acetylesterase [digitalis lanata]
  misc_feature (27)..(370): NCBI GI: 64165026 NCBI Desc: lanatoside 15-o-acetylesterase [digitalis grandiflora]
  misc_feature (27)..(370): NCBI GI: 64165042 NCBI Desc: lanatoside 15-o-acetylesterase [digitalis subalpina]
MRTVWPLLLVAAALCCASPAASAGTGRCKFPAVFNFGDSNSDTGGFWAAFPAQQGPFGMTYFGRPAGRASDGRLVIDFIGPYLLQYTHRSIGSDYRHGANSATLASTVLLPNTSVFVTGISPFSLGIQLNQMKEFRNRVLSSNGNNGQLPRPDIFGKALYTIDIGQNDFTSNLGSLGVESVKRSLPSIVNQISWTIQDMYNIGARHFMVFNMAPIGCYPAFLTELPHNSNDLDEFGCMKSYNSGVTYYNELLNNSLAEVRKKLQDASILYVDKHTVTLELFQHPTAHGLKYGTRACCGYGGGTYNFNQDVYCGNSKVVNGKTATAGACGDPQNYVSWDGIHATEAANYKIAYAVISGSYSYPPFDLSKLCSP

SEQ ID NO: 2701 - DNA, 585 bp, Sorghum bicolor
  misc_feature: Ceres ANNOT ID no. 6025732
  misc_feature: Encodes the peptide sequence at SEQ ID NO 2702
atgattggtgtggggaaggtgaagcagtacgccaacgtccttgacaagcccctcagccgtggcaggcaggaggtcagtttgagtgcatttgcattcttgttctctgagttggttcagtacaaccagactcaagttgacaacattactgagctggaacggaggctggaggatgctggttatgcagttggggcaagggtgcttgaactactctgtcacagggagaagggaaatagacgagagacacgacttctgggtattttatcgttcatccacagtactgtttggaaagtgttgtttggaaaggtggctgactcacttgagaagggaacagaacatgaggatgaatacatgatcagtgaaaaggagcttcttgttaaccgtttcatttccgtgccaaaagacatgggagcattcaactgtggagcttttgttgcgggaatcgtaaagggtgtattagataatgctggctttcctgccgtagttactgcacattttgtgccaattgaaggccaacaaaggccaaggacgacaatcctgataaagttttctgaagaggttttacacagagaagcaagactgggctga

SEQ ID NO: 2702 - protein, 194 aa, Sorghum bicolor
  misc_feature: Ceres ANNOT ID no. 6025732
  misc_feature (29)..(185): Pfam Id: TRAPP_Bet3 Pfam Desc: Transport protein particle (TRAPP) component, Bet3
  misc_feature (1)..(194): NCBI GI: 56784761 NCBI Desc: spp30-like [oryza sativa (japonica cultivar-group)]
  misc_feature (1)..(194): NCBI GI: 4959712 NCBI Desc: spp30 [solanum chacoense]
  misc_feature (11)..(193): NCBI GI: 118792665 NCBI Desc: ensangp00000016974 [anopheles gambiae str. pest]
  misc_feature (12)..(194): NCBI GI: 7106062 NCBI Desc: spbc1718.05 [schizosaccharomyces pombe]
  misc_feature (12)..(194): NCBI GI: 19113243 NCBI Desc: similar to yeast bet3 involved in targeting and fusion of er to golgi transport vesicles [schizosaccharomyces pombe]
MIGVGKVKQYANVLDKPLSRGRQEVSLSAFAFLFSELVQYNQTQVDNITELERRLEDAGYAVGARVLELLCHREKGNRRETRLLGILSFIHSTVWKVLFGKVADSLEKGTEHEDEYMISEKELLVNRFISVPKDMGAFNCGAFVAGIVKGVLDNAGFPAVVTAHFVPIEGQQRPRTTILIKFSEEVLHREARLG

SEQ ID NO: 2703 - DNA, 4428 bp, Sorghum bicolor
  misc_feature: Ceres ANNOT ID no. 6025736
  misc_feature: Encodes the peptide sequence at SEQ ID NO 2704
atgggcgtttgcgggagcccattttgctccaagcaagccgtagcctcatgtggatggaaggacatattcgactcctccacttgcacgaatcatattctgtcaattggcatttctactctgatcaccatcgttcttgcgctccagctactcgtcagggttacaaagagcagggcatctgcacgacagcagcttgtcgcgctcagttcgccactgcagttggctggtgtagtgctcaatgtctgcttgggtctcatttatcttggccttgcattgtggatgctgtggaggaacttcagtcagcatgcttctgttcaccttccacattggtggatggtgaccttatgtcagggattctgtctgatccttgtcagttttgctttcagcatcagagcacatttctttggaccaaaatttctccgcgtttggtcagttatgctggccatatatgctggttttatttgttgttcctcggttgttcacatggttgtagataaagtactaaccgtgaaggcttgtttagatgttctattcctaccaggtgcactgctactccttgtttatggcatttggcacgtcagggaagatggtgatggaggaattgaaagtgctttatataagcccttgaacactgagactgttgatgatggcagggccgattctcagagtcatgtaaccccatttgctaaagctgtttttttcagcgtgatgtcattttggtggctaaatcctatgatgaagatgggttatgagaagccccttgaggagaaagatatgccacttttaggtccctcagatcgagcatatagccagtacatgatgtttctggagaagctgaacaggaagaagcagttgcaggcacatggcaatccgtcaatcttttggactatcatttcttgtcaaaaaagtgcaatcttggtctcaggtctctttgcattgctcaaggttcttgcattatcttcaggtccattgcttttgaaagcattcatcaatgtttcacttgggaaagggtcatttaagtatgaaggttacgtgttagctgtaacaatgttcatttgtaaatgtggtgaatctttgtcacagaggcagtggtatttccgcactcggaggttaggactccaggtgcggtcattcctatcagctgccatctataagaaacaacagcagctatcaaactcagcaaaattgaagcattcttccggtgagatcatgaactatgtcactgtcgacgcctaccggattggtgaattcccatactggttccatcagacgtggacaacaggtgtccaactttgcattgctctagtgattctgtataatgcagttggtcttgctacaattgcatcactgggtgtcataattgtcactgtagcttgcaatgctccactggccaagctgcaacacaaatttcagagtaaacttatgggagcacaagatgtgagactgaaggcgatgtcagagtccttaattcatatgaaagtcttgaaactttatgcatgggagactcatttcaagaaggtcattgaggggttaagggagattgaaatcaaatggctttcagcattccagcttaggaaagcatacaacagtttcctgttttggacatcacctattttggtttcggctgcaaccttcctggcatgctatcttctgaaaattcctcttgatgctagcaacgtcttcacatttgtggccactctgcgccttgttcaagatccaattaggcagataccagatgtgattggagttgtgatacaagctaaagttgctttcaccaggataacaaagtttcttgatgcgcctgagatgaatggacagattaggaagaaatattgtgtgggggatgaatatccaatagtgatgaactcttgtagtttctcatgggatgagaacctgtcaaaaccaactctaaagaatataaatttggtagtcaaagctggacagaaggttgcaatatgtggcgaggtaggatcaggaaagtcaacactgttggccgcagttcttggagaggttccgaaaactgaaggcacgatccaagtttgcgggaaaatagcatatgtttctcagaatgcatggatccaaactggaaccgtgcaagacaatattctctttgggtcttcgatggacacgcaaagataccaagaaacacttgagacgtgttctttagtaaaggaccttgaaatgttgccatatggagaccgtactcaaatcggggagaggggtgtaaatcttagtggtggtcagaagcagcgtgttcagcttgctcgtgcattataccaaaatgcagacatctatcttcttgatgaccctttcagcgctgtggatgcccacacagcaacaagtctctttaatgaatatgtcatgggagctctatcagacaagactgttcttttggtgacccaccaagtagattttctgcctgtatttgattctattctgttaatgtcagatggcgaaattattcgttctgcatcttaccatgatctattggcatattgtcaagaatttcagaaccttgtaaatgcccataaagacactattggtgtttcagatctaaacaaagtgcccccccatagagcaaatgaaatatcgatgaaggagacaattgatattcgtggaagcagatacatagagtctgtgaagccgtcaccaacagatcaactgatcaagacagaagaaagagaaatgggtgatactggtttcaagccttatattctctacctgcgtcagaataaaggcttcttgtatgcctctctgggtattttttgccatatagtttttgtatgtggccaaatatcacagaattcatggatggctgctaatgtcgagaatcctgatgttagtacacttaagttgacttctgtgtacattgcaattggaatcttcacggtgttcttcttgctatttagatcattagtagttgttattcttggggtcaagacatcaagatccttattttctcagttactgaactcattattccgtgcaccaatgtccttttatgattctacccctcttggaagggtacttagccgggtttcttcagatctgagtattgttgaccttgacattccatttgccttcatgtttagtgctagtgccggcataaatgcatatagcaatctaggagtattggctgttgttacatggcaagttctgttcgtttctgtgccaatgattgttttggcaatcagattgcagaggtattatttagcctcatctaaggaattgatgaggatcaatggcactaccaaatctgctctggctaatcacttgggcgagtcgattgcaggggctataacaataagggccttccaggaagaagatcgtttctttgagaaaaatttggaacttgttgacaagaatgctggtccatatttctataattttgcagcgactgaatggctgattcaacgtttggagatcatgagtgctgcagtgctttctttttctgcccttgtcatggctcttcttcctcaaggaacttttagccctggctttgtgggaatggcattatcttacggcctatccctgaatatgtcctttgttttctctatccaaaaccagtgccagctagcaagtcaaatcatctctgtggaaagagtgaaccagtacatggacataccaagtgaagcagcagagattattgaagaaaatcgaccagcaccagactggccccaagttggcacggtagaccttagagatttgaagattagatacaggcaagatgctcctcttgtactacatggaatcacctgcactttcgacggtggagataagattggtatagttggccgaacaggaagtggaaagacaactttaattggtgcgttgtttcgtcttgttgagccaactggagggaaaataattatagactctatagacatcaccacaataggcttacatgacctgcgttcacgtttgggtatcattccgcaagatccgacactctttcgaggaaccataagatataatctagaccctcttggccaattctcggatcaacaaatatgggaggttcttggcaaatgtcagcttcttgaagctgtccgggagaaggaacagggattggactcacttgttgtggaagatggttctaactggagcatgggtcaaaggcagctcttctgtttgggacgtgcacttctaaggagatgccgtatcttagttctcgacgaggccacagcatctatagacaatgctactgatgctatccttcagaaaacaatcaggacagaatttacagattccactgttatcactgtcgcgcaccgtatacccactgttatggactgcgatatggtacttgcaatgagtgatgggaaagtagtggagtatgacaaacctacgaagctcatcgaaaccgaaggatctcttttccgtgagctcgtcaaagagtactggtcatacacatcgaatggaaatatttag

SEQ ID NO: 2704 - protein, 1475 aa, Sorghum bicolor
  misc_feature: Ceres ANNOT ID no. 6025736
  misc_feature (646)..(817): Pfam Id: ABC_tran Pfam Desc: ABC transporter
  misc_feature (1257)..(1440): Pfam Id: ABC_tran Pfam Desc: ABC transporter
  misc_feature (304)..(573): Pfam Id: ABC_membrane Pfam Desc: ABC transporter transmembrane region
  misc_feature (907)..(1181): Pfam Id: ABC_membrane Pfam Desc: ABC transporter transmembrane region
  misc_feature (1)..(1472): NCBI GI: 47717725 NCBI Desc: multidrug-resistance associated protein 3 [zea mays]
  misc_feature (6)..(1469): NCBI GI: 92883856 NCBI Desc: cyclic peptide transporter [medicago truncatula]
  misc_feature (6)..(1469): NCBI GI: 140063323 NCBI Desc: cyclic peptide transporter [medicago truncatula]
  misc_feature (25)..(1474): NCBI GI: 22331862 NCBI Desc: abc transporter family protein [arabidopsis thaliana]
  misc_feature (137)..(1474): NCBI GI: 7529757 NCBI Desc: abc transporter-like protein [arabidopsis thaliana]
  misc_feature (137)..(1474): SWISSPROT Homolog: EC 3.6.3.44 Multidrug resistance-associated protein 14
MGVCGSPFCSKQAVASCGWKDIFDSSTCTNHILSIGISTLITIVLALQLLVRVTKSRASARQQLVALSSPLQLAGVVLNVCLGLIYLGLALWMLWRNFSQHASVHLPHWWMVTLCQGFCLILVSFAFSIRAHFFGPKFLRVWSVMLAIYAGFICCSSVVHMVVDKVLTVKACLDVLFLPGALLLLVYGIWHVREDGDGGIESALYKPLNTETVDDGRADSQSHVTPFAKAVFFSVMSFWWLNPMMKMGYEKPLEEKDMPLLGPSDRAYSQYMMFLEKLNRKKQLQAHGNPSIFWTIISCQKSAILVSGLFALLKVLALSSGPLLLKAFINVSLGKGSFKYEGYVLAVTMFICKCGESLSQRQWYFRTRRLGLQVRSFLSAAIYKKQQQLSNSAKLKHSSGEIMNYVTVDAYRIGEFPYWFHQTWTTGVQLCIALVILYNAVGLATIASLGVIIVTVACNAPLAKLQHKFQSKLMGAQDVRLKAMSESLIHMKVLKLYAWETHFKKVIEGLREIEIKWLSAFQLRKAYNSFLFWTSPILVSAATFLACYLLKIPLDASNVFTFVATLRLVQDPIRQIPDVIGVVIQAKVAFTRITKFLDAPEMNGQIRKKYCVGDEYPIVMNSCSFSWDENLSKPTLKNINLVVKAGQKVAICGEVGSGKSTLLAAVLGEVPKTEGTIQVCGKIAYVSQNAWIQTGTVQDNILFGSSMDTQRYQETLETCSLVKDLEMLPYGDRTQIGERGVNLSGGQKQRVQLARALYQNADIYLLDDPFSAVDAHTATSLFNEYVMGALSDKTVLLVTHQVDFLPVFDSILLMSDGEIIRSASYHDLLAYCQEFQNLVNAHKDTIGVSDLNKVPPHRANEISMKETIDIRGSRYIESVKPSPTDQLIKTEEREMGDTGFKPYILYLRQNKGFLYASLGIFCHIVFVCGQISQNSWMAANVENPDVSTLKLTSVYIAIGIFTVFFLLFRSLVVVILGVKTSRSLFSQLLNSLFRAPMSFYDSTPLGRVLSRVSSDLSIVDLDIPFAFMFSASAGINAYSNLGVLAVVTWQVLFVSVPMIVLAIRLQRYYLASSKELMRINGTTKSALANHLGESIAGAITIRAFQEEDRFFEKNLELVDKNAGPYFYNFAATEWLIQRLEIMSAAVLSFSALVMALLPQGTFSPGFVGMALSYGLSLNMSFVFSIQNQCQLASQIISVERVNQYMDIPSEAAEIIEENRPAPDWPQVGTVDLRDLKIRYRQDAPLVLHGITCTFDGGDKIGIVGRTGSGKTTLIGALFRLVEPTGGKIIIDSIDITTIGLHDLRSRLGIIPQDPTLFRGTIRYNLDPLGQFSDQQIWEVLGKCQLLEAVREKEQGLDSLVVEDGSNWSMGQRQLFCLGRALLRRCRILVLDEATASIDNATDAILQKTIRTEFTDSTVITVAHRIPTVMDCDMVLAMSDGKVVEYDKPTKLIETEGSLFRELVKEYWSYTSNGNI

SEQ ID NO: 2705 - DNA, 285 bp, Sorghum bicolor
  misc_feature: Ceres ANNOT ID no. 6025744
  misc_feature: Encodes the peptide sequence at SEQ ID NO 2706
atggcgaagaggaagtcgaggaaggcgccgccgccggccaagaaggcgcggaaggtccccacggccttcgactgccccttctgcggccacaccggcagcgtccagtgcagcatcgacatcaacaaggacatgatcgccgaggcggcgtgcgccgtctgcaaggtggtttacgccaccgtcgccaacgcgctcaccgagcccatcgacgtctactccgagtggatcgacgagtgccacaaagccaacgagggcgtccacgtcaacgccggcgaggattcgatgtga

SEQ ID NO: 2706 - protein, 94 aa, Sorghum bicolor
  misc_feature: Ceres ANNOT ID no. 6025744
  misc_feature (7)..(69): Pfam Id: Elf1 Pfam Desc: Transcription elongation factor Elf1 like
  misc_feature (1)..(93): NCBI GI: 44983882 NCBI Desc: aer237wp [eremothecium gossypii]
  misc_feature (1)..(93): NCBI GI: 45190840 NCBI Desc: aer237wp [eremothecium gossypii]
  misc_feature (1)..(82): NCBI GI: 31209067 NCBI Desc: ensangp00000023899 [anopheles gambiae]
  misc_feature (1)..(82): NCBI GI: 45553143 NCBI Desc: cg6244-pa [drosophila melanogaster]
  misc_feature (1)..(83): NCBI GI: 119604636 NCBI Desc: elongation factor 1 homolog (s. cerevisiae), isoform cra_a [homo sapiens]
MAKRKSRKAPPPAKKARKVPTAFDCPFCGHTGSVQCSIDINKDMIAEAACAVCKVVYATVANALTEPIDVYSEWIDECHKANEGVHVNAGEDSM

SEQ ID NO: 2707 - DNA, 1137 bp, Sorghum bicolor
  misc_feature: Ceres ANNOT ID no. 6025748
  misc_feature: Encodes the peptide sequence at SEQ ID NO 2708
atgcaagacggcgcgggagcagaagcagcagggagcagcatgcaggcgctgctggcgctcctcgccgacggcgaggagcaggcgcggcagctcggggagatgatggccgacgacccgtggtcacgggcggagcactacaggggcgcggcgcggcggctgcagtgcacgctcgggaaggcggcggccgtcgccagggccatcgaggcggccgcgccggggtcgtcgcggggcaccgacgaccgctccgactcgccgcggtcggcggacgagagctctggccggacaacgacggaggtgcaggagcgccagagcatgttcaagagaaggaaaggtctaccaagatggaccgcgaaattccgcgtgccagatgcaagcttggatgccaccccggacgacggcttcagctggagaaagtacggccagaaggacatcctcggcgccaagtttcccaggggctactaccggtgcacgtaccgcaccgcgcaggcgtgcggcgccacgaagcaggtgcagcgctccgacaccgacctgtgcgtgttcgacgtcacgtaccagggcgagcacacctgccaccagaagcagcgcgccagcgccaccgtggccgcggcgcccgcgcacggcgccgggagccagtcgccgccgccgccgccgccgctggagcagcagcagcagcagcaggacccgagcatgatgcagctgctgaggttgggcttcaagcgcgtcctcaaggtggagacgacgccggggctccacgaccatggaattggccaccgcgacagcggccccgcctccgcgcccgccgcgcccttctccttcccctccgcgtcgccgttccacctcgccggcgaggcgaccgacaaccccgccgcggccttctcgccgccgcccgcgtcgagctacttccctgcgccgcacccggtggcggtcgacgggagcttctacgactatgaggctagtccggtggcgctcatgcgcggggcggagccgtcggagctcggcgaggtcgtcaccagggcgatcaccaccggccccgccgcgttcgactactcgtcactcttccaccaccaggctgagctcgacgacccgcacctgccgttcccgccatttggcggcccgccccacggaccataccagtag

SEQ ID NO: 2708 - protein, 378 aa, Sorghum bicolor
  misc_feature: Ceres ANNOT ID no. 6025748
  misc_feature (130)..(192): Pfam Id: WRKY Pfam Desc: WRKY DNA -binding domain
  misc_feature (44)..(378): NCBI GI: 55296717 NCBI Desc: transcription factor wrky35 [oryza sativa (japonica cultivar-group)]
  misc_feature (44)..(378): NCBI GI: 50843970 NCBI Desc: transcription factor wrky35 [oryza sativa (indica cultivar-group)]
  misc_feature (1)..(362): NCBI GI: 118739188 NCBI Desc: wrky35-like protein [hordeum vulgare subsp. vulgare]
  misc_feature (6)..(221): NCBI GI: 46394284 NCBI Desc: tpa: wrky transcription factor 15 [oryza sativa (japonica cultivar-group)]
  misc_feature (44)..(221): NCBI GI: 55773948 NCBI Desc: transcription factor wrky08-like [oryza sativa (japonica cultivar-group)]
  misc_feature: Useful for making plants with modulated low light sensitivity
  misc_feature: Functional homolog of the protein sequence given in SEQ ID NO 13340
MQDGAGAEAAGSSMQALLALLADGEEQARQLGEMMADDPWSRAEHYRGAARRLQCTLGKAAAVARAIEAAAPGSSRGTDDRSDSPRSADESSGRTTTEVQERQSMFKRRKGLPRWTAKFRVPDASLDATPDDGFSWRKYGQKDILGAKFPRGYYRCTYRTAQACGATKQVQRSDTDLCVFDVTYQGEHTCHQKQRASATVAAAPAHGAGSQSPPPPPPLEQQQQQQDPSMMQLLRLGFKRVLKVETTPGLHDHGIGHRDSGPASAPAAPFSFPSASPFHLAGEATDNPAAAFSPPPASSYFPAPHPVAVDGSFYDYEASPVALMRGAEPSELGEVVTRAITTGPAAFDYSSLFHHQAELDDPHLPFPPFGGPPHGPYQ

SEQ ID NO: 2709 - DNA, 1917 bp, Sorghum bicolor
  misc_feature: Ceres ANNOT ID no. 6025750
  misc_feature: Encodes the peptide sequence at SEQ ID NO 2710
atgaagcacctggtggaggtggagccggcgacggcgaccacgggtccggcgtaccggaacgcgcgggcgaaggacggcctcctgcaggctccgccggggctccacagctgctgggacatcttccggacgtccgtggagaagtaccccgacaacccgatgctcggtcgccggagagtggtcgacggcaaggcgagcgattacacctgggtgacttacaaggaagtctatgatgatgtgatgaagcttgcggcctccattgacaaatccggaatcaaacagggtgaaggctgtggtatatacggcgcaaactgccccgaatggatcatcagcatggaggcttgcaacgcgcttggggtttgctgcgttcccctctacgattctctcggtgctggggcggtggagtttatcatttgccatgccgaaatacagatcgcgtttgtggaggaaaagaagatcacagaggtagaggcggtcataagctttggaggggtcacaaatgaccatagagatgaagctagaaaccatggcctgtccattttctcttgggaggaattcctggtcatgggtggctctcataattttgatctgcctgaaaagaagagatctgacatctgtacagtaatgtatacaagcggcacaacgggagaccctaaaggagttatgatatcaaatgaaagccttcttgtaaatattgtgggccctgattctgtacttcagtatattggtgaagttatagatcaagatgatgtctatttgtcatatcttccactagcccatgtctttgatagaatgtttgaggaagtgttcattcaccatggatcaaaaattggattttggtgtggggatgtcaaactattggttgatgacattgaagcactaaaaccaacattattttgtgctgttccacgtgtgctggataggatatattcaggtcttacaactaggattttgtcaggtggtatactgaagaaaactttattcaacattgcttataagatgaaactggacaatatgaggaaaggaattaaacatgagacggcagccccattctttgacaaattagttttcagcaaggtgaaagaaaggcttggtggaaaattaagacttattatatctggaggtgcccctctagctgtaccagtggaagaatttttgagggttgtgacatgtgcttatgttgttcaaggctatggactcacggaaacttgtgcgggatctatagtttcgataccaaatgaatactccatgcttgggactgttggtccacctgttccacatatagatgtacgcctcgagtcagttccagagatgggttatgatgctttgtctactgtcccacgtggagaaatatgcataagaggaagtgttctgttctctggatactacaaaagagaggaccttgtgcaggaagtcatgattgatggctggtttcacactggagatattggtgagtggcaaccagatggatccttaaaagttattgatagaaagaagaatattttcaagctttcacaaggggaatacgttgcagtggaaaatctagagaatgtatatggtgttcttcaagatatagattcaatatgggtatatgggaatagctttgaatcttctcttgtcgctgttgtcaatccgaaccaacaagctcttgaacgctgggcggaacaatacaatattattggaagttttgctgaactatgcgagcattcaagagccaaagaacatattattgcagagctcacaaagattgcgaaggaaaagaagctaaaaggatttgagttcataaaagctatccatcttgacccattgtcatttgatattgagcgcgatctcatcaccccaacatacaagaagaaacggccacaaatgcttaaatactaccagggagtaatcgatgcgctctacaagagcatgaagtaa

SEQ ID NO: 2710 - protein, 638 aa, Sorghum bicolor
  misc_feature: Ceres ANNOT ID no. 6025750
  misc_feature (71)..(529): Pfam Id: AMP-binding Pfam Desc: AMP-binding enzyme
  misc_feature (6)..(636): NCBI GI: 83320523 NCBI Desc: acs1 [ricinus communis]
  misc_feature (2)..(638): NCBI GI: 115439199 NCBI Desc: os01g0681200 [oryza sativa (japonica cultivar-group)]
  misc_feature (15)..(636): NCBI GI: 74147576 NCBI Desc: acs-like protein [gossypium hirsutum]
  misc_feature (15)..(637): NCBI GI: 74147588 NCBI Desc: acs-like protein [gossypium hirsutum]
  misc_feature (13)..(637): NCBI GI: 20805869 NCBI Desc: long chain acyl-coa synthetase 4 [arabidopsis thaliana]
MKHLVEVEPATATTGPAYRNARAKDGLLQAPPGLHSCWDIFRTSVEKYPDNPMLGRRRVVDGKASDYTWVTYKEVYDDVMKLAASIDKSGIKQGEGCGIYGANCPEWIISMEACNALGVCCVPLYDSLGAGAVEFIICHAEIQIAFVEEKKITEVEAVISFGGVTNDHRDEARNHGLSIFSWEEFLVMGGSHNFDLPEKKRSDICTVMYTSGTTGDPKGVMISNESLLVNIVGPDSVLQYIGEVIDQDDVYLSYLPLAHVFDRMFEEVFIHHGSKIGFWCGDVKLLVDDIEALKPTLFCAVPRVLDRIYSGLTTRILSGGILKKTLFNIAYKMKLDNMRKGIKHETAAPFFDKLVFSKVKERLGGKLRLIISGGAPLAVPVEEFLRVVTCAYVVQGYGLTETCAGSIVSIPNEYSMLGTVGPPVPHIDVRLESVPEMGYDALSTVPRGEICIRGSVLFSGYYKREDLVQEVMIDGWFHTGDIGEWQPDGSLKVIDRKKNIFKLSQGEYVAVENLENVYGVLQDIDSIWVYGNSFESSLVAVVNPNQQALERWAEQYNIIGSFAELCEHSRAKEHIIAELTKIAKEKKLKGFEFIKAIHLDPLSFDIERDLITPTYKKKRPQMLKYYQGVIDALYKSMK

SEQ ID NO: 2711 - DNA, 1950 bp, Sorghum bicolor
  misc_feature: Ceres ANNOT ID no. 6025751
  misc_feature: Encodes the peptide sequence at SEQ ID NO 2712
atgaagcacctggtggaggtggagccggcgacggcgaccacgggtccggcgtaccggaacgcgcgggccaaggacggcctcctgcaggctccgccggggctccacagctgctgggacatcttccggacgtccgtggagaagtaccccaacaaccagatgctaggtcgtcggcgagtggtcgatggcaaggcgggcgaatacacctgggtgacttacaaggaagtctatgatgttgtgatgaagcttgcagcctccattgacaaatccggaatcaaacagggtgaaagctgcggtatatacggcgcaaactgccccgaatggatcatcagcatggaggcttgcaacgcgcttggggtttgctgcgttcccctctacgattctctcggtgctggggccgtggagtttatcatatgccatgccgaaatccagatcgcgtttgtggaggaaaagaagatcacagagctcctgaaaacttgtcatgctacttcgaagtatctgaaaacggtcataagctttggaggagtcacaaatgaccataaagatgaagctaaaaactatggcctgtccattttctcttgggaggaattcctgatcatgggtggctctcataattttgatttgcctgaaaagaagatatctgacatctgtacaataatgtatacaagcggcacaacgggagatcctaaaggagttatgatatcaaatgaaagccttcttgtaaatatcacaggccccgattctgtacttcagtatattggtgaagttttagatcaagatgatgtctatttgtcatatcttccactagcccatatctttgatagaatgtttgaggaagtgttcatttaccatggatcaaagatcggattttggcgtggggatgtcaaactattggttgatgacattgcagcactaaaaccaacaatattctgtgctgttccacgtgtgctggataggatatattcaggtcttacagctaggatttcgtctggtggtatactgaagaaaactttattcaacatcgcttataagatgaaactggacagtatgaggaaaggaattaaacatgagaaggcagccccattctttgacaaattagttttcagcaaggtgaaagaaaggcttggtggaaaattaagagttattgtatctggaggtgcccctctatctgtaccagtggaagaatttttgagggttgtgacatgtgcttatgttattcaaggctatggactgacggaaacttgtgcgggatctatagtttcgataccaaatcaatactccatgcttgggactgttggtccacctgttccacatattgatgtacgccttgagtcagttccagagatgggttatcatgctttgtctagtgtcccacgtggagagatatgcataaggggaagtgttctgttctctggatactacaaaagagaggaccttgtgcaggaagtcatgattgatggctggtttcacactggagatattggtgagtggcaaccagatggatccttaaaagtgattgatagaaagaagaatattttcaagctttcgcagggggaatacgttgcagtggaaaatctagagaatgtatacggtgttcttcaagatatagattcaatatgggtatatgggaatagttttgaatcttctcttgtcgctgttgttaatccgaaccaacaatctcttgagcgctgggcggaacaaaacggtactgctggaagttttgctgaactatgcgagcattccagagccaaagaacatattcttgcagagctcacgaagattgcgaaggaaaagaagctgaaaggttttgagttcataaaagctatccatcttgacccgttgccatttgatatcgaacgcgatctcatcaccccaacatacaagaagaaacggccacaaatgctcaaatactaccagggagtaattgatgcactctacaaaagcatgaagtaa

SEQ ID NO: 2712 - protein, 649 aa, Sorghum bicolor
  misc_feature: Ceres ANNOT ID no. 6025751
  misc_feature (71)..(540): Pfam Id: AMP-binding Pfam Desc: AMP-binding enzyme
  misc_feature (3)..(648): NCBI GI: 74147588 NCBI Desc: acs-like protein [gossypium hirsutum]
  misc_feature (6)..(647): NCBI GI: 83320523 NCBI Desc: acs1 [ricinus communis]
  misc_feature (1)..(649): NCBI GI: 115439199 NCBI Desc: os01g0681200 [oryza sativa (japonica cultivar-group)]
  misc_feature (15)..(647): NCBI GI: 74147576 NCBI Desc: acs-like protein [gossypium hirsutum]
  misc_feature (13)..(648): NCBI GI: 20805869 NCBI Desc: long chain acyl-coa synthetase 4 [arabidopsis thaliana]
MKHLVEVEPATATTGPAYRNARAKDGLLQAPPGLHSCWDIFRTSVEKYPNNQMLGRRRVVDGKAGEYTWVTYKEVYDVVMKLAASIDKSGIKQGESCGIYGANCPEWIISMEACNALGVCCVPLYDSLGAGAVEFIICHAEIQIAFVEEKKITELLKTCHATSKYLKTVISFGGVTNDHKDEAKNYGLSIFSWEEFLIMGGSHNFDLPEKKISDICTIMYTSGTTGDPKGVMISNESLLVNITGPDSVLQYIGEVLDQDDVYLSYLPLAHIFDRMFEEVFIYHGSKIGFWRGDVKLLVDDIAALKPTIFCAVPRVLDRIYSGLTARISSGGILKKTLFNIAYKMKLDSMRKGIKHEKAAPFFDKLVFSKVKERLGGKLRVIVSGGAPLSVPVEEFLRVVTCAYVIQGYGLTETCAGSIVSIPNQYSMLGTVGPPVPHIDVRLESVPEMGYHALSSVPRGEICIRGSVLFSGYYKREDLVQEVMIDGWFHTGDIGEWQPDGSLKVIDRKKNIFKLSQGEYVAVENLENVYGVLQDIDSIWVYGNSFESSLVAVVNPNQQSLERWAEQNGTAGSFAELCEHSRAKEHILAELTKIAKEKKLKGFEFIKAIHLDPLPFDIERDLITPTYKKKRPQMLKYYQGVIDALYKSMK

SEQ ID NO: 2713 - DNA, 1095 bp, Sorghum bicolor
  misc_feature: Ceres ANNOT ID no. 6025761
  misc_feature: Encodes the peptide sequence at SEQ ID NO 2714
  misc_feature: Up-regulated in shoot tissues in response to salicylic acid treatment
atgccgggctcgcccaaggtcttcttcgcctcctccgcctcgcgccgcggcggggcgctgcggcggctgctctccacgccggccttctccgcggcctgcctcctcttcggcctcgccggcttcctcgccgccgcgctcacgctctcgcgctccccgtccgtcactcacagccgctgcccggattcctcgcgcccgctctccgtctccgtcgcgtgggatcgccgcccgggggatggctccgccgcgggctccgcggagctcccggcctcgctcgccaccggatcgcgcggccgccacaaggtcatggccttcgtcgggatcttcaccgggttcggctccattggacgccgccgcgcgctgcgccggacgtggctccccgcggatcgccagggcctacttcgattggaggaagctactggcctggcattccgctttgtgattgggaaaagcaattcaaagaacaagatggctgctcttaatagagaagttgaagaatatgatgattttgtgcttttagatctcgaagaggagtatagcaggctcccatacaaaacgttagctttctttaaggctgcctatgcattgtatgattctgatttctatgttaaagcggatgatgacatttacttgagaccagatagactttccttgcttctggctaaagaacggtcacatccacaaacatacattggatgcatgaagaaggggcctgtttttactgatcctaagttgaaatggtatgagccccaatccttcttactcggatcggaatacttccttcatgcgtatgggccaatttatgctctatcagctgacgtggtggctagcttggttgctttgagaaacaacagtttccgtatgtttagcaacgaggatgttacaattggatcttggatgcttgccatgaacgtcaaccatgagaacacacatgcactttgtgaagctgactgcacggagtcttcagttgctgtttgggacattccaaaatgctcagggctatgccacccagaggtaaaaatgctagagcttcatcaaagaaaagagtgcacaggtggtccaactgttgcagctgaggtgtccgagtctgaggattga

SEQ ID NO: 2714 - protein, 364 aa, Sorghum bicolor
  misc_feature: Ceres ANNOT ID no. 6025761
  misc_feature (115)..(310): Pfam Id: Galactosyl_T Pfam Desc: Galactosyltransferase
  misc_feature (4)..(358): NCBI GI: 7769857 NCBI Desc: f12m16.19 [arabidopsis thaliana]
  misc_feature (156)..(364): NCBI GI: 22553074 NCBI Desc: beta 1,3-glycosyltransferase-like protein iii [oryza sativa]
  misc_feature (29)..(355): NCBI GI: 52421269 NCBI Desc: at2g26100 [arabidopsis thaliana]
  misc_feature (81)..(358): NCBI GI: 115446789 NCBI Desc: os02g0566800 [oryza sativa (japonica cultivar-group)]
  misc_feature (98)..(346): NCBI GI: 21553519 NCBI Desc: avr9 elicitor response-like protein [arabidopsis thaliana]
  misc_feature: Useful for making plants with altered carbohydrate content
  misc_feature: Functional homolog of the protein sequence given in SEQ ID NO 13800
  misc_feature: Up-regulated in shoot tissues in response to salicylic acid treatment
  misc_feature: The sequence is a functional homolog of SEQ ID NO. 346 in the 11/188,298 US application
MPGSPKVFFASSASRRGGALRRLLSTPAFSAACLLFGLAGFLAAALTLSRSPSVTHSRCPDSSRPLSVSVAWDRRPGDGSAAGSAELPASLATGSRGRHKVMAFVGIFTGFGSIGRRRALRRTWLPADRQGLLRLEEATGLAFRFVIGKSNSKNKMAALNREVEEYDDFVLLDLEEEYSRLPYKTLAFFKAAYALYDSDFYVKADDDIYLRPDRLSLLLAKERSHPQTYIGCMKKGPVFTDPKLKWYEPQSFLLGSEYFLHAYGPIYALSADVVASLVALRNNSFRMFSNEDVTIGSWMLAMNVNHENTHALCEADCTESSVAVWDIPKCSGLCHPEVKMLELHQRKECTGGPTVAAEVSESED

SEQ ID NO: 2715 - DNA, 1974 bp, Sorghum bicolor
  misc_feature: Ceres ANNOT ID no. 6025777
  misc_feature: Encodes the peptide sequence at SEQ ID NO 2716
atgccgcccccgccgccgctccacctccgcctccgtctctccctcgtcccgccccaccctatctctccttctctccgccatgcctcccgctcaccctccatcgcgtcctgccctctcgcggtgcgccccttcgcccaacgccgcggtgggcgcccgctctgcgccgtgcggggcggggccgaggccgaggcggagggcttcgcgtggccggatgggtccgaggaggaggagctgcggcggctcctggagctgctccctagggaactgaggcggcgggtggagacccacccggagctccctgcgctcgtggaggtggtcatggacctcggccggcccccgctcgcgcgcttcccgtcaggagacttcctcctctcccaccgccccatctcctttgacgacctccgacatgccacctcccaggttggggactttggagcggataatcgtgctggaatcagccggacgctgcaccggatcagcgcgattaggaaccggaagggcgtcattgtaggcctcacttgccgtgtcgggcgtgcagtgcccgggagcgctaatttgcttcaggacttggttaaggatggtggctcgttgctgctcatcggcccacctggggtggggaagactactgtcataagagaaattgcccgtatgttagctgatgactataagaagcgggtgatgattgtcgacacatctaatgagattggtggggatggtgatattcctcacccaggaataggcaatgcacgtaggttgcaagtgcctaaccaagacatgcagcataaggtactgatagaagctgtggaaaaccatatgcctcaggcaattgttattgatgaaattggaacgaaactagaggccatggctgcaagcaccattgcacagaggggcatacagcttgttgcaactgcccatggtgtaacgatagagaatctgatcatgaacccctcactagagatgcttgtgggaggaatacagagtgtcacacttggtgatgaagaagctaaccggagaggagttcaaaaaactgtcctagagcgcaagggcccatcaacatttacatgtgctgcagagatcgtctcgaaaaaagaattacgtgtccatcgtagtctggaagccacagtagatgctctactcgcaggcaagctgcctaatgttgaaattcggaagttgggttcaaagggattgatgcaggaagtttctgtgcaaaaggaacgatcacatcttggtatctctgatgcaactgaatttgaccgtgactctctaaggaatgccagaagaagcttggactctgcatttaatcttgactctgctgaagggcatatagagaggacagacggagatggttcaagcttgaatctatatgcatatgggatctccgagtcgactgccttgcaagccattcaacagctggagttggaggacattgttactttaacttataatatcagtgaagctgatgcagtgatcgcgttacattcaaagctcaagaagaattctcagattcaggctttggtgaaatctcaagatataccggttttcttcgtgaagacaaactccctgtctcaaatcactcgggcacttcgtgctcttgttgacgatcacatggacgagctgatagactacgatgataaggaagaagcaagatctcccgaggaaactgatgctctggaggaggcaaggctggcaatcgagcaagtagtgatcccgaaaggcgagagcgtgcagctactgccgaggccatcaagcatcatctcatcccaagtggatctcgtcgaaagcttcagcctccagtgggaggtcataggccaggagcctcacgcgtacgtgacgatccttccgcacttcgcgccaaaagaagctgaagctatccagaaagaaaccccagcggcggggctcgccgattcagagagctccgatgacttggatcatgcccagaatggcatcaccaggctacctttcctacccgattag

SEQ ID NO: 2716 - protein, 657 aa, Sorghum bicolor
  misc_feature: Ceres ANNOT ID no. 6025777
  misc_feature (196)..(379): Pfam Id: AAA Pfam Desc: ATPase family associated with various cellular activities(AAA)
  misc_feature (9)..(657): NCBI GI: 55297449 NCBI Desc: atpase-like [oryza sativa (japonica cultivar-group)]
  misc_feature (75)..(657): NCBI GI: 18086459 NCBI Desc: at1g73170/t18k17_17 [arabidopsis thaliana]
  misc_feature (141)..(657): NCBI GI: 145327231 NCBI Desc: atp binding / atp-dependent peptidase/ nucleoside-triphosphatase/ nucleotide binding / serine-type endopeptidase [arabidopsis thaliana]
  misc_feature (3)..(394): NCBI GI: 115470955 NCBI Desc: os07g0187400 [oryza sativa (japonica cultivar-group)]
  misc_feature (3)..(394): NCBI GI: 33146924 NCBI Desc: atpase-like protein [oryza sativa (japonica cultivar-group)]
MPPPPPLHLRLRLSLVPPHPISPSLRHASRSPSIASCPLAVRPFAQRRGGRPLCAVRGGAEAEAEGFAWPDGSEEEELRRLLELLPRELRRRVETHPELPALVEVVMDLGRPPLARFPSGDFLLSHRPISFDDLRHATSQVGDFGADNRAGISRTLHRISAIRNRKGVIVGLTCRVGRAVPGSANLLQDLVKDGGSLLLIGPPGVGKTTVIREIARMLADDYKKRVMIVDTSNEIGGDGDIPHPGIGNARRLQVPNQDMQHKVLIEAVENHMPQAIVIDEIGTKLEAMAASTIAQRGIQLVATAHGVTIENLIMNPSLEMLVGGIQSVTLGDEEANRRGVQKTVLERKGPSTFTCAAEIVSKKELRVHRSLEATVDALLAGKLPNVEIRKLGSKGLMQEVSVQKERSHLGISDATEFDRDSLRNARRSLDSAFNLDSAEGHIERTDGDGSSLNLYAYGISESTALQAIQQLELEDIVTLTYNISEADAVIALHSKLKKNSQIQALVKSQDIPVFFVKTNSLSQITRALRALVDDHMDELIDYDDKEEARSPEETDALEEARLAIEQVVIPKGESVQLLPRPSSIISSQVDLVESFSLQWEVIGQEPHAYVTILPHFAPKEAEAIQKETPAAGLADSESSDDLDHAQNGITRLPFLPD

SEQ ID NO: 2717 - DNA, 783 bp, Sorghum bicolor
  misc_feature: Ceres ANNOT ID no. 6025793
  misc_feature: Encodes the peptide sequence at SEQ ID NO 2718
atgagggcgctgcctcgcgtaggcgagcccgggcccgtgcgctggtggtggttggcctcgcgcgcgcggccgcggcgggcgatggggtcgtcggcgccggcgagggcggcgggcggcagaagggatcccggcgagaacccggcggtggggaggctgcgggagctcttcacaggcgacgcggcagatgggtgggagaagtcctgggagtttggtgtgaccccgtgggatttgggaaagccaacacctgtcatcgagcatcttgttagatcaggaacactcccaaaaggaagagctttggttcctggatgtggaatgggatacgatgtggtcgctctggcaagtcctgaacgttttgttgttggcttggatatttctgatctggctgttaagaaggctaagcagtggtcatcctctttgcccaatgcagattattttacttttctggctgaagatttcttcaagtggataccgagtgaaaaattcgatcttatatttgattacacgttcttttgtgcacttgacccgagcttgagggtggcttgggcagagacagttaaccggcttctaaaaccagatggagagcttcttaccttgatttatctgataagtgatcaagagggaggaccaccttacaataatacagttgctgattatcagaaggtactggaaccgctgggtttgaaggccattcttatggaagacaatgaggtagccattaaaccacggaagggctgtgagaaaattgggaggtggaggagatgtgcacaccaatcatctctgtga

SEQ ID NO: 2718 - protein, 260 aa, Sorghum bicolor
  misc_feature: Ceres ANNOT ID no. 6025793
  misc_feature (59)..(254): Pfam Id: TPMT Pfam Desc: Thiopurine S-methyltransferase (TPMT)
  misc_feature (99)..(195): Pfam Id: Methyltransf_12 Pfam Desc: Methyltransferase domain
  misc_feature (99)..(197): Pfam Id: Methyltransf_11 Pfam Desc: Methyltransferase domain
  misc_feature (63)..(253): NCBI GI: 14583123 NCBI Desc: thiol methyltransferase 1 [brassica oleracea]
  misc_feature (63)..(253): NCBI GI: 14583121 NCBI Desc: thiol methyltransferase 2 [brassica oleracea]
  misc_feature (63)..(253): NCBI GI: 119655911 NCBI Desc: thiol methyltransferase [brassica rapa subsp. chinensis]
  misc_feature (63)..(253): NCBI GI: 4588479 NCBI Desc: methyl chloride transferase [batis maritima]
  misc_feature (64)..(253): NCBI GI: 37520387 NCBI Desc: similar to thiol methyltransferase [gloeobacter violaceus pcc 7421]
MRALPRVGEPGPVRWWWLASRARPRRAMGSSAPARAAGGRRDPGENPAVGRLRELFTGDAADGWEKSWEFGVTPWDLGKPTPVIEHLVRSGTLPKGRALVPGCGMGYDVVALASPERFVVGLDISDLAVKKAKQWSSSLPNADYFTFLAEDFFKWIPSEKFDLIFDYTFFCALDPSLRVAWAETVNRLLKPDGELLTLIYLISDQEGGPPYNNTVADYQKVLEPLGLKAILMEDNEVAIKPRKGCEKIGRWRRCAHQSSL

SEQ ID NO: 2719 - DNA, 843 bp, Sorghum bicolor
  misc_feature: Ceres ANNOT ID no. 6025794
  misc_feature: Encodes the peptide sequence at SEQ ID NO 2720
atggccatgaaggtggacatgtccgcgctcgagaccaacttcgccaacatgactttccccgccagcgacgacacgtacttctccgccggcgcccctgacgtgccgtccatggtgctccccacctgcgacgacttcgacgggttccaggcggacaccaaggccatggtgaagaataagaaggggacgaccacgctcgccttcatcttcgacaagggcgtcatcgtcgccgctgattccagggccagcatgggcggttatatatcctcacaaaccgtgaggaaaattattgaaataaatccttacatgctggggacaatggctggaggcgctgctgattgccaattctggcataggaacctaggaaacaagtgtcgcctccatgagctttcaaacaagcgaaggatctctatagctggtgcttccaaactgttggctaacatcctttattcatatcgtgggatgggactgtcgattggtacaatgattgctggatgggatgagaagggccctggcttgtactatgttgacagtgagggtgcaaggcttgtgggaaacaagttctctgttggctctggttccctctatgcttatggtgttttggacgacggttaccgcttcaacatgtcagttgaggaagctgccgaattagcgcgacgggctatttatggggcaaccttccgtgatgcagcaagtggtggttgtgttagtgtttatcatgttggccctgatggttggacaaagctttctggggatgatgttggggagctgcactaccactactacccggttcagaaaactccggttgaacaggaaatgactgatgcgcctactgcttctgcttaa

SEQ ID NO: 2720 - protein, 280 aa, Sorghum bicolor
  misc_feature: Ceres ANNOT ID no. 6025794
  misc_feature (58)..(240): Pfam Id: Proteasome Pfam Desc: Proteasome A-type and B-type
  misc_feature (3)..(278): NCBI GI: 55297435 NCBI Desc: beta 5 subunit of 20s proteasome [oryza sativa (japonica cultivar-group)]
  misc_feature (3)..(278): NCBI GI: 8671510 NCBI Desc: beta 5 subunit of 20s proteasome [oryza sativa (japonica cultivar-group)]
  misc_feature (6)..(279): NCBI GI: 52548240 NCBI Desc: 20s proteasome beta 5 subunit [triticum aestivum]
  misc_feature (35)..(275): NCBI GI: 92868982 NCBI Desc: peptidase t1a, proteasome beta-subunit [medicago truncatula]
  misc_feature (3)..(274): NCBI GI: 2285800 NCBI Desc: 26s proteasome beta subunit [spinacia oleracea]
  misc_feature (3)..(275): SWISSPROT Homolog: EC 3.4.25.1 Proteasome subunit beta type 5-A precursor
  misc_feature: The sequence is a functional homolog of SEQ ID NO. 409 in the 11/188,298 US application
MAMKVDMSALETNFANMTFPASDDTYFSAGAPDVPSMVLPTCDDFDGFQADTKAMVKNKKGTTTLAFIFDKGVIVAADSRASMGGYISSQTVRKIIEINPYMLGTMAGGAADCQFWHRNLGNKCRLHELSNKRRISIAGASKLLANILYSYRGMGLSIGTMIAGWDEKGPGLYYVDSEGARLVGNKFSVGSGSLYAYGVLDDGYRFNMSVEEAAELARRAIYGATFRDAASGGCVSVYHVGPDGWTKLSGDDVGELHYHYYPVQKTPVEQEMTDAPTASA

SEQ ID NO: 2721 - DNA, 975 bp, Sorghum bicolor
  misc_feature: Ceres ANNOT ID no. 6025807
  misc_feature: Encodes the peptide sequence at SEQ ID NO 2722
atgctccgccgcgccctcctctcctccgcctccccagcactccacggcagggcacgaatccgagccctgcttccccaatggagcagctacgcctccgtggcctcctcctcggccccgccgccggagcagccgccgccgccaccaccacctccatctccgcctcgaggtccgtcgaggtcgggcggtggtggtcccactgtctcgtcgctgaaccctgcagaggttgccaagttcgcttccatcgccgagacttggtgggattctagcggtccattcaaacctctgcatgtgatgaatccaacccgactgtcttttatccgctccactctttgtagacatttcaggagggatccaaattcgtccaagccacttgaaggtctcaaagttattgatgttggatgtggaggtggcattctgtcagagcctcttgctcgaatgggtgctacggtgactggaattgatgccgttgacaagaatataaagattgcaagtattcatgcggcatctgatccaacaactgcttcaattgagtattgttgtgcaacagctgaggaactggtaaaagagaaaaggctgttcgatgctgtaatttctcttgaggtgattgagcatgtcgctaatcctttggagttctgtgaatccctctcggctttgacagctcctaatggtgccactgtggtttccacaatcaaccggtcaatgagagcatatgccactgcaatagttgctgctgagtatatcctcagatggcttcctagaggcacacatgaatggtccaaactggttacccctgaggagcttgtcctaatgctgcaaagggcttctgtctccgtcgaagagatggcagggttcgtttataatccgttgagtggagagtggtccctgtcagatgatatcggtgtgaactacattgcttttggcgtcaagaagagcgaagcatcgtcgacaaatggaagagaagcaggtttatcatag

SEQ ID NO: 2722 - protein, 324 aa, Sorghum bicolor
  misc_feature: Ceres ANNOT ID no. 6025807
  misc_feature (130)..(227): Pfam Id: Methyltransf_11 Pfam Desc: Methyltransferase domain
  misc_feature (130)..(225): Pfam Id: Methyltransf_12 Pfam Desc: Methyltransferase domain
  misc_feature (2)..(315): NCBI GI: 115466472 NCBI Desc: os06g0152300 [oryza sativa (japonica cultivar-group)]
  misc_feature (2)..(312): NCBI GI: 21536690 NCBI Desc: dihydroxypolyprenylbenzoate methyltransferase [arabidopsis thaliana]
  misc_feature (2)..(312): NCBI GI: 2832402 NCBI Desc: dihydroxypolyprenylbenzoate methyltransferase [arabidopsis thaliana]
  misc_feature (59)..(313): NCBI GI: 119385316 NCBI Desc: ubiquinone biosynthesis o-methyltransferase [paracoccus denitrificans pd1222]
  misc_feature (69)..(314): NCBI GI: 114762238 NCBI Desc: 3-demethylubiquinone-9 3-methyltransferase [roseovarius sp. htcc2601]
  misc_feature (2)..(312): SWISSPROT Homolog: EC 2.1.1.114 Hexaprenyldihydroxybenzoate methyltransferase, mitochondrial precursor
  misc_feature (68)..(304): SWISSPROT Homolog: EC 2.1.1.64 3-demethylubiquinone-9 3-methyltransferase
  misc_feature: The sequence is a functional homolog of SEQ ID NO. 415 in the 11/188,298 US application
MLRRALLSSASPALHGRARIRALLPQWSSYASVASSSAPPPEQPPPPPPPPSPPRGPSRSGGGGPTVSSLNPAEVAKFASIAETWWDSSGPFKPLHVMNPTRLSFIRSTLCRHFRRDPNSSKPLEGLKVIDVGCGGGILSEPLARMGATVTGIDAVDKNIKIASIHAASDPTTASIEYCCATAEELVKEKRLFDAVISLEVIEHVANPLEFCESLSALTAPNGATVVSTINRSMRAYATAIVAAEYILRWLPRGTHEWSKLVTPEELVLMLQRASVSVEEMAGFVYNPLSGEWSLSDDIGVNYIAFGVKKSEASSTNGREAGLS

SEQ ID NO: 2723 - DNA, 1128 bp, Sorghum bicolor
  misc_feature: Ceres ANNOT ID no. 6025808
  misc_feature: Encodes the peptide sequence at SEQ ID NO 2724
atgaagatccagtgcaacgcgtgcggggccgcggaggcgcgggtgctgtgctgcgcggacgaggccgcgctctgcgtcgcctgcgacgaggaggtgcacgccgccaacaaactcgccgggaagcaccagcgggtgccgctcctgacggacgccgacgccgctgggaccgccgccgcggcgccggccgtgcccaagtgcgacatctgtcaggaggcttctggatacttcttctgcctagaggaccgtgcactactttgtagagactgtgatgttgctatacacacagtaaattcctttgtttcagtacaccagagattcctgctaactggagttcaggtgggccttgatcctgctgatccagttccacctattgctgaaaagcatgttaatgccgctggtggatcagtaaatcaaccagtgaaacatctgccaaggagaagcccgacagttcaattttcagttgaaggcagtgcttctgttccaagcaaaaatgtaacaaatggagattattcaaggcagaattctgttccaacagccagggcagaagtggttgattggactatgaacaatagtacaattcgttcagtagaatccccgcctaagtacatgtcagaggaaagtccaacacttctgcaatctagccagaccacaacagccttcaaccaaattaacggcaatagtgatgggccctaccacttgtcattctcaggtggtaatgtgacagacagtctaccagattggcctgtggaagagttcttcagtaactcagaatatggtccaaactttggcttctccgagcatggttcttctaagggtgataatgctaagctggggaatgctggtggttctccacaatgccgtttagctgaaggctccgttgctgaggaactattagggcaggtgcctggattgatcacagatgaatatatgagccgagtacctgagaattcatggacagtacctgaggttccctcgccaccaacagcctcggggctcaattggcatgggaatttgtgtttccctgcatatgacagcaccatgtttgttcctgaaattacctccctccagacctcccaaaatcagttcgccgtaccttccagtttcaagcgccggagaagagagtattga

SEQ ID NO: 2724 - protein, 375 aa, Sorghum bicolor
  misc_feature: Ceres ANNOT ID no. 6025808
  misc_feature (1)..(47): Pfam Id: zf-B_box Pfam Desc: B-box zinc finger
  misc_feature (61)..(108): Pfam Id: zf-B_box Pfam Desc: B-box zinc finger
  misc_feature (1)..(144): NCBI GI: 4836873 NCBI Desc: highly similar to rice zinc finger protein [arabidopsis thaliana]
  misc_feature (1)..(302): NCBI GI: 115435138 NCBI Desc: os01g0202500 [oryza sativa (japonica cultivar-group)]
  misc_feature (1)..(131): NCBI GI: 116310380 NCBI Desc: h0115b09.3 [oryza sativa (indica cultivar-group)]
  misc_feature (1)..(186): NCBI GI: 47497925 NCBI Desc: zinc finger protein [oryza sativa (japonica cultivar-group)]
  misc_feature (1)..(215): NCBI GI: 90265170 NCBI Desc: h0522a01.9 [oryza sativa (indica cultivar-group)]
  misc_feature: The sequence is a functional homolog of SEQ ID NO 1023 in the 10/666,642US patent application
  misc_feature: The sequence is a functional homolog of SEQ ID NO 1024 in the 10/666,642US patent application
  misc_feature: The sequence is a functional homolog of SEQ ID NO 1370 in the 10/666,642US patent application
  misc_feature: The sequence is a functional homolog of SEQ ID NO 16 in the 10/412,699US patent application
  misc_feature: The sequence is a functional homolog of SEQ ID NO 1645 in the 10/374,780US patent application
  misc_feature: The sequence is a functional homolog of SEQ ID NO 1646 in the 10/374,780US patent application
  misc_feature: The sequence is a functional homolog of SEQ ID NO 1671 in the 10/412,699US patent application
  misc_feature: The sequence is a functional homolog of SEQ ID NO 1672 in the 10/412,699US patent application
  misc_feature: The sequence is a functional homolog of SEQ ID NO 2246 in the 10/374,780US patent application
  misc_feature: The sequence is a functional homolog of SEQ ID NO 236 in the 10/666,642US patent application
  misc_feature: The sequence is a functional homolog of SEQ ID NO 256 in the 10/714,887US patent application
  misc_feature: The sequence is a functional homolog of SEQ ID NO 256 in the 11/435,388US patent application
  misc_feature: The sequence is a functional homolog of SEQ ID NO 670 in the 10/225,066US patent application
  misc_feature: The sequence is a functional homolog of SEQ ID NO 90 in the 10/412,699US patent application
  misc_feature: The sequence is a functional homolog of SEQ ID NO 908 in the 10/412,699US patent application
  misc_feature: Useful for making plants with altered Lignin content
  misc_feature: Useful for making plants with modulated growth and phenotype characteristics
  misc_feature: GREAT-hit functional homolog of the protein sequence given in SEQ ID NO 12894
  misc_feature: The sequence is a functional homolog of SEQ ID NO 16 in the 20040045049 US patent application
  misc_feature: The sequence is a functional homolog of SEQ ID NO 1671 in the 20040045049 US patent application
  misc_feature: The sequence is a functional homolog of SEQ ID NO 1672 in the 20040045049 US patent application
  misc_feature: The sequence is a functional homolog of SEQ ID NO 90 in the 20040045049 US patent application
  misc_feature: The sequence is a functional homolog of SEQ ID NO 908 in the 20040045049 US patent application
  misc_feature: Useful for making plants with altered lignin content
  misc_feature: Functional homolog of the protein sequence given in SEQ ID NO 12894
  misc_feature: The sequence is a functional homolog of SEQ ID NO 1023 in the 10/666,642 US patent application
  misc_feature: The sequence is a functional homolog of SEQ ID NO 1645 in the 10/374,780 US patent application
  misc_feature: The sequence is a functional homolog of SEQ ID NO 1671 in the 10/412,699 US patent application
  misc_feature: The sequence is a functional homolog of SEQ ID NO 236 in the 10/666,642 US patent application
  misc_feature: The sequence is a functional homolog of SEQ ID NO 908 in the 10/412,699 US patent application
  misc_feature: The sequence is a functional homolog of SEQ ID NO. 370 in the 11/188,298 US application
MKIQCNACGAAEARVLCCADEAALCVACDEEVHAANKLAGKHQRVPLLTDADAAGTAAAAPAVPKCDICQEASGYFFCLEDRALLCRDCDVAIHTVNSFVSVHQRFLLTGVQVGLDPADPVPPIAEKHVNAAGGSVNQPVKHLPRRSPTVQFSVEGSASVPSKNVTNGDYSRQNSVPTARAEVVDWTMNNSTIRSVESPPKYMSEESPTLLQSSQTTTAFNQINGNSDGPYHLSFSGGNVTDSLPDWPVEEFFSNSEYGPNFGFSEHGSSKGDNAKLGNAGGSPQCRLAEGSVAEELLGQVPGLITDEYMSRVPENSWTVPEVPSPPTASGLNWHGNLCFPAYDSTMFVPEITSLQTSQNQFAVPSSFKRRRREY

SEQ ID NO: 2725 - DNA, 396 bp, Sorghum bicolor
  misc_feature: Ceres ANNOT ID no. 6025809
  misc_feature: Encodes the peptide sequence at SEQ ID NO 2726
atgtcgtggcagacgtacgtcgacgaccacctgatgtgcgagatcgatggccagcacctcagcgccgccgccatcttcggcctcgacggcagcctctgggcgcagtccacgggcttcccccagttaaagcctgaggaggttgctgcgatcacgaaggactttgatgagcctggtactcttgcaccaactggtctttttgttggaggtacaaagtacatggtgatccaaggtgaacctggagctgtcatccgaggaaagaagggaactggaggcattactatcaagaaaactggcatggccttgattattggtatctatgatgagccaatgactccagggcaatgcaatatggtggtggagaggctcggagattacctggtcgagcagggcttctaa

SEQ ID NO: 2726 - protein, 131 aa, Sorghum bicolor
  misc_feature: Ceres ANNOT ID no. 6025809
  misc_feature (2)..(126): Pfam Id: Profilin Pfam Desc: Profilin
  misc_feature (1)..(131): NCBI GI: 2642324 NCBI Desc: profilin [zea mays]
  misc_feature (1)..(131): NCBI GI: 11493677 NCBI Desc: profilin 5 [zea mays]
  misc_feature (1)..(130): NCBI GI: 85701214 NCBI Desc: profilin (allergen fra a 4)
  misc_feature (1)..(130): NCBI GI: 6979167 NCBI Desc: latex profilin hev b 8 [hevea brasiliensis]
  misc_feature (1)..(131): NCBI GI: 1709779 NCBI Desc: profilin-1
  misc_feature: The plant is abnormally small.
  misc_feature: The plant produces a reduced number of seeds.
  misc_feature: Useful for biocontainment applications
  misc_feature: Useful for making plants with modulated biomass
  misc_feature: GREAT-hit functional homolog of the protein sequence given in SEQ ID NO 13035
  misc_feature: Useful for biocontainment applications
  misc_feature: Useful for making plants with modulated biomass
  misc_feature: Functional homolog of the protein sequence given in SEQ ID NO 13035
MSWQTYVDDHLMCEIDGQHLSAAAIFGLDGSLWAQSTGFPQLKPEEVAAITKDFDEPGTLAPTGLFVGGTKYMVIQGEPGAVIRGKKGTGGITIKKTGMALIIGIYDEPMTPGQCNMVVERLGDYLVEQGF

SEQ ID NO: 2727 - DNA, 744 bp, Sorghum bicolor
  misc_feature: Ceres ANNOT ID no. 6025810
  misc_feature: Encodes the peptide sequence at SEQ ID NO 2728
atggccgcggaggcgggcagccggcgtggggcggcagcgcggaggaaggcgcaggaggcggctgtgggcgccgccgcgagggttcttttctacccgacgctgctgtacaacgttgtgcggagcaaggtccaggccgagttccggtggtgggacgaggtcgatcagttcgttttgcttggagcagttccattccgcagagatgtaacacgcttgcagaagcttggggtacatggcgtgataaccctaaatgaaccatttgagactttggtaccatcatctatgtataagtcacgtgggattgatcaccttgttattcctacaagagattatatgtttgctccttcacttgtggatattaatcaagctattgatttcattcatagaaatgcatcttgtgggaaaataacatatattcactgcaaagctggaaggggacggagtacaacaatcgtcttgtcagctttcgagcatgtacgatctaaaagggctcgagtgctgttgacacattcgcaatggaaggcggttcaagaattcagcaagaagaacactgagcttcctgctctcacaagcgattcagcaacagcatctccagcacgggacgcggtacgggtaacagtagcagatttgaatggcaatgatgctccagagtttcttacaggggatgccagcttgtctagccacaagactacaccgtcaaggccaatgattaagatgctgtcatgcttgtttccttctcggatctga

SEQ ID NO: 2728 - protein, 247 aa, Sorghum bicolor
  misc_feature: Ceres ANNOT ID no. 6025810
  misc_feature (52)..(181): Pfam Id: DSPc Pfam Desc: Dual specificity phosphatase, catalytic domain
  misc_feature (11)..(196): NCBI GI: 115464977 NCBI Desc: os05g0524200 [oryza sativa (japonica cultivar-group)]
  misc_feature (3)..(196): NCBI GI: 74318858 NCBI Desc: dual-specificity protein-like phosphatase 4 [zea mays]
  misc_feature (10)..(152): NCBI GI: 102139981 NCBI Desc: dual specificity protein phosphatase family protein [musa acuminata]
  misc_feature (22)..(178): NCBI GI: 144924691 NCBI Desc: tyrosine specific protein phosphatase and dual specificity protein phosphatase [medicago truncatula]
  misc_feature (17)..(178): NCBI GI: 74318850 NCBI Desc: dual-specificity protein-like phosphatase 1 [zea mays]
MAAEAGSRRGAAARRKAQEAAVGAAARVLFYPTLLYNVVRSKVQAEFRWWDEVDQFVLLGAVPFRRDVTRLQKLGVHGVITLNEPFETLVPSSMYKSRGIDHLVIPTRDYMFAPSLVDINQAIDFIHRNASCGKITYIHCKAGRGRSTTIVLSAFEHVRSKRARVLLTHSQWKAVQEFSKKNTELPALTSDSATASPARDAVRVTVADLNGNDAPEFLTGDASLSSHKTTPSRPMIKMLSCLFPSRI

SEQ ID NO: 2729 - DNA, 432 bp, Sorghum bicolor
  misc_feature: Ceres ANNOT ID no. 6025817
  misc_feature: Encodes the peptide sequence at SEQ ID NO 2730
atggcactagcagctatctataaccttttcatcattaacaaatctggcggtcttatatactacaaggactatggttcagcagggaggatggataccaatgacagtctaagattagcaagtctctggcattcgatgcatgctatctcccagcaactctcccctacccctggttgtaatggcattgatctcttacaagctcataactttgatctccattgctttcaatccctcacagggacaaaatttttcgttgtatgcgaaactggagctccaaatatggaaatgctgctgaaagtgatttatgagctgtacacggactttgttttgaagaatccgttctatgagatggagatgccgattcggtgtgagctgtttgatcacaatctggctcaggtgatccagaaggaccgtgttgcacttctgggtcggtga

SEQ ID NO: 2730 - protein, 143 aa, Sorghum bicolor
  misc_feature: Ceres ANNOT ID no. 6025817
  misc_feature (6)..(136): Pfam Id: Sybindin Pfam Desc: Sybindin-like family
  misc_feature (11)..(135): Pfam Id: Sedlin_N Pfam Desc: Sedlin, N-terminal conserved region
  misc_feature (1)..(83): NCBI GI: 55297276 NCBI Desc: synbindin-like [oryza sativa (japonica cultivar-group)]
  misc_feature (26)..(133): NCBI GI: 24582905 NCBI Desc: cg9298-pa [drosophila melanogaster]
  misc_feature (26)..(135): NCBI GI: 31223771 NCBI Desc: ensangp00000011080 [anopheles gambiae]
  misc_feature (26)..(133): NCBI GI: 54644131 NCBI Desc: ga21680-pa [drosophila pseudoobscura]
  misc_feature (29)..(134): NCBI GI: 41152142 NCBI Desc: trafficking protein particle complex 4 [danio rerio]
MALAAIYNLFIINKSGGLIYYKDYGSAGRMDTNDSLRLASLWHSMHAISQQLSPTPGCNGIDLLQAHNFDLHCFQSLTGTKFFVVCETGAPNMEMLLKVIYELYTDFVLKNPFYEMEMPIRCELFDHNLAQVIQKDRVALLGR

SEQ ID NO: 2731 - DNA, 1188 bp, Sorghum bicolor
  misc_feature: Ceres ANNOT ID no. 6025823
  misc_feature: Encodes the peptide sequence at SEQ ID NO 2732
atggcgtggcggcggctgctgctccttgtcgtcgtcgttatcgtcgcgctcttggtgttcatgtctgccggcggggcggccaccacgaccgtagacgtcaagcactacggggccaagggaaacggcgtcgacgacgacaccaagcctctgatgacggcgtggaaggcggcgtgcgggtccgccggcgcggtgacgatgctgctgtcgccggggacgtactacatcggccccgtgcagttccacggcccctgcaacgcctccaccttgaccttccagctgcaggggacactcaaggctgacacggacctgagtcggttccgcaacgactggatcgagttcggctgggtcaccgggctcaccgtcgccggcggcgtcatcgacggccagggcgccgcgtcctggcccttcaaccagtgccctttccgcaaggactgcaaagtcctgcccaccagcgtgcggttcgtcaacacccggaacacggcggtgcggggtgtgacgtcggtgaaccccaagttcttccacatggcgctgctgcaggcgaggggcgtccggatgagcgggctccggatcagcgcgccggccggcagccccaacacggacggcatccacatcgagcgcagcgccggggtgtccatcacggacgcgcgcatcggcacgggcgacgactgcatctccatcggccagggcaacgacggcgtggacgtggcccgcgtgcggtgcggccctggccacggcatgagcgtcggcagcctcggccggtacgccggcgagggcgacgtcacgcgggtgcgcgtccgcgacgtcgtcttcaccggcaccgacaacggcgtccgcatcaagacgtgggagaactcccccaccaagagcagcgccgcgcacatgctcttcgagagcttgctcatggtggacgtccggaaccccatcatcatcgaccagaagtactgcccctactacacctgcgagcacaagtacgtgtccggggtgacgctccaggacatccagttcaagaacatcaagggcacgacgacgacgccggttgcggtgacgctcaggtgcggcgtgccgtgccagggcctggtgctgcaggacgtggacctcaagtataagggggagggcggcacgtcggccaagtgcgagaacgccacggcgaagtatgtcggctaccagttccccaagccctgcacctag

SEQ ID NO: 2732 - protein, 395 aa, Sorghum bicolor
  misc_feature: Ceres ANNOT ID no. 6025823
  misc_feature (58)..(394): Pfam Id: Glyco_hydro_28 Pfam Desc: Glycosyl hydrolases family 28
  misc_feature (11)..(394): NCBI GI: 34223511 NCBI Desc: oil palm polygalacturonase allergen pest459 [elaeis guineensis]
  misc_feature (31)..(394): NCBI GI: 7268611 NCBI Desc: polygalacturonase-like protein [arabidopsis thaliana]
  misc_feature (51)..(394): NCBI GI: 2832691 NCBI Desc: polygalacturonase-like protein [arabidopsis thaliana]
  misc_feature (5)..(394): NCBI GI: 61393763 NCBI Desc: polygalacturonase [lilium longiflorum]
  misc_feature (32)..(391): NCBI GI: 49523394 NCBI Desc: polygalacturonase [platanus x acerifolia]
  misc_feature: Useful for making plants with altered cell wall content and/or composition
  misc_feature: Functional homolog of the protein sequence encoded by LOCUS at4g18180
MAWRRLLLLVVVVIVALLVFMSAGGAATTTVDVKHYGAKGNGVDDDTKPLMTAWKAACGSAGAVTMLLSPGTYYIGPVQFHGPCNASTLTFQLQGTLKADTDLSRFRNDWIEFGWVTGLTVAGGVIDGQGAASWPFNQCPFRKDCKVLPTSVRFVNTRNTAVRGVTSVNPKFFHMALLQARGVRMSGLRISAPAGSPNTDGIHIERSAGVSITDARIGTGDDCISIGQGNDGVDVARVRCGPGHGMSVGSLGRYAGEGDVTRVRVRDVVFTGTDNGVRIKTWENSPTKSSAAHMLFESLLMVDVRNPIIIDQKYCPYYTCEHKYVSGVTLQDIQFKNIKGTTTTPVAVTLRCGVPCQGLVLQDVDLKYKGEGGTSAKCENATAKYVGYQFPKPCT

SEQ ID NO: 2733 - DNA, 1038 bp, Sorghum bicolor
  misc_feature: Ceres ANNOT ID no. 6025841
  misc_feature: Encodes the peptide sequence at SEQ ID NO 2734
atgatctcttttaacaatttatttgggagctcgctgcagccttctctcaagttttacagaaaatgcctgacaaataacccatattttgcgctgaccatgcattcagttacaaagcccttgggtacagctatgatggtgaagagggcacgtttgaagccgcatgccacagacatgaagcggaacccccaggtacatgagctttacgaattggtttatagacttccagagaaccttagctggctgttggcaccaccagaagttcctaaaagacctacctcgaagaagaaaaaacaaaaggatgaaatagtgactagtaacagctttggtgtgatcttggagtgggagggagttgttgtggacgatgatgatccagacttggagccccgggtttggtatgttctatcacttgaagagggaaagtctttccctccagatgcattgctgaagaaaattgagggaatgagaactgaccaggctatttcagaagtcttatgttggtcagaagatccagcagaaattcaaaggttggcagcacacaaggaggtaatatatcaaacactcagaggtggatactaccagctgcgatcaggtgtgcttgatttcttgaacacccttgtgggtttggacattccaatagcaattgcaactcctcactcaaggaagagtctcgaagaagggattaaaactgttggtctgcaaggctactttgatgctataattgcattggaggacttctgcctagggaaacctgatggtgagatgtttgaggtcgcggcagagcaacttggtctggagccagatgtttgtgttgtgtttggtaactcaaacttgacgacggaatctgcacataacgctgggatgaggtgtgtggcagttgcaggccgacaccctgcctatgagctccaagcagcaaaccatgttgtgagatggcttgaccaactctctattgttgacttgcagaggcttgctaatggtgaagttattggtcgcaggggtagagaatctgacatggatatggaaattgtgattgaggaatga

SEQ ID NO: 2734 - protein, 345 aa, Sorghum bicolor
  misc_feature: Ceres ANNOT ID no. 6025841
  misc_feature (114)..(295): Pfam Id: Hydrolase Pfam Desc: haloacid dehalogenase-like hydrolase
  misc_feature (1)..(345): NCBI GI: 10444400 NCBI Desc: genetic modifier [zea mays]
  misc_feature (1)..(345): NCBI GI: 38345749 NCBI Desc: osjnba0065o17.2 [oryza sativa (japonica cultivar-group)]
  misc_feature (1)..(345): NCBI GI: 116310394 NCBI Desc: osigba0137d06.5 [oryza sativa (indica cultivar-group)]
  misc_feature (82)..(341): NCBI GI: 92894210 NCBI Desc: histidine acid phosphatase; had-superfamily hydrolase subfamily ia, variant 3 [medicago truncatula]
  misc_feature (84)..(327): NCBI GI: 145342111 NCBI Desc: inhibitor of striate chloroplast protein-like protein [ostreococcus lucimarinus cce9901]
MISFNNLFGSSLQPSLKFYRKCLTNNPYFALTMHSVTKPLGTAMMVKRARLKPHATDMKRNPQVHELYELVYRLPENLSWLLAPPEVPKRPTSKKKKQKDEIVTSNSFGVILEWEGVVVDDDDPDLEPRVWYVLSLEEGKSFPPDALLKKIEGMRTDQAISEVLCWSEDPAEIQRLAAHKEVIYQTLRGGYYQLRSGVLDFLNTLVGLDIPIAIATPHSRKSLEEGIKTVGLQGYFDAIIALEDFCLGKPDGEMFEVAAEQLGLEPDVCVVFGNSNLTTESAHNAGMRCVAVAGRHPAYELQAANHVVRWLDQLSIVDLQRLANGEVIGRRGRESDMDMEIVIEE

SEQ ID NO: 2735 - DNA, 1041 bp, Sorghum bicolor
  misc_feature: Ceres ANNOT ID no. 6025842
  misc_feature: Encodes the peptide sequence at SEQ ID NO 2736
atggcgggagaggaggccgggaggaggggggttccctctctcctcaacccgccgtccgcttccagcgaagggcagcaggaacacatcgcctctgatgtcactcagctcatcgggtggacacctctgatcgagctcaagcgaattgccgacaaggaaggggtagatgcccggatcgtcggcaaggtcgaggcgtaccagcctctctgctccgtcaaggatcgcagcgctttgagaatgattgaagatgcagaggagagggggttgatttcacccggtgtgacgacacttgtcgagccgacaagcggcaacttagggttaggattagtactcattgctcttcgcaaaggttacaggttcgttgcagttatgccaggtcaatactcgctcgataagcagatcctgttgaggtacatgggtgcagagttgtatttaacagatccagcccttggtttcccgggcatagatgcgaaggttgaggagctcaaaaaagaattgcccaatgtacatgttcttgatcaattcaagaacaaagcaaatcctgaagcacatattagatggactggacctgagatttggaaggacactgctggcaaggtggacatatttgtagctggttcaggctcaggaggtacggtgtctggtgttgggaagtatctgaagacgcaaaaccccagtatcaagatcatctgtgttgagcctgcagagagtccagttgtttcaggtggcgaaccaggcaaacacaaaatccagggaataggaccaggatttctacctgaagtactggacaccacagttattgatgaagctgtcacagtgaccactgatgaagcgatggtgcacgctaggaggttggccagggaagagggtcttcttgtgggcatatcttctggagcaaacttggcagcttgcttgaaggtcgcatcaagagaagaaaataaggggaagatgattgtcaccatgtttccaagtgggggcgagagatacatgaattctgacctttttgctgctgctagagaggagtgtattgccatgacattttga

SEQ ID NO: 2736 - protein, 346 aa, Sorghum bicolor
  misc_feature: Ceres ANNOT ID no. 6025842
  misc_feature (33)..(323): Pfam Id: PALP Pfam Desc: Pyridoxal-phosphate dependent enzyme
  misc_feature (4)..(346): NCBI GI: 115468570 NCBI Desc: os06g0564500 [oryza sativa (japonica cultivar-group)]
  misc_feature (25)..(346): NCBI GI: 92874757 NCBI Desc: pyridoxal-5-phosphate-dependent enzyme, beta subunit [medicago truncatula]
  misc_feature (17)..(344): NCBI GI: 3290022 NCBI Desc: cysteine synthase; cs-b; o-acetylserine (thiol) lyase; plastidic isoform [solanum tuberosum]
  misc_feature (17)..(344): NCBI GI: 12081919 NCBI Desc: plastidic cysteine synthase 1 [solanum tuberosum]
  misc_feature (27)..(346): NCBI GI: 11131901 NCBI Desc: cysteine synthase (o-acetylserine sulfhydrylase) (o-acetylserine (thiol)-lyase) (csase) (oas-tl)
  misc_feature (17)..(344): SWISSPROT Homolog: EC 2.5.1.47 Cysteine synthase, chloroplast/chromoplast precursor
  misc_feature: Useful for making plants with modulated cold sensitivity
  misc_feature: GREAT-hit functional homolog of the protein sequence given in SEQ ID NO 13038
  misc_feature: Useful for making plants with modulated cold sensitivity
  misc_feature: Functional homolog of the protein sequence given in SEQ ID NO 13038
MAGEEAGRRGVPSLLNPPSASSEGQQEHIASDVTQLIGWTPLIELKRIADKEGVDARIVGKVEAYQPLCSVKDRSALRMIEDAEERGLISPGVTTLVEPTSGNLGLGLVLIALRKGYRFVAVMPGQYSLDKQILLRYMGAELYLTDPALGFPGIDAKVEELKKELPNVHVLDQFKNKANPEAHIRWTGPEIWKDTAGKVDIFVAGSGSGGTVSGVGKYLKTQNPSIKIICVEPAESPVVSGGEPGKHKIQGIGPGFLPEVLDTTVIDEAVTVTTDEAMVHARRLAREEGLLVGISSGANLAACLKVASREENKGKMIVTMFPSGGERYMNSDLFAAAREECIAMTF

SEQ ID NO: 2737 - DNA, 1146 bp, Sorghum bicolor
  misc_feature: Ceres ANNOT ID no. 6025847
  misc_feature: Encodes the peptide sequence at SEQ ID NO 2738
atgggcggcgagaaagaaacctttgacatctccgacctcaacgcctccctccccgcggccgctgcagccctcagcgccgaggaccgcgctggcctcgtcaatgcccttaaggataagctgcagagcctggcgggccagcacgccgatgtgctagagtcgctttcgcccaatgttaggaagcgtgttgagtttttgagagagatccagagccaacatgatgaaattgaggccaagttttttgaagagcgagctgcacttgaggcaaagtaccagaagctttatgaacctttatacacaaagaggtatgacattgtaaatggagtagtggaggtagatggtgtcagtgatgaaccgaccagtgagaatgctgctgagggaaaagaaccagatgctaaaggagttccagatttttggcttactgctttgaaaacaaatgaagttttgtctgaggagatccaagagcgtgatgaacctgcgctgaaatatctaaaagatatcaagtggtccagaatcgaggatcctaagggtttcaagctggagtttttctttgatacaaacccattcttcaagaactctgtcctgacaaaaacttaccacatggttgatgaagatgacccaattttggagaaagctattggaactgacatcgattggtatcctgggaagaacctaacacagaagattctaaaaaagaaacccaagaaaggttcaaagaatacaaagcctattactaaaactgaggactgtgagagtttcttcaactttttcaatcccccacaggtccctgaagacgatgaggacattgatgaagacactgctgatgagctgcagggagaaatggagcatgattatgacattgggaccaccataagggataaaattatcccacatgcagtttcatggtttactggtgaggctgtacaaggtgatgattttgctgacttgggcgacgatgatgaggatgatgatgaagatgacgacgatgaggaggatgaagaggatgaggacgaggatgaagacgacgaggaggatgatgaggaagaaagcaagccagcacggaagtcgggatctggtcgcaaacataaggggccgcagaaggtgtcgcaaggaaatgctgaacaaccagcggagtgcaagcagcagtaa

SEQ ID NO: 2738 - protein, 381 aa, Sorghum bicolor
  misc_feature: Ceres ANNOT ID no. 6025847
  misc_feature (59)..(308): Pfam Id: NAP Pfam Desc: Nucleosome assembly protein (NAP)
  misc_feature (1)..(381): NCBI GI: 29569109 NCBI Desc: nucleosome/chromatin assembly factor group a [zea mays]
  misc_feature (1)..(381): NCBI GI: 45433309 NCBI Desc: nucleosome assembly protein 1-like protein 1 [oryza sativa]
  misc_feature (1)..(381): NCBI GI: 145329176 NCBI Desc: nap1;2 (nucleosome assembly protein1;2) [arabidopsis thaliana]
  misc_feature (1)..(381): NCBI GI: 140051848 NCBI Desc: nucleosome assembly protein (nap) [medicago truncatula]
  misc_feature (1)..(381): NCBI GI: 45433311 NCBI Desc: nucleosome assembly protein 1-like protein 2 [oryza sativa]
MGGEKETFDISDLNASLPAAAAALSAEDRAGLVNALKDKLQSLAGQHADVLESLSPNVRKRVEFLREIQSQHDEIEAKFFEERAALEAKYQKLYEPLYTKRYDIVNGVVEVDGVSDEPTSENAAEGKEPDAKGVPDFWLTALKTNEVLSEEIQERDEPALKYLKDIKWSRIEDPKGFKLEFFFDTNPFFKNSVLTKTYHMVDEDDPILEKAIGTDIDWYPGKNLTQKILKKKPKKGSKNTKPITKTEDCESFFNFFNPPQVPEDDEDIDEDTADELQGEMEHDYDIGTTIRDKIIPHAVSWFTGEAVQGDDFADLGDDDEDDDEDDDDEEDEEDEDEDEDDEEDDEEESKPARKSGSGRKHKGPQKVSQGNAEQPAECKQQ

SEQ ID NO: 2739 - DNA, 1434 bp, Sorghum bicolor
  misc_feature: Ceres ANNOT ID no. 6025910
  misc_feature: Encodes the peptide sequence at SEQ ID NO 2740
atgagctccagcgtgcgagttctcaacgtcacccatgtcctcccggatcaaaatcgagctgcgctgtactcgccgtcgccgcagcagcttctccccgacgacgacagcatcatgaagctgtcgttcatggactccctgttcgtcgacaggatcatgccgatgcggcggctgttcttgtacgagggccccggcgtcccgcccttcccggacctcgtcggctccctgcagtcctccctcgccaccgtgctcgccatcttcttccctctcgcagggaagctcacctaccgcccatcacccggcggtgacgtcgtcgtggactgctcgccggccgcggtgtcgccaggcgtcaagttcgtggaggccgagtacgccggcagcatcgacgacatgcgccgcgtggccagtgccagtagcgacggcgacgagggcgacagggacgcgctgacggagctcgggcccgagctggacgcgaggcagctgccggccccggtgatagcggtgcaggtcaccaggccgggcgtcggcggcgggcgcgctgtggtggtcgcggtggccatccaccacgccgtggctgacggccactccgtgtggcagttcatgagggcgtggacagccgtggcgcggacggagcagggctcggcggccatggcgcgcctcgtgccgccgacgtttgaccggacgacggtgattcggtaccccgaagctgacgagctcgcctccaagatcttgcgcgcgattgcgccggcgctgcctgtggtgagatcgccgtcgtcgtgctcgccgccggaccggtcgaggaggagctttctgatccacgccgacgagatccagtcggtgaagcagcagatacgggcacaaacagagaccgccgtcgccgagcagctggagacacctccaactccaagcacctacgtcgcggtgtcgtccctggtgtggacatccatcgtgcgcgccaagtcccgagccccgcacctcgccgtcgccggcgacgacgcctactactactttctggtggccgtggactaccgccgccggcgccgcctcggccctgaggtcaacgagcggtacttcggcaactgcgtcgtgccgtgcgtggccagagccgccgcgcgcgacctgtgcggcggcgacgacccggaggacccggtgcgcgccatggagagctggctggactcgttgctcgcggctccgaaggagaggttcacgttcacggggtcgtccaacaggttcatggcgtacgagacggacttcgggtggggcgcgccgagccgggtggagctcgtgtcgctcttcgccacggagctggtgctgctggtgggcgcggaggacggcggcgtgcaggtcaccgtgacgctcgatccagtgcagatggagggcttcgcgtccaacctcctgcgggtagcacgtagcagggcgagggaacgaggtatatag

SEQ ID NO: 2740 - protein, 477 aa, Sorghum bicolor
  misc_feature: Ceres ANNOT ID no. 6025910
  misc_feature (3)..(467): Pfam Id: Transferase Pfam Desc: Transferase family
  misc_feature (24)..(465): NCBI GI: 115475015 NCBI Desc: os08g0174100 [oryza sativa (japonica cultivar-group)]
  misc_feature (1)..(468): NCBI GI: 115466378 NCBI Desc: os06g0145300 [oryza sativa (japonica cultivar-group)]
  misc_feature (106)..(465): NCBI GI: 57899019 NCBI Desc: acyltransferase -like [oryza sativa (japonica cultivar-group)]
  misc_feature (1)..(203): NCBI GI: 55297124 NCBI Desc: anthocyanin 5-aromatic acyltransferase-like [oryza sativa (japonica cultivar-group)]
  misc_feature (38)..(467): NCBI GI: 115460852 NCBI Desc: os04g0638100 [oryza sativa (japonica cultivar-group)]
MSSSVRVLNVTHVLPDQNRAALYSPSPQQLLPDDDSIMKLSFMDSLFVDRIMPMRRLFLYEGPGVPPFPDLVGSLQSSLATVLAIFFPLAGKLTYRPSPGGDVVVDCSPAAVSPGVKFVEAEYAGSIDDMRRVASASSDGDEGDRDALTELGPELDARQLPAPVIAVQVTRPGVGGGRAVVVAVAIHHAVADGHSVWQFMRAWTAVARTEQGSAAMARLVPPTFDRTTVIRYPEADELASKILRAIAPALPVVRSPSSCSPPDRSRRSFLIHADEIQSVKQQIRAQTETAVAEQLETPPTPSTYVAVSSLVWTSIVRAKSRAPHLAVAGDDAYYYFLVAVDYRRRRRLGPEVNERYFGNCVVPCVARAAARDLCGGDDPEDPVRAMESWLDSLLAAPKERFTFTGSSNRFMAYETDFGWGAPSRVELVSLFATELVLLVGAEDGGVQVTVTLDPVQMEGFASNLLRVARSRARERGI

SEQ ID NO: 2741 - DNA, 1998 bp, Sorghum bicolor
  misc_feature: Ceres ANNOT ID no. 6025919
  misc_feature: Encodes the peptide sequence at SEQ ID NO 2742
atggccggcgccgccgtgctccggcgttccgctcgccgtatttaccggcacctcgccgccgcccctgcgttctcccgcagtgtgctccagcagcccaagcgcctcctgtcgtcgcagtcgtcgccggagcacggcgcgcgcggcgcggtttccgggtctgagctggcgctgtacccgccggagcgggtccggaacttctcgatcatcgcgcacgtcgaccacggcaagtcgacgctggctgatcggctgctggagctcaccggtaccatccagaagggccatgggcagccccagtacctcgacaagctgcaagttgagagagaaagggggattacggtcaaagcacaaacagcaacaatgttctataggcacgttagtgcatctcaggactcagatacgccaaaatatttgcttaatctgattgatacgccaggccatgtggatttcagctatgaggtatccaggtcccttgcagcttgccagggtgctcttttagtagttgacgcagcacaaggagtacaagctcaaacaatagcaaacttttaccttgcctttgaatcaaatttgagtatcattcctgtgattaacaagattgatcagccgactgctgacccagataatgtaaaggatcaattgaagaggttgtttgacattgatccaagtgaagctctgcttacttctgccaagactggtcaaggccttgagcaggtattgcctgctgttattgaacgcataccttccccacctgggaaatgtgatgcacctgtacggatgttgcttttggattcctactatgatgaatacaaaggcgtgatttgccatgttgctattgttgatggtgctctgcgtaaaggtgataagattgcgtcagctgcaactggtcgtgcatatgaagttcttgatgtcggcattatgcaccctgagcttaaacctactggagttctctacactggacaagttggatatgttattagtggaatgcgttcaactaaagaagcacgcattggtgatacccttcaccaggcaaagagtaccgtcgagccacttcctggtttcaagcctgcgaaacacatggtcttctctggtctctatcctgctgatggttctgactttgaagctcttagccatgcgatcgagaaactaacatgtaatgatgccagtgtctctattacaaaggagacaagcaatgcacttggcatgggattcagatgtggcttcctaggattgctacacatggatgtgttccatcaacggcttgaacaagaatatggagctcaagtcatatcgaccataccaaccgtaccttatatttttgaatatggtgatggaagcaaggtgcaagttgagaatcctgctgctttggcttcgaatcctggaaagcgtgtagcagcctgttgggagcccacagttattgcaacaatcattatccctagtgagtatgttgggcctgtcattatgctttgttcagaaagaaggggcgaacagctagaatatacatttattgatgcccaaagggctctgttgaagtaccagttaccattgaaggagatcattgtggacttctacaatgagttgaagggcattacgtctggctatgctacttttgactatgaagattctgaataccaacaatctgatctagttaagatggacatccttcttaatggtcagcctgttgatgctatggcaactatagtgcataaccagaaggctcagcgggttggaaaggaattagtggagaagctcaagaaatttatagaaaggcaaatgtttgagatcaccattcaagcagcaattggttcaaaggttattgcaagggaaaccctgtcagcaatgaggaagaatgttctggccaagtgctatggtggtgatattactcggaagaagaaattgctggagaagcaaaaggaaggcaaaaagcgcatgaaacgtgtgggatctgtcgacattcctcaggaagcattccatgagctactgaaggtctccaattcaaaatag

SEQ ID NO: 2742 - protein, 665 aa, Sorghum bicolor
  misc_feature: Ceres ANNOT ID no. 6025919
  misc_feature (554)..(662): Pfam Id: LepA_C Pfam Desc: GTP-binding protein LepA C-terminus
  misc_feature (61)..(247): Pfam Id: GTP_EFTU Pfam Desc: Elongation factor Tu GTP binding domain
  misc_feature (464)..(553): Pfam Id: EFG_C Pfam Desc: Elongation factor G C-terminus
  misc_feature (270)..(340): Pfam Id: GTP_EFTU_D2 Pfam Desc: Elongation factor Tu domain 2
  misc_feature (64)..(199): Pfam Id: MMR_HSR1 Pfam Desc: GTPase of unknown function
  misc_feature (1)..(665): NCBI GI: 119638453 NCBI Desc: gfp binding protein [brachypodium sylvaticum]
  misc_feature (54)..(662): NCBI GI: 79527295 NCBI Desc: gtp binding / translation elongation factor [arabidopsis thaliana]
  misc_feature (63)..(665): NCBI GI: 24211904 NCBI Desc: gtp-binding protein lepa
  misc_feature (63)..(665): NCBI GI: 20807432 NCBI Desc: membrane gtpase lepa [thermoanaerobacter tengcongensis]
  misc_feature (61)..(665): NCBI GI: 78044431 NCBI Desc: gtp-binding protein lepa [carboxydothermus hydrogenoformans z-2901]
MAGAAVLRRSARRIYRHLAAAPAFSRSVLQQPKRLLSSQSSPEHGARGAVSGSELALYPPERVRNFSIIAHVDHGKSTLADRLLELTGTIQKGHGQPQYLDKLQVERERGITVKAQTATMFYRHVSASQDSDTPKYLLNLIDTPGHVDFSYEVSRSLAACQGALLVVDAAQGVQAQTIANFYLAFESNLSIIPVINKIDQPTADPDNVKDQLKRLFDIDPSEALLTSAKTGQGLEQVLPAVIERIPSPPGKCDAPVRMLLLDSYYDEYKGVICHVAIVDGALRKGDKIASAATGRAYEVLDVGIMHPELKPTGVLYTGQVGYVISGMRSTKEARIGDTLHQAKSTVEPLPGFKPAKHMVFSGLYPADGSDFEALSHAIEKLTCNDASVSITKETSNALGMGFRCGFLGLLHMDVFHQRLEQEYGAQVISTIPTVPYIFEYGDGSKVQVENPAALASNPGKRVAACWEPTVIATIIIPSEYVGPVIMLCSERRGEQLEYTFIDAQRALLKYQLPLKEIIVDFYNELKGITSGYATFDYEDSEYQQSDLVKMDILLNGQPVDAMATIVHNQKAQRVGKELVEKLKKFIERQMFEITIQAAIGSKVIARETLSAMRKNVLAKCYGGDITRKKKLLEKQKEGKKRMKRVGSVDIPQEAFHELLKVSNSK

SEQ ID NO: 2743 - DNA, 1179 bp, Sorghum bicolor
  misc_feature: Ceres ANNOT ID no. 6025939
  misc_feature: Encodes the peptide sequence at SEQ ID NO 2744
atggagatccagtcgtctggccggtccatcgaggggctgatggagaaggtgctgtctgtgaacatcctctcctcggactacttcaaggagctcttcaagtacaagacctaccacgaggtggtcgacgagatctacaaccaggtggaccacgtcgagccctggatgaccggcaactgccgcggcccttcctccgccttctgcctcctctacaagttattcaccatgaagctcaccgtcaagcagatgcacggcctgctcaagcaccaggactcaccctacatcagagctattggattcctctacctgcgatatgttgcagaaccgaagacgctgtggtcttggtacgaaccctatatcaaggatggcgaggagtttgcccctggctcaaatggtaaatcgactacaatgggcgtttatgtgcgtgatcttctccttggtcagtactatttcgatagtcttcttccacgagtgcctctcccaattctccgacaggtcactagccatcttgagaagctgaagcttccaacaaagcagtcaggaatgactggggactccaataggcttgaatcaaatgatactgccagaagacctccttctgtaaaggcttctttgtctgtctcttttggtcagcgtgctccacaccgtgcatccacaagggattcttccccagtccgaagaacattaccttccaaacaggacaaggaaagaagttatgatggcgaccgtgcaaaatcgccaccaaggaaacgccgaagtcggagttctgagcgtgatcatgactctgagagggaccgttcagatcgtgatcgtggcaggtataaggatagggagcatgatcgttatgctcgtgatcacagagaccgtgatcatcatcggtcgagttattcagatagggatgatgaaagacggggccgtgaaaagagggacagggattctgaccgaaatagacattcaagctcccgcaggagcaggagcaggagtccagtccgtggcagaactgacggtgacaaacatcgctccagtccatttggtagggcaccagaatcatccaacctggcaaagctgaaggatctgtatggtgatgcaacaaacacaaagaatgatgctggtgatgatagagctcacagggattctggaacagaagaggtaatccgactgggaggggcaaggtggaggtga

SEQ ID NO: 2744 - protein, 392 aa, Sorghum bicolor
  misc_feature: Ceres ANNOT ID no. 6025939
  misc_feature (1)..(169): Pfam Id: PRP38 Pfam Desc: PRP38 family
  misc_feature (1)..(373): NCBI GI: 115462403 NCBI Desc: os05g0178900 [oryza sativa (japonica cultivar-group)]
  misc_feature (63)..(339): NCBI GI: 30794464 NCBI Desc: riken cdna 1110021e09 [mus musculus]
  misc_feature (63)..(339): NCBI GI: 55665680 NCBI Desc: novel protein (flj10330) [homo sapiens]
  misc_feature (63)..(392): NCBI GI: 47087297 NCBI Desc: zgc:63496 [danio rerio]
  misc_feature (63)..(357): NCBI GI: 54643853 NCBI Desc: ga14052-pa [drosophila pseudoobscura]
MEIQSSGRSIEGLMEKVLSVNILSSDYFKELFKYKTYHEVVDEIYNQVDHVEPWMTGNCRGPSSAFCLLYKLFTMKLTVKQMHGLLKHQDSPYIRAIGFLYLRYVAEPKTLWSWYEPYIKDGEEFAPGSNGKSTTMGVYVRDLLLGQYYFDSLLPRVPLPILRQVTSHLEKLKLPTKQSGMTGDSNRLESNDTARRPPSVKASLSVSFGQRAPHRASTRDSSPVRRTLPSKQDKERSYDGDRAKSPPRKRRSRSSERDHDSERDRSDRDRGRYKDREHDRYARDHRDRDHHRSSYSDRDDERRGREKRDRDSDRNRHSSSRRSRSRSPVRGRTDGDKHRSSPFGRAPESSNLAKLKDLYGDATNTKNDAGDDRAHRDSGTEEVIRLGGARWR

SEQ ID NO: 2745 - DNA, 1287 bp, Sorghum bicolor
  misc_feature: Ceres ANNOT ID no. 6025941
  misc_feature: Encodes the peptide sequence at SEQ ID NO 2746
  misc_feature: Up-regulated in root tissues in response to salicylic acid treatment
  misc_feature: Up-regulated in shoot tissues in response to salicylic acid treatment
atggctggctcccttgctgcctcagccttcttccctggtccaggggcttctccggcagcatccgccaaaacatcaaagaacttggctggtgaattaccggataatttgagcgtccgtggtattgttgcaaaacctaacgccccttcgggcaacatgcaagtgaaggctcaagcacaggctcttcccaaggttaatggcaccaaggttaacctcaagagtgcaagcacagacaaagaggaggcgataccctacactgctcctaaaacattctacaaccaactgccagattggagcatgcttcttgcagctgtcactaccatcttcctggcagcagagaagcagtggacactgcttgactggaagccgaagaaacccgacatgcttgttgatacatttggttttggtaggatcatccaggatgggctggtgtttaggcagaacttcttgattaggtcctatgagattggtgctgatcgtacggcttctatagagacattaatgaaccatttacaggaaacagctcttaaccatgtgaagacagctggccttcttggagatggttttggcgccacgccagagatgagcaagcgaaacctgatttgggttgtcagcaaaattcagcttcttgttgagcaatatccctcgtggggagatatggttcaagtggacacatgggtagctgctgctggaaaaaatggcatgcgtcgagactggcatgttcgtgactataactctggacgtacaatcttgagagctacaagtgtttgggtgatgatgaataagaacactagaaggctttcaaaaatgccagatgaagttagggctgagataggcccgtatttcaatggccgctcagccataacagatgagcaaagtgagaagttggctaagccagggagcacttctgatggtgatactatgaaacagttcataagaaagggtctcactcctaggtggggcgaccttgatgtcaaccagcatgtgaataatgtcaagtatattggttggattcttgagagtgctccgatttcaatcctggaaaagcatgagcttgcaagcatgacactggattacaggaaggagtgtggccgtgacagcgtgctgcagtcgctcaccaccgtcgcaggcgaatgtgtggacggccacgcagactccaccatccagtgtgaccacctgctgcagctggaatcaggagccgacatcgtgaaggcgcacacagagtggcgcccgaagcgggcgcacggtggtgaagggaacatgggctttttcccggcggagagcgcatga

SEQ ID NO: 2746 - protein, 428 aa, Sorghum bicolor
  misc_feature: Ceres ANNOT ID no. 6025941
  misc_feature (141)..(410): Pfam Id: Acyl-ACP_TE Pfam Desc: Acyl-ACP thioesterase
  misc_feature (1)..(428): NCBI GI: 119638461 NCBI Desc: acyl-atp thioesterase [brachypodium sylvaticum]
  misc_feature (1)..(415): NCBI GI: 90018255 NCBI Desc: palmitoyl-acp thioesterase [elaeis guineensis]
  misc_feature (1)..(415): NCBI GI: 30962820 NCBI Desc: palmitoyl-acyl carrier protein thioesterase [elaeis guineensis]
  misc_feature (1)..(412): NCBI GI: 12004037 NCBI Desc: acyl-acp thioesterase [iris germanica]
  misc_feature (1)..(412): NCBI GI: 12004041 NCBI Desc: acyl-acp thioesterase [iris tectorum]
  misc_feature: Up-regulated in root tissues in response to salicylic acid treatment
  misc_feature: Up-regulated in shoot tissues in response to salicylic acid treatment
MAGSLAASAFFPGPGASPAASAKTSKNLAGELPDNLSVRGIVAKPNAPSGNMQVKAQAQALPKVNGTKVNLKSASTDKEEAIPYTAPKTFYNQLPDWSMLLAAVTTIFLAAEKQWTLLDWKPKKPDMLVDTFGFGRIIQDGLVFRQNFLIRSYEIGADRTASIETLMNHLQETALNHVKTAGLLGDGFGATPEMSKRNLIWVVSKIQLLVEQYPSWGDMVQVDTWVAAAGKNGMRRDWHVRDYNSGRTILRATSVWVMMNKNTRRLSKMPDEVRAEIGPYFNGRSAITDEQSEKLAKPGSTSDGDTMKQFIRKGLTPRWGDLDVNQHVNNVKYIGWILESAPISILEKHELASMTLDYRKECGRDSVLQSLTTVAGECVDGHADSTIQCDHLLQLESGADIVKAHTEWRPKRAHGGEGNMGFFPAESA

SEQ ID NO: 2747 - DNA, 762 bp, Sorghum bicolor
  misc_feature: Ceres ANNOT ID no. 6025945
  misc_feature: Encodes the peptide sequence at SEQ ID NO 2748
  misc_feature: Down-regulated in shoot tissues in response to salicylic acid treatment
atggcggcttccgcgctccaccttcgcctcctcccctcgccgccggcgagtgtgaagcttcagcagcgacagctgcgctcgttgagccccagaatacagagacagggtggactatctcgaagattttcgaaagttgtgtcctattacggtctcacaactccaccatataaactggatgctctggaaccttatatgagcaagagaacagttgaacttcactggggtaagcaccatcaagattacgtggatggcttgaataagcagctggctaccagccctctgtatggatacactctggaggatctgataaaagaagcctacaacaatggcaatccattaccagagtataacaatgcagcacaggtctggaaccatcacttcttctgggaatcaatgcaaccagaaggtggtggcgtacctgtgggaggtgtgctgcagcagattgaaaaggattttggctcgtttactaattttagggaagagtttatccgctcagctttacaactattgggatctggttgggtttggcttgtcttgaagagaaatgagagaaaactttcagtggttcatacacgaaatgctatctccccacttgcttttggcgatattccaatcatcagcctagacttatgggaggatgataggctagcatatattacaaactttatggaccatctcatctcttgggatactgtcactctacgcatgatgcgtgcagagtcttttgtgaaccttggtgagccaactatcccggaggcatga

SEQ ID NO: 2748 - protein, 253 aa, Sorghum bicolor
  misc_feature: Ceres ANNOT ID no. 6025945
  misc_feature (48)..(133): Pfam Id: Sod_Fe_N Pfam Desc: Iron/manganese superoxide dismutases, alpha-hairpin domain
  misc_feature (138)..(236): Pfam Id: Sod_Fe_C Pfam Desc: Iron/manganese superoxide dismutases, C-terminal domain
  misc_feature (1)..(253): NCBI GI: 58737157 NCBI Desc: mitochondrial iron-superoxide dismutase [zea mays]
  misc_feature (1)..(253): NCBI GI: 55295807 NCBI Desc: iron-superoxide dismutase [oryza sativa (japonica cultivar-group)]
  misc_feature (1)..(253): NCBI GI: 4164149 NCBI Desc: iron-superoxide dismutase [oryza sativa (japonica cultivar-group)]
  misc_feature (4)..(253): NCBI GI: 99907037 NCBI Desc: fe-superoxide dismutase [gymnadenia conopsea]
  misc_feature (16)..(253): NCBI GI: 21554867 NCBI Desc: iron superoxide dismutase 3 [arabidopsis thaliana]
  misc_feature: Down-regulated in shoot tissues in response to salicylic acid treatment
MAASALHLRLLPSPPASVKLQQRQLRSLSPRIQRQGGLSRRFSKVVSYYGLTTPPYKLDALEPYMSKRTVELHWGKHHQDYVDGLNKQLATSPLYGYTLEDLIKEAYNNGNPLPEYNNAAQVWNHHFFWESMQPEGGGVPVGGVLQQIEKDFGSFTNFREEFIRSALQLLGSGWVWLVLKRNERKLSVVHTRNAISPLAFGDIPIISLDLWEDDRLAYITNFMDHLISWDTVTLRMMRAESFVNLGEPTIPEA

SEQ ID NO: 2749 - DNA, 2169 bp, Sorghum bicolor
  misc_feature: Ceres ANNOT ID no. 6025946
  misc_feature: Encodes the peptide sequence at SEQ ID NO 2750
atggacacggcgtttctgcgccctccgctcgctcgtaatctggtttatgacgagtttgccgttctgcaccccacaagctacccttttcacactcttcggtatttgagatgcaacccgatgtattcaagaccgctgctaacaacatcaccagcttcaccatcaaggggcttgactcagagaatggccgcactacctgatgttgatgatttcttctgggagaaggatcctactccgatcctggacacaattgatgcacccatccatttgaaaaatttatctagtaaggagctcaagcagttagccgacgaagttcgttctgaaatagctttcataatgtccagaaaatgccaaccatgtggtcctggtcgctcagttgtggagctgacaattgctatacattatgtgttcaatgccccaatggataagatactatgggatgctggtcaacatgcgtatgcgcacaagattctcacaggaaggcgctctcaatttcatactattaaacagaaaaatggcctttccgggttcacgtcgcgttttgagagcgagtatgatccctttggtgctggacatggatgcaatagtctatctgctggccttgggatggcggttgcaagggatataaatgggagaaaaaatcgaatagtgacagtaataagtaattggacaaccatggctggccaggtgtacgaggcaatgggtcatgctggtttcctcgattccaacatggtagttattctaaatgatagctgccataccttgcttcctaaagccgatggccggccaaagatgtcagtcaatgccttctctagtgctctcagcaagattcaatccagcaaaggatttagaaggtttagggaggctgcaaagggacttgccaaatggtttggcaaaggaatgcatgaatttgctgccaaagttgatgagtatgctcgtggtatgataggtcctcatggagcaactctttttgaagaacttggattatattatatcggtcctattgatgggcgcaacattgatgatctcatctgtgtactaaaggaggttgcaagcctagattcaactggcccagtacttgtacatgtaattactgggactgaaagtgacactgatggaaatattagaagtgaaataactgcaagtgaggaagggccttcaaattcgagcaatgatcttcttaaatttttagaaactggactttctaggacatataatgactgctttgtagaagcactaacagcagaagcagagaatgacaagcgcattgtggtagttcatggcggcatgggaatggatcggtcactccgcttattccagtctaggttcccagacagattttttgacttgggcatcgctgagcaacatgctgttaccttttctgctggtttggcctgtggaggtttaaagcctttctgcataattccatccacatttcttcagcgagcatatgatcagatagttgaagatgtggacatgcaaaagataccagttcgatttgctatcacaaatgctggtctggtgggatctgagggcccaactaactcaggaccatttgatattacattcatgtcatgcttgccaaacatgattgtcatgtcaccatctaatgaggatgaacttattgacatggtggcaacagctgcaatgattgaggacaaacctatttgcttccgctatcctaggggtgccattgttgggactagtggaactttaacatatgggaatccgcttgagattggtaaaggagagattcttgtcgagggaaaagagatagcttttcttggctatggcgaggtggtccagagatgcttgattgctcgatctcttttgtctaactttggcattcaggcgacagttgcaaatgcgagattttgcaagccacttgacatcgatctaatcagaacgctatgtcagcagcacagttttcttatcacagttgaagaaggaacagttggtggctttggatcacatgtctctcagtttatttcacttgatggtctacttgatggccgaataaagtggagacccattgtgctaccagacaggtacattgaacacgcttcactggcggagcaacttgacttggctggcctaactgcccatcacatagctgcaactgcattgaccctcctagggcgtcatcgtgatgcacttctgttgatgaagtag

SEQ ID NO: 2750 - protein, 722 aa, Sorghum bicolor
  misc_feature: Ceres ANNOT ID no. 6025946
  misc_feature (580)..(703): Pfam Id: Transketolase_C Pfam Desc: Transketolase, C-terminal domain
  misc_feature (400)..(566): Pfam Id: Transket_pyr Pfam Desc: Transketolase, pyrimidine binding domain
  misc_feature (92)..(675): NCBI GI: 115466348 NCBI Desc: os06g0142900 [oryza sativa (japonica cultivar-group)]
  misc_feature (23)..(721): NCBI GI: 92869038 NCBI Desc: deoxyxylulose-5-phosphate synthase [medicago truncatula]
  misc_feature (62)..(721): NCBI GI: 140062660 NCBI Desc: deoxyxylulose-5-phosphate synthase [medicago truncatula]
  misc_feature (62)..(721): NCBI GI: 21322713 NCBI Desc: 1-deoxy-d-xylulose 5-phosphate synthase 1 [medicago truncatula]
  misc_feature (63)..(721): NCBI GI: 35187002 NCBI Desc: 1-deoxy-d-xylulose 5-phosphate synthase [pueraria montana var. lobata]
  misc_feature: The sequence is a functional homolog of SEQ ID NO 12 in US patent 7132250
MDTAFLRPPLARNLVYDEFAVLHPTSYPFHTLRYLRCNPMYSRPLLTTSPASPSRGLTQRMAALPDVDDFFWEKDPTPILDTIDAPIHLKNLSSKELKQLADEVRSEIAFIMSRKCQPCGPGRSVVELTIAIHYVFNAPMDKILWDAGQHAYAHKILTGRRSQFHTIKQKNGLSGFTSRFESEYDPFGAGHGCNSLSAGLGMAVARDINGRKNRIVTVISNWTTMAGQVYEAMGHAGFLDSNMVVILNDSCHTLLPKADGRPKMSVNAFSSALSKIQSSKGFRRFREAAKGLAKWFGKGMHEFAAKVDEYARGMIGPHGATLFEELGLYYIGPIDGRNIDDLICVLKEVASLDSTGPVLVHVITGTESDTDGNIRSEITASEEGPSNSSNDLLKFLETGLSRTYNDCFVEALTAEAENDKRIVVVHGGMGMDRSLRLFQSRFPDRFFDLGIAEQHAVTFSAGLACGGLKPFCIIPSTFLQRAYDQIVEDVDMQKIPVRFAITNAGLVGSEGPTNSGPFDITFMSCLPNMIVMSPSNEDELIDMVATAAMIEDKPICFRYPRGAIVGTSGTLTYGNPLEIGKGEILVEGKEIAFLGYGEVVQRCLIARSLLSNFGIQATVANARFCKPLDIDLIRTLCQQHSFLITVEEGTVGGFGSHVSQFISLDGLLDGRIKWRPIVLPDRYIEHASLAEQLDLAGLTAHHIAATALTLLGRHRDALLLMK

SEQ ID NO: 2751 - DNA, 1140 bp, Sorghum bicolor
  misc_feature: Ceres ANNOT ID no. 6025948
  misc_feature: Encodes the peptide sequence at SEQ ID NO 2752
atggcgtccctccctaacggcgccggcgccgccgccgccgcctctggttcctccggcgcgcgcccggtggacaaggaggtggacttcgccaactacttctgcacctacgcctacctctaccaccagaaggagatgctctgcgaccgtgtccgcatggacgcctaccactccgccgtcttccgcaacgcgccgcacttccagggcaaggtggtccttgacgtgggcaccgggagcggcatccttgccatctggagcgcgcaggccggggccaggaaggtgtacgctgtcgaggcgactaacatggcggagcacgctcgcgagcttgcgcgcgccaacggcgtcgcggacattgtcgaggtgattcagggcaccgtggaagacgttgagcttccggagaaagttgatgtcattatctcagaatggatgggctacttccttttgagagagtccatgtttgattctgttatttctgcacgtgaccgctggttgaagccagatggtgtaatgtatcctagccatgctaggatgtggctagcacccataagaactggtttgggtgacaaaaagagggaagattttgatattgctatggatgactggagcctgtttgttcaggacactcaaacttattatggggtcaacatgaatgctttgacaaaggcatatcgttcagaacatgagaaatactatttgaagtcttcaatatggaacaatcttcatccaaaccaagttatcggtcaacctgcagctatcaaggaaatcgattgcttgacagccactgttgatgagatccgagaagtcagagcacaagttacattgccactcacaatggatgctagattatcagcactggctggatggtttgatgttcattttcgaggtagtgctcaaaaccctggggtggaggaaattgaattaactacagcgccagatgagcatggtggaactcattggggtcagcaggtattcttgctgactccacctctgagtgtgactaaaggagacaatgttaatgtctccttctcgatggttcgctcaaaggaaaatcatcgacttatggatatggagttcacctatgaattgcatgagttatctggaaggaagcacccagcagtcacaaccaagatgtacttagagtag

SEQ ID NO: 2752 - protein, 379 aa, Sorghum bicolor
  misc_feature: Ceres ANNOT ID no. 6025948
  misc_feature (72)..(171): Pfam Id: Methyltransf_11 Pfam Desc: Methyltransferase domain
  misc_feature (1)..(379): NCBI GI: 22135775 NCBI Desc: at1g04870/f13m7_12 [arabidopsis thaliana]
  misc_feature (1)..(379): NCBI GI: 16930707 NCBI Desc: at1g04870/f13m7_12 [arabidopsis thaliana]
  misc_feature (101)..(379): NCBI GI: 16604456 NCBI Desc: at1g04870/f13m7_12 [arabidopsis thaliana]
  misc_feature (5)..(225): NCBI GI: 38344195 NCBI Desc: osjnba0064g10.11 [oryza sativa (japonica cultivar-group)]
  misc_feature (17)..(218): NCBI GI: 9293956 NCBI Desc: protein arginine n-methyltransferase-like protein [arabidopsis thaliana]
MASLPNGAGAAAAASGSSGARPVDKEVDFANYFCTYAYLYHQKEMLCDRVRMDAYHSAVFRNAPHFQGKVVLDVGTGSGILAIWSAQAGARKVYAVEATNMAEHARELARANGVADIVEVIQGTVEDVELPEKVDVIISEWMGYFLLRESMFDSVISARDRWLKPDGVMYPSHARMWLAPIRTGLGDKKREDFDIAMDDWSLFVQDTQTYYGVNMNALTKAYRSEHEKYYLKSSIWNNLHPNQVIGQPAAIKEIDCLTATVDEIREVRAQVTLPLTMDARLSALAGWFDVHFRGSAQNPGVEEIELTTAPDEHGGTHWGQQVFLLTPPLSVTKGDNVNVSFSMVRSKENHRLMDMEFTYELHELSGRKHPAVTTKMYLE

SEQ ID NO: 2753 - DNA, 1209 bp, Sorghum bicolor
  misc_feature: Ceres ANNOT ID no. 6025970
  misc_feature: Encodes the peptide sequence at SEQ ID NO 2754
atggcaatccacctccgcgcccacgccttcgcggccaacccgctgcgtggcgtctccgccgccaccaccgccgtctccccctccgcggccgccgaggttctccgctcccttctcgaccccagctccgccgccgccgccaatccccagccgtacctctccaagatcctccctttccgccggggccgcccgcttgcgcgctccacggaccctcctcccgcgtccgcccccgccgcggcgccggcctggtgccttgcgtggctcccgccgtcccgcgtccccgggctcgccccggacgccttcgtcttcctgggcgcgcatgtcgagggcggcggcaaggaggccgccgcgtactgggcggtcgacgtcagcgagggcgagggagcgacggtcggtgggccggcggacggggatgggccgtcggcgtttgtggacttgaggacgctcatggtggccacggactggagcgacaagcacgccatgggggagctcgccatcgcaggacatgctcgagcactgctcgaatggcacagcacggcaaagttttgtggagcatgtggagcaaaggctgttcctactgaagccggaaggcgtaagcagtgcagcaacgagtcctgcaagaagaggatataccctcgaattgatcctgttgtgatcatgttggtcattgataaagaaaatgatcgggcgctcttaagtcgccagtcaagatttgtgcctcgtatgtggagttgtcttgctggtttcatagagccaggagaaagcctggaagaggcagtgagacgagaaacctgggaggaaactggtattgaagttggacaagtcgtttatcacagttctcaaccatggcctgttgggccaaatactatgccctgccaactaatgatgggcttctttgcttatgctaaaacgttggagataaaagtggacaagcaggagcttgaagatgcccagtggcacagccgtgaagacatcaagaaagcgttgacgtttgctgaatacgaaaaagctcagagaacaaatgctgccaaggtcaatcagatttgcaagggtgctgagaaagggcagagcctctctggtgacttcaaagtcgaaagtggtgagcctgctccaatgttcgtcccaggacccttcgccattgctcatcaccttatctcagcatgggcttttgagggagtaccaaagctgcctagttccttctcaaatctataa

SEQ ID NO: 2754 - protein, 402 aa, Sorghum bicolor
  misc_feature: Ceres ANNOT ID no. 6025970
  misc_feature (213)..(340): Pfam Id: NUDIX Pfam Desc: NUDIX domain
  misc_feature (52)..(175): Pfam Id: NUDIX-like Pfam Desc: NADH pyrophosphatase-like rudimentary NUDIX domain
  misc_feature (177)..(210): Pfam Id: zf-NADH-PPase Pfam Desc: NADH pyrophosphatase zinc ribbon domain
  misc_feature (1)..(402): NCBI GI: 55295798 NCBI Desc: mutt/nudix protein-like [oryza sativa (japonica cultivar-group)]
  misc_feature (1)..(389): NCBI GI: 92881974 NCBI Desc: isopentenyl-diphosphate delta-isomerase, type 1 [medicago truncatula]
  misc_feature (53)..(328): NCBI GI: 121527080 NCBI Desc: mutt/nudix family protein [parvibaculum lavamentivorans ds-1]
  misc_feature (101)..(328): NCBI GI: 118034061 NCBI Desc: nudix hydrolase [burkholderia phymatum stm815]
  misc_feature (162)..(332): NCBI GI: 87134665 NCBI Desc: nudix hydrolase [novosphingobium aromaticivorans dsm 12444]
MAIHLRAHAFAANPLRGVSAATTAVSPSAAAEVLRSLLDPSSAAAANPQPYLSKILPFRRGRPLARSTDPPPASAPAAAPAWCLAWLPPSRVPGLAPDAFVFLGAHVEGGGKEAAAYWAVDVSEGEGATVGGPADGDGPSAFVDLRTLMVATDWSDKHAMGELAIAGHARALLEWHSTAKFCGACGAKAVPTEAGRRKQCSNESCKKRIYPRIDPVVIMLVIDKENDRALLSRQSRFVPRMWSCLAGFIEPGESLEEAVRRETWEETGIEVGQVVYHSSQPWPVGPNTMPCQLMMGFFAYAKTLEIKVDKQELEDAQWHSREDIKKALTFAEYEKAQRTNAAKVNQICKGAEKGQSLSGDFKVESGEPAPMFVPGPFAIAHHLISAWAFEGVPKLPSSFSNL

SEQ ID NO: 2755 - DNA, 1014 bp, Sorghum bicolor
  misc_feature: Ceres ANNOT ID no. 6025986
  misc_feature: Encodes the peptide sequence at SEQ ID NO 2756
atggaggcgtcagcagcagcagcagcaggagatgggggaggaggcagcgccgccacgcggagcagcccggcggccgtgcaggccaccaacgacgacgccgcggcaagcaagtcctgtgttaacaaaggatacatgaaggatgattatgtgcggttttttgttaggcgaccaacaaggagggctccgataatcaatcgtgggtattatgcgcgttggtctgttctcaggaagcttctgcatcaattcctcgatgcggggaagaatagtaacaatgagaagcctaagcaaatattatctcttggtgctggctttgacacaacattcttccagttgcaagatgaaaggattgctccacacctttatgtagaactggatttcaaggaggtaaccagcaaaaaggccgccatcatcaaccattatattgaaatgaaggaaaagttaggctcagaagcttcgatttcgattgaaaaaggtgaagtgataagtacgcattacaagctattttctgctgatattcgtgacataccaaaactggattcagttattcacatggctgaaatggatcctagcttgccaacctttataattgcagagtgtgtgcttatttatctggacccaactgccactggtgctatcgtgagttgggcatctcaaaagttctccactgctgtctttttcttatatgagcagattcaccctgatgatgcatttggggagcaaatgattagaaatcttgagagtagaggatgccccctccttggtataaatgctacaccaaccttaagtcacaaggagaacctttttcttggcaatggatggcagagagctgttgcatgggatatgctgaaaatctataatgacttcattgacagtcaagaaagacgcaggattgaacgattagaactgtttgacgagtttgaagagtggtatatgatgcaggaacactactgtgtagcctacggaatcaacgatgccgagggcatatttgacagttttggttttaaagagacctag

SEQ ID NO: 2756 - protein, 337 aa, Sorghum bicolor
  misc_feature: Ceres ANNOT ID no. 6025986
  misc_feature (24)..(323): Pfam Id: LCM Pfam Desc: Leucine carboxyl methyltransferase
  misc_feature (1)..(336): NCBI GI: 55296480 NCBI Desc: leucine carboxyl methyltransferase family protein-like [oryza sativa (japonica cultivar-group)]
  misc_feature (11)..(336): NCBI GI: 119638449 NCBI Desc: leucine carboxyl methyl transferase [brachypodium sylvaticum]
  misc_feature (17)..(313): NCBI GI: 42571299 NCBI Desc: leucine carboxyl methyltransferase family protein [arabidopsis thaliana]
  misc_feature (7)..(318): NCBI GI: 19921402 NCBI Desc: cg3793-pa [drosophila melanogaster]
  misc_feature (25)..(318): NCBI GI: 54644490 NCBI Desc: ga17689-pa [drosophila pseudoobscura]
MEASAAAAAGDGGGGSAATRSSPAAVQATNDDAAASKSCVNKGYMKDDYVRFFVRRPTRRAPIINRGYYARWSVLRKLLHQFLDAGKNSNNEKPKQILSLGAGFDTTFFQLQDERIAPHLYVELDFKEVTSKKAAIINHYIEMKEKLGSEASISIEKGEVISTHYKLFSADIRDIPKLDSVIHMAEMDPSLPTFIIAECVLIYLDPTATGAIVSWASQKFSTAVFFLYEQIHPDDAFGEQMIRNLESRGCPLLGINATPTLSHKENLFLGNGWQRAVAWDMLKIYNDFIDSQERRRIERLELFDEFEEWYMMQEHYCVAYGINDAEGIFDSFGFKET

SEQ ID NO: 2757 - DNA, 1830 bp, Sorghum bicolor
  misc_feature: Ceres ANNOT ID no. 6026003
  misc_feature: Encodes the peptide sequence at SEQ ID NO 2758
atggcgccctcctcctcttcctccggaggcggcggcggcgacagcgccggagccgccgacccgatggcgctcgtgcaggggtacacggccgaggagctcgccatcgcgggggagttcctcaccacctggctccccttcctctccgccggcctctgcccttcctgcgtctcctcgctccgcggccgcgtcgactccctgctcccccgagcagaggagtcgccgccgccgccgtcgccgcggcagccggtcgatcagattgagccgtcagggtgggactcggatccggcgctccagcagaaccttcctttcgagccgagcggttgggattcggatccgcccccacccgcgccggcgccggcgccggctgagaagccgaggatgtcgtgggcggacatggcgcaggaggacgagctcgccgcggcggcggaggacgacgcggcggccgcggctgccgaggatggggacgagggggccgaggcggggaggcccaaggtgcagcccacgagggagcagcgggaacagaggaggctcagtagcatcgtgcgcaacaaggatttcaggtgctacgagagagttcatggccagctcgtcaacatcctcgctggccttgagcttcatgccggcgtgttcagcgcagctgagcagcggcggattgtccaatgcgtgtatgacctccaggcgagagggcagcgtggggagctcggagagcgcacatatacagaaccccaaaaatggatgcgtggtaaaggccgggtaacaatccaatttggatgctgttacaattatgctacggataagaatggaaatccaccaggcatcatacggaccattgtttctgatccaatgcctgacctgtttaagactatgattaagagattggtacgatggcaagttctgcctacaacttgtgtaccagacagctgcattgtaaatatatatgaacctggagattgcatcccaccacatatagatagccatgattttgttaggccattttgcactgtttctttcctcagcgaatgcaatattctttttggatctaacctgaaagcttctgcccctggagaattcaccggttcaattgcgacccctctccctgtcggatctgtgcttgttctgaatggcaatggtgctgatgtagcaaagcattgtgttccagcagtccctaccaaaaggatatccattacattcagaaaaatggatccagcaaagcgtccattcgattttaaagatgacccagaactgcttaaccttgcccctctagggacagctgtacaagaaactggcatatcatcagatgaaggcaagggcaagctacctgacgcccaaataacaaatctgagcaaagtatccagaggcaagaggtctaaaggaagaacaactcctgggaaatatggaagcggcattcttggagagcagcctcctaggcatgcacaagcccctgcagtcgaagtgctgtcgcttcaaagtccgcatggccagcgccctgtctctgcctcaagtgctgagagggaaaggaattctgcttggaggtcaagggaattgagatatcaatctagttcacctggcgtgcaatctcaagctgacaacagcagggagtggccacgtcggtcggtgcacgagaggttgagttccgttgaagatggtgtggaatctgcggaaaggagaccttggatggagcataggcagatatcgttgataaaccgaacactaaacaatgacatgaactctctttcgctcacaagccgtgaatcaggcgatcagtctcgtgctagcgcgcgaaccttgtataacaagcccaggaggaccagagtaatcctggaagattga

SEQ ID NO: 2758 - protein, 609 aa, Sorghum bicolor
  misc_feature: Ceres ANNOT ID no. 6026003
  misc_feature (304)..(401): Pfam Id: 2OG-FeII_Oxy Pfam Desc: 2OG-Fe(II) oxygenase superfamily
  misc_feature (5)..(609): NCBI GI: 55296462 NCBI Desc: oxidoreductase, 2og-fe(ii) oxygenase family protein-like [oryza sativa (japonica cultivar-group)]
  misc_feature (14)..(608): NCBI GI: 119638440 NCBI Desc: oxidoreductase [brachypodium sylvaticum]
  misc_feature (117)..(432): NCBI GI: 145328752 NCBI Desc: oxidoreductase, 2og-fe(ii) oxygenase family protein [arabidopsis thaliana]
  misc_feature (113)..(368): NCBI GI: 42567443 NCBI Desc: oxidoreductase, 2og-fe(ii) oxygenase family protein [arabidopsis thaliana]
  misc_feature (155)..(421): NCBI GI: 124360274 NCBI Desc: 2og-fe(ii) oxygenase [medicago truncatula]
MAPSSSSSGGGGGDSAGAADPMALVQGYTAEELAIAGEFLTTWLPFLSAGLCPSCVSSLRGRVDSLLPRAEESPPPPSPRQPVDQIEPSGWDSDPALQQNLPFEPSGWDSDPPPPAPAPAPAEKPRMSWADMAQEDELAAAAEDDAAAAAAEDGDEGAEAGRPKVQPTREQREQRRLSSIVRNKDFRCYERVHGQLVNILAGLELHAGVFSAAEQRRIVQCVYDLQARGQRGELGERTYTEPQKWMRGKGRVTIQFGCCYNYATDKNGNPPGIIRTIVSDPMPDLFKTMIKRLVRWQVLPTTCVPDSCIVNIYEPGDCIPPHIDSHDFVRPFCTVSFLSECNILFGSNLKASAPGEFTGSIATPLPVGSVLVLNGNGADVAKHCVPAVPTKRISITFRKMDPAKRPFDFKDDPELLNLAPLGTAVQETGISSDEGKGKLPDAQITNLSKVSRGKRSKGRTTPGKYGSGILGEQPPRHAQAPAVEVLSLQSPHGQRPVSASSAERERNSAWRSRELRYQSSSPGVQSQADNSREWPRRSVHERLSSVEDGVESAERRPWMEHRQISLINRTLNNDMNSLSLTSRESGDQSRASARTLYNKPRRTRVILED

SEQ ID NO: 2759 - DNA, 756 bp, Sorghum bicolor
  misc_feature: Ceres ANNOT ID no. 6026007
  misc_feature: Encodes the peptide sequence at SEQ ID NO 2760
atggcagcgccctccgccgtcgccgtggcgggcgtcatactcataggggtgctcgtcctactcgtcgctggggtctcgggtgcgcgcctcccgggccgcggcggtgccgtccgtggagcgacggcgctgccgcgcggaggagcgacggccacggcggtgttcgcgctgggcagcttctggcggtcggaggcggcgttcgggtgcctccctggcgtgatccgcacctccgttggctacgctggcggctccaaggccaaccccgagtaccgcaacctcgccgaccacgccgagtgcgtcaaggttgagtatgatccacggttgattcactacaggcagcttttggatgtgttctgggcaagtcatgacccacgggaggtgtttgggcaagggccagatgttggcaaccagtatagatctgttatcttcactaatggaaccattgaggccagattggctgctcttagcaaagaaaaagaacaagctaaagatcgtagcagcgttattaccacacagatccaaccattgggggtgtttcattctgctgaaccagaacatcagaaatttgaactgaagcgcaaaccattcctcttgcaattgattgggaatttgccggaggaggagctcctgacatcaacactagctgcaaaactgaatgcatatgctgctgagctctgtcctgcgaatacccaaaagagaattaactccaagattgatgaggtcacaaagaaaggatggcccatcttaagggacatttaa

SEQ ID NO: 2760 - protein, 251 aa, Sorghum bicolor
  misc_feature: Ceres ANNOT ID no. 6026007
  misc_feature (50)..(203): Pfam Id: PMSR Pfam Desc: Peptide methionine sulfoxide reductase
  misc_feature (1)..(251): NCBI GI: 119638438 NCBI Desc: methyl sulfoxide reductase [brachypodium sylvaticum]
  misc_feature (51)..(186): NCBI GI: 42570819 NCBI Desc: peptide methionine sulfoxide reductase family protein [arabidopsis thaliana]
  misc_feature (52)..(222): NCBI GI: 48100580 NCBI Desc: similar to methionine sulfoxide reductase [apis mellifera]
  misc_feature (52)..(222): NCBI GI: 33089114 NCBI Desc: methionine sulfoxide reductase [apis mellifera ligustica]
  misc_feature (31)..(222): NCBI GI: 55378270 NCBI Desc: peptide methionine sulfoxide reductase msra1 [haloarcula marismortui atcc 43049]
MAAPSAVAVAGVILIGVLVLLVAGVSGARLPGRGGAVRGATALPRGGATATAVFALGSFWRSEAAFGCLPGVIRTSVGYAGGSKANPEYRNLADHAECVKVEYDPRLIHYRQLLDVFWASHDPREVFGQGPDVGNQYRSVIFTNGTIEARLAALSKEKEQAKDRSSVITTQIQPLGVFHSAEPEHQKFELKRKPFLLQLIGNLPEEELLTSTLAAKLNAYAAELCPANTQKRINSKIDEVTKKGWPILRDI

SEQ ID NO: 2761 - DNA, 1041 bp, Sorghum bicolor
  misc_feature: Ceres ANNOT ID no. 6026008
  misc_feature: Encodes the peptide sequence at SEQ ID NO 2762
atgacgccggcgaacggcgccccagcgccggcagcggagtctgtcccccccgaggtggagtcggaggccgatgcgttccggcgccaggttgacgacctcgtctcgaagaccgacgtgctggagaagcgggtgaaagaggtggtggacttctatgatggcaagaagcacggaagcggcgggcggaagggcggcggtggcggcaggcacggggcatactcgagggggatgcccgaccttatgcgccagttcggcgtgcttttgaaagagatcacctctcataaagatgcatggccatttctgaagccggtggatgttgtaaccctgcacattcctgactatcacaaaattattacccaacctatggacttctctaccatccaaaagaaaatggaaaggaaagatggtacctgttacaccaatgttcgagaaatatgttctgatgttcgattaatttttgccaatgcgatgaagtacaatgatgatcaaaatgtagtccacttgatggctaaatcattgcttgagaaatttgaagagaagtggctccattttcttcctaaagttgagagtgaggaaaaaagacaaaaggaggaggaatcaaagggtgttgcagccacaaatacttctcgagaagttgcaatcgcaaaattagcaaaagatactgatgatgagctaaatcagatcaataggaagctggaggaactccggaaaatggtggttcacagatgcaggaaaatgaccacagatgagaagaggaagctgggtgcagggatctgccacttgtctccagatgatcttaacaaggcgctagaaattgttgcacaagacaatcctagcttccaaactaaagcagaagaagtggatcttgatatggatgcccagagtgagacaaccctatggaggctgaaattctttgtgagggaagcactggaacgacaggccaacgttgcctctgggaagatggacgaaaacgccaaaagaaagagggagatatgcaatgctctggccaaaacagcatcgaaacggatcaagaagcaaccctag

SEQ ID NO: 2762 - protein, 346 aa, Sorghum bicolor
  misc_feature: Ceres ANNOT ID no. 6026008
  misc_feature (79)..(171): Pfam Id: Bromodomain Pfam Desc: Bromodomain
  misc_feature (9)..(346): NCBI GI: 55297001 NCBI Desc: dna-binding bromodomain-containing protein-like [oryza sativa (japonica cultivar-group)]
  misc_feature (62)..(344): NCBI GI: 27803868 NCBI Desc: imb1 [arabidopsis thaliana]
  misc_feature (62)..(344): NCBI GI: 62321808 NCBI Desc: ring3 protein-like [arabidopsis thaliana]
  misc_feature (80)..(344): NCBI GI: 42571057 NCBI Desc: dna-binding bromodomain-containing protein [arabidopsis thaliana]
  misc_feature (224)..(346): NCBI GI: 115466274 NCBI Desc: os06g0138000 [oryza sativa (japonica cultivar-group)]
MTPANGAPAPAAESVPPEVESEADAFRRQVDDLVSKTDVLEKRVKEVVDFYDGKKHGSGGRKGGGGGRHGAYSRGMPDLMRQFGVLLKEITSHKDAWPFLKPVDVVTLHIPDYHKIITQPMDFSTIQKKMERKDGTCYTNVREICSDVRLIFANAMKYNDDQNVVHLMAKSLLEKFEEKWLHFLPKVESEEKRQKEEESKGVAATNTSREVAIAKLAKDTDDELNQINRKLEELRKMVVHRCRKMTTDEKRKLGAGICHLSPDDLNKALEIVAQDNPSFQTKAEEVDLDMDAQSETTLWRLKFFVREALERQANVASGKMDENAKRKREICNALAKTASKRIKKQP

SEQ ID NO: 2763 - DNA, 1125 bp, Sorghum bicolor
  misc_feature: Ceres ANNOT ID no. 6026009
  misc_feature: Encodes the peptide sequence at SEQ ID NO 2764
atggctcattccaacggcgcggccgccactgccactgccgccggcgacggcgagaccgccccggtgccgcggtccctcgcgccggcgcggaaggtggcgctgatcacgggcatcacggggcaggacgggagctacctgacggagctgctcctgtccaaggggtacgaggtgcacggcctcatccgccgctcctccaacttcaacacgcagcggctggaccacatctaccacgacccgcacgcggtgccgtcgtcgccgcgtcccccgatgcggctccactacgccgacctctccgactcctcgtccctccgccgcgcgctcgacgccatcgcccccgacgaggtctacaacctcgccgcgcagtcacacgtcgccgtctccttcgaggtccccgactacaccgccgacgtcaccgccacgggggcgctccgcctcctcgaggccgtccgcctgtcgcgcaagcccatccgctactaccaggcgggctcctcggagatgttcggctccacgccgccgccgcagagcgaggacacgcccttccacccgcgctccccctacgccgccgccaaggtcgccgcgcactggtacaccgtcaactaccgcgaggcctacggcatcttcgcctgcaacggcgtgctcttcaaccacgagtccccgcgccgcggcgagaacttcgtcacgcgcaagatcacgcgcgccgtcggccgcatcaaggtcggcctgcagaccaaggtcttcctcggcaacctctcggcggccagggactggggtttcgcgggggactacgtcgaggcaatgtggctcatgctgcagcaggatcagccggccgattacgtcgtcgccactgaggagtcccacaccgtcgaggagttcttgcaggctgccttcggctacgccgggctcaactggaaggatcatgtggtcattgacaagaagtacttccggccagcagaggtcgacagcctcaagggggactccaccaaggccaggaaggtgctcaaatggaagcccaaggttgggttccagcagctcgtggagatgatggttgatcacgacattgagctcgccaagaaggagaaggtcctggtggatgctggataccgtgaccccaagcagcagccatag

SEQ ID NO: 2764 - protein, 374 aa, Sorghum bicolor
  misc_feature: Ceres ANNOT ID no. 6026009
  misc_feature (33)..(281): Pfam Id: Epimerase Pfam Desc: NAD dependent epimerase/dehydratase family
  misc_feature (1)..(374): NCBI GI: 7939611 NCBI Desc: root cap-specific protein [zea mays]
  misc_feature (201)..(374): NCBI GI: 115466272 NCBI Desc: os06g0137700 [oryza sativa (japonica cultivar-group)]
  misc_feature (16)..(374): NCBI GI: 106879167 NCBI Desc: at3g51160 [arabidopsis thaliana]
  misc_feature (16)..(374): NCBI GI: 28373943 NCBI Desc: chain b, crystal structure of gdp-mannose 4,6-dehydratase ternary complex with nadph and gdp
  misc_feature (16)..(374): NCBI GI: 21536808 NCBI Desc: gdp-d-mannose-4,6-dehydratase mur1 [arabidopsis thaliana]
  misc_feature (16)..(374): SWISSPROT Homolog: EC 4.2.1.47 GDP-mannose 4,6 dehydratase 2
  misc_feature: Useful for making plants with altered cell wall content and/or composition
  misc_feature: GREAT-hit functional homolog of the protein sequence encoded by LOCUS at3g51160
  misc_feature: GREAT-hit functional homolog of the protein sequence encoded by LOCUS at5g66280
  misc_feature: Useful for making plants with altered carbohydrate content
  misc_feature: Functional homolog of the protein sequence given in SEQ ID NO 13802
  misc_feature: Useful for making plants with altered cell wall content and/or composition
  misc_feature: Functional homolog of the protein sequence given in SEQ ID NO 13803
MAHSNGAAATATAAGDGETAPVPRSLAPARKVALITGITGQDGSYLTELLLSKGYEVHGLIRRSSNFNTQRLDHIYHDPHAVPSSPRPPMRLHYADLSDSSSLRRALDAIAPDEVYNLAAQSHVAVSFEVPDYTADVTATGALRLLEAVRLSRKPIRYYQAGSSEMFGSTPPPQSEDTPFHPRSPYAAAKVAAHWYTVNYREAYGIFACNGVLFNHESPRRGENFVTRKITRAVGRIKVGLQTKVFLGNLSAARDWGFAGDYVEAMWLMLQQDQPADYVVATEESHTVEEFLQAAFGYAGLNWKDHVVIDKKYFRPAEVDSLKGDSTKARKVLKWKPKVGFQQLVEMMVDHDIELAKKEKVLVDAGYRDPKQQP

SEQ ID NO: 2765 - DNA, 1089 bp, Sorghum bicolor
  misc_feature: Ceres ANNOT ID no. 6026013
  misc_feature: Encodes the peptide sequence at SEQ ID NO 2766
atggcgaaggagaagaagcggaagcagcctcccgccgacgcggcgccgcccccgggcgacgatggcgaggggaggagcgggcggaagggcaagaaggccaggaaggagaaggcggaggcgatactgccgtcgcagatcaagaacaaggacaagcgccgcgaggtgcatgccaagctcaagcgagagaagaaggcccagaagcgcgcgcttgcccgtgaacgcggccaggccgcccgccgcgccgaagagctcggggagcagccgccggagaggcaggtgccgcggacgatcgagaataccagggagcccgatgagactgtgtgccggcccgacgaccaggagctgtttgcaggaaatgatgcggatgaattcaatgcagttctaaagcagcacataaccccgaaaatattgattacaacatgccgcttcaattcagggaggggacctgcatttattgacgagttaatgcaagtgataccgaattcccattatgtaaaaaggggaacgtacgaactcaagaaaattgtggactatgcaaaaaatagggatttcacctcacttattgttgtccacacaaatcgaagggaacctgatgctctacttatcattgggttacctgatggccctactgcacatttcaaactatccaaacttgttcttcggaaggacataaagaaccatggcaaccctacaagtcataagccagagctagtattgaacaatttcactacacgccttggtcatcgtgttggaaggatgatacaatctctcttccctcaagaccccaatttccgtgggcgccgtgttgtgaccttccataatcagcgagactacatatttttccgtcatcacaggtacatcttcgatacaaaagaaaagaaggttgcttcaaaggacaagaaagctaagacatctgaaagcaaaagcgaatctgagaagcaagtgatttgtcgccttcaggaatgtgggcctcgctttgttctaaagctgctcaccttgcaacatgggaccttcgacacgaaaagcggggagtacgagtgggttcacaagccggatatggatacgagcaggaggagattcttcttgtga

SEQ ID NO: 2766 - protein, 362 aa, Sorghum bicolor
  misc_feature: Ceres ANNOT ID no. 6026013
  misc_feature (137)..(333): Pfam Id: Brix Pfam Desc: Brix domain
  misc_feature (1)..(350): NCBI GI: 115466268 NCBI Desc: os06g0137500 [oryza sativa (japonica cultivar-group)]
  misc_feature (3)..(299): NCBI GI: 71153722 NCBI Desc: ribosome production factor 1 (ribosome biogenesis protein rpf1)
  misc_feature (3)..(299): NCBI GI: 71153719 NCBI Desc: ribosome production factor 1 (ribosome biogenesis protein rpf1)
  misc_feature (3)..(299): NCBI GI: 71153718 NCBI Desc: ribosome production factor 1 (ribosome biogenesis protein rpf1)
  misc_feature (44)..(299): NCBI GI: 50344976 NCBI Desc: zgc:86604 [danio rerio]
MAKEKKRKQPPADAAPPPGDDGEGRSGRKGKKARKEKAEAILPSQIKNKDKRREVHAKLKREKKAQKRALARERGQAARRAEELGEQPPERQVPRTIENTREPDETVCRPDDQELFAGNDADEFNAVLKQHITPKILITTCRFNSGRGPAFIDELMQVIPNSHYVKRGTYELKKIVDYAKNRDFTSLIVVHTNRREPDALLIIGLPDGPTAHFKLSKLVLRKDIKNHGNPTSHKPELVLNNFTTRLGHRVGRMIQSLFPQDPNFRGRRVVTFHNQRDYIFFRHHRYIFDTKEKKVASKDKKAKTSESKSESEKQVICRLQECGPRFVLKLLTLQHGTFDTKSGEYEWVHKPDMDTSRRRFFL

SEQ ID NO: 2767 - DNA, 2712 bp, Sorghum bicolor
  misc_feature: Ceres ANNOT ID no. 6026015
  misc_feature: Encodes the peptide sequence at SEQ ID NO 2768
atggcgagcagcggggtgaggaacggggtggggcccaggatgagcgcgaagccggaccgggggcagggcttcagcgctacgcccaagacagccgcggggaagcagcgcctctcctcggcggcggcgggcggcgcgtaccggcggaccagctcgggcccgctccccagccgcgcggcgtcggatggagtttctagtagagtaagggttgctgtaaggcttaggcctaggaatgctgaagagttggccgcagatgcagatttcggtgattgtgttgaacttcagccagagctcaaaaggttaaagcttcgtaaaaataattgggagtcagagacatacgaattcgatgaagtgctcacagagttttcttcgcaaaagcgagtgtatgaagttgttgcgaaaccagttgtggagagtgttatggaaggatataatggtacagttatggcatatggccagactggtactgggaaaacttttacactgggaagacttggtgaagaagacactgctgctaggggaatcatggttcgtgcaatggaggatattttagcagacataacacctgggactgattctgtctcagtatcatatcttcagttgtacatggagatgatacaagatctccttgatcctgtaaatgataatatagccattgtagaagacccaaggactggggatgtttcattgcctggagccacagtagttgaagttagagatcaaaaaagctttgtggaccttctaagggtgggtgaggctcatcgtgttgctgcaaatacaaagttaaacacagaatcatcacgaagtcatgcgatcctcatggtgaatgtcaggaggtccgtaaaaggtagaactgaaatggatgtcagcatttctggtgaaaatgggcattcgtcatccatgatggggtctttgagaccgcctattgttaggaaaagtaagcttgtagttgttgacttggctggatcagagcgcatagacaagtcaggaagtgagggtcatacgttagaagaggcaaagtctatcaacttgtccttaagtgctctgggaaaatgcatcaatgcacttgctgaaagcagtcctcatgtacctgttcgtgattctaagcttacaagattgcttaaagattcatttggaggtactgcaagaacatcattggttgtgacaattggtccatcaccaagacatcggggggaaactacgagtacaataatgtttggccaaagggcaatgaaagttgagaacatggtgaaattgaaggaagagttcgattacaagagcttatgtaggagacttgatattgaattggataaattggttgcagaaaatgaaaggcaaaggaaattttttgatgatgaagttgagagaataagagctgaagctcaatgccgcattgctgagtccgaaagggaatgcaaaatcacattagagaacgagaaaatgaagtatcaccaagaatacttggactcaataagaataatggaggagaagtggaaagtacatcaacaatcacccaagaaacaaaataaagaggctgagtctacatccaatgataccggagaagtgcataacttactgcagaatgagaaaatgctacgtcaatcggctgaagatgaggccagtgacctcaagaatcaagtatcacactggaaaaagctggaggctacagctacagctgaggtagtaaaactccggaaaatgctagatgctgaagctagccagaaagagaaacttgaagaagaaatagatgttttgaggagtcagttattgcagatgagtatggaagctgatgagacaaggaggagtcttgataaaggagatgggccaggaaaaatatttcctggtttagattcgttggtgtctcagactcgaggttcgcaacccagagagcagagcaatggaccaaagcaaccaattgccaaactctttgaacaagttgggttaaaaaagatattgtcattgcttgaatctgaagaacctgatgtccgcgttcatgcagtgaaagttgttgcaaatctggcagctgaagaggcaaatcaggaaaagattgtagaagcaggtggcctcacttccctccttacgctacttaggagctctgaggatgagacaattcgtagggtagcagcaggagcaattgctaatcttgcaatgaatgaaacaaatcaagatcttatcatggatcaaggaggtgtaaccttgttgtctatgacagcatctgatgccgaggatccacaaactcttagaatggtggctggagcaatagctaacctttgtggcaatgacaaactgcaaacacggttgcggggagaaggtggaattaaagcattgcttgggatggttaggtgtgggcaccctgatgtccttgctcaagttgcacgtggcattgcaaattttgcaaaatgtgaatctagagcagctactcaaggaaataaggtgggaaaatcactattaatcgatgacggatcacttccttggattgtaaaaaatgctaataacgaagctgccccaattaggcggcacattgagcttgcactgtgtcatttggcacaacatgaagtaaatgcaaaagatattatcaatgaaggtgccctatgggaacttgttcggatttcaagggactgttctcgagaagatataaggaaattggcatatcggacagtgacgtccagccccactcttcaagcagagataaggagattaggaataaaaatgtga

SEQ ID NO: 2768 - protein, 903 aa, Sorghum bicolor
  misc_feature: Ceres ANNOT ID no. 6026015
  misc_feature (72)..(413): Pfam Id: Kinesin Pfam Desc: Kinesin motor domain
  misc_feature (675)..(716): Pfam Id: Arm Pfam Desc: Armadillo/beta-catenin-like repeat
  misc_feature (7)..(901): NCBI GI: 18391394 NCBI Desc: armadillo/beta-catenin repeat family protein / kinesin motor family protein [arabidopsis thaliana]
  misc_feature (1)..(902): NCBI GI: 30678214 NCBI Desc: armadillo/beta-catenin repeat family protein / kinesin motor family protein [arabidopsis thaliana]
  misc_feature (1)..(902): NCBI GI: 8570446 NCBI Desc: contains similarity to a kinesin homolog from arabidopsis thaliana gbt06733 and contains a kinesin motor pf00225 domain and multiple armadillo/beta-catenin-like pf00514
  misc_feature (1)..(902): NCBI GI: 8570446 (continued) repeats
  misc_feature (410)..(901): NCBI GI: 8778646 NCBI Desc: f5o11.15 [arabidopsis thaliana]
  misc_feature (3)..(882): NCBI GI: 30694137 NCBI Desc: armadillo/beta-catenin repeat family protein / kinesin motor family protein [arabidopsis thaliana]
MASSGVRNGVGPRMSAKPDRGQGFSATPKTAAGKQRLSSAAAGGAYRRTSSGPLPSRAASDGVSSRVRVAVRLRPRNAEELAADADFGDCVELQPELKRLKLRKNNWESETYEFDEVLTEFSSQKRVYEVVAKPVVESVMEGYNGTVMAYGQTGTGKTFTLGRLGEEDTAARGIMVRAMEDILADITPGTDSVSVSYLQLYMEMIQDLLDPVNDNIAIVEDPRTGDVSLPGATVVEVRDQKSFVDLLRVGEAHRVAANTKLNTESSRSHAILMVNVRRSVKGRTEMDVSISGENGHSSSMMGSLRPPIVRKSKLVVVDLAGSERIDKSGSEGHTLEEAKSINLSLSALGKCINALAESSPHVPVRDSKLTRLLKDSFGGTARTSLVVTIGPSPRHRGETTSTIMFGQRAMKVENMVKLKEEFDYKSLCRRLDIELDKLVAENERQRKFFDDEVERIRAEAQCRIAESERECKITLENEKMKYHQEYLDSIRIMEEKWKVHQQSPKKQNKEAESTSNDTGEVHNLLQNEKMLRQSAEDEASDLKNQVSHWKKLEATATAEVVKLRKMLDAEASQKEKLEEEIDVLRSQLLQMSMEADETRRSLDKGDGPGKIFPGLDSLVSQTRGSQPREQSNGPKQPIAKLFEQVGLKKILSLLESEEPDVRVHAVKVVANLAAEEANQEKIVEAGGLTSLLTLLRSSEDETIRRVAAGAIANLAMNETNQDLIMDQGGVTLLSMTASDAEDPQTLRMVAGAIANLCGNDKLQTRLRGEGGIKALLGMVRCGHPDVLAQVARGIANFAKCESRAATQGNKVGKSLLIDDGSLPWIVKNANNEAAPIRRHIELALCHLAQHEVNAKDIINEGALWELVRISRDCSREDIRKLAYRTVTSSPTLQAEIRRLGIKM

SEQ ID NO: 2769 - DNA, 879 bp, Sorghum bicolor
  misc_feature: Ceres ANNOT ID no. 6026023
  misc_feature: Encodes the peptide sequence at SEQ ID NO 2770
  misc_feature: Up-regulated in root tissues in response to salicylic acid treatment
atggcggcgccggccaactcctcatgcttccacccccgcgcgaccttcagcccgccgtcttctctcagcgtcggaaccaaggtcttcgtcgggctcagggcgcagaccaagctcggttcgtcggagtcgtcatgcccgaatgtcagcgctgggttctacactgccgtcaaccggaggatctctctagggttgtcaagcaagaaggccaccagagcccgcatttcgatgatgcctattggtactccgcgtgtgccttacagaacacctggtgaaggaacctggcaatggcttgacatatggaatgctctgtaccgtgagcggattatcttcattggggacaatatagatgaagagttcagcaaccaagtgttggcaagcatgctgtatctagacagcattgataattccaaaaagataatgctgtacattaatggaccaggaggagatcttactccatgtatggcactatatgataccatgctaagtctaaaaagtcctattggtacgcactgcttgggctttgcattcaacctggcaggatttattcttgcagctggtgaaaagggttcacgtactggtatgcctctatgccgaatttcacttcagtcacctgctggagcagctcgaggccaggctgatgatatagaaaatgaagcaaatgagcttattcgtatcaagaactatctctatggcaagcttgcagagcacacaggtcattctgttgagaagatccatgaggacctctctagggtgaagcgcttcgacgctgaaggggctctcgaatatgggattattgaccgtattatcaggccttctaggatcaagaaagagggctccactgcccaaaggagggatatgcgaaatctgggacttggctaa

SEQ ID NO: 2770 - protein, 292 aa, Sorghum bicolor
  misc_feature: Ceres ANNOT ID no. 6026023
  misc_feature (89)..(272): Pfam Id: CLP_protease Pfam Desc: Clp protease
  misc_feature (1)..(292): NCBI GI: 92884628 NCBI Desc: peptidase s14, clpp [medicago truncatula]
  misc_feature (1)..(292): NCBI GI: 20148625 NCBI Desc: similar to nclpp2 dbjbaa82066.1 [arabidopsis thaliana]
  misc_feature (1)..(292): NCBI GI: 16209712 NCBI Desc: at1g12410/f5o11_7 [arabidopsis thaliana]
  misc_feature (77)..(269): NCBI GI: 34222549 NCBI Desc: atp-dependent clp protease proteolytic subunit 2 (endopeptidase clp 2)
  misc_feature (77)..(269): NCBI GI: 22298615 NCBI Desc: atp-dependent clp protease proteolytic subunit 2 [thermosynechococcus elongatus bp-1]
  misc_feature (77)..(269): SWISSPROT Homolog: EC 3.4.21.92 ATP-dependent Clp protease proteolytic subunit 2
  misc_feature: The leaves start out wild-type green and gradually turn yellow-greenin color, while the cotyledons stay wild-type green.
  misc_feature: Useful for biocontainment applications
  misc_feature: GREAT-hit functional homolog of the protein sequence given in SEQ ID NO 13199
  misc_feature: Useful for biocontainment applications
  misc_feature: Functional homolog of the protein sequence given in SEQ ID NO 13199
  misc_feature: Up-regulated in root tissues in response to salicylic acid treatment
MAAPANSSCFHPRATFSPPSSLSVGTKVFVGLRAQTKLGSSESSCPNVSAGFYTAVNRRISLGLSSKKATRARISMMPIGTPRVPYRTPGEGTWQWLDIWNALYRERIIFIGDNIDEEFSNQVLASMLYLDSIDNSKKIMLYINGPGGDLTPCMALYDTMLSLKSPIGTHCLGFAFNLAGFILAAGEKGSRTGMPLCRISLQSPAGAARGQADDIENEANELIRIKNYLYGKLAEHTGHSVEKIHEDLSRVKRFDAEGALEYGIIDRIIRPSRIKKEGSTAQRRDMRNLGLG

SEQ ID NO: 2771 - DNA, 867 bp, Sorghum bicolor
  misc_feature: Ceres ANNOT ID no. 6026033
  misc_feature: Encodes the peptide sequence at SEQ ID NO 2772
atggtgaacgccttcttcctcttttgcggctgcgtggaccaggccagcgtggcggtggtggagaagtggggccgcttcctccgcctcgccgacccgggcctccacttcttcaaccccttcgccggggagtgcgtcgcgggcgccctcaccacccgcgtccagtccctcgacgtccgcgtcgagaccaagaccaaggataatgtctttgtccagctgatctgcacaattcagtaccgtgttgtcaaggaaaatgcagatgatgcattctatgagttgcagaatccccaacaacaaattcaggcctacgtctttgatgttgtccgggccatagtgccaagaatgaatctggatgatctctttgagcagaagaatgatgtggccaaagctgtactggaggagcttgaaaaggtgatggcagcttatggttacagtattgagcacattctcatggtcgatatcatccctgacgctgctgttcgcaaagcaatgaacgaaataaatgcagcccaaaggctccagctggcaagtgtttacaaaggagaagcagagaagattcttatggtgaagaaagcggaggcagaagccgaggcgaaatacctttctggtgtcggtatcgccaaacagcggcaggcgataactgatggcctcagagagaacatcctgaacttctcacactcggtgtcaggcaccagcgcgaaggaagtcatggacctgatcatggtcacgcagtacttcgacaccatcaaggagctcggtgatggctccaagaacaccacgatcttcataccccatggaccgggccacgtgaaggacatcagcgagcagatccgcgatggcatgatgcaagcctcaagtagcaatgtgtaa

SEQ ID NO: 2772 - protein, 288 aa, Sorghum bicolor
  misc_feature: Ceres ANNOT ID no. 6026033
  misc_feature (10)..(184): Pfam Id: Band_7 Pfam Desc: SPFH domain / Band 7 family
  misc_feature (1)..(288): NCBI GI: 23345038 NCBI Desc: hypersensitive-induced reaction protein 4 [hordeum vulgare subsp. vulgare]
  misc_feature (135)..(286): NCBI GI: 113205144 NCBI Desc: spfh domain / band 7 family protein [solanum demissum]
  misc_feature (7)..(288): NCBI GI: 21554781 NCBI Desc: hypersensitive-induced response protein [arabidopsis thaliana]
  misc_feature (7)..(284): NCBI GI: 46452120 NCBI Desc: hypersensitive-induced reaction protein [capsicum annuum]
  misc_feature (12)..(283): NCBI GI: 14150732 NCBI Desc: hypersensitive-induced response protein [oryza sativa]
MVNAFFLFCGCVDQASVAVVEKWGRFLRLADPGLHFFNPFAGECVAGALTTRVQSLDVRVETKTKDNVFVQLICTIQYRVVKENADDAFYELQNPQQQIQAYVFDVVRAIVPRMNLDDLFEQKNDVAKAVLEELEKVMAAYGYSIEHILMVDIIPDAAVRKAMNEINAAQRLQLASVYKGEAEKILMVKKAEAEAEAKYLSGVGIAKQRQAITDGLRENILNFSHSVSGTSAKEVMDLIMVTQYFDTIKELGDGSKNTTIFIPHGPGHVKDISEQIRDGMMQASSSNV

SEQ ID NO: 2773 - DNA, 1245 bp, Sorghum bicolor
  misc_feature: Ceres ANNOT ID no. 6026058
  misc_feature: Encodes the peptide sequence at SEQ ID NO 2774
atgccgccactcgcgcgccgcttcctcctcctccaccaccaccacgcgctgccgcgcggggcgcgcgccctccacacgaccccgcgcaccgacccgggggtgctggcctgccgtctggcgtcccgcgccgtggtccgcttcgcgggtcccgaggcggcgcgcttcctgcactcgctgctcaccaacgacctcctctcggctttctccgcggcggccgcgtcggcgccgcagcggtacgcgcccacgcccaacgcgcccgcgcggggccccgcggcgcccgcctacgccgcgctgctcacgccgcaggggaggttcctctacgacctcttcctctaccggcccccgccgccgtcccagatgctcgaccggaccggctccgcgccggagaccggggaggctcccgagggggacacgggggagcctcaggaggtgctcgctgatgttgacgccgctgaggtggacgacctcgtcgcctgcttcaagagatatcggttgagatccaaggttgaaatagacaatgtaagtgagaattttgcatgttggcaaagatttggacataatgtagtgcatactgaaccttctactcaagagcctgaggctcaatccattggatggggacaaggtgttgatcatgctggtgagtcagctgcacaagggaacggtcatggttggcaatggctcaaagatcctcggttggactaccttggttacagaggaatttttccagctaacacaataccaccactagttgagtctgacaaagaagcggatgaacggcattatcaactttggcgcatagaaaatggagttgcagaaggttcaactgagatcccaaaaggtgaagcaatcccgctggagtacaatcttgctggcctgaatgctatttcctttgagaaaggatgctacatcgggcaggagcttattgcacggacacaccatcgtggtgtcgttcggaagcgcctaatgccaatgaagtttgttgacgaaaatgggcaagaactcgaggaggctgtcgtcgctccaggttcagaagttgtggatgaggcttcaggcaagaagatcgggacagtaaacaccgcactgggctcccgcgggatgggcctgttgagactcgaggaagcactgaaaccaggctcggccctccgcatcagcgataacagggacgtgaaggtccaggcgatcaagccggactggtggccagccgagtggacgcaggtgcttcagcaacagagcgcagcagcttga

SEQ ID NO: 2774 - protein, 414 aa, Sorghum bicolor
  misc_feature: Ceres ANNOT ID no. 6026058
  misc_feature (300)..(396): Pfam Id: GCV_T_C Pfam Desc: Glycine cleavage T-protein C-terminal barrel domain
  misc_feature (1)..(414): NCBI GI: 55297200 NCBI Desc: glycine cleavage t protein-like [oryza sativa (japonica cultivar-group)]
  misc_feature (138)..(402): NCBI GI: 125775558 NCBI Desc: ga20785-pa [drosophila pseudoobscura]
  misc_feature (140)..(402): NCBI GI: 116117065 NCBI Desc: ensangp00000015808 [anopheles gambiae str. pest]
  misc_feature (229)..(393): NCBI GI: 92119419 NCBI Desc: glycine cleavage t protein (aminomethyl transferase) [nitrobacter hamburgensis x14]
  misc_feature (229)..(397): NCBI GI: 85714363 NCBI Desc: glycine cleavage t protein (aminomethyl transferase) [nitrobacter sp. nb-311a]
MPPLARRFLLLHHHHALPRGARALHTTPRTDPGVLACRLASRAVVRFAGPEAARFLHSLLTNDLLSAFSAAAASAPQRYAPTPNAPARGPAAPAYAALLTPQGRFLYDLFLYRPPPPSQMLDRTGSAPETGEAPEGDTGEPQEVLADVDAAEVDDLVACFKRYRLRSKVEIDNVSENFACWQRFGHNVVHTEPSTQEPEAQSIGWGQGVDHAGESAAQGNGHGWQWLKDPRLDYLGYRGIFPANTIPPLVESDKEADERHYQLWRIENGVAEGSTEIPKGEAIPLEYNLAGLNAISFEKGCYIGQELIARTHHRGVVRKRLMPMKFVDENGQELEEAVVAPGSEVVDEASGKKIGTVNTALGSRGMGLLRLEEALKPGSALRISDNRDVKVQAIKPDWWPAEWTQVLQQQSAAA

SEQ ID NO: 2775 - DNA, 2247 bp, Sorghum bicolor
  misc_feature: Ceres ANNOT ID no. 6026068
  misc_feature: Encodes the peptide sequence at SEQ ID NO 2776
  misc_feature: Down-regulated in shoot tissues in response to salicylic acid treatment
atggttgggagctcaattgctgctctgcataccaccattggtagacactctggttccccgtctcgaggcagcgcacctgcgctggtggccatgggaggacaagtcaagttctgccacctcatgtcactccgaaaccacaatgcatatgtggcctcctcgggccacaagcgcatcatatgcgccatctgcactgaggcacctgagagtttgactgccactggccagctgctggcacctgagagtttgactgccactggccagctgcttgagaggtcagtgaacacaatccgcttcctgaccattgatgccgtggagaaggccaactctggccatgtggggatgtccatggggtgcgcgcccatgggccacatcctctatgatgaagtcatgcggtacaaccccaagaacccctattggtttaaccgtgaccgcttcgtcctctctgccggccatgggtccatgcttcagtatgcgttgttccacctggccggctatgacagtatcagcgtacaggagttgaagcaattcagtcaactcggaagcaagacaccgggccaccctgaaaactttgtaaccccaggagttgaagttaccactggacctcttggtcagggtatcaccaatgcagttgggttggcactcgccgagaagcacctggctggccgcttcaacaagcccgacagtgaagttgtcaaccactacacatacgttatcctgggagatggttgtcaaatggagggtatctccagtgaagcttgctcgttggctggacactggggtcttggcaagctcattgctttctatgatgacaaccacatatccgttgatggagatacagagatagcattcacagaagatgtgatcgcccgctttgaagcctacgggtggcacacactctgggttaagaatggaaacactggctatgatgacatccgtgaagccattaaggaagcaaaagcagtaaccgacaagcctacattggtcaaagtgaccacaacaatcggttacggatctcccaacaaggccaactcatacagtgtgcacggaggtgcattgggcaccaaagaggttgaagcaacccggcagaatcttggatggccctatgagccattctttgtgcctgaggatgttaagagccactggagccgccacgtgccccgaggtgctgcacttgaggctgattgggatgctaagtttgcagagtatgagaagaagtacccagaggatgcagcaaccttgaaaaatatcatctcaggggacttgcctgctggttgggctgatgaccttcctaaatacactgcagcgtgcccagaagcttcgaccaggaacctctctcagcactgcttgaatgaacttgctaaagtactgcctggttttcttggaggcagtgctgatgttgcatcttccagcatgacgctgcttaagatgtttggcaacttccagaagtatacacctgaggagcgaaacctctgctttggagtgagggagcatggcatgggcggcatttgcaacggcattgctctgcacagcccaggtctcattccatactgttcaacctatctcgctttctctgattacatgagagctgccatgagagtctcagccttgtctgaagctggagttatctatgttatgacccacgacagtatcggtgtcggagagaatggcccaacccatcagcccatcgagcacttgatgagcttccgaatgatgcccaacatgttggtgctccgtcctgcggatggcaatgagactgctggagcatacagagttgcggtccttaacaggaagaggccatctgttcttgctctctccaggcaaaaccttcctcagctgcctggtacctcgatcgagggtgttgagaagggtgggtacgtcatctccgacaactcaagcagcaacaagccagaccttattgtgttgggtactggttccgagctggagatcgctgcgaaagctgcagatgagttgaggaaggaggggaagactgtccgcgtcgtgtcgcttgtctgctgggaactctttgaggagcagtcagatgaatacaaggagagtgttctccctgaatctgtcaccgcaaggatcagcatcgaagcagggtgcgctcttggatggcagaagtacgttggccccaggggaaagattatcgcgatcgacagattcggtgcgagtgctcctgctgaaaagatctacatggagtgtggcatcactgtggagagcgtcgttgcggcagccaggagcttctaa

SEQ ID NO: 2776 - protein, 748 aa, Sorghum bicolor
  misc_feature: Ceres ANNOT ID no. 6026068
  misc_feature (88)..(422): Pfam Id: Transketolase_N Pfam Desc: Transketolase, thiamine diphosphate binding domain
  misc_feature (437)..(611): Pfam Id: Transket_pyr Pfam Desc: Transketolase, pyrimidine binding domain
  misc_feature (624)..(741): Pfam Id: Transketolase_C Pfam Desc: Transketolase, C-terminal domain
  misc_feature (80)..(747): NCBI GI: 115466224 NCBI Desc: os06g0133800 [oryza sativa (japonica cultivar-group)]
  misc_feature (70)..(748): NCBI GI: 25067747 NCBI Desc: thioredoxin/transketolase fusion protein [synthetic construct]
  misc_feature (84)..(748): NCBI GI: 28948384 NCBI Desc: chain c, maize transketolase in complex with tpp
  misc_feature (52)..(746): NCBI GI: 1658322 NCBI Desc: transketolase precursor [solanum tuberosum]
  misc_feature (55)..(746): NCBI GI: 2117700 NCBI Desc: transketolase (ec 2.2.1.1) precursor - potato (fragment)
  misc_feature (84)..(748): SWISSPROT Homolog: EC 2.2.1.1 Transketolase, chloroplast
  misc_feature: Useful for making plants with modulated biomass
  misc_feature: Functional homolog of the protein sequence given in SEQ ID NO 13642
  misc_feature: Down-regulated in shoot tissues in response to salicylic acid treatment
MVGSSIAALHTTIGRHSGSPSRGSAPALVAMGGQVKFCHLMSLRNHNAYVASSGHKRIICAICTEAPESLTATGQLLAPESLTATGQLLERSVNTIRFLTIDAVEKANSGHVGMSMGCAPMGHILYDEVMRYNPKNPYWFNRDRFVLSAGHGSMLQYALFHLAGYDSISVQELKQFSQLGSKTPGHPENFVTPGVEVTTGPLGQGITNAVGLALAEKHLAGRFNKPDSEVVNHYTYVILGDGCQMEGISSEACSLAGHWGLGKLIAFYDDNHISVDGDTEIAFTEDVIARFEAYGWHTLWVKNGNTGYDDIREAIKEAKAVTDKPTLVKVTTTIGYGSPNKANSYSVHGGALGTKEVEATRQNLGWPYEPFFVPEDVKSHWSRHVPRGAALEADWDAKFAEYEKKYPEDAATLKNIISGDLPAGWADDLPKYTAACPEASTRNLSQHCLNELAKVLPGFLGGSADVASSSMTLLKMFGNFQKYTPEERNLCFGVREHGMGGICNGIALHSPGLIPYCSTYLAFSDYMRAAMRVSALSEAGVIYVMTHDSIGVGENGPTHQPIEHLMSFRMMPNMLVLRPADGNETAGAYRVAVLNRKRPSVLALSRQNLPQLPGTSIEGVEKGGYVISDNSSSNKPDLIVLGTGSELEIAAKAADELRKEGKTVRVVSLVCWELFEEQSDEYKESVLPESVTARISIEAGCALGWQKYVGPRGKIIAIDRFGASAPAEKIYMECGITVESVVAAARSF

SEQ ID NO: 2777 - DNA, 1746 bp, Sorghum bicolor
  misc_feature: Ceres ANNOT ID no. 6026102
  misc_feature: Encodes the peptide sequence at SEQ ID NO 2778
atggaacaaggtaaagagtctgattccaatacatattggaacaagtcacagggtgttgaggtgatccgcacaacaggatttgtaacaaccgaggcgtccggcggcattgggttcaacctccaccatcggttctcgccggtggtccggcagtggatggtggacgcgcgaggcggcggccatggcgtccccggctccagctggttgttgccagaggaggcgcctgcggttggctcgccggagtactactccgcgctgctccgccacgaccgtgccctcttcacccgccgccgcggcctcgccagcgccgccgacggccagagcaccaccctcaccttcgccgacggcaatgccactcgcctcgatacctatgaatacctgcactacgcggaggtggaggtgggcacgccgagctcgaagttcctggtggcgctggacaccggcagcgacctcttctggctgccctgcgaatgcaagctgtgtgcgaagaacggcagcaccatgtacagcccgagcctgtcgtcgacgagcaagacggtgccgtgcggccacccgctgtgcgagcgtccggacgcctgcgccaccgcgggaaagagcagcagcagctgcccctacgaggtgaagtacgtctccgccaacaccggctcgtccggggtgctcgtggaggacgtgctgcacctcgttgacggcggcggcggcggcggaggaaaggcggtgcaggcgccgatcgtgttcgggtgcggccaggtgcagacgggcgccttcctgcgcggcgctgccgccggcgggctgatggggctgggcttggacaaggtctccgtgcccagcgcgctcgccagcagtggcctcgtcgcgtccgacagcttctccatgtgcttcagccgcgacggcgtcggccggatcaacttcggcgacgccggcagcccggaccaggcggagacgccgctcatcgccgccgggagcttacagcctagttactacaacatcagtgtcggagcgatcaccgtggacagcaaggctatggcggtggagttcaccgccgttgtggactccggcacgtcgtttacctacctcgacgacccggcttacacgttcctcacgaccaatttcaattcgagggtttccgaggccagcgaaacttatggcagcggctatgaaaagttcgagttttgctacagattgagcccaggccaaacaagtatgaagcggctgccggcgatgagcctgacgaccaagggaggcgccgtgttccccattacatggcccatcatccccgtccttgccagcaccaatggcgggccgtaccaccccattggctactgcttggggatcatcaagaccagcatcttgagcaccgaggacgccaccattggccagaacttcatgacagggctcaaggtcgtctttgaccgcaggaaatctgtcctgggatgggagaagttcgactgttacaaggatgctaagatgcaagagggcgggagcccggacacttctcttgggagccctgctgctgccgccggtgactctactccgggaagccccagcggcgactatgctccctccgtgccactgccatgggagaacaatgcaaccaatggaccgtattattaccccggcagggtgcccctgacgtggccggcgaggtcaggttcaggttcaggttcaggcagcagcagccgggtgtcgtttggaggcctcctctccttgatactgcttcatgtgctggttgttacatctgtgacttggtga

SEQ ID NO: 2778 - protein, 581 aa, Sorghum bicolor
  misc_feature: Ceres ANNOT ID no. 6026102
  misc_feature (124)..(480): Pfam Id: Asp Pfam Desc: Eukaryotic aspartyl protease
  misc_feature (18)..(515): NCBI GI: 32526671 NCBI Desc: chloroplast nucleoid dna-binding protein -like protein [oryza sativa (japonica cultivar-group)]
  misc_feature (41)..(528): NCBI GI: 38346027 NCBI Desc: osjnbb0071d01.4 [oryza sativa (japonica cultivar-group)]
  misc_feature (41)..(521): NCBI GI: 116308959 NCBI Desc: h0209a05.1 [oryza sativa (indica cultivar-group)]
  misc_feature (38)..(531): NCBI GI: 42567433 NCBI Desc: aspartyl protease family protein [arabidopsis thaliana]
  misc_feature (64)..(516): NCBI GI: 140047301 NCBI Desc: peptidase aspartic, active site [medicago truncatula]
MEQGKESDSNTYWNKSQGVEVIRTTGFVTTEASGGIGFNLHHRFSPVVRQWMVDARGGGHGVPGSSWLLPEEAPAVGSPEYYSALLRHDRALFTRRRGLASAADGQSTTLTFADGNATRLDTYEYLHYAEVEVGTPSSKFLVALDTGSDLFWLPCECKLCAKNGSTMYSPSLSSTSKTVPCGHPLCERPDACATAGKSSSSCPYEVKYVSANTGSSGVLVEDVLHLVDGGGGGGGKAVQAPIVFGCGQVQTGAFLRGAAAGGLMGLGLDKVSVPSALASSGLVASDSFSMCFSRDGVGRINFGDAGSPDQAETPLIAAGSLQPSYYNISVGAITVDSKAMAVEFTAVVDSGTSFTYLDDPAYTFLTTNFNSRVSEASETYGSGYEKFEFCYRLSPGQTSMKRLPAMSLTTKGGAVFPITWPIIPVLASTNGGPYHPIGYCLGIIKTSILSTEDATIGQNFMTGLKVVFDRRKSVLGWEKFDCYKDAKMQEGGSPDTSLGSPAAAAGDSTPGSPSGDYAPSVPLPWENNATNGPYYYPGRVPLTWPARSGSGSGSGSSSRVSFGGLLSLILLHVLVVTSVTW

SEQ ID NO: 2779 - DNA, 1146 bp, Sorghum bicolor
  misc_feature: Ceres ANNOT ID no. 6026104
  misc_feature: Encodes the peptide sequence at SEQ ID NO 2780
atggcaggcctcgaacggccccgccgccgccctcccccggaccccgtcgccgtgctccgcggccaccgcgccgcagtcaacgacgcctgcttccatccctccctcccactcctcttctccggggctcatgctgggtccgcgggagtgtattctgttgctgctggtgctggacttgggaataagatcatcagccaaggcagggatgggacttgtaaatgttgggtgattgaagaagccgggctttcacggaagcccctatttactgtcaaaacaagcacatatcatttctgcaagatgtcactcgtgaagtcttctttaacacatgccacaaaatccggctcaacctgctcagctagcgacgtagagccaaaaagattgtcatctgaaaatacagaatgccatggtgtaaaccctgcagtagcccctcaagaacatgatcaatgcactacctctaatgggcataatatgttggcaattgctggcgaagaatcgtcccaggttgagctttgggacattgcaagtgctagaaagatcgtaactttgccccaaacatgtagcactgatacggcaaatcatcctactaagaaaaaaggactatgcatggctgtgcaagctttcatcccacatgaatctgcaggctacgtaaatatcttgtcaagttacgaagatggaagcactctttggtgggatgtacgaaagcctgggttacctttatcttcagtgaaatatcattcagaatcagctttatccattgctattgatgggttttgcaatggtggaatctcaggaggtgctgatgataaagtagtcatgttcacgcttgatcatccaaagggtgcatttattcttaggaaagaaatagaacttgagcgacctggtatagctggcacagcgattcggccagacaacaagatcgctgcaaccgctggctgggatcacaggattcgagtgtataactacaacaaaggaaatgctctagccgtgttaaagtatcacagtgcttcgtgcaatgccgtgactttctcatctgactgcaagcttatggcttcctgctcggcggatacgacggttgcattgtgggacctctatcccccaaaaccccaaaacaaagtggacatcacaaaaacagatgaagcctcctggtag

SEQ ID NO: 2780 - protein, 381 aa, Sorghum bicolor
  misc_feature: Ceres ANNOT ID no. 6026104
  misc_feature (13)..(75): Pfam Id: WD40 Pfam Desc: WD domain, G-beta repeat
  misc_feature (323)..(361): Pfam Id: WD40 Pfam Desc: WD domain, G-beta repeat
  misc_feature (1)..(380): NCBI GI: 55295818 NCBI Desc: transducin protein-like [oryza sativa (japonica cultivar-group)]
  misc_feature (42)..(365): NCBI GI: 42567255 NCBI Desc: transducin family protein / wd-40 repeat family protein [arabidopsis thaliana]
  misc_feature (156)..(364): NCBI GI: 22902249 NCBI Desc: guanine nucleotide binding protein (g protein), beta polypeptide 1-like [mus musculus]
  misc_feature (156)..(364): NCBI GI: 50511039 NCBI Desc: mkiaa1645 protein [mus musculus]
  misc_feature (157)..(364): NCBI GI: 13359165 NCBI Desc: kiaa1645 protein [homo sapiens]
  misc_feature: The sequence is a functional homolog of SEQ ID NO. 502 in the 11/188,298 US application
MAGLERPRRRPPPDPVAVLRGHRAAVNDACFHPSLPLLFSGAHAGSAGVYSVAAGAGLGNKIISQGRDGTCKCWVIEEAGLSRKPLFTVKTSTYHFCKMSLVKSSLTHATKSGSTCSASDVEPKRLSSENTECHGVNPAVAPQEHDQCTTSNGHNMLAIAGEESSQVELWDIASARKIVTLPQTCSTDTANHPTKKKGLCMAVQAFIPHESAGYVNILSSYEDGSTLWWDVRKPGLPLSSVKYHSESALSIAIDGFCNGGISGGADDKVVMFTLDHPKGAFILRKEIELERPGIAGTAIRPDNKIAATAGWDHRIRVYNYNKGNALAVLKYHSASCNAVTFSSDCKLMASCSADTTVALWDLYPPKPQNKVDITKTDEASW

SEQ ID NO: 2781 - DNA, 483 bp, Sorghum bicolor
  misc_feature: Ceres ANNOT ID no. 6026108
  misc_feature: Encodes the peptide sequence at SEQ ID NO 2782
atgtcggtgacgctgcacacgaacctgggcgacatcaagtgcgaggtgttctgcgaccaggtgccccgcacggcggagaacttcctggcgctctgcgccagcggctactacgacggcaccgtcttccaccgcaacatcaagggcttcatgatccagggcggcgaccccaccggcacaggcaagggcggcacctccatctggggcaccaagttcgccgacgagttcagggagtcgctcaagcacaacgcgagagggatcatgtcgatggccaacagcgggcccaacaccaacggcagccagttcttcatcacctacgccaagcagccgcacctcaacggccactacaccgtcttcgccaaggtcatccatggcttcgaggtgctggacctcatggagaaagcgcagacaggacccggggacaggccgctcgccgagatcaggctcaaccgcgtcaccatccacgccaacccgctcgcactctga

SEQ ID NO: 2782 - protein, 160 aa, Sorghum bicolor
  misc_feature: Ceres ANNOT ID no. 6026108
  misc_feature (2)..(153): Pfam Id: Pro_isomerase Pfam Desc: Cyclophilin type peptidyl-prolyl cis-trans isomerase/CLD
  misc_feature (1)..(159): NCBI GI: 93140614 NCBI Desc: peptidyl-prolyl cis-trans isomerase-like 3 (ppiase) (rotamase)
  misc_feature (1)..(159): NCBI GI: 109892836 NCBI Desc: peptidyl-prolyl cis-trans isomerase-like 3 (ppiase) (rotamase)
  misc_feature (1)..(159): NCBI GI: 60656175 NCBI Desc: peptidylprolyl isomerase-like 3 [synthetic construct]
  misc_feature (1)..(159): NCBI GI: 14043400 NCBI Desc: peptidylprolyl isomerase-like protein 3, isoform ppil3b [homo sapiens]
  misc_feature (1)..(159): NCBI GI: 73921768 NCBI Desc: peptidyl-prolyl cis-trans isomerase-like 3 (ppiase) (rotamase) (cyclophilin-like protein ppil3) (cyp10l)
  misc_feature (1)..(159): SWISSPROT Homolog: EC 5.2.1.8 Peptidyl-prolyl cis-trans isomerase-like 3
MSVTLHTNLGDIKCEVFCDQVPRTAENFLALCASGYYDGTVFHRNIKGFMIQGGDPTGTGKGGTSIWGTKFADEFRESLKHNARGIMSMANSGPNTNGSQFFITYAKQPHLNGHYTVFAKVIHGFEVLDLMEKAQTGPGDRPLAEIRLNRVTIHANPLAL

SEQ ID NO: 2783 - DNA, 1458 bp, Sorghum bicolor
  misc_feature: Ceres ANNOT ID no. 6026120
  misc_feature: Encodes the peptide sequence at SEQ ID NO 2784
atgagcttcctccgctcgctagccgactccttctcctcgctgctcttctcgtcgtggggcgaggcggcgcccatggacgcggcgggggcggcgccgtcgccggcggctgtggtgggggagcgcgtggcggtgaagctcaggggctacttcgacctcgccaaggaggagatcgacaaggccgtgcgcgccgaggagtggggcctcccggacgaggccaccgcgcactaccgcaacgcgatgcgcgtcatgctcgaggccaaggccgcgcgcgtccccgacgccgtctcctccagcgagagggggcaggtcagggtgtaccaagagaagatcgccaagtggcaggcgcaggtcgaggagcggctcagagtgcttggtcggagaagtggtgaagtagtgcctaagaaggttgctgcaagcaatcctatcggtaggactgcaagaacagcgccaaatagcatccaaagatctcctttgcaaaatagtcctaccttcaacagaggtggccaagcatctggacatcagaagataggaagtggagcttccagacctgttcaaaaggctggtggaagctatgatgacaagcttgttgaaatgattaatacaacaattgtggacagaagccctgctgttaaatgggatgacgttgctggtcttgacaaggcaaagcaagcactcatggaaatggttattttgcctactaaacgaagggatttgttcaccggacttaggagacctgctaggggtttgcttctctttggtccacctgggaatggaaaaacaatgcttgccaaagctgttgcatcagaatctgaagcaacattttttaatgtttcggcttcttcattgacatcaaagtgggtaggagaagctgaaaaacttgtcaggacacttttcatggttgcaattgatagacaaccatccgttatttttatggacgagattgatagtgtcatgtctacaaggttggctaatgagaatgactctagcaggcgactgaaatctgaattccttatccagtttgatggggtgtcctcaaacccagatgatttagtaattgttataggggctactaataaacctcaagagttggatgacgctgttcttcgaagactggtaaaaagaatatatgtgccactacctgatccaaatgtacggaagctacttctgaaaaatcagctcagaggacaagcattcaaattgtcgaactatgatttcgaaagacttgctgtggagactgaaggatattctggaagtgatctgagagccttgtgcgaagaagctgcaatgatgccaataagagagctcggtccacagaatattcttactattaaagcaaatcagttgcgacctttgaggtacgaggatttcaagaacgcaatgacggtgattagaccaagcttgcagaagagcaaatgggacgagctggagaaatggaacgaggaattcggttcgagctga

SEQ ID NO: 2784 - protein, 485 aa, Sorghum bicolor
  misc_feature: Ceres ANNOT ID no. 6026120
  misc_feature (248)..(433): Pfam Id: AAA Pfam Desc: ATPase family associated with various cellular activities(AAA)
  misc_feature (49)..(124): Pfam Id: MIT Pfam Desc: MIT (microtubule interacting and transport) domain
  misc_feature (1)..(485): NCBI GI: 145361024 NCBI Desc: atp binding [arabidopsis thaliana]
  misc_feature (25)..(485): NCBI GI: 16518974 NCBI Desc: tobacco mosaic virus helicase domain-binding protein [nicotiana tabacum]
  misc_feature (133)..(485): NCBI GI: 50603653 NCBI Desc: spg4-prov protein [xenopus laevis]
  misc_feature (133)..(485): NCBI GI: 34539797 NCBI Desc: spastin [danio rerio]
  misc_feature (192)..(485): NCBI GI: 119620866 NCBI Desc: spastin, isoform cra_a [homo sapiens]
  misc_feature: The sequence is a functional homolog of SEQ ID NO. 471 in the 11/188,298 US application
  misc_feature: The sequence is a functional homolog of SEQ ID NO. 462 in the 11/188,298 US application
MSFLRSLADSFSSLLFSSWGEAAPMDAAGAAPSPAAVVGERVAVKLRGYFDLAKEEIDKAVRAEEWGLPDEATAHYRNAMRVMLEAKAARVPDAVSSSERGQVRVYQEKIAKWQAQVEERLRVLGRRSGEVVPKKVAASNPIGRTARTAPNSIQRSPLQNSPTFNRGGQASGHQKIGSGASRPVQKAGGSYDDKLVEMINTTIVDRSPAVKWDDVAGLDKAKQALMEMVILPTKRRDLFTGLRRPARGLLLFGPPGNGKTMLAKAVASESEATFFNVSASSLTSKWVGEAEKLVRTLFMVAIDRQPSVIFMDEIDSVMSTRLANENDSSRRLKSEFLIQFDGVSSNPDDLVIVIGATNKPQELDDAVLRRLVKRIYVPLPDPNVRKLLLKNQLRGQAFKLSNYDFERLAVETEGYSGSDLRALCEEAAMMPIRELGPQNILTIKANQLRPLRYEDFKNAMTVIRPSLQKSKWDELEKWNEEFGSS

SEQ ID NO: 2785 - DNA, 507 bp, Sorghum bicolor
  misc_feature: Ceres ANNOT ID no. 6026121
  misc_feature: Encodes the peptide sequence at SEQ ID NO 2786
atggagccatccaacaagctcgtcgctgtcttgctcgtgtccttggccatggctgccgccaccgtcgtgcagccttcctacgctcagaactcgccccaaaactacctgactccccacaacaacgcccgtgccgccgtcggcgttggcccggtgacctggagcacgaagctgcagcagttcgcggagagctacgccgcgaagcgggccggcgactgccgcctgcagcactccggcgggccgtatggggagaacatcttctggggctccgccggcgccgactggaaggcggcggacgcggtgcggtcgtgggtggacgagaagcagtggtacagctacgccaccaacagctgcgccgccggcaaggtgtgcggccactacacgcaggtggtgtggcgcgccagcactagcatcggctgcgcgcgcgtcgtctgccgcgacaaccgcggcgtcttcatcatctgcaactacgagccccgcggcaacatcgtgggacacaagccctactga

SEQ ID NO: 2786 - protein, 168 aa, Sorghum bicolor
  misc_feature: Ceres ANNOT ID no. 6026121
  misc_feature (36)..(156): Pfam Id: SCP Pfam Desc: SCP-like extracellular protein
  misc_feature (1)..(168): NCBI GI: 75993951 NCBI Desc: pathogenesis-related maize seed protein [zea mays subsp. parviglumis]
  misc_feature (1)..(168): NCBI GI: 75993989 NCBI Desc: pathogenesis-related maize seed protein [zea diploperennis]
  misc_feature (1)..(168): NCBI GI: 22454 NCBI Desc: pathogenesis-related protein [zea mays]
  misc_feature (1)..(168): NCBI GI: 75993975 NCBI Desc: pathogenesis-related maize seed protein [zea mays subsp. parviglumis]
  misc_feature (1)..(168): NCBI GI: 75993991 NCBI Desc: pathogenesis-related maize seed protein [zea diploperennis]
  misc_feature: Useful for making plants with modulated biotic stress sensitivity
  misc_feature: Functional homolog of the protein sequence given in SEQ ID NO 13804
MEPSNKLVAVLLVSLAMAAATVVQPSYAQNSPQNYLTPHNNARAAVGVGPVTWSTKLQQFAESYAAKRAGDCRLQHSGGPYGENIFWGSAGADWKAADAVRSWVDEKQWYSYATNSCAAGKVCGHYTQVVWRASTSIGCARVVCRDNRGVFIICNYEPRGNIVGHKPY

SEQ ID NO: 2787 - DNA, 969 bp, Sorghum bicolor
  misc_feature: Ceres ANNOT ID no. 6026133
  misc_feature: Encodes the peptide sequence at SEQ ID NO 2788
atggcattgccggccgcgagtgcgcgtgcgcagtgtctccttcgcttccgcggccggtcgccgttgccgcgtctccctctccctctcccttcccctcccgcgaccacacgagcagcgtcccgccgccgaggtgtacggatggcctcctcggacgcctctgccgctgcgccgcccagcgctaccgtcgaggtgcccggcgccgcggcccccgtcctcgtcgtgggcgcgccgggactccccgaggcggacttcaggaacgcggtggagtcgtcgctgttcaagcagtggctgcggaacctgcagtcggagaagggcgtcctcacctacgggaggctgagccttacgcgggtcctcatccagggagttgacacgtttgggaaacgggtgggctttctcaagttcaaagctgacatcgtggacgaggaaacgaaaaccaaggttccaggaattgtctttgcaagaggacctgcggttgccgtgttgattcttttggagtctaagggggaaacatatgctgtgcttactgagcaggttagagttcctgttggaaaattcctgttggagctgccagctgggatgctagatgatgaaaaaggtgattttgttggcaccgcagtccgtgaggtggaagaggagactggtataaagctgaatatagaagacatggttgatcttacggcactgctggacccggctaccggaggtcgaatgctaccatcaccgggtggctgcgacgaagagatcggcctgttcctgtacaggggccgcgttgacgaggagaccataagatcgctccaggggaaggaaaccgggctgcgcgaccatggtgagctgatcaagctgcgcgtggttccctacagccagctctggcggtcgaccggcgatgctaaagcactctccgcgatagccctgtacgagatggccaagagggaaggcctgctgccacatccgccgtcggccaacttgtaa

SEQ ID NO: 2788 - protein, 322 aa, Sorghum bicolor
  misc_feature: Ceres ANNOT ID no. 6026133
  misc_feature (154)..(308): Pfam Id: NUDIX Pfam Desc: NUDIX domain
  misc_feature (5)..(321): NCBI GI: 5734637 NCBI Desc: mutt/nudix protein-like [oryza sativa (japonica cultivar-group)]
  misc_feature (47)..(321): NCBI GI: 115466168 NCBI Desc: os06g0129700 [oryza sativa (japonica cultivar-group)]
  misc_feature (10)..(315): NCBI GI: 110622992 NCBI Desc: adp-sugar diphosphatase [solanum tuberosum]
  misc_feature (18)..(314): NCBI GI: 68565950 NCBI Desc: nudix hydrolase 14, mitochondrial precursor (atnudt14)
  misc_feature (146)..(315): NCBI GI: 140058026 NCBI Desc: nudix hydrolase [medicago truncatula]
MALPAASARAQCLLRFRGRSPLPRLPLPLPSPPATTRAASRRRGVRMASSDASAAAPPSATVEVPGAAAPVLVVGAPGLPEADFRNAVESSLFKQWLRNLQSEKGVLTYGRLSLTRVLIQGVDTFGKRVGFLKFKADIVDEETKTKVPGIVFARGPAVAVLILLESKGETYAVLTEQVRVPVGKFLLELPAGMLDDEKGDFVGTAVREVEEETGIKLNIEDMVDLTALLDPATGGRMLPSPGGCDEEIGLFLYRGRVDEETIRSLQGKETGLRDHGELIKLRVVPYSQLWRSTGDAKALSAIALYEMAKREGLLPHPPSANL

SEQ ID NO: 2789 - DNA, 2100 bp, Sorghum bicolor
  misc_feature: Ceres ANNOT ID no. 6026136
  misc_feature: Encodes the peptide sequence at SEQ ID NO 2790
atggttaacttcgggaagaaattgatggcagatcaaattccagaatggaaaggatattatatcaattacaagttgatgaagaagaaagttaaacagtatggccagcagctccagcagggtgagaaagatcgtcgtcgggttctgaaggatttctcgaagatgcttgatgatcagatagagaagattgtcctgtttctgttggaacaacaaggaatgttggcaagcaggattgagaagttaggaaagcaaagggcaatactacaagagcagccagatatatctggcattgctgagttacgagaagcttatagggaagttggtatcgacctcatcaaacttctcaagtttgttgatcttaatgcaactggcattcggaaaattttgaagaagtttgataagcgtttcggctatagatttactgattactatgtgacaagtagatcaaatcacccgtactctcagctgcaacaggtctttaagcatgtgggtgtaggagctgttgtaggagctttgtcacgtaaccttgctgaactccaagaacgtcaaggaagctacttatctatttatgatcagccatcttctgctcttaaggaccccatcattgatatgataaattcctcagttgataagttgacaaggtcaactaattttcttcgctttttggggcaacatgccatgattgcggatgaggagtctcctagcactgcaggagaggaagaaatagaagatcagaaataccatttcatgtctcttatgctgaacctggtgaacacattcctttacatggtcaacacatacatcattgtgccaactgcagatgactattcagtgagccttggggcagcttctactgtttgtggtgtggtcattggttcaatggctgttgcgcaaattttttcttctgtttacttcagtgcatggtccaacaagtcatatttcaaaccacttgttttcagtagcattgttttgttcttggggaatgtatgctatgcaatggcatatgatatgaagtccctgacagtccttattatcggccgtttactctgtgggatgggttctgcaagagctgtcaatcgtcgatacattagtgattgtgtccctgcaagaatacgcatgcaagcttcggcaggatttgttagcgcaagtgcccttggcatggcctgtgggccagcgctagctggtttacttcagtggaaattcaagatctacatggttactttcaatcaatcgactctacctggttgggtgatggcagttgcatggctattgtatttggtttggctatgggtctcattcaaagaaccaaaccgtgccaccgaggtggatgaagcctcccagaatcctgcttctggacaaacagttgatattggacgactagagaatggacttgcacagcctctgctcacggattctgtagataaacaaaatgaagatgaagatgaagaagttgatgatagtgaagaagctgcagatgattctcgcaaacctgcaacatcaattggctcagcataccgattacttaccccgtcagtaaaggtccagttgttgatatacttcatgcttaaatatgcaatggagattttgctttcagagtcaagtgttgtcaccaatcactatttcagttggaatacaagcgcagtggcaatttttctagcaatccttgggttgacagtccttcctgttaatgctcttgttggaacatacatcagcaatatgtttgaggacaggcaactcctcatggtatctcaaattacgttgctagtaggcattattttcagcttcaaagttacgagtacatactctgttgtccagtatgttgtctcagcacttgtcacatttgtttctgccgaagttcttgaaggcgtgaacctttccctcctatcaagcgtgatgtcgtcccgcctctcccgtggcacatacaatggtggtctcctctcgacggaggctgggaccctggcgagggtggtcgccgactgcaccatcactgcagcggggtacctaggcgtggggatgctcctcaatgtcaccctgctaccatccctggtgatatgtgttgcgtccattgcctgcaccttcctgacgtataactcgcttttctga

SEQ ID NO: 2790 - protein, 699 aa, Sorghum bicolor
  misc_feature: Ceres ANNOT ID no. 6026136
  misc_feature (2)..(148): Pfam Id: SPX Pfam Desc: SPX domain
  misc_feature (250)..(651): Pfam Id: MFS_1 Pfam Desc: Major Facilitator Superfamily
  misc_feature (253)..(699): Pfam Id: Sugar_tr Pfam Desc: Sugar (and other) transporter
  misc_feature (19)..(694): NCBI GI: 115466164 NCBI Desc: os06g0129400 [oryza sativa (japonica cultivar-group)]
  misc_feature (1)..(699): NCBI GI: 115460022 NCBI Desc: os04g0573000 [oryza sativa (japonica cultivar-group)]
  misc_feature (1)..(699): NCBI GI: 116309924 NCBI Desc: osigba0147h17.5 [oryza sativa (indica cultivar-group)]
  misc_feature (1)..(699): NCBI GI: 50253121 NCBI Desc: spx (syg1/pho81/xpr1) domain-containing protein-like [oryza sativa (japonica cultivar-group)]
  misc_feature (1)..(699): NCBI GI: 144924240 NCBI Desc: spx, n-terminal; major facilitator superfamily mfs_1 [medicago truncatula]
MVNFGKKLMADQIPEWKGYYINYKLMKKKVKQYGQQLQQGEKDRRRVLKDFSKMLDDQIEKIVLFLLEQQGMLASRIEKLGKQRAILQEQPDISGIAELREAYREVGIDLIKLLKFVDLNATGIRKILKKFDKRFGYRFTDYYVTSRSNHPYSQLQQVFKHVGVGAVVGALSRNLAELQERQGSYLSIYDQPSSALKDPIIDMINSSVDKLTRSTNFLRFLGQHAMIADEESPSTAGEEEIEDQKYHFMSLMLNLVNTFLYMVNTYIIVPTADDYSVSLGAASTVCGVVIGSMAVAQIFSSVYFSAWSNKSYFKPLVFSSIVLFLGNVCYAMAYDMKSLTVLIIGRLLCGMGSARAVNRRYISDCVPARIRMQASAGFVSASALGMACGPALAGLLQWKFKIYMVTFNQSTLPGWVMAVAWLLYLVWLWVSFKEPNRATEVDEASQNPASGQTVDIGRLENGLAQPLLTDSVDKQNEDEDEEVDDSEEAADDSRKPATSIGSAYRLLTPSVKVQLLIYFMLKYAMEILLSESSVVTNHYFSWNTSAVAIFLAILGLTVLPVNALVGTYISNMFEDRQLLMVSQITLLVGIIFSFKVTSTYSVVQYVVSALVTFVSAEVLEGVNLSLLSSVMSSRLSRGTYNGGLLSTEAGTLARVVADCTITAAGYLGVGMLLNVTLLPSLVICVASIACTFLTYNSLF

SEQ ID NO: 2791 - DNA, 441 bp, Sorghum bicolor
  misc_feature: Ceres ANNOT ID no. 6026147
  misc_feature: Encodes the peptide sequence at SEQ ID NO 2792
atgctgtccctgtcgagggcgctagggaggcggctcttctcatccgccgccgccgccgcttcagagtccgccgccgccgcgtcgacgtctgcggtgaggaaggcgcagaacccgctcgaggagttcttcgaggtcgagcggagcaccgaggaggacaagccccctccccactacggtcgcagttggaaggcttctgaattgcgcttaaaatcttgggatgatcttcagaagctgtggtatgttctcctaaaggaaaagaacatgctaatgacacagcgtcagatgctgcactcagagaacatgcggtttccaaatccagagcgaatttccaaggtaaaaaaatcaatgtgccggataaaacatgtcttgactgagagggctatagccgagcctgatccaaggagatcttcggaaatgaagcggatgataaacgccctgtga

SEQ ID NO: 2792 - protein, 146 aa, Sorghum bicolor
  misc_feature: Ceres ANNOT ID no. 6026147
  misc_feature (39)..(126): Pfam Id: MRP-L47 Pfam Desc: Mitochondrial 39-S ribosomal protein L47 (MRP-L47)
  misc_feature (1)..(146): NCBI GI: 52075615 NCBI Desc: ribosomal protein l29 protein-like [oryza sativa (japonica cultivar-group)]
  misc_feature (4)..(146): NCBI GI: 19548071 NCBI Desc: at1g07830/f24b9_7 [arabidopsis thaliana]
  misc_feature (60)..(146): NCBI GI: 8439885 NCBI Desc: contains similarity to a mitochondrial ribosomal protein from saccharomyces cerevisiae gbz30582. ests gbt13847 and gbai995906 come from this gene. [arabidopsis thaliana]
  misc_feature (10)..(126): NCBI GI: 116132807 NCBI Desc: ensangp00000013554 [anopheles gambiae str. pest]
  misc_feature (29)..(126): NCBI GI: 45549079 NCBI Desc: cg9378-pa, isoform a [drosophila melanogaster]
MLSLSRALGRRLFSSAAAAASESAAAASTSAVRKAQNPLEEFFEVERSTEEDKPPPHYGRSWKASELRLKSWDDLQKLWYVLLKEKNMLMTQRQMLHSENMRFPNPERISKVKKSMCRIKHVLTERAIAEPDPRRSSEMKRMINAL

SEQ ID NO: 2793 - DNA, 2130 bp, Sorghum bicolor
  misc_feature: Ceres ANNOT ID no. 6026148
  misc_feature: Encodes the peptide sequence at SEQ ID NO 2794
atggcagcgagccacagccacggcgcggggacgctcaagtccaccgccatcaacggggtcaagctctactcgctcaccggcagccgctacgtcgccccctgggtagtcgccaagaagaagcgcgccctccgtaaggacaaagagtatcagcggaggttggatttgatccatgacctgaggttcgagaccgccaccactaagatcaagctgacgcccgatgaccagtacgtgatcgcctcaggtatttaccccccgcaagttaaagtctatgagttgaaggagttgtcgatgaagttcgagcggcacttgatctcagaaattgtaactttccagatccttggtgatgactattcaaaacttgcgtttttgtgtgctgatcgttctgtaaatttgcacgccaagtatggaagccattatagcttgagaattccaagaatgggaagggacatggcctacgattgttggtcctgcgacttgctatgtgctgcttcatcaccagatctgtacaggatcaacttagagcagggacgattccttgcttctctttcctcccaatcaccagcaataaatgcggttacgcgaagtaagatccatggacttgttgcttgtggcggtgaggatggtgcggttgagtgctttgatatgaggaaaaaaacttctgttggcagaattaatattccagctgtttcttctgaagattattatcaggaggtcacgtctttgcaatttgatgaagatcagggataccttatggcagtgggaaccagtacaggaaagatatcaatatatgatttacgcatgtcttctcctctgcgagttaaggatcacatgtatggtagcccaatattgaatatcaagtggcaccagacacttaattctactgaacctaaactgatcactgctgataagcacatagtgagagtctgggatcctaatacaggaaataacatgactagcattgaaccagatggtggtgctataaacgatgtctgcatcttccggaatagtggtttaatgctattagctctggacaatagccagatacctgcccacttcattcctgcacttggccctgctccaaagtggtgctcacatcttgataacctaactgaggagatggaagagaaaccagatacaacactgtttgatgagtacaagttcttgactaaagaagagatggagcgactgaaccttactcaatacattggcagtagtgctgtaagagcatatttacatggatttgtcgtacgttatgaactatacaagaagcaacgggcagaagttgctcctgttgagtacgagacaattaaagaagagatcaagaaaaagaaaatagaagctcagagaaaatctcgtataacgcaagtcgtcaaaataccgaaggttaacaggcatattatggacagtataatggaagatgaaatggatcttgatgcggagaatgttgataaatcaagtattaagaagaagaaaagaaaactagaactcaataaggcgattttgcatgatgaacggttcaaaccaatgtttgaggataaggattttgaaattgatgaagaatcaaaagaatatcttgcacttcatcctcaagcagctacaaaggagcctcacctagttgaagaacattttgatagtgttagtgaggatgatcaacaatctgatggtaatgcatctgatgcttcagcggaatctgacagtgatgatggcattcataattcaaagcgtataaggttatatgaggtcaaggatgaacaccatgctgaagcatttgtgaatagtgtctctttatctaacgaggaggctgttccccttggggataggatagctgccttggaaaggaaacagaactcgaaagcacttgatgcggtcaagtatgggcctggtggctcacgggagatttcatttatctctaaaagccgaagaaggcacaaggaagaatcgtctagcgacgatgaacccaagggtgtcaaaaagagaggtgtacagcccctgggtttgaagcagggaaaagccgagttctatatgtttggtggaaatcgtggccgagggagaggcggtggtggccgagggagaggcggtcgaggaagaggtggagggaggggtaggggcaggggcaggggcagaggatga

SEQ ID NO: 2794 - protein, 709 aa, Sorghum bicolor
  misc_feature: Ceres ANNOT ID no. 6026148
  misc_feature (503)..(532): Pfam Id: NUC153 Pfam Desc: NUC153 domain
  misc_feature (6)..(708): NCBI GI: 15230179 NCBI Desc: glycine-rich protein [arabidopsis thaliana]
  misc_feature (6)..(441): NCBI GI: 115466146 NCBI Desc: os06g0128400 [oryza sativa (japonica cultivar-group)]
  misc_feature (17)..(568): NCBI GI: 73921234 NCBI Desc: nucleolar protein 10
  misc_feature (12)..(568): NCBI GI: 119621360 NCBI Desc: nucleolar protein 10, isoform cra_c [homo sapiens]
  misc_feature (260)..(694): NCBI GI: 140041393 NCBI Desc: wd40-like; nuc153 [medicago truncatula]
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
  misc_feature: GREAT-hit functional homolog of the protein sequence given in SEQ ID NO 13577
  misc_feature: Useful for making plants with modulated biomass
  misc_feature: Useful for making plants with modulated flowering time
  misc_feature: Functional homolog of the protein sequence given in SEQ ID NO 13577
MAASHSHGAGTLKSTAINGVKLYSLTGSRYVAPWVVAKKKRALRKDKEYQRRLDLIHDLRFETATTKIKLTPDDQYVIASGIYPPQVKVYELKELSMKFERHLISEIVTFQILGDDYSKLAFLCADRSVNLHAKYGSHYSLRIPRMGRDMAYDCWSCDLLCAASSPDLYRINLEQGRFLASLSSQSPAINAVTRSKIHGLVACGGEDGAVECFDMRKKTSVGRINIPAVSSEDYYQEVTSLQFDEDQGYLMAVGTSTGKISIYDLRMSSPLRVKDHMYGSPILNIKWHQTLNSTEPKLITADKHIVRVWDPNTGNNMTSIEPDGGAINDVCIFRNSGLMLLALDNSQIPAHFIPALGPAPKWCSHLDNLTEEMEEKPDTTLFDEYKFLTKEEMERLNLTQYIGSSAVRAYLHGFVVRYELYKKQRAEVAPVEYETIKEEIKKKKIEAQRKSRITQVVKIPKVNRHIMDSIMEDEMDLDAENVDKSSIKKKKRKLELNKAILHDERFKPMFEDKDFEIDEESKEYLALHPQAATKEPHLVEEHFDSVSEDDQQSDGNASDASAESDSDDGIHNSKRIRLYEVKDEHHAEAFVNSVSLSNEEAVPLGDRIAALERKQNSKALDAVKYGPGGSREISFISKSRRRHKEESSSDDEPKGVKKRGVQPLGLKQGKAEFYMFGGNRGRGRGGGGRGRGGRGRGGGRGRGRGRGRG

SEQ ID NO: 2795 - DNA, 2322 bp, Sorghum bicolor
  misc_feature: Ceres ANNOT ID no. 6026159
  misc_feature: Encodes the peptide sequence at SEQ ID NO 2796
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in root tissues in response to methyl jasmonate treatment
atggcgtcgtccatccaccaactagaggagcacggcgacgaggagggagaggacgacgaccgccatggcagccagatcacctctccgctgctgcaaccgtcgccgcgtcgccggcatggctcaccggaggaagaggagcgtgaggcgggggacgacgacgacgacgacgactcctcgccgatcgagcaggtggcgctgacggtgccggttggggacgacccggcgacgccggtgctgacgttccggatgtggatgctgggcacagcgtcctgcgccggactttccttcctcaacgctttcttcgggtatcgcaaggagccgctcaccatcaccgccgtctcggcgcagatcgccgtgcttccgttgggccgcctcatggcggcagcactgccggagggcgccttcttccggggccggccgtgggcgttcaccctcaatccggggccattcaacatgaaggagcatgtcctgatcaccatcttcgccaacgccggcgctggcgcagtgttcggcatgaatctcgtgacctctgtacgcgtcttctacggccagcacatgtccttcttcgtcgccctcctcctcatcctcaccagccaggtgctggggtttggttgggcgggaatattccggcggtatctggtggagccggcggcgatgtggtggccctccaacctcgtgcaggtctccctcttcagggcacttcatgagaaggagcgaaggagaaaaggtagaatgacacgcaaccagttctttctggtggcattcatctgcagttttgcctactacatcttcccaggctatctgttccagatgcttacctccctgtcctggatctgttgggtatttcccatctccgtgattgcccaacagcttggctcaggcctccatggtcttggcattggtgcaattggactcgactggtcatccatctcctcctaccttggaagcccccttgctagcccctggtttgccacagccaacattgcagctggcttcttcatagtcatgtacataatcacaccgatcaactactggtttaatgtttacaaggcacgcaacttccccatctactcagatggtctctacacagagtctggacaaaagtacaacgtctccagcattatggactcccaattctattttgatacagatgcctatgagaagaatggaccattatacatcagcacattcttcgcttccagctatggccttggttttgcatgccttaccgcaacggtttcccacgttctccttttccatggaagtgaaatctgtcagttaagcaaatcagctttcgaggataagaagatggatatacatacaaagcttatgaggagatacaggcaggtccctgagtggtggttcatatgcatccttgtggccagtgttgcagtcaccatgcttacctgtgagtactacattgagcaactgcagttaccttggtggggagtactgcttgcatgtgcccttgccattttctacacccttccgattggaattatcaaagcaacaactaaccaggctccaggcttgaatatcatcacagagtacatcatggggtacctatatcctggacgacccattgccaacatgtgcttcaaagtatatggctacgttggcccacgtcaagcactagaatttttgcaagactttaagttgggacactacatgaagattcccccaaggaccatgttcatggctcaggtcgtgggcactttgattgcgggttctgtataccttggaacgacatggtggctcatggacacaatacctaatgtgtgcaacagggagtttctcccagcagacagcccttggacatgcccttatgatcatttgttttatgatgcatcagtattatggggccttattggcccacgcagaatatttggtgatttaggcacttactctgctgtgaactggttcttcctaggcggcgccattgctcccttccttgtctggtgtacacagaaagcattcccggctcagaaatggatccgacatgtcaatgtgcctgtattgattggtgcaaccagcttgatgccgcctggcactgcagtcaactataccacatggatactcattgcatttttgtcaggttacgtggtctataggtaccgacgtaattggtgggagcgacacaattacctgctctcaggtgcccttgacgctggtttggcattcatggctgtattgctatatctatgcctgggactggagaacaaaagtttgaactggtggggcaatgatttggatggatgccctcttgcttcatgccccactgcaaagggcataactgtggatggatgcccagcacataattga

SEQ ID NO: 2796 - protein, 773 aa, Sorghum bicolor
  misc_feature: Ceres ANNOT ID no. 6026159
  misc_feature (78)..(736): Pfam Id: OPT Pfam Desc: OPT oligopeptide transporter protein
  misc_feature (43)..(770): NCBI GI: 9759190 NCBI Desc: isp4 protein [arabidopsis thaliana]
  misc_feature (51)..(770): NCBI GI: 9759191 NCBI Desc: isp4 protein [arabidopsis thaliana]
  misc_feature (44)..(770): NCBI GI: 92895885 NCBI Desc: oligopeptide transporter opt superfamily [medicago truncatula]
  misc_feature (51)..(772): NCBI GI: 144922933 NCBI Desc: peptidase aspartic, active site; oligopeptide transporter opt superfamily [medicago truncatula]
  misc_feature (53)..(770): NCBI GI: 15218331 NCBI Desc: oligopeptide transporter opt family protein [arabidopsis thaliana]
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in root tissues in response to methyl jasmonate treatment
MASSIHQLEEHGDEEGEDDDRHGSQITSPLLQPSPRRRHGSPEEEEREAGDDDDDDDSSPIEQVALTVPVGDDPATPVLTFRMWMLGTASCAGLSFLNAFFGYRKEPLTITAVSAQIAVLPLGRLMAAALPEGAFFRGRPWAFTLNPGPFNMKEHVLITIFANAGAGAVFGMNLVTSVRVFYGQHMSFFVALLLILTSQVLGFGWAGIFRRYLVEPAAMWWPSNLVQVSLFRALHEKERRRKGRMTRNQFFLVAFICSFAYYIFPGYLFQMLTSLSWICWVFPISVIAQQLGSGLHGLGIGAIGLDWSSISSYLGSPLASPWFATANIAAGFFIVMYIITPINYWFNVYKARNFPIYSDGLYTESGQKYNVSSIMDSQFYFDTDAYEKNGPLYISTFFASSYGLGFACLTATVSHVLLFHGSEICQLSKSAFEDKKMDIHTKLMRRYRQVPEWWFICILVASVAVTMLTCEYYIEQLQLPWWGVLLACALAIFYTLPIGIIKATTNQAPGLNIITEYIMGYLYPGRPIANMCFKVYGYVGPRQALEFLQDFKLGHYMKIPPRTMFMAQVVGTLIAGSVYLGTTWWLMDTIPNVCNREFLPADSPWTCPYDHLFYDASVLWGLIGPRRIFGDLGTYSAVNWFFLGGAIAPFLVWCTQKAFPAQKWIRHVNVPVLIGATSLMPPGTAVNYTTWILIAFLSGYVVYRYRRNWWERHNYLLSGALDAGLAFMAVLLYLCLGLENKSLNWWGNDLDGCPLASCPTAKGITVDGCPAHN

SEQ ID NO: 2797 - DNA, 873 bp, Sorghum bicolor
  misc_feature: Ceres ANNOT ID no. 6026160
  misc_feature: Encodes the peptide sequence at SEQ ID NO 2798
atggccgacgcgtactggaggtacgctgccgccgacccgcgccagcagcagcagcagcagccgcagccgccctccgccggcgggggcatcgggcaccccggcatgggcggcggcgcaccgcagatggcccccgccgtggggcagcagcagcagcagcagcccatgaagcgaccccgccccgccgacttctcagatgtacccggtgcacctgacatgactggctattatccacgtgatgaagaaagggcaggatatcgtcctgctagagatactgaggctcttaacgcgtcctacgaacgttttctgcgtactgggcaaattcaatcctttggtggtggacctgctggagaacctattaggcctgctgttggtggcaatgctggctacccagttgatgaccgttcgatgatggctgctaggggtatggatagcagaaatattggtttcggtggtggaatgccagagccaccccttccacctgatgcctcaaacaccttatatattgaaggcattccaactggctgtacacgtcgagaagtttcacgtatccttagatatatatatcttttccgtcactctctttttctaaacatctatttgcataaactgcgatcaaacatcttccgaccatttgttggctttcgtgaggttaggcttgtaaacaaagaaccgaaacatcctggtggtgaccctattgtcctgtgttttgttgatttcgcggaacctacacaatctgctattgccatggaggctttgcaaggctataagtttgatgagcatgatcgcaattcacccaatttgcggctgcaatttgctcgatttacgggtccaagggggaattcaggacctggtggcggtcgtggtaggcgataa

SEQ ID NO: 2798 - protein, 290 aa, Sorghum bicolor
  misc_feature: Ceres ANNOT ID no. 6026160
  misc_feature (56)..(290): NCBI GI: 23304837 NCBI Desc: rna-binding protein [medicago truncatula]
  misc_feature (48)..(290): NCBI GI: 140063333 NCBI Desc: rna-binding region rnp-1 (rna recognition motif) [medicago truncatula]
  misc_feature (48)..(290): NCBI GI: 30699215 NCBI Desc: rna recognition motif (rrm)-containing protein [arabidopsis thaliana]
  misc_feature (72)..(287): NCBI GI: 42571569 NCBI Desc: rna recognition motif (rrm)-containing protein [arabidopsis thaliana]
  misc_feature (221)..(287): NCBI GI: 8920632 NCBI Desc: contains weak similarity to bab503 major core protein from simian t-cell lymphotrophic virus type 1 gbaf230486. [arabidopsis thaliana]
MADAYWRYAAADPRQQQQQQPQPPSAGGGIGHPGMGGGAPQMAPAVGQQQQQQPMKRPRPADFSDVPGAPDMTGYYPRDEERAGYRPARDTEALNASYERFLRTGQIQSFGGGPAGEPIRPAVGGNAGYPVDDRSMMAARGMDSRNIGFGGGMPEPPLPPDASNTLYIEGIPTGCTRREVSRILRYIYLFRHSLFLNIYLHKLRSNIFRPFVGFREVRLVNKEPKHPGGDPIVLCFVDFAEPTQSAIAMEALQGYKFDEHDRNSPNLRLQFARFTGPRGNSGPGGGRGRR

SEQ ID NO: 2799 - DNA, 819 bp, Sorghum bicolor
  misc_feature: Ceres ANNOT ID no. 6026180
  misc_feature: Encodes the peptide sequence at SEQ ID NO 2800
atggccaccgtggggcagtccggggccctgaggagggtcaccgtgcactacgccaactcacccacccgcagcacggtggcagaggtgagccttgacgacttcgacgacgagctgctccagtttgtcctcgccgatcttcttcctggccaggaaggtttacaccaatcgatcttggaaggagcatacagcaaccagaaccatatgagaggtgcagggccccatgccccgtatgattattcacaggcacaggaataccatggagagagcagcactgctgcagcagcaactgctaccaggaattcaggcacggatcaacagatcgcctcagacttcgagtacgccaagcagctgcagcaggagatggaggacctcagcgtcgaagacgacgatggcgacgatatcagctgcgtgccgtctccatctgactccgacgatgaccatgaccatcacgacgaagaggaagaggctgacaggcaggatggcaatggtgatgatgatgatgatgttgatccagacaacatgacttatgagcaaagacaggcacttgtagaatctgtggggactgaggacagaggtttatccgatgagctcatctcctacctgcagccatggaagtacaaggcagtcaaggcttcagggtttttctcccggaaaacaaaccatgaagactgccctatctgcttgtccactttcagaagccgtgaaaccatgataacgttgccgtgcaggcatcactaccacgcagcttgtgtcaccaaatggctcaaggtcaacaagacatgtcctgtatgcaaatatgaactgtttggacattcctag

SEQ ID NO: 2800 - protein, 272 aa, Sorghum bicolor
  misc_feature: Ceres ANNOT ID no. 6026180
  misc_feature (224)..(264): Pfam Id: zf-C3HC4 Pfam Desc: Zinc finger, C3HC4 type (RING finger)
  misc_feature (1)..(272): NCBI GI: 6983871 NCBI Desc: zinc finger protein-like [oryza sativa (japonica cultivar-group)]
  misc_feature (1)..(272): NCBI GI: 29170198 NCBI Desc: zinc finger protein [oryza sativa (indica cultivar-group)]
  misc_feature (57)..(270): NCBI GI: 115460008 NCBI Desc: os04g0571200 [oryza sativa (japonica cultivar-group)]
  misc_feature (57)..(270): NCBI GI: 116310277 NCBI Desc: osigba0111l12.9 [oryza sativa (indica cultivar-group)]
  misc_feature (162)..(269): NCBI GI: 91807030 NCBI Desc: zinc finger protein-like protein [arabidopsis thaliana]
  misc_feature: Useful for making plants with altered terpenoid content
  misc_feature: GREAT-hit functional homolog of the protein sequence given in SEQ ID NO 13012
  misc_feature: Useful for making plants with altered terpenoid content
  misc_feature: Functional homolog of the protein sequence given in SEQ ID NO 13012
  misc_feature: The sequence is a functional homolog of SEQ ID NO. 271 in the 11/188,298 US application
  misc_feature: The sequence is a functional homolog of SEQ ID NO. 329 in the 11/188,298 US application
  misc_feature: The sequence is a functional homolog of SEQ ID NO. 350 in the 11/188,298 US application
MATVGQSGALRRVTVHYANSPTRSTVAEVSLDDFDDELLQFVLADLLPGQEGLHQSILEGAYSNQNHMRGAGPHAPYDYSQAQEYHGESSTAAAATATRNSGTDQQIASDFEYAKQLQQEMEDLSVEDDDGDDISCVPSPSDSDDDHDHHDEEEEADRQDGNGDDDDDVDPDNMTYEQRQALVESVGTEDRGLSDELISYLQPWKYKAVKASGFFSRKTNHEDCPICLSTFRSRETMITLPCRHHYHAACVTKWLKVNKTCPVCKYELFGHS

SEQ ID NO: 2801 - DNA, 2358 bp, Sorghum bicolor
  misc_feature: Ceres ANNOT ID no. 6026183
  misc_feature: Encodes the peptide sequence at SEQ ID NO 2802
atggcatcctctcctcctcctcctcctctccaggaagaggaacaggaacagggacgggaagaggagcaccgccatggcgccggcggcggtgacgatgaccagatcaccaccccgctcctcctggtggaagcgacgacatcgacgtcgcgcagctcgccggcgggcgacgagcactactccgacgacttgtcgtcgtcggagggagagaactcgccgatcgagcaggtggcgctgacggtgccggtgggggacgacccgacgacgccggtgctgacgttccggatgtgggtgctgggcacggcgtcgtgcgcgctgctgtcgttcctgaaccagttcttctggtaccgcaaggagccgctgaccatcacggccatctcggcgcagatcgcggtggtgccgctgggccgcctcatggcggcggcgctgccggagcgcgccttcctccggggcacgcgctgggagttctcactcaacccggggcccttcaacgtgaaggagcacgtgctcatcaccatcttcgccaactccggcgccggcaccgtctacgccatccacgtcatcaccgccgtccgcgtcttctacggcaagaacatcaccttcttcgtctccctcctcgtcgtcctcaccacccaggtgctggggtttggttgggcgggaatattccggcggtatctggtggagccggcggcgatgtggtggccctccaacctcgtgcaggtctccctcttcagggcgctccacgagagagaacggcgggtcaaaggcggcatgactcgcaaccagttcttcctggtggcattcatctgcagcttcgcctactacatcttcccgggctacctgttccagatgctcacttccctgtcctggatctgctgggtcttcccgcactccgtgctcgcccagcagctcgggtcaggcctgaccggactaggcattggagcgatcggtctcgactggtccaccatctcctcctaccttgggagcccccttgccagcccctggtttgccaccgcgaatgtcgctgctgggttcttcatcatcatgtatgtgatcacgcccattgcttactggttcaacttctacaaggcgcaaaacttccccatcttttccgatggcctcttcaccttgaccgggcagacgtacaacatctcgagcatcgtggactctcacttccaatttgatacggaggcgtacgagaagaatggtccgctatacctcagcactttctttgctgtcacctatggtgtcggtttcgcatcccttaccgcgacaattgttcatgttttcctcttccatggaagtgaaattttgcagttaagtaaatcagctttccaagaaaaaaaggtggacatacatacaaaacttatgaggagatataagcaggtcccggagtggtggttcatctgcatcctcattgctaacattgctgtcaccatatttgcctgtgaatactatattgagcaactccagctgccttggtggggtgttctgcttgcatgtgccattgcgtttaccttcaccctcccaattggaataatcacagcaacaacgaaccagactccaggcttgaacatcatcacagagtacatcatggggtacttataccctggacggccagtggcaaatatgtgcttcaaggtgtatggttacatcagcatgagtcaagctctgacctttcttcaagattttaagctgggccactacatgaagattcccccaaggaccatgtttatggctcaggtggtgggaactttgattgcagcatttgtataccttggaacagcatggtggttgatggacacagtccctaacatctgcaacaccgagctcctcccatcagacagcccttggacctgccctggggatcatgtgttctatgatgcatcagttatctggggtcttattagcccacgcagaatatttggcgacctaggcacttactcggcggtgaactggttcttcttgggtggagctgttgcccccctcctagtatggcttgcacacaaggcattcccaagccagagctggatcttactcatcaacatgcccgtgatgatcggtgccaccggcatgatgccacctgctactgcagtcaactacaccacatggatacttgttgggtttttgtcaggttatgtggtttacagatatcggcgtgactggtgggagcgacacaattatctgctttccggtgcactagatgctggtttggcattcatggctgtcctgatttacttatgcctaggcttggagaacatcagtttgaactggtggggcaatgatttggacggatgtcctctctcttcttgtccaactgccaaaggtattgttgtcgagggctgcccagtgtatacatga

SEQ ID NO: 2802 - protein, 785 aa, Sorghum bicolor
  misc_feature: Ceres ANNOT ID no. 6026183
  misc_feature (90)..(748): Pfam Id: OPT Pfam Desc: OPT oligopeptide transporter protein
  misc_feature (67)..(783): NCBI GI: 9759190 NCBI Desc: isp4 protein [arabidopsis thaliana]
  misc_feature (59)..(784): NCBI GI: 9759191 NCBI Desc: isp4 protein [arabidopsis thaliana]
  misc_feature (67)..(784): NCBI GI: 92895885 NCBI Desc: oligopeptide transporter opt superfamily [medicago truncatula]
  misc_feature (67)..(784): NCBI GI: 144922933 NCBI Desc: peptidase aspartic, active site; oligopeptide transporter opt superfamily [medicago truncatula]
  misc_feature (66)..(783): NCBI GI: 21592665 NCBI Desc: isp4-like protein [arabidopsis thaliana]
MASSPPPPPLQEEEQEQGREEEHRHGAGGGDDDQITTPLLLVEATTSTSRSSPAGDEHYSDDLSSSEGENSPIEQVALTVPVGDDPTTPVLTFRMWVLGTASCALLSFLNQFFWYRKEPLTITAISAQIAVVPLGRLMAAALPERAFLRGTRWEFSLNPGPFNVKEHVLITIFANSGAGTVYAIHVITAVRVFYGKNITFFVSLLVVLTTQVLGFGWAGIFRRYLVEPAAMWWPSNLVQVSLFRALHERERRVKGGMTRNQFFLVAFICSFAYYIFPGYLFQMLTSLSWICWVFPHSVLAQQLGSGLTGLGIGAIGLDWSTISSYLGSPLASPWFATANVAAGFFIIMYVITPIAYWFNFYKAQNFPIFSDGLFTLTGQTYNISSIVDSHFQFDTEAYEKNGPLYLSTFFAVTYGVGFASLTATIVHVFLFHGSEILQLSKSAFQEKKVDIHTKLMRRYKQVPEWWFICILIANIAVTIFACEYYIEQLQLPWWGVLLACAIAFTFTLPIGIITATTNQTPGLNIITEYIMGYLYPGRPVANMCFKVYGYISMSQALTFLQDFKLGHYMKIPPRTMFMAQVVGTLIAAFVYLGTAWWLMDTVPNICNTELLPSDSPWTCPGDHVFYDASVIWGLISPRRIFGDLGTYSAVNWFFLGGAVAPLLVWLAHKAFPSQSWILLINMPVMIGATGMMPPATAVNYTTWILVGFLSGYVVYRYRRDWWERHNYLLSGALDAGLAFMAVLIYLCLGLENISLNWWGNDLDGCPLSSCPTAKGIVVEGCPVYT

SEQ ID NO: 2803 - DNA, 924 bp, Sorghum bicolor
  misc_feature: Ceres ANNOT ID no. 6026202
  misc_feature: Encodes the peptide sequence at SEQ ID NO 2804
atggtgaggcccgcgctggcgtgctgcaagctctacatctccgaggcccgcaacgcgggggcgctgcgcgccatcgaacacgcggcggcggcgctccgcccggcggccgccctcgtcaacgccttcgccgacgacgcctacaaccgggtcgggtacacgctcgtgtccccactcgcgggcgacggcaccggcgaggcaccgccgctgcaccgcgcggcgttccgcgtggtcgcggccgcgctcgaggccgtcgacttgggcgcgcacgccggcgcgcacccgcgcctcggtgtcgtcgaccacgttgccttccaccctctcgccggcgctcgcctcgaggacgtcgccgcgctcaccagggccgtcgcggcggacatcggagaaaatcttcaagtgtctacgtatctctacggcgcagctcacaaagacggcaggacgctggcgtccatcaggaggcagctgggctacttcacgccgacctcccccggcggcgaccaatggtgcggcgcgccggacgcgccgctgccggtggcccccgacgccgggccggtgacgccgtccaggtccaagggcgtggtggtggtgggcgcgacggcgtgggtggacaactacaacgtgcccgtgcgcacggccgacgtcggcgcggcgaggcgcatcgcgcgcgccgtcagcgagcgcggcggcgggctcgcgtccgtgcaggccatggggctcgcgcacggcgacggcgccgccgaggtcgcatgcaacctgctcgacccggccgcggtgggcgcggaccaggtgcaggagagggtgcgccggctcgccgccgcgatgggaatcggcgtcggcgaggggtacttcaccgacttgtcgcaggagaaggtcgtcgagctgtacttgcagcaggcggctcaagcggaggctgcttctcggcagtga

SEQ ID NO: 2804 - protein, 307 aa, Sorghum bicolor
  misc_feature: Ceres ANNOT ID no. 6026202
  misc_feature (5)..(199): Pfam Id: FTCD_N Pfam Desc: Formiminotransferase domain, N-terminal subdomain
  misc_feature (116)..(302): NCBI GI: 24413963 NCBI Desc: formiminotransferase-cyclodeaminase-like [oryza sativa (japonica cultivar-group)]
  misc_feature (1)..(293): NCBI GI: 116227452 NCBI Desc: glutamate formiminotransferase [solibacter usitatus ellin6076]
  misc_feature (14)..(296): NCBI GI: 113939467 NCBI Desc: formiminotransferase-like [herpetosiphon aurantiacus atcc 23779]
  misc_feature (9)..(275): NCBI GI: 94969157 NCBI Desc: formiminotransferase-like [acidobacteria bacterium ellin345]
  misc_feature (9)..(277): NCBI GI: 34396477 NCBI Desc: formiminotransferase-cyclodeaminase-related protein [porphyromonas gingivalis w83]
MVRPALACCKLYISEARNAGALRAIEHAAAALRPAAALVNAFADDAYNRVGYTLVSPLAGDGTGEAPPLHRAAFRVVAAALEAVDLGAHAGAHPRLGVVDHVAFHPLAGARLEDVAALTRAVAADIGENLQVSTYLYGAAHKDGRTLASIRRQLGYFTPTSPGGDQWCGAPDAPLPVAPDAGPVTPSRSKGVVVVGATAWVDNYNVPVRTADVGAARRIARAVSERGGGLASVQAMGLAHGDGAAEVACNLLDPAAVGADQVQERVRRLAAAMGIGVGEGYFTDLSQEKVVELYLQQAAQAEAASRQ

SEQ ID NO: 2805 - DNA, 1149 bp, Sorghum bicolor
  misc_feature: Ceres ANNOT ID no. 6026208
  misc_feature: Encodes the peptide sequence at SEQ ID NO 2806
atgctgagctcggcgtcctcggcgggggcggctatggggatgggcggcgggtacccgcaccagcccccgccgctgccgctgccgcagcgaggttcggcggccgcggtcttcaccgccgcgcagtgggccgagctggagcagcaggcgctcatctacaagtacctcatggccggcgtccccgtcccgcccgatctcctcctccccgtccgccccggcccccactccgccgccgccgctttctccttcgccggccccgccgcctcgcccttctaccaccaccaccaccacccgtccctgagttactacgcctactacgggaagaagctggacccggagccgtggcggtgccgccgcactgacggcaagaagtggcggtgctccaaggaggcgcaccctgactccaagtactgcgagcgccacatgcaccgtggccgcaaccgttcaagaaagcctgtggaatccaagaccgcctcgcctgcgcacccgtcgcagccccagctgtccaccgtcaccaccaccacccgggaggctgctgccgccgcgcctcttgagtcccttgctgcggctgggggtaaggctcatggcctgtccctcggtggcggggctggctcatcgcatctcaatgtcgacgcttcgaatgctcattatcgctatggcagcaagtaccctattggagctaaatccgatgctagcgagctgagcttcttctcaggagcatcaggaaactcgaggggcttcaccattgattctccatcagataactcatggcactccctgccatccaatgtgcccccgtttacattatctaagggcagagattctggcctcctgcctggtgcctactcctactcccacattgagccgccgcaggagcttggccaggtcaccatcgcctcgctgtcccaagagcaggagcgccagccgttcagcagcggtggtgctggggccggggctggtgggctgctcgggaacgtgaagcaggagaaccagccgctgaggcccttcttcgacgagtggcccgggacaagggactcatggtcggagatggacgacgcgaggtccaacaggacctccttctcgaccacccagctctccatctccatcccgatgcccagatgtgagtttcctactgatccagttccaccttaa

SEQ ID NO: 2806 - protein, 382 aa, Sorghum bicolor
  misc_feature: Ceres ANNOT ID no. 6026208
  misc_feature (110)..(155): Pfam Id: WRC Pfam Desc: WRC
  misc_feature (35)..(71): Pfam Id: QLQ Pfam Desc: QLQ
  misc_feature (165)..(382): NCBI GI: 46367642 NCBI Desc: transcription activator grf3 [oryza sativa (japonica cultivar-group)]
  misc_feature (37)..(279): NCBI GI: 51039835 NCBI Desc: tpa: growth-regulating factor 3 [oryza sativa (japonica cultivar-group)]
  misc_feature (37)..(377): NCBI GI: 38345778 NCBI Desc: osjnba0083n12.16 [oryza sativa (japonica cultivar-group)]
  misc_feature (37)..(377): NCBI GI: 115460326 NCBI Desc: os04g0600900 [oryza sativa (japonica cultivar-group)]
  misc_feature (37)..(377): NCBI GI: 116310919 NCBI Desc: b0403h10-osigba0105a11.9 [oryza sativa (indica cultivar-group)]
  misc_feature: The sequence is a functional homolog of SEQ ID NO 1781 in the 10/374,780US patent application
  misc_feature: Useful for making plants with modulated growth and phenotype characteristics
  misc_feature: Useful for making plants with modulated nitrogen use efficiency
  misc_feature: GREAT-hit functional homolog of the protein sequence given in SEQ ID NO 13351
  misc_feature: The sequence is a functional homolog of SEQ ID NO 1781 in the 20060162006 US patent application
MLSSASSAGAAMGMGGGYPHQPPPLPLPQRGSAAAVFTAAQWAELEQQALIYKYLMAGVPVPPDLLLPVRPGPHSAAAAFSFAGPAASPFYHHHHHPSLSYYAYYGKKLDPEPWRCRRTDGKKWRCSKEAHPDSKYCERHMHRGRNRSRKPVESKTASPAHPSQPQLSTVTTTTREAAAAAPLESLAAAGGKAHGLSLGGGAGSSHLNVDASNAHYRYGSKYPIGAKSDASELSFFSGASGNSRGFTIDSPSDNSWHSLPSNVPPFTLSKGRDSGLLPGAYSYSHIEPPQELGQVTIASLSQEQERQPFSSGGAGAGAGGLLGNVKQENQPLRPFFDEWPGTRDSWSEMDDARSNRTSFSTTQLSISIPMPRCEFPTDPVPP

SEQ ID NO: 2807 - DNA, 1179 bp, Sorghum bicolor
  misc_feature: Ceres ANNOT ID no. 6026216
  misc_feature: Encodes the peptide sequence at SEQ ID NO 2808
atggcgtccaccgcgctggtggcagtggcagtggggggcggcctctgtcccggtctcgtcgcctcctgcagcgtcgcatcctgctccctgcgcgccggcggcggtgactccccacggcttggccgccgcctcgtcctcctgcagagaggaggaggcgccgagggagagaggaagaggatacggaattgcccaatatttcgttgtgccaatgaggtggatgtcgtgaccgaggatgacaatgtggatggtgatgctaccgacgatgaagaagaccttgaggctgcagctgatgacgctattgatgctgacgttgatactgaagatgaactggattcttcgctgcctgaggatgttgagtggataaagcagcagccacttccttatcctttggatgccctggagccatacataagcaaggagacggtggggcagcactggggagttcatcagcagattcacgtggaccggctcaatggcatgatcggtggtagcgagtgggaaggcatgtcgctggggcagatgatgctcgcctcgttcaatgagggcagagagcagccccatcctcccttcttccatgctgcacaggtatggaaccatgatttctattggcgatccatgaaacctggcggtgggggcaagccaccggaacggcttctgaagtttattaatagagactttggctcctatgagggtatgatccgccaattcatggatgctgcattaactcagtttggttctggatgggtttggctttcctacaaaggaagcggtttgccttatgtgaaatcaagaagcccaatcgcatcggacaattatggtaggctggtcatctcaaagactccaaatgccatcaaccctcttgtctggggccactctccactccttgggattgatgtttgggagcatgcatactacctggattatgaggatcgaagggctgattatgtttctgcaattctagagaatcttgtgtcgtgggaaatagtcgagtcaaggctcacgaaagccgttgtacgggcagtagaaagagatgaggatctccgcagaagaattcaaaggaagcagcatttatctcaggcgaatgggcagagtagagctaggcctcgcactcggcaaggcagaccgacagggtggcaaggagaccaagaagtcgccaggagcagccctgtggaggcatga

SEQ ID NO: 2808 - protein, 392 aa, Sorghum bicolor
  misc_feature: Ceres ANNOT ID no. 6026216
  misc_feature (212)..(333): Pfam Id: Sod_Fe_C Pfam Desc: Iron/manganese superoxide dismutases, C-terminal domain
  misc_feature (124)..(207): Pfam Id: Sod_Fe_N Pfam Desc: Iron/manganese superoxide dismutases, alpha-hairpin domain
  misc_feature (206)..(373): NCBI GI: 55295899 NCBI Desc: fe-superoxide dismutase precursor-like [oryza sativa (japonica cultivar-group)]
  misc_feature (124)..(355): NCBI GI: 46402892 NCBI Desc: fe-superoxide dismutase 1 precursor [lotus corniculatus var. japonicus]
  misc_feature (124)..(368): NCBI GI: 16974682 NCBI Desc: fe-superoxide dismutase precursor [medicago sativa]
  misc_feature (118)..(362): NCBI GI: 3719455 NCBI Desc: iron superoxide dismutase [zantedeschia aethiopica]
  misc_feature (124)..(336): NCBI GI: 6840824 NCBI Desc: iron-superoxide dismutase precursor [vigna unguiculata]
  misc_feature (124)..(336): SWISSPROT Homolog: EC 1.15.1.1 Superoxide dismutase [Fe], chloroplast precursor
  misc_feature: Useful for making plants with modulated high pH sensitivity
  misc_feature: Useful for making plants with modulated seed number
  misc_feature: GREAT-hit functional homolog of the protein sequence given in SEQ ID NO 13429
  misc_feature: Useful for making plants with modulated high pH sensitivity
  misc_feature: Useful for making plants with modulated seed number
  misc_feature: Functional homolog of the protein sequence given in SEQ ID NO 13429
MASTALVAVAVGGGLCPGLVASCSVASCSLRAGGGDSPRLGRRLVLLQRGGGAEGERKRIRNCPIFRCANEVDVVTEDDNVDGDATDDEEDLEAAADDAIDADVDTEDELDSSLPEDVEWIKQQPLPYPLDALEPYISKETVGQHWGVHQQIHVDRLNGMIGGSEWEGMSLGQMMLASFNEGREQPHPPFFHAAQVWNHDFYWRSMKPGGGGKPPERLLKFINRDFGSYEGMIRQFMDAALTQFGSGWVWLSYKGSGLPYVKSRSPIASDNYGRLVISKTPNAINPLVWGHSPLLGIDVWEHAYYLDYEDRRADYVSAILENLVSWEIVESRLTKAVVRAVERDEDLRRRIQRKQHLSQANGQSRARPRTRQGRPTGWQGDQEVARSSPVEA

SEQ ID NO: 2809 - DNA, 276 bp, Sorghum bicolor
  misc_feature: Ceres ANNOT ID no. 6026217
  misc_feature: Encodes the peptide sequence at SEQ ID NO 2810
atgggtctgcaggaggagtttgaggagcacgccgagaaggccaagaccttgcctgacacgacgacgaacgagaacaagctcatcctctacgggctctacaagcaggccaccgtcagcgatgtcaacaccgggcgtcctggcattttcagtctgaaagagagagccaaatgggatgcttggaaggccgttgaagggaaatccaaggatgaagcaatgaccgactacatcaccaaagtgaaacagctgctggaggaggccgcagcatccacttcctag

SEQ ID NO: 2810 - protein, 91 aa, Sorghum bicolor
  misc_feature: Ceres ANNOT ID no. 6026217
  misc_feature (3)..(87): Pfam Id: ACBP Pfam Desc: Acyl CoA binding protein
  misc_feature (1)..(87): NCBI GI: 19352190 NCBI Desc: acyl-coa-binding protein [panax ginseng]
  misc_feature (1)..(90): NCBI GI: 32454286 NCBI Desc: acyl-coa-binding protein [tropaeolum majus]
  misc_feature (1)..(91): NCBI GI: 6002102 NCBI Desc: acyl-coa binding protein (acbp) [digitalis lanata]
  misc_feature (1)..(89): NCBI GI: 1938236 NCBI Desc: acyl-coa-binding protein [ricinus communis]
  misc_feature (1)..(91): NCBI GI: 91992436 NCBI Desc: acyl-coa-binding protein [jatropha curcas]
MGLQEEFEEHAEKAKTLPDTTTNENKLILYGLYKQATVSDVNTGRPGIFSLKERAKWDAWKAVEGKSKDEAMTDYITKVKQLLEEAAASTS

SEQ ID NO: 2811 - DNA, 1230 bp, Sorghum bicolor
  misc_feature: Ceres ANNOT ID no. 6026266
  misc_feature: Encodes the peptide sequence at SEQ ID NO 2812
atgggaactggtgtgagtctgccatcatgcaaagccctatcacaattcacaatttctggcacctctgcctccacagaaacagcccctgctacatgtgggattcaagggtgggctgatctccctggaggcccactccagtctattgttgccctcctgggctccttcactgacctccttgccttcagaagcacctgccgttcttggcgtgctgccttctcatcatacccatccaaatccaggttctgtgccttgctcccacctctcctcgtcaggcccaatatccccgtgcgtgcacctgatggcaacgagctgcgcagatggcaggtcattgatctagccaatccaaaaacggatctttgctgccagattcctcaagaaatatgcaaggctatgcactttgccggctcctcttatggtcagctgatatgcggccttcgcaaagattgcctcattgtcgatgtgttcactggtgccagagtttgggcaccaccgctcccacttaacgaggacacttttttctactctggcatgctgaccgctcctcttgcactacaagactcgcacctccttgtctgtgtagtatccagccagcacagtgttccggcctcccttcttgactggtcagttggaagtgattgttggtcggaaatacagctcggtaattcactgatcgagcagattgtggagttcaatggccagttcatcgcgatggacagctactacaggctctacactctatccttgggcccccagcttggtctgcaggagatgacaactgtgtggtgggacgacaatgacatgcatggatgcccattccgaaggccatggcttgtggtatgcagtggcatgcttctaattgtggactactacttgagtgtcacatcatctggagcacctgtcaactacaaagcctaccacctggatatgtccactgaacctgcaacttgggtggaggtggtgaagctggagaatgatgccatttttattgggggtgatgtgaggagcccgccgatctcttgcatgagcccaggacgatggggcgggagaagcaactgcctgtactatgctcattacagacaaccctgggtcttgcatgggctgggtgatgatgtagatgctgtttgggatgattccactgaccctggccttgggttcaagagggactggtacatccagcttcagccattctgggtgtacccgagcatgttctactcagatggacaacagtga

SEQ ID NO: 2812 - protein, 409 aa, Sorghum bicolor
  misc_feature: Ceres ANNOT ID no. 6026266
  misc_feature (21)..(408): NCBI GI: 115465968 NCBI Desc: os06g0111200 [oryza sativa (japonica cultivar-group)]
  misc_feature (45)..(407): NCBI GI: 115465996 NCBI Desc: os06g0113500 [oryza sativa (japonica cultivar-group)]
  misc_feature (131)..(407): NCBI GI: 55295887 NCBI Desc: selenium-binding protein-like [oryza sativa (japonica cultivar-group)]
  misc_feature (23)..(408): NCBI GI: 55295888 NCBI Desc: selenium-binding protein-like [oryza sativa (japonica cultivar-group)]
  misc_feature (107)..(401): NCBI GI: 55295904 NCBI Desc: selenium-binding protein-like [oryza sativa (japonica cultivar-group)]
MGTGVSLPSCKALSQFTISGTSASTETAPATCGIQGWADLPGGPLQSIVALLGSFTDLLAFRSTCRSWRAAFSSYPSKSRFCALLPPLLVRPNIPVRAPDGNELRRWQVIDLANPKTDLCCQIPQEICKAMHFAGSSYGQLICGLRKDCLIVDVFTGARVWAPPLPLNEDTFFYSGMLTAPLALQDSHLLVCVVSSQHSVPASLLDWSVGSDCWSEIQLGNSLIEQIVEFNGQFIAMDSYYRLYTLSLGPQLGLQEMTTVWWDDNDMHGCPFRRPWLVVCSGMLLIVDYYLSVTSSGAPVNYKAYHLDMSTEPATWVEVVKLENDAIFIGGDVRSPPISCMSPGRWGGRSNCLYYAHYRQPWVLHGLGDDVDAVWDDSTDPGLGFKRDWYIQLQPFWVYPSMFYSDGQQ

SEQ ID NO: 2813 - DNA, 1197 bp, Sorghum bicolor
  misc_feature: Ceres ANNOT ID no. 6026268
  misc_feature: Encodes the peptide sequence at SEQ ID NO 2814
atgcaaggccctagcaaaatgatctgtgcctctgcctccagtatgccccctgctgtgtatggacttgaagggtgggcagatctcccagaaggtctgctccattctatcattcctctgttgagctccttccttgagctccacgcttttgctggcacctgccgctcttggcgtgctgctttcgcctcatacccatctaaatccacattctgcaccttgctcccacctctcctcatcctgccccatatcaaagtctctgctcctaatcttccttctagaagcgatgatggtcacgagctccgcacgtgccaggtccttgatccatccaacttgaaaagtacccttcgctgccagattcctgaagagacatttcagaagttgcactttgccggctcttcctatgggcagctgatttgtggccgcggcagaaattgtgttatcgtggatgtgttcactggtgccaaagttttacctccacaactcccatttggcgacaacacttatttctactctggcatgctgacagctcctgtcgcatcaccaaactcacacctcctactttgcgcatcatcgaaacagggaggtcagtgcttcctgcttgattggctgattggaagtgattcttggtcaaaacttcagctcgatgattcacggattgagcagattgtggagttcaatggccagttcatcgcgatggactactactacaagctctacaatctgtccttggcccctcagcttggtctacagaagatagcaactgtgtggtgggatggcaatgatgaatgctgcccatatctaaggccatggatcgtggtgtgtggtgacatgctcctgatggttgaccattgcataaccctttcgttagctggagcacctgtcgagtacaaagcctatcgccttgacatgtcaactgtgcctgcagcttgggtggaggtgaagaagctagagaattactcgctttttattgggtgtgatgtgaggagccctgcattttcttgcgccagcttaggacgatggagcgggaggagcaactgcttgtactacgggtattatgatccacccttggtgttgcatgggcttggagatgatgcggatgctgtgtggaatccagacaacgatgattaccttgagttcaagaggaactggtacacccaactgcaggttttctgggtgtacccaagtttgctctatcgctga

SEQ ID NO: 2814 - protein, 398 aa, Sorghum bicolor
  misc_feature: Ceres ANNOT ID no. 6026268
  misc_feature (1)..(397): NCBI GI: 115465968 NCBI Desc: os06g0111200 [oryza sativa (japonica cultivar-group)]
  misc_feature (30)..(397): NCBI GI: 115465996 NCBI Desc: os06g0113500 [oryza sativa (japonica cultivar-group)]
  misc_feature (128)..(397): NCBI GI: 55295887 NCBI Desc: selenium-binding protein-like [oryza sativa (japonica cultivar-group)]
  misc_feature (4)..(397): NCBI GI: 55295888 NCBI Desc: selenium-binding protein-like [oryza sativa (japonica cultivar-group)]
  misc_feature (103)..(396): NCBI GI: 55295904 NCBI Desc: selenium-binding protein-like [oryza sativa (japonica cultivar-group)]
MQGPSKMICASASSMPPAVYGLEGWADLPEGLLHSIIPLLSSFLELHAFAGTCRSWRAAFASYPSKSTFCTLLPPLLILPHIKVSAPNLPSRSDDGHELRTCQVLDPSNLKSTLRCQIPEETFQKLHFAGSSYGQLICGRGRNCVIVDVFTGAKVLPPQLPFGDNTYFYSGMLTAPVASPNSHLLLCASSKQGGQCFLLDWLIGSDSWSKLQLDDSRIEQIVEFNGQFIAMDYYYKLYNLSLAPQLGLQKIATVWWDGNDECCPYLRPWIVVCGDMLLMVDHCITLSLAGAPVEYKAYRLDMSTVPAAWVEVKKLENYSLFIGCDVRSPAFSCASLGRWSGRSNCLYYGYYDPPLVLHGLGDDADAVWNPDNDDYLEFKRNWYTQLQVFWVYPSLLYR

SEQ ID NO: 2815 - DNA, 2640 bp, Sorghum bicolor
  misc_feature: Ceres ANNOT ID no. 6026271
  misc_feature: Encodes the peptide sequence at SEQ ID NO 2816
atggcgggcgcggcggcggcgggccggggcgactgggaggacctggtgcgccggatgttcccgccggggaccaccatcccggaggcgccgcccaacctggactactccatcgcgctggagtacgacgggccggacgtctcgtacgagctcccgcggatcgaccccgtctgtctccccgccatacccaccgccgagccggtctcggggcccctggggctcggcctcggcagcggcggcgtcgtgcctgtcgcgcccgtcatcggccctgctgcggcccgtgcccgtgacaacccgccggcagcgtcccgggctggttccgctgctgctcaccgtgcaccgcaggcgcagccggctgcgcgcgcgaggagggaaagctcgccgtcgggtggttcggcggcgcgggatgaggatggctgctccgatgacgatgaggaggaggacggcggctcccgcccgccgcggagttctaggcctgctgcgctggagggaaggcgggctcaggtggtcacctttggggagccggaggatagcaggtacgagagcaacgatttcgacgcggcgtccgccgaccaacagtacgtcgcggtgacgaggccggctgtggagaggaaggggaagaggacttgctgccaccgatgcgggaagagcaaatgggagagcaaggagtcctgcatcgtctgtgacgcgcgctactgtggccactgcctgctccgcgccatggggtccatgcctgagggccgcaagtgcgtcacctgcattggccagcccatcgacgaggccaagcgctccaagctcgggaagggctccagggtactggcgcgcctgctcagccccctggaggtcaggcagatcctcagggtcgagaaggagtgccaggcgaaccagctcaggcctgagcagctcgtggtcaatggtttccctcttcatgacgaggagatggcggatttgcttagctgccaacggcctcctgggaatctcaagcctggaagatattggtatgataaggaatcaggattgtggggaaaggaaggtgaaaaaccagacaggattattagcactaacctcaactttaacggaaagcttcagcctgatgctagtaacggcaacgctcaggttttcattaacggacgggaaattacaaagattgaactgagaattctaaagattgcaaaagtccaatgcccccgtgatactcacttttgggtttaccatgatggcggctatgaggaagaaggacagaacaatatcaaagggaaaatatgggagtcacctttgacacgttttgcgtgcgccttggtttcactaccagtgcctcctacacactttgatgcgacaaaagatgacgtcccttattcatcaagaactgtacctgactacttagatcataaaagaatacaaaagcttcttattcttggatcacctggagctggaacaagcaccatatttaagcaggctaagttgttatacggcaatagatttactgaggaggaacttgagaatatcaaattaatgatccagagcaacatgttcaagtacctggggattctgctcgagggccgtgagcgctttgaagaagaggctttggctgtatcaaatcacccaggctcagagggcgatgattctcagcaagatgagagtaaatcttcaagttccagtccttgcatctactcgataaatgcaaagctgaagaagttttctgattggcttctggacatcattgcaatgggagacctagatgcattctttcctgcagctacccgtgaatatgctccagttgttgatgagctgtggaaagatcctgccattcaagcaacatataaaagaaaggatgaattgcattttctccctgatgccgctgagtatttcttgagcagggctattgaagtatcaagtaatgaatacgaaccatcagagaaagatgtaatatatgctgaaggagtaacacaagggaatggattggcctttattgatttcactttggatgaccggagccctatgtcagaacccttcggtgacaatcacgatgcatactctcaaccagtaaacaaataccagctgattcgagtaagcgccaagggcatgaacgagggctgcaagtgggtggaaatgtttgaggatgttagcatggtgatcttctctgtagcgctcagtgactatgaccagcttggagccccagcgagcggcagtagcaggacactcacgaataagatgattcaaagcagggacttgtttgaagcaacaatcagacagccgtgcttccgcgacacgccattcgtgctggtgctgaacaagtacgacctgttcgaggagaagatcggccggtcgccactgtcgtcgtgcgagtggttcggtgacttctgcccgctgcggacgaaccacaacaaccagtcgctggcgcagcaggcgttctactacgtggccatgaggttcaaggacctgtacgcggcgagcacggggaggaagctgtttgtgtggcaggcgcgcgcccgtgaccgccccaccgtcgacgaggccttccgctacatccgggaggtgctccggtgggaggacgagcgcgacgcggccggctactgccccgaggagtccttctatagcaccaccgagctcagctcgtcccgcctcatcgtcgccgcagagtga

SEQ ID NO: 2816 - protein, 879 aa, Sorghum bicolor
  misc_feature: Ceres ANNOT ID no. 6026271
  misc_feature (452)..(856): Pfam Id: G-alpha Pfam Desc: G-protein alpha subunit
  misc_feature (81)..(877): NCBI GI: 115484635 NCBI Desc: os11g0206700 [oryza sativa (japonica cultivar-group)]
  misc_feature (162)..(872): NCBI GI: 3201682 NCBI Desc: extra-large g-protein [arabidopsis thaliana]
  misc_feature (88)..(865): NCBI GI: 77556370 NCBI Desc: extra-large g-protein [oryza sativa (japonica cultivar-group)]
  misc_feature (259)..(865): NCBI GI: 115489376 NCBI Desc: os12g0593000 [oryza sativa (japonica cultivar-group)]
  misc_feature (33)..(537): NCBI GI: 7270389 NCBI Desc: extra-large g-protein-like [arabidopsis thaliana]
  misc_feature: The sequence is a functional homolog of SEQ ID NO. 522 in the 11/188,298 US application
MAGAAAAGRGDWEDLVRRMFPPGTTIPEAPPNLDYSIALEYDGPDVSYELPRIDPVCLPAIPTAEPVSGPLGLGLGSGGVVPVAPVIGPAAARARDNPPAASRAGSAAAHRAPQAQPAARARRESSPSGGSAARDEDGCSDDDEEEDGGSRPPRSSRPAALEGRRAQVVTFGEPEDSRYESNDFDAASADQQYVAVTRPAVERKGKRTCCHRCGKSKWESKESCIVCDARYCGHCLLRAMGSMPEGRKCVTCIGQPIDEAKRSKLGKGSRVLARLLSPLEVRQILRVEKECQANQLRPEQLVVNGFPLHDEEMADLLSCQRPPGNLKPGRYWYDKESGLWGKEGEKPDRIISTNLNFNGKLQPDASNGNAQVFINGREITKIELRILKIAKVQCPRDTHFWVYHDGGYEEEGQNNIKGKIWESPLTRFACALVSLPVPPTHFDATKDDVPYSSRTVPDYLDHKRIQKLLILGSPGAGTSTIFKQAKLLYGNRFTEEELENIKLMIQSNMFKYLGILLEGRERFEEEALAVSNHPGSEGDDSQQDESKSSSSSPCIYSINAKLKKFSDWLLDIIAMGDLDAFFPAATREYAPVVDELWKDPAIQATYKRKDELHFLPDAAEYFLSRAIEVSSNEYEPSEKDVIYAEGVTQGNGLAFIDFTLDDRSPMSEPFGDNHDAYSQPVNKYQLIRVSAKGMNEGCKWVEMFEDVSMVIFSVALSDYDQLGAPASGSSRTLTNKMIQSRDLFEATIRQPCFRDTPFVLVLNKYDLFEEKIGRSPLSSCEWFGDFCPLRTNHNNQSLAQQAFYYVAMRFKDLYAASTGRKLFVWQARARDRPTVDEAFRYIREVLRWEDERDAAGYCPEESFYSTTELSSSRLIVAAE

SEQ ID NO: 2817 - DNA, 2853 bp, Sorghum bicolor
  misc_feature: Ceres ANNOT ID no. 6026277
  misc_feature: Encodes the peptide sequence at SEQ ID NO 2818
atgggcgtgtcaaggccgccaagcacccctgcatcaaagggtgagcacacaccgatgtcgactcctggtggtagctcaagggccaaggaggagaagatttttgttacagtgagggtgaggccactaagcaagaaggagctggctgtgaaggatgatgtggcatgggaatgcgctgatagccagacaatcttgtacaagggccccacgcaggaccgagctgcaccgacatcttacacttttgataaagtgtttggacctgctagccaaacagacgtggtctatgaagagggagctaaggatgttgcaatgtctgcattgacaggcattaatgccaccatttttgcatatgggcaaaccagcagtggtaaaacattcacgatgagaggcgttacagagagtgctgtttgtgatatttatagacacatagataatactcctgagagggaatttgtgataaaaatatctgctatggaaatttacaatgagattgtgaaggatcttctacgacctgactctgctccccttcggttgttagatgatcctgagaaaggaaccattgtggagaagttgcaagaagagattgctaaggacagccaacatctgaggcatctaatcagcatttgtgaagaacaaagacaggttggggagactgcactaaatgacactagttcacgttcccaccaaatcattaggctgactcttgagagcaggctccgtgaagtttcaggatgtgttaaatctttcgttgctaacctgaactttgttgaccttgctggaagtgaacgagctgcacaaacacatgccataggtgcaaggctgaaagaaggttgtcatataaatcgcagcttgttgactttgactactgtcatcagaaagctaagttcaggaaaaagaagtgggcacataccctacagggactcaaagctgacacgcattttacagctttctttgggtggaaatgcaagaacagcaatcatctgtactatgagcccagccctgacacatgtagaacaatctagaaatactctattctttgcaacctgcgcaaaggaggtcacaaatactgcaaaagttaatatggttatatcagataagcaattggtgaaacaccttcagacagaacttgctagactagaatcagagctgaggacccctgaccgtgctgcctcttctgatatcctcataatggaaaaggacaggaagattagagagatggaaattgaaatagaggaactcaggaaacagcgagataatgcacagtcagagcttgaagaactgcggaagaagaagagtgatcaccagccagggtggaatccctttgattcgccacaaaaagcacgcaagtgccttacattttcaggatcactagagccaagtaacaaaatcaagatgatgaggagctcgattaggcaatcatctactgctccatttatgttgaagcatgaaatccgcaagctggagcagctacaacagcagcttgaggttgaagcaaaccgcgccatcgaagtacttcacaaagaagttgaatgccacaagcatggcaaccaggatgctgcggaaaccatcgctaaacttcaggcagaaatcagggagatgcaatctgttaggtctgagaacagagacgtggagatgattacagatgaaggaaatggatctgatttgaaagatgagatttctagacttcatatgcaagacaatgatattgccaaacttgaggcgaagttagaaaatgtgcaacggtctattgacagattggtgatgtcacttccaaatgttgccatgccgtgtaatgagactaccccaaagtcaaacagatcaaagaagaagaagaggctccttcttcctctgggtgtgagcaacaacatcaacagagcaaatcttctcagagcaccttgctctcctcattcttccagtaggccttcagaatcagaagttgagaacagggccccagagggtgacactatgtctgttgagggttcagaaaaggctacccccaccaagagtgaagatggagatatatcatctcgtgacgaaacaccacgctacaggcgctccagttcagtcaatatgaaaaagatgcagaggatgttccaaaatgctgcagaggaaaacgtgaggagcatccgggcctacgtgactgaactgaaggagcgagttgcaaaacttcagtaccaaaagcagctgctagtctgccaggtcctcgagttggaatctaatgaaggcaagtcgaatggagaggataattctgggcctgtacaggatggtcctgattcatgggacagattattcaaggagcagatgcagtgcattattcatctgtgggatcagtgtcatgtatcgatcatacacaggacccagttctacctgttattcaggggtgacagggctgatcagatatacatagaagtcgaagtaagaagactggtatggctgcaacaacactttgctgaggtcggtgacgcaagccctggcgctgttgatgaccctgcagtttcacttatctccagtatgaaggcattgaggaacgagcgagaatttctcgcgagaaggatggggtcaaggctgacggacgaagagcgggagcgcctcttcatcaagtggcaggtgcccctggacgcgaagcagcggaagctgcagctggtgaacaagctctggacggatcccaacgacccggcgcacattgaggagagcgcggacctggtggctcggctggtgggcttctgcgagggtggcaacatcagcaaggagatgttcgagctcaactttaccgtccccacgagcaagaagccgtggatggtgggctggcaacccatctcgaacatgatcagggagaagacccagcagctctggtga

SEQ ID NO: 2818 - protein, 950 aa, Sorghum bicolor
  misc_feature: Ceres ANNOT ID no. 6026277
  misc_feature (38)..(353): Pfam Id: Kinesin Pfam Desc: Kinesin motor domain
  misc_feature (192)..(934): NCBI GI: 15208449 NCBI Desc: kinesin heavy chain [zea mays]
  misc_feature (5)..(942): NCBI GI: 19570247 NCBI Desc: kinesin-like protein nack1 [nicotiana tabacum]
  misc_feature (1)..(942): NCBI GI: 19570249 NCBI Desc: kinesin-like protein nack2 [nicotiana tabacum]
  misc_feature (6)..(942): NCBI GI: 21743232 NCBI Desc: kinesin-like protein [arabidopsis thaliana]
  misc_feature (6)..(942): NCBI GI: 7649361 NCBI Desc: kinesin-like protein [arabidopsis thaliana]
MGVSRPPSTPASKGEHTPMSTPGGSSRAKEEKIFVTVRVRPLSKKELAVKDDVAWECADSQTILYKGPTQDRAAPTSYTFDKVFGPASQTDVVYEEGAKDVAMSALTGINATIFAYGQTSSGKTFTMRGVTESAVCDIYRHIDNTPEREFVIKISAMEIYNEIVKDLLRPDSAPLRLLDDPEKGTIVEKLQEEIAKDSQHLRHLISICEEQRQVGETALNDTSSRSHQIIRLTLESRLREVSGCVKSFVANLNFVDLAGSERAAQTHAIGARLKEGCHINRSLLTLTTVIRKLSSGKRSGHIPYRDSKLTRILQLSLGGNARTAIICTMSPALTHVEQSRNTLFFATCAKEVTNTAKVNMVISDKQLVKHLQTELARLESELRTPDRAASSDILIMEKDRKIREMEIEIEELRKQRDNAQSELEELRKKKSDHQPGWNPFDSPQKARKCLTFSGSLEPSNKIKMMRSSIRQSSTAPFMLKHEIRKLEQLQQQLEVEANRAIEVLHKEVECHKHGNQDAAETIAKLQAEIREMQSVRSENRDVEMITDEGNGSDLKDEISRLHMQDNDIAKLEAKLENVQRSIDRLVMSLPNVAMPCNETTPKSNRSKKKKRLLLPLGVSNNINRANLLRAPCSPHSSSRPSESEVENRAPEGDTMSVEGSEKATPTKSEDGDISSRDETPRYRRSSSVNMKKMQRMFQNAAEENVRSIRAYVTELKERVAKLQYQKQLLVCQVLELESNEGKSNGEDNSGPVQDGPDSWDRLFKEQMQCIIHLWDQCHVSIIHRTQFYLLFRGDRADQIYIEVEVRRLVWLQQHFAEVGDASPGAVDDPAVSLISSMKALRNEREFLARRMGSRLTDEERERLFIKWQVPLDAKQRKLQLVNKLWTDPNDPAHIEESADLVARLVGFCEGGNISKEMFELNFTVPTSKKPWMVGWQPISNMIREKTQQLW

SEQ ID NO: 2819 - DNA, 876 bp, Sorghum bicolor
  misc_feature: Ceres ANNOT ID no. 6026295
  misc_feature: Encodes the peptide sequence at SEQ ID NO 2820
atggcggcgacggcggcggaggttcccgtggaggcgccggttctgcaattgcggaagcattctgacaagagactagaccatttgctattcactttgactggcaaggtgaggacagtgaaggtcaccaatgtctctcttagtgcaactgtgcaagacattaaggagttcttttccttttcaggagatattgaacatgtggagatgcagagtggtgatgagtggtctcaagttgcatatgtcacattcaaagatgcacaaggcgcagaaactgcacttcttctatcgggtgccacaatagttgatctttctgtcattattgcgcctgctccagagtatcagccaccccctacgtactctgcgccaccaatgagtggaaccagagttgcagttggtggagacaacaccgttgtccacaaggctgaggatgttgtcagctctatgcttgccaagggtttcgtgctaggcaaagacgctgttggcaaggccaaagcgttcgatgagaagcacggcttcacttccacggccggtgctaaggtagcctccattgacaagaagattgggctgagtgataagatcaccacgggcacatccttggtcactgggaaggtgaaggagatggaccagaagttccaggtctctgacaagaccaagtcagcattcgccgccgccgagcagaaggtgagcagcgccgggtctgccatcatgaagaacagatacgtcttcaccggcgcgtcgtgggtcactggcgcattcaacaaggtcgccaaggctgccacggacgtcgggacgatgaccaaggagaagatggcagctgaggagcagcagaagggctctggcccttcctctgggggccactcgtacacgcccatccgatga

SEQ ID NO: 2820 - protein, 291 aa, Sorghum bicolor
  misc_feature: Ceres ANNOT ID no. 6026295
  misc_feature (28)..(291): NCBI GI: 115465990 NCBI Desc: os06g0112400 [oryza sativa (japonica cultivar-group)]
  misc_feature (36)..(275): NCBI GI: 140066585 NCBI Desc: rna-binding region rnp-1 (rna recognition motif) [medicago truncatula]
  misc_feature (32)..(290): NCBI GI: 145334499 NCBI Desc: rna recognition motif (rrm)-containing protein [arabidopsis thaliana]
  misc_feature (38)..(276): NCBI GI: 89257671 NCBI Desc: rna recognition motif (rrm)-containing protein [brassica oleracea]
  misc_feature (36)..(290): NCBI GI: 145334501 NCBI Desc: rna recognition motif (rrm)-containing protein [arabidopsis thaliana]
  misc_feature: The plant is abnormally small.
  misc_feature: Useful for making plants with altered Lignin content
  misc_feature: Useful for making plants with altered alkaloid content
  misc_feature: Useful for making plants with modulated biomass
  misc_feature: GREAT-hit functional homolog of the protein sequence given in SEQ ID NO 13029
  misc_feature: GREAT-hit functional homolog of the protein sequence given in SEQ ID NO 13052
  misc_feature: Functional homolog of the protein sequence given in SEQ ID NO 13116
  misc_feature: Functional homolog of the protein sequence given in SEQ ID NO 13167
  misc_feature: Useful for making plants with altered lignin content
  misc_feature: Functional homolog of the protein sequence given in SEQ ID NO 13052
  misc_feature: Useful for making plants with altered alkaloid content
  misc_feature: Functional homolog of the protein sequence given in SEQ ID NO 13167
  misc_feature: Useful for making plants with modulated biomass
  misc_feature: Functional homolog of the protein sequence given in SEQ ID NO 13029
MAATAAEVPVEAPVLQLRKHSDKRLDHLLFTLTGKVRTVKVTNVSLSATVQDIKEFFSFSGDIEHVEMQSGDEWSQVAYVTFKDAQGAETALLLSGATIVDLSVIIAPAPEYQPPPTYSAPPMSGTRVAVGGDNTVVHKAEDVVSSMLAKGFVLGKDAVGKAKAFDEKHGFTSTAGAKVASIDKKIGLSDKITTGTSLVTGKVKEMDQKFQVSDKTKSAFAAAEQKVSSAGSAIMKNRYVFTGASWVTGAFNKVAKAATDVGTMTKEKMAAEEQQKGSGPSSGGHSYTPIR

SEQ ID NO: 2821 - DNA, 441 bp, Sorghum bicolor
  misc_feature: Ceres ANNOT ID no. 6026299
  misc_feature: Encodes the peptide sequence at SEQ ID NO 2822
atgcaggcggtgaaggagaaggtgaaggacgcgatgagcacggcgaaggcgaaggcgagggagcaggaggcgaaggcggaggagaaggccggcaaggcgacggcgagctcgagcgccgagaaagagctggtgcaccagcgcgccaaggccaaggtcgccgccgccaagatggacctccaccaggagaaggccatccacaaggaggaggccatcgcgcagaagctccaccatggtcgtcgccaccaccagcaccactacggcggctacggcgccggtcccggcgtcgtcggaccagcagcgacgacgactgctgctactactgctgtcccgccggcaccagcagccaccacggcggccgccgtaccgccgccgccaacgacgacggctgctggaccgctgcatcaccaccacgctccggcggccaaccgacactactactag

SEQ ID NO: 2822 - protein, 146 aa, Sorghum bicolor
  misc_feature: Ceres ANNOT ID no. 6026299
  misc_feature (1)..(73): Pfam Id: LEA_1 Pfam Desc: Late embryogenesis abundant (LEA) group 1
  misc_feature (1)..(144): NCBI GI: 82394666 NCBI Desc: seed maturation protein [glycine tomentella]
  misc_feature (1)..(144): NCBI GI: 82394634 NCBI Desc: seed maturation protein [glycine canescens]
  misc_feature (1)..(144): NCBI GI: 82394632 NCBI Desc: seed maturation protein [glycine canescens]
  misc_feature (1)..(144): NCBI GI: 82394672 NCBI Desc: seed maturation protein [glycine tomentella]
  misc_feature (1)..(144): NCBI GI: 82394646 NCBI Desc: seed maturation protein [glycine tabacina]
MQAVKEKVKDAMSTAKAKAREQEAKAEEKAGKATASSSAEKELVHQRAKAKVAAAKMDLHQEKAIHKEEAIAQKLHHGRRHHQHHYGGYGAGPGVVGPAATTTAATTAVPPAPAATTAAAVPPPPTTTAAGPLHHHHAPAANRHYY

SEQ ID NO: 2823 - DNA, 765 bp, Sorghum bicolor
  misc_feature: Ceres ANNOT ID no. 6026303
  misc_feature: Encodes the peptide sequence at SEQ ID NO 2824
atggcagatgcgatcaagagtcaagttgggtcgtttcctcctgggaaaaagataacggttgtgtttgtactaggtggcccaggcagtggcaagggcactcagtgttccaacattgtcaaacagtttggcttcacccatctgagtgctggcgaccttctgcgtgaagaagctaaatctgatactgaacaaggtacgatggtaaagaacctgatgcatgaaggaaaacttgtgccgtctgagctgatcatcaagcttctgctgaaggccatgcttcagagtggaaatgataagttccttgttgatggatttcctcggaacgaagagaaccgccaagcatatgagagtgttattggtattgagcctgagttcattctgttcatcgactgcccaaaggaagagttggagcggcgcattctacaccggaatcagggaagagatgacgacaacattgacactattaggaagcggtttgaagttttccaggagtcaactctacctgttgttcagtactatgagaaaagggggaagcttcgaaagatcgatggcgccaaatcccctgatgcagtttttgaagatgtgaaggctatattctctcaactgaacactactcaggaaaaccaaggtagcagtatgagcagcagagtacagagcaatccactgaagcggttcctggacctgctctgtgtgcagctagttgatcagatggtttgttcgcaccaagtacgagttgacctgttttacctattttgtcctgttcttgtatag

SEQ ID NO: 2824 - protein, 254 aa, Sorghum bicolor
  misc_feature: Ceres ANNOT ID no. 6026303
  misc_feature (23)..(176): Pfam Id: ADK Pfam Desc: Adenylate kinase
  misc_feature (15)..(198): NCBI GI: 30690243 NCBI Desc: uridylate kinase / uridine monophosphate kinase / ump kinase (pyr6) [arabidopsis thaliana]
  misc_feature (15)..(198): NCBI GI: 2497486 NCBI Desc: uridylate kinase (uk) (uridine monophosphate kinase) (ump kinase) (ump/cmp kinase)
  misc_feature (13)..(198): NCBI GI: 7076771 NCBI Desc: uridylate kinase-like protein [arabidopsis thaliana]
  misc_feature (16)..(198): NCBI GI: 6683813 NCBI Desc: ump/cmp kinase b [oryza sativa]
  misc_feature (16)..(198): NCBI GI: 33146624 NCBI Desc: ump/cmp kinase a [oryza sativa (japonica cultivar-group)]
  misc_feature (20)..(201): SWISSPROT Homolog: EC 2.7.4.3 Adenylate kinase
MADAIKSQVGSFPPGKKITVVFVLGGPGSGKGTQCSNIVKQFGFTHLSAGDLLREEAKSDTEQGTMVKNLMHEGKLVPSELIIKLLLKAMLQSGNDKFLVDGFPRNEENRQAYESVIGIEPEFILFIDCPKEELERRILHRNQGRDDDNIDTIRKRFEVFQESTLPVVQYYEKRGKLRKIDGAKSPDAVFEDVKAIFSQLNTTQENQGSSMSSRVQSNPLKRFLDLLCVQLVDQMVCSHQVRVDLFYLFCPVLV

SEQ ID NO: 2825 - DNA, 2328 bp, Sorghum bicolor
  misc_feature: Ceres ANNOT ID no. 6026307
  misc_feature: Encodes the peptide sequence at SEQ ID NO 2826
atggccaagcgcccgcgccacgccggcaacggcgccggccgctcccagatgacgtccttagagtggaagctccaccgccacatactcaacggcggcctagcccgccgcggcgcctccgccgaggacgtcgccaacaccctccgcatccaccacccggacctcggccgccacaagcaaggccccttcctcgcctgcgtccgccgcgctctcgcctccattcccatcccctccccctcctccccttcctcctctgaatcctcctccgacgacgaaggctcctcggcctcccgccgccgccgccgccgccatgacgcccacgccaccacttcgtcctccacctccgtctccgacgccgccgctcactcgtcgccaccagcccccaccttcgacctcaccaaatccattatccgctccaactacgccgcgcagacgcccaagcggaaccagcagctggagatcgaggtcaccgcggagaagccgcgccgcctcatcacggccgacggcggcggcggcggtgacgccaagccggaggccgccccggctgctgctgaaggcttcggcagaggggacaaggggcccaggttcgccgacctcggcgggttggaggcggtgatcgaggagctcatgatggaggtggtcgtgcccctgtgccatccggagctgccacaccgacttggcgtcaggcctgtcgcggggctgctactgcacggaccgcccggttgcggaaagaccaccctagcccatgccattgctaatgagactggcgtgccgttctacaagatctccgcaccggaagtcgtgtctggggtgtctggagcttctgaggaaaacatcaggggcttgtttcagaaggcctatcggactgctccttcaattgtatttattgatgagatagatgcaattgcatccaagagggagaatctgcaacgagagatggaacggcgtatagttactcaattaatgacatgcatggatcaattccaccagaatattggatcaggcagtggcaatttggatgctgaatcatctgaaaaaaaacctggttatgttattgtcattggagccacaaataggcctgatgctgtggatcaagctttgcgaaggccaggaagatttgaccgagagatatctcttggtgtcccagatgagaatgcacggaaacaaatactgaagatgcttactcagcatcttcgacttgaaggcgaatttgacttgttcaagatagctagagcaacaccaggttttgttggtgctgacttgaaggcattagtggataaagcagggaatctagcaatgaagagaataattgatgaaagaagagttcaatatcgccgcgagcacgatgggaataccaatcatgactggtggagacaaccttgggatgaaagtgaggtggagggcctgcatattactatggatgactttgaggaagcaacgaaaatggttcaaccatctttgagaagagaagggttttcttctgtccctgatgtcacatgggatgatgttggaggtcttgattcattaagaaaagagtttgaccgctgcattattcgttgtatcaagcaccctgaagactatgaggtatttggagtgaatatgcaagctggcttccttctgtttggacctcctggttgcgggaaaacactaatagcaaaagcagtggcacatgaggcaggggctaattttattcacatcaaggggcctgagctattgaacaagtatgttggggagagtgaatctgaagttagaaaaatattcactcgtgcacgtactaactctccttgcatcctgttttttgatgaggttgatgctttgacaacaaaaagagggaaagagggaggatgggttgttgaacgtctcttaaatcagttactcatcgaacttgatggtgctgatcaacgacaaggtgtctatgtgataggagctacaaacaggattgatgtgatagatgatgctgttttacggcctggtagatttggaaagaaacattatgtacctttacctggtgcagacgaacgggtttcaatattaaaagcacatgctcgtagcaagcctttctcagctgatgttgatttggatgcacttgcacgtcgtgctgaatgcaacaatctcactggtgctgacctagcatcactggtcaatgaagcagccatggcagcattggaagagagattggaattccttgagaatgggacatcctcaatgagttcctcttgtttgattgagatctcgcactttgaacgtgctctatcgaagattaagccatcagtatctgaacagcaaatcaaacattacgaggcgttgtcaaagagatactcgtcgaactga

SEQ ID NO: 2826 - protein, 775 aa, Sorghum bicolor
  misc_feature: Ceres ANNOT ID no. 6026307
  misc_feature (232)..(433): Pfam Id: AAA Pfam Desc: ATPase family associated with various cellular activities(AAA)
  misc_feature (536)..(722): Pfam Id: AAA Pfam Desc: ATPase family associated with various cellular activities(AAA)
  misc_feature (536)..(667): Pfam Id: AAA_5 Pfam Desc: ATPase family associated with various cellular activities(AAA)
  misc_feature (190)..(731): NCBI GI: 44984716 NCBI Desc: afr188wp [eremothecium gossypii]
  misc_feature (190)..(731): NCBI GI: 45198706 NCBI Desc: afr188wp [eremothecium gossypii]
  misc_feature (459)..(771): NCBI GI: 146451503 NCBI Desc: ribosome biogenesis atpase rix7 [lodderomyces elongisporus nrrl yb-4239]
  misc_feature (194)..(773): NCBI GI: 21619335 NCBI Desc: nuclear vcp-like [mus musculus]
  misc_feature (459)..(775): NCBI GI: 40362746 NCBI Desc: aaa atpase [candida albicans]
  misc_feature: The sequence is a functional homolog of SEQ ID NO. 462 in the 11/188,298 US application
  misc_feature: The sequence is a functional homolog of SEQ ID NO. 471 in the 11/188,298 US application
MAKRPRHAGNGAGRSQMTSLEWKLHRHILNGGLARRGASAEDVANTLRIHHPDLGRHKQGPFLACVRRALASIPIPSPSSPSSSESSSDDEGSSASRRRRRRHDAHATTSSSTSVSDAAAHSSPPAPTFDLTKSIIRSNYAAQTPKRNQQLEIEVTAEKPRRLITADGGGGGDAKPEAAPAAAEGFGRGDKGPRFADLGGLEAVIEELMMEVVVPLCHPELPHRLGVRPVAGLLLHGPPGCGKTTLAHAIANETGVPFYKISAPEVVSGVSGASEENIRGLFQKAYRTAPSIVFIDEIDAIASKRENLQREMERRIVTQLMTCMDQFHQNIGSGSGNLDAESSEKKPGYVIVIGATNRPDAVDQALRRPGRFDREISLGVPDENARKQILKMLTQHLRLEGEFDLFKIARATPGFVGADLKALVDKAGNLAMKRIIDERRVQYRREHDGNTNHDWWRQPWDESEVEGLHITMDDFEEATKMVQPSLRREGFSSVPDVTWDDVGGLDSLRKEFDRCIIRCIKHPEDYEVFGVNMQAGFLLFGPPGCGKTLIAKAVAHEAGANFIHIKGPELLNKYVGESESEVRKIFTRARTNSPCILFFDEVDALTTKRGKEGGWVVERLLNQLLIELDGADQRQGVYVIGATNRIDVIDDAVLRPGRFGKKHYVPLPGADERVSILKAHARSKPFSADVDLDALARRAECNNLTGADLASLVNEAAMAALEERLEFLENGTSSMSSSCLIEISHFERALSKIKPSVSEQQIKHYEALSKRYSSN

SEQ ID NO: 2827 - DNA, 771 bp, Sorghum bicolor
  misc_feature: Ceres ANNOT ID no. 6026327
  misc_feature: Encodes the peptide sequence at SEQ ID NO 2828
atgatgactgcctcttgctacgtctgccgatccgtcgtccgtgctcctccgctcaagtccaggactgcagtgcgctgccaaagcgccgcgccgccaggtgccacctccacctccaagcttgtcctagaggtgaaagaacggctagcgagggagcacccaggcctccccactggcaggaacgggagagacgatgacgacatggtcctctggttcttgaaggaccgcaaattctctgtcgatgaagccgtccccaagctcaccaaggcgattaaatggcgtcaggagtttggtgtttcagaattatcagaagaatcagtgaaaggcctctaccaaactggcaaggcatatgtacatgattctttggacgtttatggccgacctgtgctggttgtagtggcagccaaacattttccttcgacacaggatccagttgaaaaccagaagctctgtgcctatttggttgagaaggcagtaagcagacttccctcaggagcagagaatatacttgggatctttgatctgagaggctttcgtgttgaaaatggtgatctccagttcctaaagtttttgattgatgttttttactattactacccgaagcggcttggccaagttctttttgtcgatgctccatttgtttttcagccaatgtggcaggttgttaaacctctgttgaaatcatatgcctccctggtaaggttttgcgacgcggagactgtgagaaaggaatacttcaaagaagaaactgtgcctcctgatttctgcaattag

SEQ ID NO: 2828 - protein, 256 aa, Sorghum bicolor
  misc_feature: Ceres ANNOT ID no. 6026327
  misc_feature (103)..(249): Pfam Id: CRAL_TRIO Pfam Desc: CRAL/TRIO domain
  misc_feature (43)..(101): Pfam Id: CRAL_TRIO_N Pfam Desc: CRAL/TRIO, N-terminus
  misc_feature (2)..(256): NCBI GI: 50252681 NCBI Desc: sec14 cytosolic factor-like [oryza sativa (japonica cultivar-group)]
  misc_feature (39)..(254): NCBI GI: 79546079 NCBI Desc: transporter [arabidopsis thaliana]
  misc_feature (63)..(254): NCBI GI: 2739046 NCBI Desc: polyphosphoinositide binding protein ssh2p [glycine max]
  misc_feature (60)..(225): NCBI GI: 20805228 NCBI Desc: sec14 like protein [oryza sativa (japonica cultivar-group)]
  misc_feature (64)..(225): NCBI GI: 92871092 NCBI Desc: cellular retinaldehyde binding/alpha-tocopherol transport; cellular retinaldehyde-binding/triple function, n-terminal [medicago truncatula]
MMTASCYVCRSVVRAPPLKSRTAVRCQSAAPPGATSTSKLVLEVKERLAREHPGLPTGRNGRDDDDMVLWFLKDRKFSVDEAVPKLTKAIKWRQEFGVSELSEESVKGLYQTGKAYVHDSLDVYGRPVLVVVAAKHFPSTQDPVENQKLCAYLVEKAVSRLPSGAENILGIFDLRGFRVENGDLQFLKFLIDVFYYYYPKRLGQVLFVDAPFVFQPMWQVVKPLLKSYASLVRFCDAETVRKEYFKEETVPPDFCN

SEQ ID NO: 2829 - DNA, 693 bp, Sorghum bicolor
  misc_feature: Ceres ANNOT ID no. 6026337
  misc_feature: Encodes the peptide sequence at SEQ ID NO 2830
atgacgacggcggcgcgccccacctgggcgccggccaagggcggcaacgagcaggggggcacccgcattttcggcccctcccagaagtactcctcccgcgacctcgccgcgcacacctccctcaagcccagaaaagacggacaacagacccaagaggagttacagaagaggaacctcagggaggaacttgaggaacgtgagcgcaagcactactcttccaaggataagtcatatgctgaagaaagagaccgacggaaaagttcaagccagctactcttagaagggtcaaagagagaggcggaggataagatagttccacgagaaattgatgcagatgattccgatgtggagcctaaaagtgatgacgaaagtgatgacgatgacgatgatgatgacactgaagctctaatggcagagcttgagaggattaagaaagaaagagctgaggagaagcttagaaaggagcggcaacaagcagaagaggaggccaagatgaaggaggctgagctgatgcggggaaaccctttgatcaatatcaacaatcctagctccttcagtgttaagagaaggtgggacgatgatgtggtattcaagaaccaggcacgtggagagaccaagacaccgaaacggttcatcaacgacacgatcagaagcgatttccaccgcaaatttttgcagaggtacatgaagtga

SEQ ID NO: 2830 - protein, 230 aa, Sorghum bicolor
  misc_feature: Ceres ANNOT ID no. 6026337
  misc_feature (1)..(230): Pfam Id: Cwf_Cwc_15 Pfam Desc: Cwf15/Cwc15 cell cycle control protein
  misc_feature (1)..(230): NCBI GI: 92872088 NCBI Desc: cwf15/cwc15 cell cycle control protein [medicago truncatula]
  misc_feature (1)..(230): NCBI GI: 46329463 NCBI Desc: mgc81091 protein [xenopus laevis]
  misc_feature (1)..(230): NCBI GI: 49522089 NCBI Desc: mgc81909 protein [xenopus laevis]
  misc_feature (1)..(230): NCBI GI: 6841518 NCBI Desc: hspc148 [homo sapiens]
  misc_feature (1)..(230): NCBI GI: 48094717 NCBI Desc: similar to ensangp00000016945 [apis mellifera]
MTTAARPTWAPAKGGNEQGGTRIFGPSQKYSSRDLAAHTSLKPRKDGQQTQEELQKRNLREELEERERKHYSSKDKSYAEERDRRKSSSQLLLEGSKREAEDKIVPREIDADDSDVEPKSDDESDDDDDDDDTEALMAELERIKKERAEEKLRKERQQAEEEAKMKEAELMRGNPLININNPSSFSVKRRWDDDVVFKNQARGETKTPKRFINDTIRSDFHRKFLQRYMK

SEQ ID NO: 2831 - DNA, 2994 bp, Sorghum bicolor
  misc_feature: Ceres ANNOT ID no. 6026362
  misc_feature: Encodes the peptide sequence at SEQ ID NO 2832
atggataccctcaagcgcaaggccccggacggccccgaagctgccgaccaggcctctcctctgaaagcaccgcgcgtcgtcgcccccacctcggagcctcccgctcccaccgccctcgcgaccgcggaaccagtcgcctgcgtgcacgacgtctcctaccccgagggctacgacgcgtctgcctctacgtcccgcgccattgccggcggcgctgacgcctctgagccagcaaggaagttccccttccagctcgaccccttccagtccgaggccatacgctgcgtcgacaatggcgaatccgtcatggtttcagctcatacgtctgccggaaagacagtggttgcgttgtatgcaatagcaatgtctttgcgcaaccaacagcgggtcatctacacgtctccaatcaaggcactgagcaaccaaaagtacagggagttcaaagaagagttctctgatgttggtctcatgacaggggatgtcacgattgagcctaatgcctcttgtctggtcatgactacagaaatttggcggagcatgcaatacaagggatctgaggtcatgagggaagttgcttggattatttttgatgaggtgcattacatgcgggatagagagagaggagtggtctgggaggagagtatagtgatggctcccaagaactcacgctttgtcttcctctcagcaactgtacctaatgccaaggagtttgctgattgggtagctaaggtacataagcaaccctgtcatatagtatacactgactatagacctacacctcttcagcactatgtatttccttctggaggggatggattataccttgtagtggatgagaagggcaagttcagagaggacagttttcagaaagcattgaatgcccttgtccctgctagcgacagtgccaagaagaaggagaatgggaagtggcagaaagttatcatggcagggaaatctagcgaggaaagcgacatattcaagatggtgaaaatgataattcagcgccaatatgatcctgtaatacttttcagctttagcaaaagggaatgcgaatttcttgctatgcagatggctaagatggacttgaatgaggatgacgagaaggcaaacatcgaaacaattttttggagtgctatggatatgctttctgatgatgacaaaaaacttcctcaggtttcaaacatgctccccttactgaaacgcggcattggcgtgcatcattctggtctgttgcccattttaaaggaagtcattgagatactcttccaggagggcctcattaaggttaaaacattcagtattggtctgaacatgcctgcaaagactgttgtgtttaccaatgtgcgaaaatttgatggagaccgattcagatggttgtcaagtggagagtacatccaaatgagtggccgtgctggtcgtcgaggtattgatcagcgtggtatctgtatactgatggtagatgagaaaatggaaccttcaactgccaaaatgatgctgaaaggaagtgctgatagtttgaacagtgcctttcatctgagctacaacatgctgttaaatcaaatgcgatctgaggatggggatccagaaaagctcctccggcattcattttatcaatttcaggctgatcgttctctccctgatcttgagaagcaaatcaaggaactggaatcagagagaaattcgatggtcattgaggaagaggagagcttgaaggattattatgatctcttacagcagcacaggagtttaaagaaggatgtccatgatattgtcctctctccaaaacatgttctgcctttcttgcaacctggaaggcttgtccgcattgaatatagtacagatgagccagccaacttttccattgatgaaaatgtcacatggggaattataataaactttgaaaaagtgaaatcccatggtgaagataggagacctgaggattctgattacacggttgatgtccttaccagatgttctgtaactaaggacaacaatggtaagaaaacaatgaaggttgttcctctgaaagcgcgtggagaaccagttgtagtttcattgccactttcacagattgatggactaagcagcatacggatgtacatacctaaggatcttttgcctgtagaagctcgagaaaacaccttgaggaaagttgaagaagtcctttcaaggtttgctaaagatggggtgcctctattggatccagaagaagatatgaaagtacaatcgaaatcatttcggaaagctaccagacgaatagaagctctggagagcttgtttgagaagcacgatatccgtaactctccacatatccagcaaaagctgaaagtctttcatgctaagcaagaactatcagccaaaataaagtccataaagaaaacaatgcgatcttccactgctttagctttcaaggatgaactcaaggcccggaaacgtgttcttcgcaggctgggatatgttacgagtgatgatgttgtggaagtgaagggcaaagtggcctgtgagataagttcagctgatgagcttacattgacggagcttatgtttagtggtgctctgaaggatgctacagtagagcagatggtggcactgctttcttgctttgtttggcaggagaagctccaggatgccccaaagccaagagaggagcttgatttgctcttctaccagctgcaggagacagcaagaagggttgctaaccttcagcttgaatgcaagatccaaattgatgtggaaagttttgtgaattctttccgacctgacataatggaagcggtgtattcatgggccagagggtcgaagttctaccaaatcatggagatgacccaagtgtttgaaggaagcttgatcagggccatcaggaggctggaggaggttctgcagcagctgattctggcatccaagtctattggggaaaccgagttagaagcaaaactcgaggaggcagtcaacaagatcaagagggacatagtgtttgcagcatctttgtacttgtaa

SEQ ID NO: 2832 - protein, 997 aa, Sorghum bicolor
  misc_feature: Ceres ANNOT ID no. 6026362
  misc_feature (809)..(997): Pfam Id: DSHCT Pfam Desc: DSHCT (NUC185) domain
  misc_feature (85)..(236): Pfam Id: DEAD Pfam Desc: DEAD/DEAH box helicase
  misc_feature (394)..(474): Pfam Id: Helicase_C Pfam Desc: Helicase conserved C-terminal domain
  misc_feature (47)..(997): NCBI GI: 6633995 NCBI Desc: kiaa0052 protein [homo sapiens]
  misc_feature (47)..(997): NCBI GI: 60654395 NCBI Desc: kiaa0052 protein [synthetic construct]
  misc_feature (47)..(997): NCBI GI: 61363854 NCBI Desc: kiaa0052 protein [synthetic construct]
  misc_feature (47)..(997): NCBI GI: 40850929 NCBI Desc: kiaa0052 protein [homo sapiens]
  misc_feature (47)..(997): NCBI GI: 85397868 NCBI Desc: superkiller viralicidic activity 2-like 2 [homo sapiens]
MDTLKRKAPDGPEAADQASPLKAPRVVAPTSEPPAPTALATAEPVACVHDVSYPEGYDASASTSRAIAGGADASEPARKFPFQLDPFQSEAIRCVDNGESVMVSAHTSAGKTVVALYAIAMSLRNQQRVIYTSPIKALSNQKYREFKEEFSDVGLMTGDVTIEPNASCLVMTTEIWRSMQYKGSEVMREVAWIIFDEVHYMRDRERGVVWEESIVMAPKNSRFVFLSATVPNAKEFADWVAKVHKQPCHIVYTDYRPTPLQHYVFPSGGDGLYLVVDEKGKFREDSFQKALNALVPASDSAKKKENGKWQKVIMAGKSSEESDIFKMVKMIIQRQYDPVILFSFSKRECEFLAMQMAKMDLNEDDEKANIETIFWSAMDMLSDDDKKLPQVSNMLPLLKRGIGVHHSGLLPILKEVIEILFQEGLIKVKTFSIGLNMPAKTVVFTNVRKFDGDRFRWLSSGEYIQMSGRAGRRGIDQRGICILMVDEKMEPSTAKMMLKGSADSLNSAFHLSYNMLLNQMRSEDGDPEKLLRHSFYQFQADRSLPDLEKQIKELESERNSMVIEEEESLKDYYDLLQQHRSLKKDVHDIVLSPKHVLPFLQPGRLVRIEYSTDEPANFSIDENVTWGIIINFEKVKSHGEDRRPEDSDYTVDVLTRCSVTKDNNGKKTMKVVPLKARGEPVVVSLPLSQIDGLSSIRMYIPKDLLPVEARENTLRKVEEVLSRFAKDGVPLLDPEEDMKVQSKSFRKATRRIEALESLFEKHDIRNSPHIQQKLKVFHAKQELSAKIKSIKKTMRSSTALAFKDELKARKRVLRRLGYVTSDDVVEVKGKVACEISSADELTLTELMFSGALKDATVEQMVALLSCFVWQEKLQDAPKPREELDLLFYQLQETARRVANLQLECKIQIDVESFVNSFRPDIMEAVYSWARGSKFYQIMEMTQVFEGSLIRAIRRLEEVLQQLILASKSIGETELEAKLEEAVNKIKRDIVFAASLYL

SEQ ID NO: 2833 - DNA, 954 bp, Sorghum bicolor
  misc_feature: Ceres ANNOT ID no. 6026376
  misc_feature: Encodes the peptide sequence at SEQ ID NO 2834
atgacacccgcctccgtctccgcccccgcccccggcgccgccgccgctcccacaaagccgctctacctccgcggtccggtcatcgcgggcgccgccgcgctggccgcgttcctcctcctcgccgccgcctacgccaccaggcgagccggttccccaccgaccgccctcctcgctcacccagctgttgccaccaggttcttctccttcgacctggtccgcgagtaccctcacgacccggacgccttcacccagggtctcttatacgcggaaaatgacactcttttcgagtccactggcctctaccacaggtcttcagtccgaaaggttgatcttcagacgggaaaggttttggttaatcaccaaatggacggacaaatgtttggagaaggtttaactcttctcggccacagattgtttcaggttacctggttgaagaacgacgggtttatatatgatcaacataacttctccaaacgcacgagttttacccataaaatgcgagatggttggggtttggcgactgatggaaaagttctttttggcagtgatggcacttcaatgctgtataagctggatccaaagtcacttgaagtcatgaaagtggtgactgtcaagtatcacggtgatgaagtcccctaccttaatgagctggagtatgtagatggtgaagtctgggcaaatgtctggcagacagattgcatagctagagtgtcccctgaagatggcctagtggtgggctggatctttcttcatgagctgaggcggcagttgtggaactcaggcaatacgaatattgatgtcttaaacgggatagcttgggatgaaagaaaccacagattatttgtgacagggaaactgtggccaaagctctatgagatcaagctacgggcagtagatggtccagcagatggatctgtagaaaaactttgtccaaaagccagcttctatcgctga

SEQ ID NO: 2834 - protein, 317 aa, Sorghum bicolor
  misc_feature: Ceres ANNOT ID no. 6026376
  misc_feature (34)..(303): Pfam Id: Glu_cyclase_2 Pfam Desc: Glutamine cyclotransferase
  misc_feature (65)..(310): NCBI GI: 21536884 NCBI Desc: glutamine cyclotransferase precursor-like protein [arabidopsis thaliana]
  misc_feature (67)..(312): NCBI GI: 82621150 NCBI Desc: glutamine cyclotransferase precursor-like [solanum tuberosum]
  misc_feature (63)..(310): NCBI GI: 3342798 NCBI Desc: glutamine cyclotransferase precursor [carica papaya]
  misc_feature (63)..(310): NCBI GI: 112491423 NCBI Desc: chain a, unbound glutaminyl cyclotransferase from carica papaya
  misc_feature (65)..(310): NCBI GI: 7269422 NCBI Desc: glutamine cyclotransferase precursor-like protein [arabidopsis thaliana]
MTPASVSAPAPGAAAAPTKPLYLRGPVIAGAAALAAFLLLAAAYATRRAGSPPTALLAHPAVATRFFSFDLVREYPHDPDAFTQGLLYAENDTLFESTGLYHRSSVRKVDLQTGKVLVNHQMDGQMFGEGLTLLGHRLFQVTWLKNDGFIYDQHNFSKRTSFTHKMRDGWGLATDGKVLFGSDGTSMLYKLDPKSLEVMKVVTVKYHGDEVPYLNELEYVDGEVWANVWQTDCIARVSPEDGLVVGWIFLHELRRQLWNSGNTNIDVLNGIAWDERNHRLFVTGKLWPKLYEIKLRAVDGPADGSVEKLCPKASFYR

SEQ ID NO: 2835 - DNA, 2001 bp, Sorghum bicolor
  misc_feature: Ceres ANNOT ID no. 6026383
  misc_feature: Encodes the peptide sequence at SEQ ID NO 2836
atggcggaagtggaccacctcgccggcgagagggccaccgcgggcttcgacgtggaggagatgaaggtcgcgtgggccggctcacgccacgccgtccacgtcgccgaccgtatggcgcgcctcgtcgcatccgaccctgtcttccgcaaggataacaggaccatgctttccaggaaggaattgttcaaggacactctgagaaaagcagcccatgcatggaagcggatcgtcgagctacgtcttacagaagaggaagcaaatttgctgagacaatatgtcgaccagcctggttatgttgatctgcattggggcatgtttgttccagctataaaagggcaaggaactgaggagcagcagcagaagtggttaccactggcttacaagttccaaataattgggtgctatgctcagacggaacttggtcatggctcaaacgttcagggccttgaaacaactgctacattcgatccaaagactgatgagtttgtcatccacagtccaactctcacgtccagcaaatggtggcctggtggcttgggaaaagcttccacccatgcagtggtgtacgctcggttgataactgaagggaaggactatggcatacatggtttcattgtgcaactgcgaagcttagaggatcactccccacttcctggtgttaccctcggtgatattggtggaaagtttggtagtggtgcatataacagtatggataatggtgttctgcaatttgaccatgtgcgcatcccaagggatcaaatgctgatgaggctttcacaagttacaagggaggggaaatatgttcactcaaatgttccaaagcagctgctgtatgggacaatggtttatgttcgtcagtcaattgttgcagatgcttctaaggctttgtcccgtgctgtttgcattgctgtacgatacagcgcagtccgaaagcagtttggctctcaagatggtggccctgagactcaggtccttaattacaagactcaacagagcagactctttccattgttggcttcagcatatgcatttagatttgtgggtgattggctcaactggctatatacggatgtcactcagaaactggaagccaaggacttctcaacactgcaggaagctcatgcatgcacagctggtttgaaggctgtgacaacatctgtaactgctgatgcaattgaagaatgccgaaagctctgtggtggacatggttacttgaacagcagtggccttcctgaattgtttgccgtctatgttcctgcttgcacttacgaaggagataatgttgttttacttttgcaggttgcaaggattctaatgaaaaccgtttctcaattggcatccggaaaacagcctgttggcacaatggcctacatgggcaaagtacaatatttgatgcaatgcaaatctgctgtcaattcagccgaagattggcttaaccctgttgccatacaagaggcatttgaagcaagagcgctcaggatggcggtaaactgtgcccagaacataagccaagctgcaagccaagaggaaggtttctacgagctctccccagatttgcttgaggctgcggtagcacacatccagctgatcatcgtgaccaagttcatcgagaaggtgcagcaggacattcctggacacggagtgaaggaacagctgcagaccctgtgcaacgtgtacgcgctgtacatccttcacaagcacctgggcgacttcctggcgaccgggtgcatcacacccaggcagggagctctggcaaacgagcagctggtgggcaagctgtacgcgcaggtgcggccgaatgcagtggcgctggtggatgcgttcaactacacggaccactacctggggtctgtgctggggcggtacgacggggacgtgtacccggcgctgtacgaggaggcgtggaaggacccgctcaaccagacggtggtgccggagggctaccacgactacctccgccccctcatcaagcagcagttactgaagctctcgaggctctga

SEQ ID NO: 2836 - protein, 666 aa, Sorghum bicolor
  misc_feature: Ceres ANNOT ID no. 6026383
  misc_feature (476)..(659): Pfam Id: ACOX Pfam Desc: Acyl-CoA oxidase
  misc_feature (134)..(194): Pfam Id: Acyl-CoA_dh_M Pfam Desc: Acyl-CoA dehydrogenase, middle domain
  misc_feature (1)..(660): NCBI GI: 58531948 NCBI Desc: peroxisomal acyl-coa oxidase 1a [lycopersicon esculentum]
  misc_feature (1)..(660): NCBI GI: 109157678 NCBI Desc: chain c, x-ray crystal structure of leacx1, an acyl-coa oxidase from lycopersicon esculentum (tomato)
  misc_feature (1)..(660): NCBI GI: 58531952 NCBI Desc: peroxisomal acyl-coa oxidase 1a [lycopersicon cheesmaniae]
  misc_feature (4)..(660): NCBI GI: 15553480 NCBI Desc: acyl-coa oxidase [glycine max]
  misc_feature (1)..(666): NCBI GI: 24111395 NCBI Desc: at4g16760/dl4405c [arabidopsis thaliana]
  misc_feature (1)..(666): SWISSPROT Homolog: EC 1.3.3.6 Acyl-coenzyme A oxidase 1, peroxisomal
MAEVDHLAGERATAGFDVEEMKVAWAGSRHAVHVADRMARLVASDPVFRKDNRTMLSRKELFKDTLRKAAHAWKRIVELRLTEEEANLLRQYVDQPGYVDLHWGMFVPAIKGQGTEEQQQKWLPLAYKFQIIGCYAQTELGHGSNVQGLETTATFDPKTDEFVIHSPTLTSSKWWPGGLGKASTHAVVYARLITEGKDYGIHGFIVQLRSLEDHSPLPGVTLGDIGGKFGSGAYNSMDNGVLQFDHVRIPRDQMLMRLSQVTREGKYVHSNVPKQLLYGTMVYVRQSIVADASKALSRAVCIAVRYSAVRKQFGSQDGGPETQVLNYKTQQSRLFPLLASAYAFRFVGDWLNWLYTDVTQKLEAKDFSTLQEAHACTAGLKAVTTSVTADAIEECRKLCGGHGYLNSSGLPELFAVYVPACTYEGDNVVLLLQVARILMKTVSQLASGKQPVGTMAYMGKVQYLMQCKSAVNSAEDWLNPVAIQEAFEARALRMAVNCAQNISQAASQEEGFYELSPDLLEAAVAHIQLIIVTKFIEKVQQDIPGHGVKEQLQTLCNVYALYILHKHLGDFLATGCITPRQGALANEQLVGKLYAQVRPNAVALVDAFNYTDHYLGSVLGRYDGDVYPALYEEAWKDPLNQTVVPEGYHDYLRPLIKQQLLKLSRL

SEQ ID NO: 2837 - DNA, 1335 bp, Sorghum bicolor
  misc_feature: Ceres ANNOT ID no. 6026385
  misc_feature: Encodes the peptide sequence at SEQ ID NO 2838
atgaggggtttccagctgctactcatgctggcactgcttgccggggagttgcactgcgcaagaacagcagcagcaacaccagcagcagcagatgcaccggagactgcaccagatcagtctcccgaaccaccaccagcagatcagcaagcgccacagcaggcgcctgggccaacacctcctccaccacctccacctccacgacggccacatcgacgaccaccaaagcaggatccaggaccaccggcagcaccaaaccaggatccagcaccaccggatgatcaagaggatcctgcaccgccaaggttggttgtgccaccacaggaccctccaacgccggcaccacccggaatgatcaaccgcactttgggctgtactacactccttgtacttggagactcaaccgtggaccccggaaacaacaaccatctgcccaccacagccagggccaatttcttgccctacggcttcaacttctacggacgaaggccgactggccgatttaccaatggccgattagccacagatatgttagctgagaaactaggtatatcgaggattattccaggttttcttgacccgaatctgaggttggcccagctcaggaggggtgtgagctttgcatcaggcggctccggatatgacgacagcactgccaacagaataaatgtgatgtcattctctgcacaactgcgcaaccttttccgttacaagctactcatccgaacactgcttggaccaagaagagcagagcgacttgttaacagggctgcctttgtgataagctccggtacaaatgatttgctttctgtctatcttgcaacaaatcggtcaaatgcaattagtatggaactgtatgagaatcacctgatagcacacgtcgcaaattatacccaggccatgataatgcttggaggaaggagatttatttttgtcggactgcccccgatgggttgcttgccaattgcccgaactttggtgggcacaggatcagacagatgtgatgagacattgaatcagcttgcaacttcgttcaactcaaagctgattcaactgttgaatttcataaattttcagcaccagataagaactgcatacatagacacctatactactatacattccgcgacggtggatcctaatgcctttggcctaatagaagtgtcaagagggtgctgcggatcaggggtgattgaagttgggcaaacatgcagaggacgaagaacatgtggagaccctagcaagtacctatactgggatgctgtccatccaacggagacaatgaaccaaatcatcgcaaatgcgatgatggattccgttagagaactctacagctag

SEQ ID NO: 2838 - protein, 444 aa, Sorghum bicolor
  misc_feature: Ceres ANNOT ID no. 6026385
  misc_feature (127)..(435): Pfam Id: Lipase_GDSL Pfam Desc: GDSL-like Lipase/Acylhydrolase
  misc_feature (125)..(441): NCBI GI: 9758942 NCBI Desc: gdsl-motif lipase/hydrolase-like protein [arabidopsis thaliana]
  misc_feature (27)..(425): NCBI GI: 18266041 NCBI Desc: anther-specific proline-rich protein [brassica oleracea]
  misc_feature (24)..(431): NCBI GI: 30725276 NCBI Desc: at1g20130/t20h2_9 [arabidopsis thaliana]
  misc_feature (24)..(431): NCBI GI: 22599 NCBI Desc: apg [arabidopsis thaliana]
  misc_feature (27)..(430): NCBI GI: 22597 NCBI Desc: proline-rich protein [brassica napus]
MRGFQLLLMLALLAGELHCARTAAATPAAADAPETAPDQSPEPPPADQQAPQQAPGPTPPPPPPPPRRPHRRPPKQDPGPPAAPNQDPAPPDDQEDPAPPRLVVPPQDPPTPAPPGMINRTLGCTTLLVLGDSTVDPGNNNHLPTTARANFLPYGFNFYGRRPTGRFTNGRLATDMLAEKLGISRIIPGFLDPNLRLAQLRRGVSFASGGSGYDDSTANRINVMSFSAQLRNLFRYKLLIRTLLGPRRAERLVNRAAFVISSGTNDLLSVYLATNRSNAISMELYENHLIAHVANYTQAMIMLGGRRFIFVGLPPMGCLPIARTLVGTGSDRCDETLNQLATSFNSKLIQLLNFINFQHQIRTAYIDTYTTIHSATVDPNAFGLIEVSRGCCGSGVIEVGQTCRGRRTCGDPSKYLYWDAVHPTETMNQIIANAMMDSVRELYS

SEQ ID NO: 2839 - DNA, 1446 bp, Sorghum bicolor
  misc_feature: Ceres ANNOT ID no. 6026386
  misc_feature: Encodes the peptide sequence at SEQ ID NO 2840
  misc_feature: Up-regulated in shoot tissues in response to salicylic acid treatment
atggccatggaggagcagcagccacctcctgctcctgctcctgcgccgccggagctgcgctacctctcggggctgggcaacagcttctcgtcggaggcggtgccggggtcgctccccgtggggcagaacagcccgctggtgtgcccgctgggactctacgccgagcagctctccggcacctccttcaccaccccgcgcgcccggaacctccgcacgtggctgtaccggatcaagccatcggtgacccacgagcccttctacccgcggaaccccaccaacgagcgcctcgtcggcgagttccaccgggccaccaccgtcgccacgcccacgcagctgcgctggagacccgccgacgtgcccctccacccggacctcgacttcatcgacgggctctacaccgtctgcggcgccggcagctcttgcctccgacacggatacgccatccacatgtcctgctgctcctgcttagtactatcttacatacagtatgctgctaacaagtccatggatggatgcgccttctgcaatgccgacggtgacttcctcattgttccccagcaaggaaggctattgatcacaactgagtgcggaaagctgctcgtttcacccggcgagatcgtcgtgattcctcaaggtttccgctttgctgttgacttgccggatggcccctcgcgtggctatgtctctgagatcttcggcacccattttcagctccctgatcttggcccaattggtgctaatggtttggcttcaccgagggatttcctttccccgacagcatggtttgagcaggaccaccaccctggatacacaatagtgcagaagtatggcggtgagctgttcactgccacgcaggatttttctccattcaatgtggtcgcatggcatgggaattatgtcccttacaagtatgatctgagtaagttctgtccattcaacaccgtcctctttgaccatggcgacccatcggtaaacacagttctaactgcgccaactgataagcctggcgtcgcgttgcttgattttgtaatattcccacctagatggctggttgctgaaaatacattccggcctccgtactaccaccgcaactgcatgagcgaattcatgggcctcatttatgggatatatgaggctaaggccgatggttttcttcctggaggtgccagtcttcacagctgcatgacaccacatgggccagacaccaagacatatgaggcaacaatcagccgtgctggtgccaacgagccattcaggctcagtggaacgttggccttcatgtttgagtcttcgcttatccctcgcgtgtgtcgatgggctctggattccccgtgtcgagatctcgattactaccagtgctggattggattgaagtcccacttttcacatgacaacggtggagtggcgaccatcgagcctgctgctggcacggatgagaaagagtag

SEQ ID NO: 2840 - protein, 481 aa, Sorghum bicolor
  misc_feature: Ceres ANNOT ID no. 6026386
  misc_feature (18)..(461): Pfam Id: HgmA Pfam Desc: homogentisate 1,2-dioxygenase
  misc_feature (18)..(473): NCBI GI: 75252057 NCBI Desc: homogentisate 1,2-dioxygenase (homogentisicase) (homogentisate oxygenase) (homogentisic acid oxidase)
  misc_feature (18)..(473): NCBI GI: 21594040 NCBI Desc: homogentisate 1,2-dioxygenase [arabidopsis thaliana]
  misc_feature (16)..(462): NCBI GI: 8131905 NCBI Desc: homogentisate 1,2-dioxygenase [lycopersicon esculentum]
  misc_feature (18)..(479): NCBI GI: 33942055 NCBI Desc: at5g54080 [arabidopsis thaliana]
  misc_feature (18)..(479): NCBI GI: 4098647 NCBI Desc: homogentisate 1,2-dioxygenase [arabidopsis thaliana]
  misc_feature (18)..(473): SWISSPROT Homolog: EC 1.13.11.5 Homogentisate 1,2-dioxygenase
  misc_feature: Up-regulated in shoot tissues in response to salicylic acid treatment
MAMEEQQPPPAPAPAPPELRYLSGLGNSFSSEAVPGSLPVGQNSPLVCPLGLYAEQLSGTSFTTPRARNLRTWLYRIKPSVTHEPFYPRNPTNERLVGEFHRATTVATPTQLRWRPADVPLHPDLDFIDGLYTVCGAGSSCLRHGYAIHMSCCSCLVLSYIQYAANKSMDGCAFCNADGDFLIVPQQGRLLITTECGKLLVSPGEIVVIPQGFRFAVDLPDGPSRGYVSEIFGTHFQLPDLGPIGANGLASPRDFLSPTAWFEQDHHPGYTIVQKYGGELFTATQDFSPFNVVAWHGNYVPYKYDLSKFCPFNTVLFDHGDPSVNTVLTAPTDKPGVALLDFVIFPPRWLVAENTFRPPYYHRNCMSEFMGLIYGIYEAKADGFLPGGASLHSCMTPHGPDTKTYEATISRAGANEPFRLSGTLAFMFESSLIPRVCRWALDSPCRDLDYYQCWIGLKSHFSHDNGGVATIEPAAGTDEKE

SEQ ID NO: 2841 - DNA, 966 bp, Sorghum bicolor
  misc_feature: Ceres ANNOT ID no. 6026406
  misc_feature: Encodes the peptide sequence at SEQ ID NO 2842
atgtcgtcctccccggcggcgctgggcttctactgccaccagtgcgaccgcaacgtctccatcgcccctcccgcatcccctgacgccgacgtcctctgcccccgctgcggcggcggattcgtcgaggagcttcctcccaaccctagccccccgcctccgcccccgtccgccgccttctttgcctcgccctccttcgacctccgccaccccagcgacctctccgccttcttcggccccacctcccccgagccgcttgccccaggcctcttcgacccctccaacttcctccacgaccacttcggcggcctactctccggcggtgccaccatccagatcgtcctcgagggtgggcccggcctcgccgcgcccccgggcctcaaccttgctgactactttgtcggctccgccggcctcgagcagctcatccagcaactcgccgagaacgaccccaaccgctacggcacccctcccgccgccaagtccgccgtcgcctcgctccccgacgttgcagtgtcagccgacatgatgcaggccgacggcggcgcccagtgcgccgtctgcatggacgacttccacctcggcgccgccgccaagcagctcccctgcaagcacgttttccacaaggactgcatcctcccgtggctggacctccacagctcctgcccggtctgccgcttcgagctgcccaccgacgatcccgactacaaccacacccatcagcagcagcacgccgcgtctccagctcctgctcctgctcctgcggcctcctcctcccccagggtggctgagcggaggttcaggatttcgctgccctggcctctcagggccgcctttggtgctgctcaggcagagagcagcaatcccaacaactatgacacacctccatcttggtctggcggcaacgataatgacaatgatgcaggtggtggccctcaatctcagactggttacgatgatcttgactga

SEQ ID NO: 2842 - protein, 321 aa, Sorghum bicolor
  misc_feature: Ceres ANNOT ID no. 6026406
  misc_feature (184)..(224): Pfam Id: zf-C3HC4 Pfam Desc: Zinc finger, C3HC4 type (RING finger)
  misc_feature (72)..(286): NCBI GI: 23308365 NCBI Desc: at3g19950/mpn9_19 [arabidopsis thaliana]
  misc_feature (66)..(304): NCBI GI: 115482626 NCBI Desc: os10g0487400 [oryza sativa (japonica cultivar-group)]
  misc_feature (10)..(291): NCBI GI: 92868562 NCBI Desc: zinc finger, ring-type; ringv [medicago truncatula]
  misc_feature (128)..(293): NCBI GI: 92888063 NCBI Desc: zinc finger, ring-type; ringv [medicago truncatula]
  misc_feature (121)..(234): NCBI GI: 38454178 NCBI Desc: at3g13430 [arabidopsis thaliana]
  misc_feature: The sequence is a functional homolog of SEQ ID NO. 329 in the 11/188,298 US application
  misc_feature: The sequence is a functional homolog of SEQ ID NO. 271 in the 11/188,298 US application
MSSSPAALGFYCHQCDRNVSIAPPASPDADVLCPRCGGGFVEELPPNPSPPPPPPSAAFFASPSFDLRHPSDLSAFFGPTSPEPLAPGLFDPSNFLHDHFGGLLSGGATIQIVLEGGPGLAAPPGLNLADYFVGSAGLEQLIQQLAENDPNRYGTPPAAKSAVASLPDVAVSADMMQADGGAQCAVCMDDFHLGAAAKQLPCKHVFHKDCILPWLDLHSSCPVCRFELPTDDPDYNHTHQQQHAASPAPAPAPAASSSPRVAERRFRISLPWPLRAAFGAAQAESSNPNNYDTPPSWSGGNDNDNDAGGGPQSQTGYDDLD

SEQ ID NO: 2843 - DNA, 2349 bp, Sorghum bicolor
  misc_feature: Ceres ANNOT ID no. 6026407
  misc_feature: Encodes the peptide sequence at SEQ ID NO 2844
atgagatctgtggaggagaccaagagatctctgacagttgccccctttgagtgcgcgtgggccgaggagcttcgcttcggggagcctggccgtggctgcatcgccttcgaggcatcagcccagaacgatgtcaccctggtcttccgccacctgcttgggagccagcactaccactacaagacggacaccagccgccactacaccgtcatcttgggcagccataggaacaaacggctcaagatcgaagtagatggaatcactgctgttgatgttactgccgtcggcctctgctgctcctcgtctttccagagctactggatcagcatctatgacggatgcataagcatcggccaaggaaagcatccaagcaacaatctccttttccaatggcttgatcctgatcccaacccacatgttcagtatgttggcctatccagctgggacaagcatgttgggtacagaaacataagccttcttccatcagctcccccaaatagcatattttggactcagattgagtatgccaacgtccactgggttgctgacgctggagactatgtgaggaaacaactgtcaagagatgattgtcatcaaagggtacttgcagactttctagagaactgggatttctctgatgctgtatttgtcgttggcactgaaagaaaggtcgtccctgcacacaaacttgtcttgtgtgcctccggggatttcccttttgaaatgggggatgaagctaccattgtgcttccatcagcatcctaccctgttctccactcccttcttgagtatatctatacaggttcgacgcagattgctgaatggctactaacttctgtgctggagttgagctcgcagtttaaagtcgaaccactggtgaagtgctgcaaagaaatcattgactgtttagaagtggataagaaactttctgattctggaaaaatcttaataaaatttccaaaaagcggactccaagatcatagatttgactcttctccactcaaagcaccactgaatgtgcagaaagttggagagttccttgcaaatggtgaacatagtgatataaatatctatgttaatggacatggtcttgtcagtaagggtcacaagcttatccttagcctgtggagcgctccacttgccaagatgttcacaaacgggatgagggaaagcagtgccacggatatctttttcggagatgttcctcctgaaccattctttctcctccttcagtttatgtactacgggaaacttaagttggatactagggatactacatcagtgttggttcaacttcttctactagcagatcagttcgccatcactgttcttcagtttgaatgctgcaaacgaataatggaatgcctttcagaggacactgtatgttcagtcttacaggcagtttcatcaatctcatcttgtaaaccgcttgaagaagtatgcaagaggaattttgctatgcattttgattattgcacaactgcttgcacggactttgtgttgttagatgaggcaccatttaaggatattcttgagcatggtgatatgacagtaacgtcggaggagagggttctggatgtcattttaacatggtgcatgggagcttgtgaaacttttcactggacttcagtagatgagctcttgagatcttcaacaccagagcagctctttggagagaggctttccggcatcaatactttgctaccattagtgagattccctttgatgcagctgtctatactaaagaggatggagagaagtactctagcaaacgacatacaagcattcagacagttggttgcagaggccattgaattctctcatgctggacaattgatgcttacatcatatgaatgtgagagatttcagcataggcgctcgagctataaagagctgcagtatatctctgatggtgataacaacggtgttatctactatgctggaacatcatttggaaaacatcagtggatgaatcctgtgttaaccaaggggacatgttttgctgggccttgtattgaaaatggcaagaagctttcttggtggatggtagacatcggacaggactaccagctgatgtgcaactactacacggtgaggcaggatggctccacaacattcatgagatcttgggctcttcagggatccatggacggccggaactggacaagcctccgtgtccatgacgacgaccctaccatttgccacccgggccagttcgcctcttggcccatcgttggcccggcggcccttctgcccttccgattcttcagggtcgccctgacaggcccggccgccggatgtgcttggaacctctgcatttgcttcctagagctctacggctacttccgttag

SEQ ID NO: 2844 - protein, 782 aa, Sorghum bicolor
  misc_feature: Ceres ANNOT ID no. 6026407
  misc_feature (201)..(302): Pfam Id: BTB Pfam Desc: BTB/POZ domain
  misc_feature (342)..(455): Pfam Id: BTB Pfam Desc: BTB/POZ domain
  misc_feature (4)..(459): NCBI GI: 115463315 NCBI Desc: os05g0345500 [oryza sativa (japonica cultivar-group)]
  misc_feature (368)..(662): NCBI GI: 42761550 NCBI Desc: similar to dictyostelium discoideum (slime mold). miga
  misc_feature (678)..(779): NCBI GI: 1841872 NCBI Desc: miga [dictyostelium discoideum]
  misc_feature (340)..(530): NCBI GI: 55228661 NCBI Desc: myocardial ischemic preconditioning associated protein 6 [rattus norvegicus]
  misc_feature (340)..(530): NCBI GI: 60360272 NCBI Desc: mkiaa4221 protein [mus musculus]
MRSVEETKRSLTVAPFECAWAEELRFGEPGRGCIAFEASAQNDVTLVFRHLLGSQHYHYKTDTSRHYTVILGSHRNKRLKIEVDGITAVDVTAVGLCCSSSFQSYWISIYDGCISIGQGKHPSNNLLFQWLDPDPNPHVQYVGLSSWDKHVGYRNISLLPSAPPNSIFWTQIEYANVHWVADAGDYVRKQLSRDDCHQRVLADFLENWDFSDAVFVVGTERKVVPAHKLVLCASGDFPFEMGDEATIVLPSASYPVLHSLLEYIYTGSTQIAEWLLTSVLELSSQFKVEPLVKCCKEIIDCLEVDKKLSDSGKILIKFPKSGLQDHRFDSSPLKAPLNVQKVGEFLANGEHSDINIYVNGHGLVSKGHKLILSLWSAPLAKMFTNGMRESSATDIFFGDVPPEPFFLLLQFMYYGKLKLDTRDTTSVLVQLLLLADQFAITVLQFECCKRIMECLSEDTVCSVLQAVSSISSCKPLEEVCKRNFAMHFDYCTTACTDFVLLDEAPFKDILEHGDMTVTSEERVLDVILTWCMGACETFHWTSVDELLRSSTPEQLFGERLSGINTLLPLVRFPLMQLSILKRMERSTLANDIQAFRQLVAEAIEFSHAGQLMLTSYECERFQHRRSSYKELQYISDGDNNGVIYYAGTSFGKHQWMNPVLTKGTCFAGPCIENGKKLSWWMVDIGQDYQLMCNYYTVRQDGSTTFMRSWALQGSMDGRNWTSLRVHDDDPTICHPGQFASWPIVGPAALLPFRFFRVALTGPAAGCAWNLCICFLELYGYFR

SEQ ID NO: 2845 - DNA, 825 bp, Sorghum bicolor
  misc_feature: Ceres ANNOT ID no. 6026474
  misc_feature: Encodes the peptide sequence at SEQ ID NO 2846
atgagggagaggttgaatcgttcttggattcgtcttcttgaggttcttgttcagttaacaaggagattgttcctgtggagaagagaaaagatggcgcctcctgcatcatcgtcgccgtcgccgctgacgcccgccatggtttgcgcaaggcagggacggctccggcagcgctacgaaggatgctaccgccttgtctcaggatgcgttccttacgtggtcaaggaggatgctggggagaaaagctgccagcagggcgtgctaggcaggctgcaagtgctcatgatctcgacgcccaagcgaagcgatctcatcttcccaaagggtggatgggaggacgacgagagcatcgacgaagctgcgtgcagggaggccttcgaggaagcaggcgtcaagggcattatcagcgcaacgccgctgggagaatggatcttcaagagcaagagcaaacagaacagctgcggtcttcagggggcttgcaagggcttcatgttcggactacaagtcacagagctagttgaaatctggcctgagcaggttacccacggcaggagatgggtacccgtagaggaggcatacggtctctgccggtacgactggatgagggaagctctggacaagctcaaggagcagctgctgttcgagagcaacgaattcaggcctctgccatcgccagagctggtggactcgtcgagcctgttcatggtgatgccgccggctgccgccgaaggggcggtcacagtgctgctggaatcatggcctgagctcgtaaagatgggtaagcatctcattctacagccatgcctaatctgccattatgcagactag

SEQ ID NO: 2846 - protein, 274 aa, Sorghum bicolor
  misc_feature: Ceres ANNOT ID no. 6026474
  misc_feature (62)..(210): Pfam Id: NUDIX Pfam Desc: NUDIX domain
  misc_feature (31)..(244): NCBI GI: 115458156 NCBI Desc: os04g0399300 [oryza sativa (japonica cultivar-group)]
  misc_feature (31)..(244): NCBI GI: 116309470 NCBI Desc: h0209h04.8 [oryza sativa (indica cultivar-group)]
  misc_feature (49)..(206): NCBI GI: 15231598 NCBI Desc: mutt/nudix family protein [arabidopsis thaliana]
  misc_feature (45)..(232): NCBI GI: 8698735 NCBI Desc: contains similarity to ap2/erebp-like transcription factor from arabidopsis thaliana gbaf216581 and contains bacterial mutt protein pf00293 and ap2 pf00847 domains
  misc_feature (49)..(206): NCBI GI: 92884561 NCBI Desc: nudix hydrolase [medicago truncatula]
MRERLNRSWIRLLEVLVQLTRRLFLWRREKMAPPASSSPSPLTPAMVCARQGRLRQRYEGCYRLVSGCVPYVVKEDAGEKSCQQGVLGRLQVLMISTPKRSDLIFPKGGWEDDESIDEAACREAFEEAGVKGIISATPLGEWIFKSKSKQNSCGLQGACKGFMFGLQVTELVEIWPEQVTHGRRWVPVEEAYGLCRYDWMREALDKLKEQLLFESNEFRPLPSPELVDSSSLFMVMPPAAAEGAVTVLLESWPELVKMGKHLILQPCLICHYAD

SEQ ID NO: 2847 - DNA, 2607 bp, Sorghum bicolor
  misc_feature: Ceres ANNOT ID no. 6026476
  misc_feature: Encodes the peptide sequence at SEQ ID NO 2848
atgtcttcgccggacccttcgccgtcgacgagcacccaacagccgaagcaattggagggtgtgacagttcttctgaaagaggcaagcaggttctaccgcagagcatataacgaactgttctcgggtggaactactgagcaggagcctgaatcatcgactagtactcctgagtatatgctttttgggtggcatctcttcttaatgcttcgttcgagatcaccggaattgttcaaggacctggtgtcctgcatccatggattagttgctgtattggccatacttttgatccacgtaccagctaaatttaggagattcatgattgatggctcttctcacttaatcaaacaaaatgagaaaggcatggatcttattgcttcgttatgccataattatcatgcctctgaagaatgtgtgaaagaaatgatggacaagtctcataaggcaatagaagacattttcggcacgaaagcactaagtgcatcagagggcaaaacagaaaatttggataagatagacacagatggcctgatgtatttcaaaggtctcattgatactgagtgtttccagtcaaatctggaaaaaatggagaaactatgcaatccaaatagctgtgaaggggagcttgattataaatcaattttgatcaataatgattatatcccctgtgctgagaactcgcctggggattccaccaatttaggacattcaaagcgtgtctttgaaatattggcatctcccacaaagacaataaagaacatgctgactgttcctagttcccctttgtcacctgccactggtggttcagtcaagattctgcaaatgacaccagtaacttctgccatgacgacagctaagtggcttcgtgaggtgatatcttcattgccagagaagccttcatctaagcttcagcagttgctgtcatcatgtgatagggatttgacaaatgctgtcacagaaagggtaagcatagttttggaagcaatttttccaaccaagtcttctgctgatcggggtggctcattaggcatcagttgtgcaaatgcctttgatattccatgggcagaagcaagaaaaatggaggcttccaagttgtactatagggtattagaggcaatttgcagagctgagttacaaaacaacaatgtaaataatctaactccattgctgtcaaatgagcgttttcaccgatgtttgattgcatgttcagcggagctagtattggcgacacataagccagtcttcatgatgtttcctgctgttcttgacagtacagggctaactgcatttgatttgagcaaaataattgagaactttgtaagacatgaagagaccctcccaagacaattgaaaaggcacctaaattccttagaacaacaacttttggaaagtatggtatgggagaaaggttcttcattgtataactcactgattgttgctaggccatctgttacttcagaaataaagcgccttggtcttttggctgaaccaatgccatctcttgatgacttagtggcaaggcagaatattcatgttgagggcttgcctgctacaccatctaaaaaacgtgctgctggtccagatgacaacgctgatcctcgatcaccaaagagatcgtgcaatgaatctaggaacacagtggtagagcacaatttgcagacacctccacccaagcaaagtcacatggtgtcgactagtttgaaagcaaaatgccatccactccagtccacatttgaaagtccaactgtcagtaatcctgttggtgggaatgaaaaatgtgctgatgtgacgattaagatattcttttccaaaattctgaagttggctgctgttagaataagaaacttgtgcgaaagacttcaacatgtggaactgacagagcgtgtctataatgtcttcaatcagattcttgatcaacagacaacattattttttaataggcacatcgatcaacttatcctttgctgtctttatggtgttgcaaaggtttgtaaattagaaccctcattcaaggagttactcaacaattacagaaaggaagcacaatgcaaaccagaagttttttcaaatgtctatattgggagtaggaatcgtaatgatgtattagtatcacgccatgttgatattattactttttacaacgaggtgtttgttccagcagccaagtctttcttggtgtcactaatatcatccggtactcgtccagaagacaagaagaatgctagtggccaaattcctggatcacccaagccatctcctctcccaaatttaccagatctgtccccgaagaaagtttcagcatctcataatgtatatgtgtctcctttgcagcaagccaagatggatttacttctgtcaccaagttccaggagtttttatgcatgctttggtgaaggcacccatgcttatcagagcccatcaaaagatttggctgctataaatagctgcctaaattatagcggccggagattaagcagtcgattaaactttgacatggtgagcgactcagtggtagctggtagtctgggccagccaaatggtggttctacctccttggatcctgcagctgcatttagccccatttcaaagaagagagagccagatacttga

SEQ ID NO: 2848 - protein, 868 aa, Sorghum bicolor
  misc_feature: Ceres ANNOT ID no. 6026476
  misc_feature (275)..(476): Pfam Id: RB_A Pfam Desc: Retinoblastoma-associated protein A domain
  misc_feature (595)..(722): Pfam Id: RB_B Pfam Desc: Retinoblastoma-associated protein B domain
  misc_feature (1)..(868): NCBI GI: 2352795 NCBI Desc: retinoblastoma-related protein 1 [zea mays]
  misc_feature (1)..(868): NCBI GI: 9716502 NCBI Desc: retinoblastoma related protein rbr1 [zea mays]
  misc_feature (1)..(868): NCBI GI: 24561941 NCBI Desc: retinoblastoma-related protein [zea mays]
  misc_feature (186)..(868): NCBI GI: 1617474 NCBI Desc: rb1 protein [zea mays]
  misc_feature (257)..(832): NCBI GI: 2352799 NCBI Desc: retinoblastoma-related protein 2b [zea mays]
MSSPDPSPSTSTQQPKQLEGVTVLLKEASRFYRRAYNELFSGGTTEQEPESSTSTPEYMLFGWHLFLMLRSRSPELFKDLVSCIHGLVAVLAILLIHVPAKFRRFMIDGSSHLIKQNEKGMDLIASLCHNYHASEECVKEMMDKSHKAIEDIFGTKALSASEGKTENLDKIDTDGLMYFKGLIDTECFQSNLEKMEKLCNPNSCEGELDYKSILINNDYIPCAENSPGDSTNLGHSKRVFEILASPTKTIKNMLTVPSSPLSPATGGSVKILQMTPVTSAMTTAKWLREVISSLPEKPSSKLQQLLSSCDRDLTNAVTERVSIVLEAIFPTKSSADRGGSLGISCANAFDIPWAEARKMEASKLYYRVLEAICRAELQNNNVNNLTPLLSNERFHRCLIACSAELVLATHKPVFMMFPAVLDSTGLTAFDLSKIIENFVRHEETLPRQLKRHLNSLEQQLLESMVWEKGSSLYNSLIVARPSVTSEIKRLGLLAEPMPSLDDLVARQNIHVEGLPATPSKKRAAGPDDNADPRSPKRSCNESRNTVVEHNLQTPPPKQSHMVSTSLKAKCHPLQSTFESPTVSNPVGGNEKCADVTIKIFFSKILKLAAVRIRNLCERLQHVELTERVYNVFNQILDQQTTLFFNRHIDQLILCCLYGVAKVCKLEPSFKELLNNYRKEAQCKPEVFSNVYIGSRNRNDVLVSRHVDIITFYNEVFVPAAKSFLVSLISSGTRPEDKKNASGQIPGSPKPSPLPNLPDLSPKKVSASHNVYVSPLQQAKMDLLLSPSSRSFYACFGEGTHAYQSPSKDLAAINSCLNYSGRRLSSRLNFDMVSDSVVAGSLGQPNGGSTSLDPAAAFSPISKKREPDT

SEQ ID NO: 2849 - DNA, 813 bp, Sorghum bicolor
  misc_feature: Ceres ANNOT ID no. 6026504
  misc_feature: Encodes the peptide sequence at SEQ ID NO 2850
atggcggcgcggcggagcaggggctgggcgcgcggcgcggcggcgttcgcggccgtggcgctggcggtgggcgctgggcggaggtacgggtgggacggcgcctccgcggtggcggcgttccgcgaggcccggggcgcactggggccctgggcggcgccggcctacgttgccgcgcacgcgctcacgctcgcgctctgcccgccctacgccatcttcttcgagggcggcgccgcgctcatcttcggattcctgccgggggagtcttgctttttttccgccagggtcctgggggcctcgctctcctttgggatcggcagggcaattttcagatacttcacttcagcaatggaatggctacagaggaacaagtacttccatgttgttgttaaaggggttgagcgggatggctggaaatttgtattacttgctaggttctctcctttgccttcctacatcatcaactacgctctatccgccacggatgttggatttttcagagattttctcctccccacagttatcggctgcttaccaatgatactacagaatgtgtccattgtaagccttgccggtgcagcagtggcctcgaccacaggatcaaataagtcccatgtatactcatacctgtttccagcgataggcattgtgtccagtgttctcatctcatggaggattaagcagtattcctctgcccttgctattcctgaagagatgaaaagttcacctactaatggaaattccaatggcgatgctaagctggcttcggcagcatccaaaaatactagctctgggaaaactaggaagagaaggtga

SEQ ID NO: 2850 - protein, 270 aa, Sorghum bicolor
  misc_feature: Ceres ANNOT ID no. 6026504
  misc_feature (66)..(189): Pfam Id: SNARE_assoc Pfam Desc: SNARE associated Golgi protein
  misc_feature (9)..(264): NCBI GI: 7767655 NCBI Desc: f27f5.5 [arabidopsis thaliana]
  misc_feature (106)..(217): NCBI GI: 115485769 NCBI Desc: os11g0537300 [oryza sativa (japonica cultivar-group)]
  misc_feature (19)..(248): NCBI GI: 53688163 NCBI Desc: cog0398: uncharacterized conserved protein [nostoc punctiforme pcc 73102]
  misc_feature (18)..(244): NCBI GI: 75908987 NCBI Desc: deda [anabaena variabilis atcc 29413]
  misc_feature (55)..(229): NCBI GI: 67922563 NCBI Desc: deda [crocosphaera watsonii wh 8501]
MAARRSRGWARGAAAFAAVALAVGAGRRYGWDGASAVAAFREARGALGPWAAPAYVAAHALTLALCPPYAIFFEGGAALIFGFLPGESCFFSARVLGASLSFGIGRAIFRYFTSAMEWLQRNKYFHVVVKGVERDGWKFVLLARFSPLPSYIINYALSATDVGFFRDFLLPTVIGCLPMILQNVSIVSLAGAAVASTTGSNKSHVYSYLFPAIGIVSSVLISWRIKQYSSALAIPEEMKSSPTNGNSNGDAKLASAASKNTSSGKTRKRR

SEQ ID NO: 2851 - DNA, 912 bp, Sorghum bicolor
  misc_feature: Ceres ANNOT ID no. 6026514
  misc_feature: Encodes the peptide sequence at SEQ ID NO 2852
atggcgacgacgacgacggcgcgggtgccgccgctgctggttgcggccgttgcggtggcggtggcggtgctggtggaggtggcgacggcggcggcgccgcggaagcccgtggacgtgccgttccagaagaactacgtgccgacgtgggcgcaggaccacatccactacgtggacggcgggcgggaggtgcagctgtacctggacaagtccacggggacgggcttccagacgcggggctcctacctcttcggccacttcagcatgcacatgaagctcgtcggcggcgactccgcgggcaccgtcacggcgttctacctgtcgtcgcagaactcggagcacgacgagatcgacttcgagttcctgggcaaccggacggggcagccctacatcctgcagaccaacgtgttcaccggcggcaagggcgaccgcgagcagaggatctacctctggttcgaccccaccaaggagtaccactcctactccgtcctctggaacctctacatgatcgcgttcttcgtggacgacgtgccgatccgtgtgttcaagaacacgagctcggacctgggggtgcggtacccgttcagccagccgatgaagctctactccagcctgtggaacgccgacgactgggcgacccgcggcgggcgggagaagacggactggtccaacgcgcccttcgtcgcctcctacaggggattccacgtcgacggctgcgaggcctccgccgaggcccgctactgcgccacccagggcgcgcgctggtgggaccagcccgagttcagggacctcgacgccgcgcagtaccgcaagctcgccgacgtccgccgccgctacaccatctacaactactgcaccgaccgcgaccgctacgccgccatgccgcccgagtgcgcgcgcgaccgcgacgtctga

SEQ ID NO: 2852 - protein, 303 aa, Sorghum bicolor
  misc_feature: Ceres ANNOT ID no. 6026514
  misc_feature (41)..(223): Pfam Id: Glyco_hydro_16 Pfam Desc: Glycosyl hydrolases family 16
  misc_feature (247)..(297): Pfam Id: XET_C Pfam Desc: Xyloglucan endo-transglycosylase (XET) C-terminus
  misc_feature (15)..(303): NCBI GI: 38605539 NCBI Desc: probable xyloglucan endotransglucosylase/hydrolase precursor
  misc_feature (15)..(303): NCBI GI: 1885310 NCBI Desc: endoxyloglucan transferase (ext) [hordeum vulgare subsp. vulgare]
  misc_feature (19)..(303): NCBI GI: 950299 NCBI Desc: xyloglucan endotransglycosylase precursor [actinidia deliciosa]
  misc_feature (19)..(303): NCBI GI: 27228078 NCBI Desc: xyloglucan endotransglycosylase precursor [populus tremula x populus tremuloides]
  misc_feature (26)..(303): NCBI GI: 47169268 NCBI Desc: chain b, xyloglucan endotransglycosylase native structure.
  misc_feature (24)..(303): SWISSPROT Homolog: EC 2.4.1.207 Xyloglucan endotransglucosylase/hydrolase protein A precursor
  misc_feature: Useful for making plants with altered Lignin content
  misc_feature: Useful for making plants with altered cell wall content and/or composition
  misc_feature: Functional homolog of the protein sequence given in SEQ ID NO 13341
  misc_feature: Functional homolog of the protein sequence encoded by LOCUS at2g06850
  misc_feature: Functional homolog of the protein sequence encoded by LOCUS at4g13080
  misc_feature: Functional homolog of the protein sequence encoded by LOCUS at4g13090
  misc_feature: Functional homolog of the protein sequence encoded by LOCUS at4g37800
  misc_feature: GREAT-hit functional homolog of the protein sequence encoded by LOCUS at5g13870
  misc_feature: Useful for making plants with altered carbohydrate content
  misc_feature: Functional homolog of the protein sequence given in SEQ ID NO 13805
  misc_feature: Useful for making plants with altered cell wall content and/or composition
  misc_feature: Functional homolog of the protein sequence given in SEQ ID NO 13806
  misc_feature: Useful for making plants with altered lignin content
  misc_feature: Functional homolog of the protein sequence given in SEQ ID NO 13341
  misc_feature: The sequence is a functional homolog of SEQ ID NO. 381 in the 11/188,298 US application
MATTTTARVPPLLVAAVAVAVAVLVEVATAAAPRKPVDVPFQKNYVPTWAQDHIHYVDGGREVQLYLDKSTGTGFQTRGSYLFGHFSMHMKLVGGDSAGTVTAFYLSSQNSEHDEIDFEFLGNRTGQPYILQTNVFTGGKGDREQRIYLWFDPTKEYHSYSVLWNLYMIAFFVDDVPIRVFKNTSSDLGVRYPFSQPMKLYSSLWNADDWATRGGREKTDWSNAPFVASYRGFHVDGCEASAEARYCATQGARWWDQPEFRDLDAAQYRKLADVRRRYTIYNYCTDRDRYAAMPPECARDRDV

SEQ ID NO: 2853 - DNA, 990 bp, Sorghum bicolor
  misc_feature: Ceres ANNOT ID no. 6026521
  misc_feature: Encodes the peptide sequence at SEQ ID NO 2854
atgaagacggccagcatccccgcgacgatgcgggccgtgcagtacgacgcctggggcgggggtgccacgggactcaagcatgtggaagttccaatcccttcggcccaaaagaatgagcttctattgaagctggaagtagcaagcatcaatccagtggactggaagatacagaaagggctcttgcggccattcctgcctcgtaaatttccttttatccctggagttgtggctgatgttgggccaggagtccagggattccaacccggagatcaagtcgttgctaagctgtactcacttaaaggaggtggacttgcggagtatgctgtggcatcagaaactctgaccgtcaagaggcctgccgaggtatttgctgctgaaggcgcagggctgcctgttgctgctggtactgcgctccaggcgcttaggaccatcggcgccaagttcgacggcactggcaagcccttaaacgttctgatcaccgcggcatcaggtggcgtcggtcactacgccgtgcagctcgcgaaaatggccggtctccacatcaccgccacctgtggcgcgcgtaacgtggagctgctgaagagcctgggcgcggatgaggtgcttgactacaagacgccagagggtgccagcctgcagagcccctcgggtaagaagtacgatgttgtcatccattgcgctgcccggatcagctggtcgacgttcgagcctgtgctggccaccaccgggagggtgatcgacatcaccccaaacttcagctccatcctcaaatgggcgctgcacatggtgaccttcgccaggaagaggctggtgccactgcacctgtcgcccaacaaggcggacctagagttcctggtcgggctgctgaaggacggcaagctcaagacactgattgactcgaggttcccactgagcgaggtgagcaaggcctggcagaagagcgtcgacggccatgccaccggaaagatcatcgtcgagatcggaggctga

SEQ ID NO: 2854 - protein, 329 aa, Sorghum bicolor
  misc_feature: Ceres ANNOT ID no. 6026521
  misc_feature (153)..(281): Pfam Id: ADH_zinc_N Pfam Desc: Zinc-binding dehydrogenase
  misc_feature (37)..(118): Pfam Id: ADH_N Pfam Desc: Alcohol dehydrogenase GroES-like domain
  misc_feature (4)..(329): NCBI GI: 21742152 NCBI Desc: osjnba0069d17.1 [oryza sativa (japonica cultivar-group)]
  misc_feature (7)..(327): NCBI GI: 62363163 NCBI Desc: quinone reductase [triticum monococcum]
  misc_feature (10)..(326): NCBI GI: 92869323 NCBI Desc: alcohol dehydrogenase superfamily, zinc-containing [medicago truncatula]
  misc_feature (7)..(329): NCBI GI: 115479997 NCBI Desc: os09g0503100 [oryza sativa (japonica cultivar-group)]
  misc_feature (10)..(326): NCBI GI: 77416923 NCBI Desc: ripening regulated protein-like [solanum tuberosum]
  misc_feature: The sequence is a functional homolog of SEQ ID NO. 530 in the 11/188,298 US application
MKTASIPATMRAVQYDAWGGGATGLKHVEVPIPSAQKNELLLKLEVASINPVDWKIQKGLLRPFLPRKFPFIPGVVADVGPGVQGFQPGDQVVAKLYSLKGGGLAEYAVASETLTVKRPAEVFAAEGAGLPVAAGTALQALRTIGAKFDGTGKPLNVLITAASGGVGHYAVQLAKMAGLHITATCGARNVELLKSLGADEVLDYKTPEGASLQSPSGKKYDVVIHCAARISWSTFEPVLATTGRVIDITPNFSSILKWALHMVTFARKRLVPLHLSPNKADLEFLVGLLKDGKLKTLIDSRFPLSEVSKAWQKSVDGHATGKIIVEIGG

SEQ ID NO: 2855 - DNA, 981 bp, Sorghum bicolor
  misc_feature: Ceres ANNOT ID no. 6026570
  misc_feature: Encodes the peptide sequence at SEQ ID NO 2856
atggtggcatgccaaggcgagacggcgacgacgacggtttgcgtgactggcgctggtggcttcatcgcgtcgtggctggtgcagcgcctcctctccagcggcagctacgtcgtgcacggcgccgtgcgcgacccgagcgacccgaagtacgcgcacctgatggcgctggatggcgccgtggagcggctgcggctgttcaaggcggacatgctggaccacgccggcgtcgcggctgccgtggccggctgcgacggcgtcttccacgttgccagccccgtcccggcgtcgaagcccgcggacccggagctggaggtcgtggcccccgcggtggacggcacgcgcaacgtgctcagggcctgccacgaggctaacgtccgccgcgtcgtggtggtctcgtccgtcgcggccatcgccgtgaaccccaactgccgcaacggcgtcgtcctggacgaggagtggtggtccgacgaggacttctgcagaaccattaagggctggtattttctgtccaagacgctagccgaacgcgccgccttcgcgtacgccaaggagaccgggcttgacgtggtgagcgtctgcccgtcgtggtgtctcggacctctgctgcagcccaccgtgaacaacagcagcttgacactcattgactacctcaaaggtgaccgcgacaccgtcgacgacaagatgaagaacgtcgtggacgtccgcgacgtcgccgaggctctcgtcctggtgtatgagaccccggaggcttccgggcgctacatctgcaggtcatatccaatgagcatgactgagatccttgacatcatcaagagcttctatcccaacctcagctaccctaacaacttcgttaaagtgcaagacgaaaggatgttcacatcgaagaagctgcaagcgctggggtggagctacaggccggcagaggaaaccttcaaggacacagtaaaatcctacaagaatgcagccatcctcaacttttaa

SEQ ID NO: 2856 - protein, 326 aa, Sorghum bicolor
  misc_feature: Ceres ANNOT ID no. 6026570
  misc_feature (13)..(257): Pfam Id: Epimerase Pfam Desc: NAD dependent epimerase/dehydratase family
  misc_feature (14)..(279): Pfam Id: 3Beta_HSD Pfam Desc: 3-beta hydroxysteroid dehydrogenase/isomerase family
  misc_feature (15)..(241): Pfam Id: NAD_binding_4 Pfam Desc: Male sterility protein
  misc_feature (11)..(149): Pfam Id: adh_short Pfam Desc: short chain dehydrogenase
  misc_feature (11)..(157): Pfam Id: KR Pfam Desc: KR domain
  misc_feature (13)..(324): NCBI GI: 145337634 NCBI Desc: cinnamoyl-coa reductase [arabidopsis thaliana]
  misc_feature (12)..(317): NCBI GI: 9998901 NCBI Desc: cinnamoyl-coa reductase [populus balsamifera subsp. trichocarpa]
  misc_feature (12)..(317): NCBI GI: 40233135 NCBI Desc: cinnamoyl coa reductase [populus tomentosa]
  misc_feature (12)..(317): NCBI GI: 2960364 NCBI Desc: cinnamoyl coa reductase [populus balsamifera subsp. trichocarpa]
  misc_feature (5)..(317): NCBI GI: 7239228 NCBI Desc: cinnamoyl coa reductase; ccr [populus tremuloides]
  misc_feature: Useful for making plants with altered Lignin content
  misc_feature: Useful for making plants with altered cell wall content and/or composition
  misc_feature: Functional homolog of the protein sequence given in SEQ ID NO 13345
  misc_feature: Functional homolog of the protein sequence encoded by LOCUS at2g33600
  misc_feature: Useful for making plants with altered carbohydrate content
  misc_feature: Functional homolog of the protein sequence given in SEQ ID NO 13643
MVACQGETATTTVCVTGAGGFIASWLVQRLLSSGSYVVHGAVRDPSDPKYAHLMALDGAVERLRLFKADMLDHAGVAAAVAGCDGVFHVASPVPASKPADPELEVVAPAVDGTRNVLRACHEANVRRVVVVSSVAAIAVNPNCRNGVVLDEEWWSDEDFCRTIKGWYFLSKTLAERAAFAYAKETGLDVVSVCPSWCLGPLLQPTVNNSSLTLIDYLKGDRDTVDDKMKNVVDVRDVAEALVLVYETPEASGRYICRSYPMSMTEILDIIKSFYPNLSYPNNFVKVQDERMFTSKKLQALGWSYRPAEETFKDTVKSYKNAAILNF

SEQ ID NO: 2857 - DNA, 1197 bp, Sorghum bicolor
  misc_feature: Ceres ANNOT ID no. 6026596
  misc_feature: Encodes the peptide sequence at SEQ ID NO 2858
atgagtatctcaggggagcttcgcggcgaaggaggatctgacggtgaggaggaggtcttcattaacgaggaggacatcatccacgagataactatcgacgacgaagatctccccgaccgcgacgaagaagatgacgacgttggcgatgggatggttgactcagaagacgtcgatgattctacatacacatttcaaggccacaaagacgaagtcttcactgttgcatgcagtcctacggatgcatcacttgtggcttctggaggcaaagatgataggggatttctgtggaggattggatcacaagagggtgccctggagctgactggacataaggatactgttggcgcagtggctttcagttcagatgggaatttgttggcttctggaagttttgacgggcaaataaatgtgtggaatacagctacacgaactctcaagggaacccttgagggttctgggtcaggttttgagtggcttaaatggcatcctcggggacatttgataatcgcaggatcagaggattgtaatgtatggatgtggaatgctgaccataatgccattctaaatacctttgctggacacagtaacacagtgacatgtggtgattttactccagatggtaaactcatatgtacgggatcggatgatgcatctttgaggatatgggacccaagaagtgcacaaagcagacatgttgttcgaggccatggctatcattctgatggattgacatgcttatcaatgacttcggattcacaaatggttgttagcggctccaaggacagttctgtgcacattgtgaatgtaaactcaggcctggtcgttggctcattagtaggccacaccaattccattgagtgtgttggtatctcgtcaagctatggctgggtagctacagggagcatggatcaaaagctgatcatctgggacctcacacgccaatccagccgatgcatttgtgaacatgatgagggcgtgacatcactggcatggctaggttcgtcaaggtacgttgcgtcaggatgcattgacggcaaggtgcgcatctgggacagcctctctggggactgcgccagggagttcagtgggcatgcagatgtagtgcagtcactggctatcactgccgacggcaacaccatggtctccgcctcatcagatggctccgcccgtgtgtttgacatctccatgttcaagtga

SEQ ID NO: 2858 - protein, 398 aa, Sorghum bicolor
  misc_feature: Ceres ANNOT ID no. 6026596
  misc_feature (58)..(97): Pfam Id: WD40 Pfam Desc: WD domain, G-beta repeat
  misc_feature (101)..(139): Pfam Id: WD40 Pfam Desc: WD domain, G-beta repeat
  misc_feature (143)..(181): Pfam Id: WD40 Pfam Desc: WD domain, G-beta repeat
  misc_feature (185)..(223): Pfam Id: WD40 Pfam Desc: WD domain, G-beta repeat
  misc_feature (272)..(310): Pfam Id: WD40 Pfam Desc: WD domain, G-beta repeat
  misc_feature (313)..(351): Pfam Id: WD40 Pfam Desc: WD domain, G-beta repeat
  misc_feature (355)..(393): Pfam Id: WD40 Pfam Desc: WD domain, G-beta repeat
  misc_feature (1)..(235): NCBI GI: 50872460 NCBI Desc: wd domain, g-beta repeat containing protein [oryza sativa (japonica cultivar-group)]
  misc_feature (14)..(310): NCBI GI: 7239511 NCBI Desc: contains similarity to the vegetative incompatibility protein het-e-1 from podospora ansering gi3023956; it contains 5 wd40 domains pf00400. [arabidopsis thaliana]
  misc_feature (24)..(392): NCBI GI: 50418219 NCBI Desc: mgc80037 protein [xenopus laevis]
  misc_feature (27)..(392): NCBI GI: 31044189 NCBI Desc: angio-associated migratory cell protein [canis familiaris]
  misc_feature (27)..(392): NCBI GI: 62899712 NCBI Desc: angio-associated migratory cell protein
  misc_feature: The sequence is a functional homolog of SEQ ID NO. 502 in the 11/188,298 US application
  misc_feature: The sequence is a functional homolog of SEQ ID NO. 485 in the 11/188,298 US application
MSISGELRGEGGSDGEEEVFINEEDIIHEITIDDEDLPDRDEEDDDVGDGMVDSEDVDDSTYTFQGHKDEVFTVACSPTDASLVASGGKDDRGFLWRIGSQEGALELTGHKDTVGAVAFSSDGNLLASGSFDGQINVWNTATRTLKGTLEGSGSGFEWLKWHPRGHLIIAGSEDCNVWMWNADHNAILNTFAGHSNTVTCGDFTPDGKLICTGSDDASLRIWDPRSAQSRHVVRGHGYHSDGLTCLSMTSDSQMVVSGSKDSSVHIVNVNSGLVVGSLVGHTNSIECVGISSSYGWVATGSMDQKLIIWDLTRQSSRCICEHDEGVTSLAWLGSSRYVASGCIDGKVRIWDSLSGDCAREFSGHADVVQSLAITADGNTMVSASSDGSARVFDISMFK

SEQ ID NO: 2859 - DNA, 891 bp, Sorghum bicolor
  misc_feature: Ceres ANNOT ID no. 6026603
  misc_feature: Encodes the peptide sequence at SEQ ID NO 2860
atgggcagcggcggcggcggcaggaatggtgctgtagcgaggcggtacatccggtccaaggagccccggatgaggtggagcgccgacctccaccgtagcttcctgcaggccatagactgcctcggcggccaacacaaggctacgcccaagctcattctccagttcatgggcgtcaaggagcttaccatatctcatgtcaagagccatctccagatgcacagagctgcgaggcttggcgcaggaagaggaggcccagggatgcaaaggaggcactcatgcaccggtgatgagcaaggtcccaaggaggaggagttcctgtgcccaccaccacctttgaaaagggtccggatggggtacgacgagagcatgcagggaagccatggagtcagtgatgcgaggactactgcagctgctgctgggggcctgtactgcatcgatgattacatgcaagccatggcctccatgggcaggagaataaaggaggagggcctcatcagatggcagaggagggacgctgctgctgatgctcctgcgaccattgctgctgctacgccttccaacctccaagccatgggatgtttggtgcaagaatctgacccctttaaggatgcctccaacaaagaggacggaagcggatgccccctcttcagtagcttcagcattgcagccaaggacgagccatccgagcagtgctcactctcgctgtcccttggtctggacccaagatgcgcccgtgccatgacagcagcctcctcgccaagcggcgagagcagctgcatcctcatggcctcgccggagaggaggagctccagcgactgctccggccattcaggctgctttgtcggaccgggtgttagcctggagctttcgctgtccatctgtggatcctag

SEQ ID NO: 2860 - protein, 296 aa, Sorghum bicolor
  misc_feature: Ceres ANNOT ID no. 6026603
  misc_feature (23)..(74): Pfam Id: Myb_DNA-binding Pfam Desc: Myb-like DNA-binding domain
  misc_feature (1)..(78): NCBI GI: 7527727 NCBI Desc: t5e21.10 [arabidopsis thaliana]
  misc_feature (1)..(78): NCBI GI: 79344640 NCBI Desc: dna binding / transcription factor [arabidopsis thaliana]
  misc_feature (2)..(78): NCBI GI: 115483751 NCBI Desc: os11g0106100 [oryza sativa (japonica cultivar-group)]
  misc_feature (2)..(82): NCBI GI: 92871144 NCBI Desc: homeodomain-related [medicago truncatula]
  misc_feature (14)..(78): NCBI GI: 140057815 NCBI Desc: homeodomain-related [medicago truncatula]
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1857 in the 10/374,780US patent application
  misc_feature: The sequence is a functional homolog of SEQ ID NO 256 in the 10/666,642US patent application
  misc_feature: Useful for making plants with modulated growth and phenotype characteristics
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 256 in the 20070033671 US patent application
MGSGGGGRNGAVARRYIRSKEPRMRWSADLHRSFLQAIDCLGGQHKATPKLILQFMGVKELTISHVKSHLQMHRAARLGAGRGGPGMQRRHSCTGDEQGPKEEEFLCPPPPLKRVRMGYDESMQGSHGVSDARTTAAAAGGLYCIDDYMQAMASMGRRIKEEGLIRWQRRDAAADAPATIAAATPSNLQAMGCLVQESDPFKDASNKEDGSGCPLFSSFSIAAKDEPSEQCSLSLSLGLDPRCARAMTAASSPSGESSCILMASPERRSSSDCSGHSGCFVGPGVSLELSLSICGS

SEQ ID NO: 2861 - DNA, 1800 bp, Sorghum bicolor
  misc_feature: Ceres ANNOT ID no. 6026619
  misc_feature: Encodes the peptide sequence at SEQ ID NO 2862
atggcatcgaattcatcggcggcggcgttctttggcgttagggatggggaccagcaagaccagattaagccgctgatatcaccgcagcagcagctggcagcggcgctgcccggcgtggcaggcgctgtgcctgcggcgtccggccaaggcgcgccgaccgcggcggcgccgcagccaccgcccaagaagaagaggactatgcccgaccccgacgctgaggtgatcgcgctgtcgcccaagacgctgctggcgacgaaccggttcgtgtgcgaggtgtgcaacaaggggttccagcgggagcagaacctgcagctgcaccgtcgcgggcacaacctgccgtggaagctgaagcagaagaacccgctgcaggcgcagcggcggcgcgtgtacctgtgcccggagccgacgtgcgtgcaccacgacccggcgcgcgccctcggcgacctgacggggatcaagaagcacttctgccgcaagcacggcgagaagaagtggaagtgcgacaagtgctccaagcgctacgccgtgcagtcggactggaaggcgcactccaagatctgcggcacccgcgagtaccgatgcgactgcggcacactcttctccaggagggacagcttcatcacgcaccgggcgttctgcgatgccctggcgcaggaaagcgcgcggctgccgccgacgagcctcagcagcctcaccagccacctctacggcgccaccaacgcgggcaacatggcgctcagcctctcgcaggtgggctcccacctcacctccactctccaggacggccaccaccaccacccgtccccggagctcctccgactcggcgccgcggccggcggcggcggcagcagcatcgccgcgcgcctcgaccacctcctgtcgcccaacggtgcgtccgccttccgctcgccgcaggctccgccgtcgtcggcgtccttcttcctcaacgcgggggcatcggtcgggcaggactttggggacgacgcgggcaatgggccgcactcgtacctgcaggccaacaagcctttccatgggctcatgcagctccccgacctccaaggcaacggtgctgggggccctggcgcctcaggccccagcctcttcaacctgggtttctttgctaacaatggcaacagctcggggtccagtcacgagcatgcaagccaggggctcatgaacaacgaccagttcagtggcggggcaggtggaggcggtggcggcgggggctcggaggtatcggcggcggggatttttggcggcaacttcgttggtggtggagatcaagttccaccgccggggctctacagtgatcaagcctccatgctgccgcagatgtcggcgaccgctctgctgcagaaggcggcgcagatgggcgcgacctcgagcaccaacggcggcgcggcatccatgttccgaggcttcgtgggctcttcttcccctcacgtgcggccggcgacgccgcacatggaacagagcgacgcgaacctgaacgacctgatgaactcgctcgctggaggtggcgtcggcggcggaggaatgttcggcggcggcaacggcgccgtcagcgcggggatgtttgaccccaggcagctgtgcaacatggcggagcacgaggtgaagttcgggcagggtggcggagacatgacacgggacttccttggcgtcggcggaggcggcatcgtgcgcgggatatcgacgccgagaggaggaggaggagaccaccagagcagcagcgatatgagctccctggaggccgagatgaagtcggcctcgtccttcaacggtggcaggatgccatga

SEQ ID NO: 2862 - protein, 599 aa, Sorghum bicolor
  misc_feature: Ceres ANNOT ID no. 6026619
  misc_feature (88)..(110): Pfam Id: zf-C2H2 Pfam Desc: Zinc finger, C2H2 type
  misc_feature (1)..(599): NCBI GI: 55418544 NCBI Desc: indeterminate-related protein 9 [zea mays]
  misc_feature (1)..(598): NCBI GI: 50251918 NCBI Desc: finger protein pcp1-like [oryza sativa (japonica cultivar-group)]
  misc_feature (1)..(530): NCBI GI: 55418540 NCBI Desc: indeterminate-related protein 10 [zea mays]
  misc_feature (1)..(360): NCBI GI: 38344265 NCBI Desc: osjnba0005n02.2 [oryza sativa (japonica cultivar-group)]
  misc_feature (59)..(264): NCBI GI: 55418546 NCBI Desc: indeterminate-related protein 1 [zea mays]
  misc_feature: The sequence is a functional homolog of SEQ ID NO 1074 in the 10/666,642US patent application
  misc_feature: The sequence is a functional homolog of SEQ ID NO 1075 in the 10/666,642US patent application
  misc_feature: The sequence is a functional homolog of SEQ ID NO 1076 in the 10/666,642US patent application
  misc_feature: The sequence is a functional homolog of SEQ ID NO 1077 in the 10/666,642US patent application
  misc_feature: The sequence is a functional homolog of SEQ ID NO 1078 in the 10/666,642US patent application
  misc_feature: The sequence is a functional homolog of SEQ ID NO 1079 in the 10/666,642US patent application
  misc_feature: The sequence is a functional homolog of SEQ ID NO 1086 in the 10/666,642US patent application
  misc_feature: The sequence is a functional homolog of SEQ ID NO 1087 in the 10/666,642US patent application
  misc_feature: The sequence is a functional homolog of SEQ ID NO 1785 in the 10/374,780US patent application
  misc_feature: Useful for making plants with modulated growth and phenotype characteristics
  misc_feature: The sequence is a functional homolog of SEQ ID NO 1785 in the 20060162006 US patent application
  misc_feature: The sequence is a functional homolog of SEQ ID NO 1074 in the 20070033671 US patent application
  misc_feature: The sequence is a functional homolog of SEQ ID NO 1075 in the 20070033671 US patent application
  misc_feature: The sequence is a functional homolog of SEQ ID NO 1076 in the 20070033671 US patent application
  misc_feature: The sequence is a functional homolog of SEQ ID NO 1078 in the 20070033671 US patent application
  misc_feature: The sequence is a functional homolog of SEQ ID NO 1079 in the 20070033671 US patent application
  misc_feature: The sequence is a functional homolog of SEQ ID NO 1086 in the 20070033671 US patent application
  misc_feature: The sequence is a functional homolog of SEQ ID NO 1087 in the 20070033671 US patent application
  misc_feature: The sequence is a functional homolog of SEQ ID NO 1087 in the 10/666,642 US patent application
  misc_feature: Useful for making plants with altered lignin content
  misc_feature: Functional homolog of the protein sequence given in SEQ ID NO 13275
  misc_feature: The sequence is a functional homolog of SEQ ID NO. 455 in the 11/188,298 US application
MASNSSAAAFFGVRDGDQQDQIKPLISPQQQLAAALPGVAGAVPAASGQGAPTAAAPQPPPKKKRTMPDPDAEVIALSPKTLLATNRFVCEVCNKGFQREQNLQLHRRGHNLPWKLKQKNPLQAQRRRVYLCPEPTCVHHDPARALGDLTGIKKHFCRKHGEKKWKCDKCSKRYAVQSDWKAHSKICGTREYRCDCGTLFSRRDSFITHRAFCDALAQESARLPPTSLSSLTSHLYGATNAGNMALSLSQVGSHLTSTLQDGHHHHPSPELLRLGAAAGGGGSSIAARLDHLLSPNGASAFRSPQAPPSSASFFLNAGASVGQDFGDDAGNGPHSYLQANKPFHGLMQLPDLQGNGAGGPGASGPSLFNLGFFANNGNSSGSSHEHASQGLMNNDQFSGGAGGGGGGGGSEVSAAGIFGGNFVGGGDQVPPPGLYSDQASMLPQMSATALLQKAAQMGATSSTNGGAASMFRGFVGSSSPHVRPATPHMEQSDANLNDLMNSLAGGGVGGGGMFGGGNGAVSAGMFDPRQLCNMAEHEVKFGQGGGDMTRDFLGVGGGGIVRGISTPRGGGGDHQSSSDMSSLEAEMKSASSFNGGRMP

SEQ ID NO: 2863 - DNA, 1281 bp, Sorghum bicolor
  misc_feature: Ceres ANNOT ID no. 6026632
  misc_feature: Encodes the peptide sequence at SEQ ID NO 2864
atgggattcgacaaggaggcgagctcctcgtcctcgcggctcgacgcggcgccgctgctcccgcagcacgggctgcacggcggcggcggcggcggcgggcacctgtcgtcgcagcccaagacgttcgccaacgtcttcatcgccgtcgtcggctcgggcgtgctgggcctcccctacaccttctcccgcacgggctgggcggcggggacgctgctcctcctcgccgtcgccgcgctcaccttccactgcatgatgctcctcgtcgccacacgccgccggatcgccgacgagcaccccaagatcgcctccttcggggacctgggccacgccgtctacggcgcgcccgggcgccacgcggtggacgccatgctcgtgctcagccaggccagcttctgcgtcggctacctgatcttcatctccaacaccatggcgcacctttaccccatcggggccgagtccccggcgtccccgctcctcacggccaaggcgctcttcatctgggccatgctgccgttccagctgggactcaactccatcaagacgctcacgctcctcgcgccgctcagcatctttgccgacgtcgttgacctcggagccatgggcgtcgtccttggccaggacgcctcaatctggctcgccaacaagccccccgtgttcgccttcgctggccccgccgagctcctctacggcctcggcgtcgccgtctacgccttcgaggggatcggcatggtgctgccgctggaggcggaggccgcggacaagcgaaggttcggcgccacgctcgcgctgtccatggcgttcatcgccgtcatgtacgggctgttcggcgccatgggctacctcgcctttggcgccgccacgcgggacatcatcaccaccaacctcggcaccggctggctctcggtccttgtacagctcggcctctgcatcaacctcttcttcaccatgccggtgatgatgaacccggtgtacgaggtcgccgagcgcctgctctgtggcaagcgctacgcctggtggctgcgctggatacttgtcgtggtcgtcgggctcctggcgatgctcgtgcccaacttcgccgacttcctctcgctcgttggcagcagcgtctgcgtcgtgctcggattcgtgctgcccgctacgttccacctcaaggttttcggcgcagagatcgggtggactgggctcgtcgccgacgtggccgttatcgtaatcgggactgtgctcgcggtgtccgggacatggacgtcacttgtacaaatcttcagttcttccaacctgtaa

SEQ ID NO: 2864 - protein, 426 aa, Sorghum bicolor
  misc_feature: Ceres ANNOT ID no. 6026632
  misc_feature (34)..(418): Pfam Id: Aa_trans Pfam Desc: Transmembrane amino acid transporter protein
  misc_feature (1)..(426): NCBI GI: 38345408 NCBI Desc: osjnba0017b10.14 [oryza sativa (japonica cultivar-group)]
  misc_feature (204)..(426): NCBI GI: 115459950 NCBI Desc: os04g0565500 [oryza sativa (japonica cultivar-group)]
  misc_feature (1)..(423): NCBI GI: 10177114 NCBI Desc: amino acid transporter protein-like [arabidopsis thaliana]
  misc_feature (30)..(421): NCBI GI: 30688867 NCBI Desc: amino acid transporter family protein [arabidopsis thaliana]
  misc_feature (84)..(423): NCBI GI: 40823279 NCBI Desc: at5g65990 [arabidopsis thaliana]
  misc_feature: Useful for making plants with modulated nitrogen use efficiency
  misc_feature: Useful for making plants with modulated nitrogen use efficiency
  misc_feature: GREAT-hit functional homolog of the protein sequence given in SEQ ID NO 13145
  misc_feature: Useful for making plants with modulated nitrogen use efficiency
  misc_feature: Functional homolog of the protein sequence given in SEQ ID NO 13145
  misc_feature: The sequence is a functional homolog of SEQ ID NO. 438 in the 11/188,298 US application
  misc_feature: The sequence is a functional homolog of SEQ ID NO. 313 in the 11/188,298 US application
MGFDKEASSSSSRLDAAPLLPQHGLHGGGGGGGHLSSQPKTFANVFIAVVGSGVLGLPYTFSRTGWAAGTLLLLAVAALTFHCMMLLVATRRRIADEHPKIASFGDLGHAVYGAPGRHAVDAMLVLSQASFCVGYLIFISNTMAHLYPIGAESPASPLLTAKALFIWAMLPFQLGLNSIKTLTLLAPLSIFADVVDLGAMGVVLGQDASIWLANKPPVFAFAGPAELLYGLGVAVYAFEGIGMVLPLEAEAADKRRFGATLALSMAFIAVMYGLFGAMGYLAFGAATRDIITTNLGTGWLSVLVQLGLCINLFFTMPVMMNPVYEVAERLLCGKRYAWWLRWILVVVVGLLAMLVPNFADFLSLVGSSVCVVLGFVLPATFHLKVFGAEIGWTGLVADVAVIVIGTVLAVSGTWTSLVQIFSSSNL

SEQ ID NO: 2865 - DNA, 1290 bp, Sorghum bicolor
  misc_feature: Ceres ANNOT ID no. 6026633
  misc_feature: Encodes the peptide sequence at SEQ ID NO 2866
atggaattcgacaaagaggcgagctcctcgtcctcgcggctcgacgcggcgccgctactcccgcagtacgggctgcactgcggcggcgccggggccggcgcgggcgggcacctgtcgtcgcagcccaagacgttcgccaacgtcttcatcgccgtcgtcggcacgggcgtgctgggcctcccctacaccttctcccgcacgggctgggcggcggggacgctgctcctcctcgccgtcgccgcgctcaccttccactgcatgatgctcctcgtcgccacgcgccgccggatcgccgacgagcacaccaagatcgcctccttcggggacctgggccacggcatctacggcgccccgggccgccacgcggtcgacgccatgctcgttctcagccaggtcagcttctgcgtcggctacgtaatcttcatctccaacaccatggcgcacctatacccgatcgtggccgactccccggcgtccccgctcctcacggccaaggcgctcttcatctgggccatgctgccgttccagctgggactcaactccatcaagacgctcacgctcctcgcgccgctcagcatcttcgccgacgtcgttgacctcggcgccatgggcgtcgtactgagccaggacgcctccatctggctcgccaacaagcctcccgtgttcgccttcgctggccctgccgagctcctctacggccttggcgtcgccgtctacgccttcgaggcgatcggaatggtcctgccgctggaggcggaggctgcggacaagcgcaggttcggcgccacgctcgcgctgtccatggcgttcatcgccgtcatgtacgttctgttcggcgccatgggctacctcgccttcggctccgccacgcgggacatcatcaccaccaacctcggtaccggctggttctcggtcctcgtgcagctcggcctatgcatcagcctcttcttcgcgatgccggtgtcgatgaacccggtctacgaggtcgccgagcgcctgatctgcggcaggcgctacgcctggtggctgcgctggatcctcgtcgtggtcgtcgggctcctggcgatgctcgtgcccaacttcgctgacttcatctcgctcgtcggcagcagcgtctgcgtcgtgctcttgttcgtgctgcccgccgccttccacatcaaggtcttcggcgctgagatcgggtggaccgggctcgtcggcgacgtgaccgtcatcgttatcgggattgcgctcgcggtgttcgggacatggacgtcccttgtacaaatcttcagttcttctaacgtgtaa

SEQ ID NO: 2866 - protein, 429 aa, Sorghum bicolor
  misc_feature: Ceres ANNOT ID no. 6026633
  misc_feature (37)..(421): Pfam Id: Aa_trans Pfam Desc: Transmembrane amino acid transporter protein
  misc_feature (1)..(429): NCBI GI: 38345408 NCBI Desc: osjnba0017b10.14 [oryza sativa (japonica cultivar-group)]
  misc_feature (220)..(429): NCBI GI: 115459950 NCBI Desc: os04g0565500 [oryza sativa (japonica cultivar-group)]
  misc_feature (1)..(426): NCBI GI: 10177114 NCBI Desc: amino acid transporter protein-like [arabidopsis thaliana]
  misc_feature (33)..(424): NCBI GI: 30688867 NCBI Desc: amino acid transporter family protein [arabidopsis thaliana]
  misc_feature (87)..(426): NCBI GI: 40823279 NCBI Desc: at5g65990 [arabidopsis thaliana]
  misc_feature: Useful for making plants with modulated nitrogen use efficiency
  misc_feature: Useful for making plants with modulated nitrogen use efficiency
  misc_feature: GREAT-hit functional homolog of the protein sequence given in SEQ ID NO 13145
  misc_feature: Useful for making plants with modulated nitrogen use efficiency
  misc_feature: Functional homolog of the protein sequence given in SEQ ID NO 13145
  misc_feature: The sequence is a functional homolog of SEQ ID NO. 438 in the 11/188,298 US application
  misc_feature: The sequence is a functional homolog of SEQ ID NO. 313 in the 11/188,298 US application
MEFDKEASSSSSRLDAAPLLPQYGLHCGGAGAGAGGHLSSQPKTFANVFIAVVGTGVLGLPYTFSRTGWAAGTLLLLAVAALTFHCMMLLVATRRRIADEHTKIASFGDLGHGIYGAPGRHAVDAMLVLSQVSFCVGYVIFISNTMAHLYPIVADSPASPLLTAKALFIWAMLPFQLGLNSIKTLTLLAPLSIFADVVDLGAMGVVLSQDASIWLANKPPVFAFAGPAELLYGLGVAVYAFEAIGMVLPLEAEAADKRRFGATLALSMAFIAVMYVLFGAMGYLAFGSATRDIITTNLGTGWFSVLVQLGLCISLFFAMPVSMNPVYEVAERLICGRRYAWWLRWILVVVVGLLAMLVPNFADFISLVGSSVCVVLLFVLPAAFHIKVFGAEIGWTGLVGDVTVIVIGIALAVFGTWTSLVQIFSSSNV

SEQ ID NO: 2867 - DNA, 1017 bp, Sorghum bicolor
  misc_feature: Ceres ANNOT ID no. 6026639
  misc_feature: Encodes the peptide sequence at SEQ ID NO 2868
atggacaccgccgtctccaccctcaccgctctcgccatcttcgcgagaccgtcgagcacggtcgccgcctacaggagcgtgcacgggtacagggtggtcgggaggaaacgcggcgggtgggttcggtgggagaggtgggtggagcggcagttcgtcctctccctctccttcccaccgtgcctcgaggtcgccctgcccgccgccgcgccgcggatactgccagcggggtggcggacccggccggtgttccgcgagggacagaccgtggaggacacctggcgttgcattgtggcattcgactccgtcgccgccgtcgcaccgtcctccccgccgccgcccgtgctctcccccctcgtgaacccgcagctgcagtatctgcctaatctgtacaacgacctgctgaaggtgtttcagtttcaggaagagaaaaaggtctcacagctcgttaattcaaaaaagcaacccatccgttctggtgagcaggggaaaacttctgatctggctgatgcgtcggagtctgattcggaaggggattctcaatctgacaaagaacttgcaccaccagttcagaagcatataagagccaacaggaagcatatagatagcattactttagttgatatagctcagtacttccatcttccactccgagatgcatcaaagacactcaagatcggggtcagcatactgaagaggaaatgccgacaatatgggatagctcgttggccgcaccggaaaatcaagtcacttgactccctcattcatgaccttgagtacgtgctggcaagagaggacgacgaggaggaggagaagcagctgcagaaggagaggctggctgctgcgataacggccctcgcaaagcggaagagcatgctggaaagcgagaaggaaaccatacagcagaaaccgaccatggacttgatggctgaaaccaagctgttcagggaagatgttttcaagaggagatatagggccaaaagttcagtcatggatgatatggatttcggtatggtttag

SEQ ID NO: 2868 - protein, 338 aa, Sorghum bicolor
  misc_feature: Ceres ANNOT ID no. 6026639
  misc_feature (199)..(250): Pfam Id: RWP-RK Pfam Desc: RWP-RK domain
  misc_feature (4)..(332): NCBI GI: 38345397 NCBI Desc: osjnba0017b10.3 [oryza sativa (japonica cultivar-group)]
  misc_feature (156)..(332): NCBI GI: 115459932 NCBI Desc: os04g0564000 [oryza sativa (japonica cultivar-group)]
  misc_feature (197)..(326): NCBI GI: 51535558 NCBI Desc: pentatricopeptide (ppr) repeat-containing protein-like [oryza sativa (japonica cultivar-group)]
  misc_feature (197)..(326): NCBI GI: 115467224 NCBI Desc: os06g0228900 [oryza sativa (japonica cultivar-group)]
  misc_feature (202)..(267): NCBI GI: 119358851 NCBI Desc: rwp1 rwp-rk domain-containing protein (ic) [ostreococcus tauri]
MDTAVSTLTALAIFARPSSTVAAYRSVHGYRVVGRKRGGWVRWERWVERQFVLSLSFPPCLEVALPAAAPRILPAGWRTRPVFREGQTVEDTWRCIVAFDSVAAVAPSSPPPPVLSPLVNPQLQYLPNLYNDLLKVFQFQEEKKVSQLVNSKKQPIRSGEQGKTSDLADASESDSEGDSQSDKELAPPVQKHIRANRKHIDSITLVDIAQYFHLPLRDASKTLKIGVSILKRKCRQYGIARWPHRKIKSLDSLIHDLEYVLAREDDEEEEKQLQKERLAAAITALAKRKSMLESEKETIQQKPTMDLMAETKLFREDVFKRRYRAKSSVMDDMDFGMV

SEQ ID NO: 2869 - DNA, 2331 bp, Sorghum bicolor
  misc_feature: Ceres ANNOT ID no. 6026655
  misc_feature: Encodes the peptide sequence at SEQ ID NO 2870
atggggtgcaaggggtccaagctcgacgaccaggaggccgtcgcgctctgccgcgcgcgcgccgagctgctcgccgcggccgtccgccaccgctacgcgctcgccgacgcgcacgcggcgctcgcggactccatcgagtcggtcgccgcgccgctgcaccgcctcctccgtctgcagcaggcggccgagtcgccgccggggctcacgctgccctccgcgcgcaagggcggtggtggcgcgcccgccagccggctgccgcgctccttcgacacgtcgtctgcccacgcccattcctcgcgcctccagttcggcgcgtcgcccggatccgagccggcgtcgtcgccggccgaggccgactcgcctccgcgccgcgtccccgagcagctgcagcaaccgcacccgcacccgcattacgccgcgtacgggtacgagtacgactacgcgacgcagcccgcgtacgcgtacccggcgccggcgggctcgctgcagttctactacgctcgcagccgcccgccccccgcgtccgtcgccgtcacgcagcgcgcgccggggccgccggagcgcgtgcgcttcggctccttcgacgcgccgggcggctacccgcagcaccactacgcctacagcgcccagcgggccccggcaccgcctccggcagcgctgcagcgggcggctccgccttcgccgccgaaggcgagctcgtgggacttcctcaacgtgttcgagaactacgactcgtacgacagctactactacgactccgccacggcagctgctgcggccgcggcgccgtacacgccgagccggagctcgcgggaggtgcgcgaggaggagggcatcccggacctggaggacgacgacgatgaagacagcttggtcgtcaaagaggtggccgggcagtactcagcgcctgggagtggcggtgcccgcagccggcgcagctcgcttggcggtgtcagtagcaccgccgagctcgaccagccggagaatgttatcgcccacaaggacgtcatcggcgagttacggcgaaggccaacagcacatggtaatgtgtcggtgcacgctccaccacctcccgcgcggagggccgttgacaatgcgaatgtagctggcgaaatcaaggcacagcttgtgcgcacggccgaggcggctaggcagctcgcgccgatgctcgaagtcgggaggccaagctaccaaggccgcagctcagtctaccaatcttcctcgaagatgatgtcggctatctccgtagctcatttggggtgcaaagacatggacgtgttggacgtcggagtggtagggaagatggtggacacgcggagcctatcctcggcacttgagaagctctatttctgggagaggaagctgtataatgaggtcaaggctgaggagaaaatgcgcttacttattgccaaaaactccaagcgactgaaattattagatcaaaagggtgcagagcctcaaaagattgatgcaactcgaaatttgctgaggaagctttcaacaaagataaggatagctgtgcgtgttatagccaagatttcaagaaaaataaacaaattaagggatgaggaattgtggccgcaagtcaacgctttgatccaagggtttgtattaatgtggcatgataaattggactgttaccatagtcagtgtcaagtgatatcagaagccaaaaactttacttcagttttgtcaggtggaaatggccaggatttggtgttggagcttgaggtagagctgattaaatggatcatcagtttttcctcttgggtgaattcacaaagaaactttgttaaggcactgaatggatggctagcactctgtcttaattacgagcctgaggacaacactactggagttccaccttattcaccaggaagcataggtgctccattggtttttgttacctgcaacaaatggtctcaagccatggatcggatttctgagaaggatgtggttaacaccatgcaagctcttgtgtctagcgtgcggcacctgtgggagcagcagcatcttgagcaaagcgaacaaataatctcgattcgagaaagggaaaaatggatcaagattttggagaggaagacccaagagattaataaggaggcagatgaactaaacaggaagctggcgttaataccaagccggcagagactgcatgtgcctcggagtgtacaactgtacgaggcgcattgtgttgaggcaagtaacttgcacataaatctgaggctggttcttgaagctttagagaactttgctgccaattcattgcaagctttccaggatgtgtcaaaaagtgctgaagggacaaggctgccaagagataatgtgtag

SEQ ID NO: 2870 - protein, 776 aa, Sorghum bicolor
  misc_feature: Ceres ANNOT ID no. 6026655
  misc_feature (1)..(767): NCBI GI: 116310157 NCBI Desc: h0211b05.8 [oryza sativa (indica cultivar-group)]
  misc_feature (1)..(767): NCBI GI: 38345928 NCBI Desc: osjnbb0078d11.3 [oryza sativa (japonica cultivar-group)]
  misc_feature (192)..(767): NCBI GI: 115480511 NCBI Desc: os09g0547300 [oryza sativa (japonica cultivar-group)]
  misc_feature (192)..(767): NCBI GI: 52076014 NCBI Desc: bzip-related transcription factor -like [oryza sativa (japonica cultivar-group)]
  misc_feature (1)..(775): NCBI GI: 115477707 NCBI Desc: os08g0551200 [oryza sativa (japonica cultivar-group)]
  misc_feature: The sequence is a functional homolog of SEQ ID NO 1522 in the 11/479,226US patent application
  misc_feature: The sequence is a functional homolog of SEQ ID NO 174 in the 10/666,642US patent application
  misc_feature: Useful for making plants with modulated growth and phenotype characteristics
  misc_feature: The sequence is a functional homolog of SEQ ID NO 1522 in the 20070022495 US patent application
MGCKGSKLDDQEAVALCRARAELLAAAVRHRYALADAHAALADSIESVAAPLHRLLRLQQAAESPPGLTLPSARKGGGGAPASRLPRSFDTSSAHAHSSRLQFGASPGSEPASSPAEADSPPRRVPEQLQQPHPHPHYAAYGYEYDYATQPAYAYPAPAGSLQFYYARSRPPPASVAVTQRAPGPPERVRFGSFDAPGGYPQHHYAYSAQRAPAPPPAALQRAAPPSPPKASSWDFLNVFENYDSYDSYYYDSATAAAAAAAPYTPSRSSREVREEEGIPDLEDDDDEDSLVVKEVAGQYSAPGSGGARSRRSSLGGVSSTAELDQPENVIAHKDVIGELRRRPTAHGNVSVHAPPPPARRAVDNANVAGEIKAQLVRTAEAARQLAPMLEVGRPSYQGRSSVYQSSSKMMSAISVAHLGCKDMDVLDVGVVGKMVDTRSLSSALEKLYFWERKLYNEVKAEEKMRLLIAKNSKRLKLLDQKGAEPQKIDATRNLLRKLSTKIRIAVRVIAKISRKINKLRDEELWPQVNALIQGFVLMWHDKLDCYHSQCQVISEAKNFTSVLSGGNGQDLVLELEVELIKWIISFSSWVNSQRNFVKALNGWLALCLNYEPEDNTTGVPPYSPGSIGAPLVFVTCNKWSQAMDRISEKDVVNTMQALVSSVRHLWEQQHLEQSEQIISIREREKWIKILERKTQEINKEADELNRKLALIPSRQRLHVPRSVQLYEAHCVEASNLHINLRLVLEALENFAANSLQAFQDVSKSAEGTRLPRDNV

SEQ ID NO: 2871 - DNA, 1149 bp, Sorghum bicolor
  misc_feature: Ceres ANNOT ID no. 6026662
  misc_feature: Encodes the peptide sequence at SEQ ID NO 2872
atgatggccgccggccgcgcattcgtggtgctcattgtcctgtgctcgctgcccgtccagccgctgcaggcttgcgccacgaagaagcgcctcgtgccggcgatgttcgtgttcggggactccctggtggacgtcggcaacaacaaccacctgcccagcgtcaacaacagctgcaaagcgaactacccgccctacggcgtcgactaccccggccactcaccgaccggccgcttcagcaacggccacaacttggccgaccagctagctcagcagctggggtttgacgagagcccgccaccttttctctccctgaagaacgcgatggcgaggaggttcagtcggctgacgagcacgggcggcatcaacttcgcgtcaggagggtcggggctccttaatacgaccggcggcagtaaagtgtgtggcggccaggtggtttccatggccgagcaagtcggcaacttcaagagtctcgttcgggcgtgggcgagcaagaaaccgaaacggaaacaccgagcggcggcggtggccgacctcatctccaattcactcgtcttcatcagcgtcggcagcaacgacctgttcgagtacagtgatctcctcgcagatcctaatcacgaccccaacgttacccgcaacgacgccgcttttttgcaaggactcgttcatctttacgcggcctacgtgaaggacttgtacgccgccggggcaaccaagttcagcgtcaggaagatagccaatgagtcgaatgacatggacgtctccggctgcttcagcacggctaacagcctctccatgcagctataccccatgatcaactccatgctgcagaacctcagcgagaaggagctgcccggcatgaagtattccctcggagacgccaccgggatggcccgatatatattgggccagacgcctcccaacagcaacttcactacaaccgaccgcccgtgctgcggctcaaaggattacggcgacaccgggtgcaacacctcggttccgctgtgcggctaccggaaaagcttcttcttctgggacaggtaccatcccaccgaggcggcgtcggcgatcaccgcgacggagctcttcagcggcaacgagacctacgtccacccggtcaacgtgcagcagctggtggcgtcgcggccatga

SEQ ID NO: 2872 - protein, 382 aa, Sorghum bicolor
  misc_feature: Ceres ANNOT ID no. 6026662
  misc_feature (35)..(361): Pfam Id: Lipase_GDSL Pfam Desc: GDSL-like Lipase/Acylhydrolase
  misc_feature (6)..(377): NCBI GI: 140066637 NCBI Desc: lipolytic enzyme, g-d-s-l [medicago truncatula]
  misc_feature (27)..(377): NCBI GI: 54291019 NCBI Desc: gdsl-lipase-like [oryza sativa (japonica cultivar-group)]
  misc_feature (26)..(377): NCBI GI: 140066638 NCBI Desc: lipolytic enzyme, g-d-s-l [medicago truncatula]
  misc_feature (59)..(377): NCBI GI: 115470042 NCBI Desc: os06g0725200 [oryza sativa (japonica cultivar-group)]
  misc_feature (31)..(377): NCBI GI: 9759340 NCBI Desc: gdsl-motif lipase/acylhydrolase-like protein [arabidopsis thaliana]
MMAAGRAFVVLIVLCSLPVQPLQACATKKRLVPAMFVFGDSLVDVGNNNHLPSVNNSCKANYPPYGVDYPGHSPTGRFSNGHNLADQLAQQLGFDESPPPFLSLKNAMARRFSRLTSTGGINFASGGSGLLNTTGGSKVCGGQVVSMAEQVGNFKSLVRAWASKKPKRKHRAAAVADLISNSLVFISVGSNDLFEYSDLLADPNHDPNVTRNDAAFLQGLVHLYAAYVKDLYAAGATKFSVRKIANESNDMDVSGCFSTANSLSMQLYPMINSMLQNLSEKELPGMKYSLGDATGMARYILGQTPPNSNFTTTDRPCCGSKDYGDTGCNTSVPLCGYRKSFFFWDRYHPTEAASAITATELFSGNETYVHPVNVQQLVASRP

SEQ ID NO: 2873 - DNA, 1551 bp, Sorghum bicolor
  misc_feature: Ceres ANNOT ID no. 6026669
  misc_feature: Encodes the peptide sequence at SEQ ID NO 2874
atgtgctggtgcgcggccctcgtcgccggaggccggctgccaccgcccgccctcccctgccggctccgccgccgccgaaggagctccgtccgggcagaggtctcgccaggtggcgagtcccagcagaagaaggtcgccgtcgcgggcgccggctgggccggccttgccgccgcgcaccacctcatcaaacaggggtacgatgtcacgcttctcgccgcagagagcggcccaaccgaggaggttggcctcagaggattctggcatccgtaccgcaacatcttcgctttagtcgatgaactggggatttcgcctttcacgggctggaataaagcagcctactattctacagagggccttgttgaatttcccatatttcataaccagccccgattaccagctccctttggagtctttgcatatccagaattcccaaatcttcctttgattgataggctgacatcaattcctgtcatagctgcagtcattgactttgacaacactgacactgcttggaggaaatatgatgcaatgactgcaaaagaactttttaagatgtacggttgctctcaaaggctctacaaggaagtctttgagccagctattcaggctgccctgtttgctcctggcgagcaatgtagtgcagctgcaacactggggatgctgtactattatatgctgtctcatcaggaaagttctgacttcttgctgtgccgtggtgaagtagaagaaaaaattctctctccttggctgcaatcattggagcttaaaggtttaaaatttgtagaaaacaaagttccaacaagtttgactacagatgcggatactggatgcatctctgctattgtctgtggtgactatgtatatgaggcagatgcatttgtttcagccatgggactctcttctctacaatccatcgtcaaaaacaggaatcttcttcacttatctacactcgacgtgatctctgtaaaattatggtttgataaaaaggtcacaattccaaaggttgccaatgtatgttctggttttgatgattcgtctggctgggcattctttgacctaacctcaatacatgatgattataatgaagaatcaataacaattgtggaggctgaattttataatgctagccatttgatacttgtaaatgatgatgatattgtctctgaagcttcatcacatcttatcaaatgcatacaagattttgagggtgctattgtgataagatattcaatcagaagatctcctaattctgtaatcaactttcttccaggctcctacaagtacacactgagaggatcaacttcctttccaaatttgtttattgctggtgattggattgtcaaccgacatgggtccttttctaaagaaaaagcatatgtgactggacttgaagctgctaatagggtggtagactattttgacaccggggactttgccaaaataattgcaatcgaaggagatgagccccatatagagacattgcgtagtctcaacagaagagccaatgaactgaagtcacaaattccattctcagaattctttctccaataa

SEQ ID NO: 2874 - protein, 516 aa, Sorghum bicolor
  misc_feature: Ceres ANNOT ID no. 6026669
  misc_feature (52)..(470): Pfam Id: Amino_oxidase Pfam Desc: Flavin containing amine oxidoreductase
  misc_feature (1)..(515): NCBI GI: 116311132 NCBI Desc: b0103c08-b0602b01.15 [oryza sativa (indica cultivar-group)]
  misc_feature (1)..(515): NCBI GI: 38345844 NCBI Desc: osjnba0084k11.8 [oryza sativa (japonica cultivar-group)]
  misc_feature (223)..(515): NCBI GI: 115459894 NCBI Desc: os04g0560500 [oryza sativa (japonica cultivar-group)]
  misc_feature (76)..(509): NCBI GI: 75906593 NCBI Desc: amine oxidase [anabaena variabilis atcc 29413]
  misc_feature (75)..(515): NCBI GI: 23129880 NCBI Desc: cog3349: uncharacterized conserved protein [nostoc punctiforme pcc 73102]
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
  misc_feature: Functional homolog of the protein sequence given in SEQ ID NO 13578
MCWCAALVAGGRLPPPALPCRLRRRRRSSVRAEVSPGGESQQKKVAVAGAGWAGLAAAHHLIKQGYDVTLLAAESGPTEEVGLRGFWHPYRNIFALVDELGISPFTGWNKAAYYSTEGLVEFPIFHNQPRLPAPFGVFAYPEFPNLPLIDRLTSIPVIAAVIDFDNTDTAWRKYDAMTAKELFKMYGCSQRLYKEVFEPAIQAALFAPGEQCSAAATLGMLYYYMLSHQESSDFLLCRGEVEEKILSPWLQSLELKGLKFVENKVPTSLTTDADTGCISAIVCGDYVYEADAFVSAMGLSSLQSIVKNRNLLHLSTLDVISVKLWFDKKVTIPKVANVCSGFDDSSGWAFFDLTSIHDDYNEESITIVEAEFYNASHLILVNDDDIVSEASSHLIKCIQDFEGAIVIRYSIRRSPNSVINFLPGSYKYTLRGSTSFPNLFIAGDWIVNRHGSFSKEKAYVTGLEAANRVVDYFDTGDFAKIIAIEGDEPHIETLRSLNRRANELKSQIPFSEFFLQ

SEQ ID NO: 2875 - DNA, 1569 bp, Sorghum bicolor
  misc_feature: Ceres ANNOT ID no. 6026670
  misc_feature: Encodes the peptide sequence at SEQ ID NO 2876
atggcagcacttcttcctctgctgctcgcccacctactcctctgcgcccatggcgccaccgcgtcctcggccgcgacaccgccgcctctcccggtcctgcccgtcccgtcttacgcgcagctccggtggcagctctccgagatggcgctcttcctccacttcggccccaataccttcacggactccgagtggggcaccggccgcgccgacccctccgtgttcgccccctcggcactcgacgcgggccagtgggcgcgcgtcgcggcgcagggcgggttcggccgcgtcgtgctcacggccaagcaccacgacggtttctgcctctggccgtcggcgctgaccgactactcggtggccgcctcgccgtggcggggcggggctggggacgtcgtcgccgacctcgccgcagccgcgcgcgcggaggggatcgggctggggctgtacctctcgccgtgggaccgccatgagccggtgtacggggacaccatcgcgtacaacgagcattacttgggacagatgacggaactgctgaccaggtatggagatctagaggaaatttggctagatggtgcaaagggcgatgccaagaagatgaattatatgtttgatgcctggttttcacttatacatcagctacaacaaagggtagttatcttctcagatgctggaccagacactagatgggtgggagatgaggcaggagtcgcaggctatacttgctggtcccccttcaacaagagttccgtgacaattgggcataccattgctgaatactcacgcagtggggatccttttgggcaagactgggttcctgcagaatgtgatgtttccatcagaccaggttggttctggcatgcctcagagaaaccaaaaaatgcgacaactctgcttgacatatactacaaatcagttggtagaaattgtctcctcattttgaatgtccctcccaattcatctggcctcattgccaatgaagacatactagtccttcaggaattcactgggattcggcatgcaattttctcgcaaaactttgctgctaatgccactgtcacagcaaacagtgtgcgtggtgggcaagataatctgcagtttgcaccatccaaagtgcttgaagatggcatatactcctactgggctccacaggaaggtcaaacctgctgggaaatgctcttcgaccttgggcgatctacttccttcaacatgctccagctccaggagcctatacaactggggcagcgtgttattgagtttcatgtggctatcctcatagatgaactatggcaaacaattgttgaaggcacgacaatcggatacaagagactgcttctatttccagtcgttgaatctcggtacctgaagctttccatcgacagtgcacgcgcagatccacttatctcgttctttggtgtcttcatggatcccttctcgtccagacatagtttacagaatcatgtcaaaccaccccgcacaaacagtagcgacgttacaatgttgaggatggcccatgcttctgtcaacaagatctgccctggccaattcaacatgccagaaccacttgcacgttga

SEQ ID NO: 2876 - protein, 522 aa, Sorghum bicolor
  misc_feature: Ceres ANNOT ID no. 6026670
  misc_feature (7)..(381): Pfam Id: Alpha_L_fucos Pfam Desc: Alpha-L-fucosidase
  misc_feature (1)..(508): NCBI GI: 116311131 NCBI Desc: b0103c08-b0602b01.14 [oryza sativa (indica cultivar-group)]
  misc_feature (1)..(508): NCBI GI: 38345843 NCBI Desc: osjnba0084k11.7 [oryza sativa (japonica cultivar-group)]
  misc_feature (28)..(476): NCBI GI: 140066202 NCBI Desc: glycoside hydrolase, family 29 (alpha-l-fucosidase); galactose-binding like [medicago truncatula]
  misc_feature (35)..(477): NCBI GI: 110674119 NCBI Desc: calx-beta domain protein [clostridium perfringens atcc 13124]
  misc_feature (35)..(477): NCBI GI: 110684178 NCBI Desc: fuca [clostridium perfringens sm101]
  misc_feature (19)..(487): SWISSPROT Homolog: EC 3.2.1.51 Alpha-L-fucosidase 1 precursor
MAALLPLLLAHLLLCAHGATASSAATPPPLPVLPVPSYAQLRWQLSEMALFLHFGPNTFTDSEWGTGRADPSVFAPSALDAGQWARVAAQGGFGRVVLTAKHHDGFCLWPSALTDYSVAASPWRGGAGDVVADLAAAARAEGIGLGLYLSPWDRHEPVYGDTIAYNEHYLGQMTELLTRYGDLEEIWLDGAKGDAKKMNYMFDAWFSLIHQLQQRVVIFSDAGPDTRWVGDEAGVAGYTCWSPFNKSSVTIGHTIAEYSRSGDPFGQDWVPAECDVSIRPGWFWHASEKPKNATTLLDIYYKSVGRNCLLILNVPPNSSGLIANEDILVLQEFTGIRHAIFSQNFAANATVTANSVRGGQDNLQFAPSKVLEDGIYSYWAPQEGQTCWEMLFDLGRSTSFNMLQLQEPIQLGQRVIEFHVAILIDELWQTIVEGTTIGYKRLLLFPVVESRYLKLSIDSARADPLISFFGVFMDPFSSRHSLQNHVKPPRTNSSDVTMLRMAHASVNKICPGQFNMPEPLAR

SEQ ID NO: 2877 - DNA, 2427 bp, Sorghum bicolor
  misc_feature: Ceres ANNOT ID no. 6026671
  misc_feature: Encodes the peptide sequence at SEQ ID NO 2878
atgtccgagcaggcgccaccttacgctcccctccccctcgtctcctcccttgccccagatcctagctctaccccgtcaccgaaccctacccttgtcctccccaatcctgtcttccccaacaagcgcaagcgcaccggattccgccgcaaagtaccctccggggcccccgccgcccatgccccctctcccgtggctccctcgcagccacctccccccgcctccgccgccgacgatatcatagtgatcaaccgtgagccgaccgcggaggccgtcaccgctctcaccgccggcttcccggcggactcgctcactgacgaggagatcgaggcgggcgttgtctccgacgttggcggcatcgagcaggtcaattacatcctcatccgcaaccacctcctctgccggtggcgcgagacctacaactcctggctcgccaaggagcccttcgcgacgctcatccctccccactgcgagcacctcctcaccgccgcctactccttcctcgtctcaaatagctacatcaatttcggcgtcgccccagccatcaaggagcgaatacccaaggagccaacgagacccaccaccgtcatcgtggtaggcgctggccttgctgggctagctgctgcacggcagctggtggcgttcgggttcaaagtgatcgtcctggaaggtcgcaaaaggtgtggtggccgtgtgtacactaagaagatggaaggcggtgggcgcatggctgctgctgaccttggcggcagcgtgcttaccgggacatttgggaacccgctaggaattgtggcgaagcaactcggcttgccaatgcacaaaattagagacaagtgtccactctaccggccggatggatcaccagttgatccagaggtggataagaacgtggagattacatttaacaagcttcttgacaaatcaagcaacctgcgggcatcaatgggggaggtggcagtggatgtttcacttggggcggctctagagacattgcgccaggctgatgggggcgtctctacacaggaggagatgaacttgttcaattggcatctcgcaaatcttgagtatgccaatgcaggattgctgtctagactaagccttgcgttctgggatcaggatgatccatatgacatgggtggggatcactgcttcttgcctggtggcaatggcaaacttgtgcaagccctggcagagaatgtagcaattgtttacgagaggacggtgcacactataaggtatggaggggatggggtgcaggtggttgtcaatggagggcaggtgtatgaaggggacatggcattgtgcacagttccacttggggttctgaaaaatggaggcatcaagtttgtaccggagttaccacagaggaagcttgatagtatcaagaggcttggtttcggattgttgaacaaggtatcaatgttgtttccacatgttttctggagtactgatcttgatacctttgggcatctggttgaagatccaaggcgacgtggggagttctttctgttctatagctatgcaacagtggctggtggtccattgttgatggccttggttgctggtgaagctgcccacaattttgaaaccacgccaccaactgatgctgtcagctcagttctccagatactaagaggtatctatgaaccacaagggattgaggtgccagaccctctacagagtgtttgcactagatggggcactgactcgttcagtctaggttcatactctcatgtcgctgtgggggcctctggagatgactatgacatattagccgaaagtgttggtgatggccgtcttttctttgctggtgaggctaccacgaggcgttatccagcaacaatgcatggtgcttttatcagtggtttgcgggaggctgctaacatgacactgcatgccaatgcccgggcagcaaaaaataaagtagacaaaagtccatcgacaaacacacaggcgtgtgctgctatattaacggacttgtttaggcaaccagatttggagtttggaagcttctccgttatttttggaggaaaagcttctgatccaaaatccccagctattctaaaggtggaattaggtgcgtcacggaagaaaaatgcagctgaaggggtaaagacggaacagaaccactcaaacaaattgttgtttcagcagctccagtcacactttaaccagcaacaacagctttatgtttacacattgctatcacgacagcaagctatggagttaagggaggtcagaggaggcgatgacatgaggttgcactacctctgtgaaaaactgggggtgaaattagttggcaggaaaggccttggtcctggggcagatgctgtaattgcatctattaaggcagaacgtaacagaggtcgaactagacctggcccctcaaagctgaaaaaatctctgaagcctaatgttgctgcatcatga

SEQ ID NO: 2878 - protein, 808 aa, Sorghum bicolor
  misc_feature: Ceres ANNOT ID no. 6026671
  misc_feature (202)..(629): Pfam Id: Amino_oxidase Pfam Desc: Flavin containing amine oxidoreductase
  misc_feature (83)..(175): Pfam Id: SWIRM Pfam Desc: SWIRM domain
  misc_feature (194)..(609): Pfam Id: DAO Pfam Desc: FAD dependent oxidoreductase
  misc_feature (1)..(798): NCBI GI: 38345842 NCBI Desc: osjnba0084k11.6 [oryza sativa (japonica cultivar-group)]
  misc_feature (22)..(795): NCBI GI: 61661322 NCBI Desc: flowering locus d [arabidopsis thaliana]
  misc_feature (72)..(691): NCBI GI: 23505983 NCBI Desc: at1g62830/f23n19_19 [arabidopsis thaliana]
  misc_feature (72)..(691): NCBI GI: 6630454 NCBI Desc: f23n19.18 [arabidopsis thaliana]
  misc_feature (349)..(595): NCBI GI: 61611724 NCBI Desc: flowering locus d [pisum sativum]
  misc_feature: Useful for making plants with modulated flowering time
  misc_feature: GREAT-hit functional homolog of the protein sequence given in SEQ ID NO 13356
  misc_feature: Useful for making plants with modulated flowering time
  misc_feature: Functional homolog of the protein sequence given in SEQ ID NO 13356
MSEQAPPYAPLPLVSSLAPDPSSTPSPNPTLVLPNPVFPNKRKRTGFRRKVPSGAPAAHAPSPVAPSQPPPPASAADDIIVINREPTAEAVTALTAGFPADSLTDEEIEAGVVSDVGGIEQVNYILIRNHLLCRWRETYNSWLAKEPFATLIPPHCEHLLTAAYSFLVSNSYINFGVAPAIKERIPKEPTRPTTVIVVGAGLAGLAAARQLVAFGFKVIVLEGRKRCGGRVYTKKMEGGGRMAAADLGGSVLTGTFGNPLGIVAKQLGLPMHKIRDKCPLYRPDGSPVDPEVDKNVEITFNKLLDKSSNLRASMGEVAVDVSLGAALETLRQADGGVSTQEEMNLFNWHLANLEYANAGLLSRLSLAFWDQDDPYDMGGDHCFLPGGNGKLVQALAENVAIVYERTVHTIRYGGDGVQVVVNGGQVYEGDMALCTVPLGVLKNGGIKFVPELPQRKLDSIKRLGFGLLNKVSMLFPHVFWSTDLDTFGHLVEDPRRRGEFFLFYSYATVAGGPLLMALVAGEAAHNFETTPPTDAVSSVLQILRGIYEPQGIEVPDPLQSVCTRWGTDSFSLGSYSHVAVGASGDDYDILAESVGDGRLFFAGEATTRRYPATMHGAFISGLREAANMTLHANARAAKNKVDKSPSTNTQACAAILTDLFRQPDLEFGSFSVIFGGKASDPKSPAILKVELGASRKKNAAEGVKTEQNHSNKLLFQQLQSHFNQQQQLYVYTLLSRQQAMELREVRGGDDMRLHYLCEKLGVKLVGRKGLGPGADAVIASIKAERNRGRTRPGPSKLKKSLKPNVAAS

SEQ ID NO: 2879 - DNA, 1221 bp, Sorghum bicolor
  misc_feature: Ceres ANNOT ID no. 6026676
  misc_feature: Encodes the peptide sequence at SEQ ID NO 2880
atggagctccgcacctgcgcggcccccagttctgcgtccctctcttccggccgtggcgcggtgccatcctcgcgcctcctttcccgtcaaatttggagccgatcggcatactgcactgtctcctccacctcatcaagccctgttgctagaaggagccggttctccactctgatggcgactgcatacaacacagggaccccggacctagctgacttcaattgggatgctcttgggtttcaactgatcccaacggacttcatgtatttaatgagctgttcttcagaaggggtgttcacaaatggtaaattggtgccgtatgggccaattgagctgaatccagcagccgctgtgctgaattatggtcagggattgcttgaaggtctacgagcacatagaaaagaggatggatcaattcttctttttcgtccacatgaaaatgcactgcggatgaaaactggtgcagatcggttatgcatgcctgcaccaagtgtagagcaattcctagaagctgtgaagctaactgttctggcaaacaagcattgggtgcctccttttggtaaaggttctttgtatatcagaccacagctaattggaagtggggctatccttggtgtggcacctgccccacagtacacattcattgtgtttgtttgcccagttgggcattatttcaaggatggtttatctccaatcagcttgttaactgaggaagaataccaccgtgctgcacctggtggaactggtgatataaagactattgggaactatgcttcggttgttagtgctcagagaagagccaaggagaaaggccattctgatgttttatacctagatccaatccataataagtttgttgaggaagtttcttcttgtaatatattcatggtgaaggacaatgttatttctactccactgttaacgggaacaattctccctggaatcacaaggagaagtgtgattgaaatttctcaaaatcttggatttcaggttgaggagcgtccaatcacaatagatgaactgcttggggctgatgaagtcttttgtacaggaacagctgttgtagtgtcacctgttgggagcatcacttaccgtggaagaagagtggagtatgggaagaaccaggaggccggagccgtgtctcagcaactctacgccgcattcacagctatccagaaaggtgtcacggaggacagaatgggatggacgttgcagctagcttag

SEQ ID NO: 2880 - protein, 406 aa, Sorghum bicolor
  misc_feature: Ceres ANNOT ID no. 6026676
  misc_feature (100)..(388): Pfam Id: Aminotran_4 Pfam Desc: Aminotransferase class IV
  misc_feature (12)..(405): NCBI GI: 116311125 NCBI Desc: b0103c08-b0602b01.8 [oryza sativa (indica cultivar-group)]
  misc_feature (12)..(405): NCBI GI: 38345837 NCBI Desc: osjnba0084k11.1 [oryza sativa (japonica cultivar-group)]
  misc_feature (13)..(406): NCBI GI: 9843665 NCBI Desc: branched-chain amino acid transaminase 5 [arabidopsis thaliana]
  misc_feature (13)..(406): NCBI GI: 111074416 NCBI Desc: at5g65780 [arabidopsis thaliana]
  misc_feature (41)..(406): NCBI GI: 21593211 NCBI Desc: branched-chain-amino-acid transaminase-like protein [arabidopsis thaliana]
  misc_feature (13)..(406): SWISSPROT Homolog: EC 2.6.1.42 Branched-chain-amino-acid aminotransferase 5, chloroplast precursor
  misc_feature: Useful for making plants with modulated nitrogen use efficiency
  misc_feature: Functional homolog of the protein sequence given in SEQ ID NO 13131
  misc_feature: The sequence is a functional homolog of SEQ ID NO. 504 in the 11/188,298 US application
MELRTCAAPSSASLSSGRGAVPSSRLLSRQIWSRSAYCTVSSTSSSPVARRSRFSTLMATAYNTGTPDLADFNWDALGFQLIPTDFMYLMSCSSEGVFTNGKLVPYGPIELNPAAAVLNYGQGLLEGLRAHRKEDGSILLFRPHENALRMKTGADRLCMPAPSVEQFLEAVKLTVLANKHWVPPFGKGSLYIRPQLIGSGAILGVAPAPQYTFIVFVCPVGHYFKDGLSPISLLTEEEYHRAAPGGTGDIKTIGNYASVVSAQRRAKEKGHSDVLYLDPIHNKFVEEVSSCNIFMVKDNVISTPLLTGTILPGITRRSVIEISQNLGFQVEERPITIDELLGADEVFCTGTAVVVSPVGSITYRGRRVEYGKNQEAGAVSQQLYAAFTAIQKGVTEDRMGWTLQLA

SEQ ID NO: 2881 - DNA, 1239 bp, Sorghum bicolor
  misc_feature: Ceres ANNOT ID no. 6026683
  misc_feature: Encodes the peptide sequence at SEQ ID NO 2882
atgggtcgtgatcgcgaagacgtgaccgagttcctggggcaggtgcccctcctgcagtgcctcccgggttcctccatccgcagaatcgccgaggtcgtccaggtcaggagctacgagcctggtgactatgtcgctcgcgaaggtgaacctgttgatggcctttacatcatattggatggtcaggctgaagtttctgcgcctgcgaatacagaagaagcaaaccgcccagactatgtgttaaataagtacgactactttggttacggatctaatagttctgttcatcaagtaactgttgttgcattatcaaagctgacctgtttcatattgcccaatcaatatgcacatttgttacaacccaaaacaatttggaatccggaggaaacacctaaacattctttgctggaacaaattttgcacttagaaccactagaggtcgatattttccgtgggtttactttgcccgaagctccaacttttaggcacgtttttggaggacaattcattggacaggcactggcagcagcatccaagactgttgattgtctaaaaatggttcatagtttgcatgcagtttttcttgttgctggagacattgacataccaataatataccaagttcatcgggcacgtgatggatccaactttgccacaagaaaagtggaggcaaagcagaagggcctagttctattcaccttaattgcttctttccagaaggaagaagtgggttttgagcatcaggctgcaatcatgcctgatgttcctcctccagaacagctccttaatctggaggagctacgagaaagacggcttactgatgatccacgcttcccaccccaatataggagcttggcagctaacaaaaagtttactccttggcccatagaaataagattatgtgaagattcagcgtctcaacataaaccaagcttaaactactggtttagagctcggggaaaactttcagacgatcaagctctacatagatgtgttgtagcatatgcttcggatctactatattctcctgtgagccgtcaccctcatctggcgaagtctttggagatacacgtgctcagtcttaatcattcgtatatcgagagcccatctgcgcatggtggtcggggtttcgtcactggacgcatgttcaacaggcaaggagagcttatcatgtcgctgacccaagaggcgttgattagaagggagaagccacgaggacgaaatccgaggccaaagctttga

SEQ ID NO: 2882 - protein, 412 aa, Sorghum bicolor
  misc_feature: Ceres ANNOT ID no. 6026683
  misc_feature (144)..(244): Pfam Id: Acyl_CoA_thio Pfam Desc: Acyl-CoA thioesterase
  misc_feature (284)..(397): Pfam Id: Acyl_CoA_thio Pfam Desc: Acyl-CoA thioesterase
  misc_feature (35)..(123): Pfam Id: cNMP_binding Pfam Desc: Cyclic nucleotide-binding domain
  misc_feature (4)..(406): NCBI GI: 115459866 NCBI Desc: os04g0558400 [oryza sativa (japonica cultivar-group)]
  misc_feature (8)..(406): NCBI GI: 38345758 NCBI Desc: osjnba0065o17.11 [oryza sativa (japonica cultivar-group)]
  misc_feature (8)..(406): NCBI GI: 116311120 NCBI Desc: b0103c08-b0602b01.3 [oryza sativa (indica cultivar-group)]
  misc_feature (6)..(363): NCBI GI: 30678177 NCBI Desc: acyl-coa thioesterase family protein [arabidopsis thaliana]
  misc_feature (8)..(328): NCBI GI: 62320828 NCBI Desc: acyl coa thioesterase [arabidopsis thaliana]
MGRDREDVTEFLGQVPLLQCLPGSSIRRIAEVVQVRSYEPGDYVAREGEPVDGLYIILDGQAEVSAPANTEEANRPDYVLNKYDYFGYGSNSSVHQVTVVALSKLTCFILPNQYAHLLQPKTIWNPEETPKHSLLEQILHLEPLEVDIFRGFTLPEAPTFRHVFGGQFIGQALAAASKTVDCLKMVHSLHAVFLVAGDIDIPIIYQVHRARDGSNFATRKVEAKQKGLVLFTLIASFQKEEVGFEHQAAIMPDVPPPEQLLNLEELRERRLTDDPRFPPQYRSLAANKKFTPWPIEIRLCEDSASQHKPSLNYWFRARGKLSDDQALHRCVVAYASDLLYSPVSRHPHLAKSLEIHVLSLNHSYIESPSAHGGRGFVTGRMFNRQGELIMSLTQEALIRREKPRGRNPRPKL

SEQ ID NO: 2883 - DNA, 1311 bp, Sorghum bicolor
  misc_feature: Ceres ANNOT ID no. 6026684
  misc_feature: Encodes the peptide sequence at SEQ ID NO 2884
  misc_feature: Up-regulated in shoot tissues in response to methyl jasmonate treatment
atggatcgtgaagaaggtaaagcagcgcccgctcggacctcgccgaatttgggagcgattctggctaacctggggcctggttgccattggtgtgcagtgaccgagttcctggggcaggtgcccctcctgcagtgcctcccgggttcctccatccgcagaatcgccgaggccgtcgagatcaggaactacgagcctggtgactatgtcgctcgtgacggtgaacctgttgatggcctttacataatattggatggtcaggctgaagtttctgcacctgcaaatgctgaagaagcgaaccgcccagactatgtgttaaataaatacgactactttggttacggaactaatagttctgttcatcaagtaaatgttgttgcactatcaaagctgacctgcttcatattgcccaatcaacatggacatttgttacaaccaaaaacaatttggaatgcggaggaaacacctgaacattctttgctggaacaaattttgcacttagaaccactggaggtagatatcttccgtgggtttactttgccagaagctccaacttttaggcaagtttttggaggacaattcattggacaggcactagcagcagcatccaagactgttgattgtctaaaaatggtgcacagtttgcatgcgatttttcttgttgctggagacaataacataccaataatatatcaagttcatcgggcacgtgatggatccagctttgccacaagaaaagtggaggcaaagcagaagggactagttgtattcaccttgattgcttctttccagaaggaagaagtgggttttgagcatcaggctgcaatcatgcctgatgttcctcctccagaacagctccttaatctggaggagatacgagaaagacggcttactgatcctcgcttcccatcccaatataggaacttggcagctaaaaagaagtttactccttggcccatagaaatgagattctgtgaagattcagcatctcaacataaaccaagcttaaactactggtttagagctcggggaaaactttcagatgaccaagctctacatagatgtgttgtagcatatgcttcggacctactatattctggtgtgagccttaaccctcatcgggagaagggtttgaagacatactcgctcagtcttgatcattcgtacatcgagagcccatctgcacacggtggtcggggtttcgtcactggacgcatgttcaacaggcaaggagagcttatcatgtcgctaacccaagaggcgttgattagaaaggagaagccacgaggacgaaatctgaggccgaagctttga

SEQ ID NO: 2884 - protein, 436 aa, Sorghum bicolor
  misc_feature: Ceres ANNOT ID no. 6026684
  misc_feature (169)..(269): Pfam Id: Acyl_CoA_thio Pfam Desc: Acyl-CoA thioesterase
  misc_feature (309)..(421): Pfam Id: Acyl_CoA_thio Pfam Desc: Acyl-CoA thioesterase
  misc_feature (60)..(148): Pfam Id: cNMP_binding Pfam Desc: Cyclic nucleotide-binding domain
  misc_feature (1)..(430): NCBI GI: 38345758 NCBI Desc: osjnba0065o17.11 [oryza sativa (japonica cultivar-group)]
  misc_feature (1)..(430): NCBI GI: 116311120 NCBI Desc: b0103c08-b0602b01.3 [oryza sativa (indica cultivar-group)]
  misc_feature (33)..(430): NCBI GI: 115459866 NCBI Desc: os04g0558400 [oryza sativa (japonica cultivar-group)]
  misc_feature (32)..(387): NCBI GI: 30678177 NCBI Desc: acyl-coa thioesterase family protein [arabidopsis thaliana]
  misc_feature (32)..(387): NCBI GI: 58293826 NCBI Desc: acyl-coa thioesterase [arabidopsis thaliana]
  misc_feature: Up-regulated in shoot tissues in response to methyl jasmonate treatment
MDREEGKAAPARTSPNLGAILANLGPGCHWCAVTEFLGQVPLLQCLPGSSIRRIAEAVEIRNYEPGDYVARDGEPVDGLYIILDGQAEVSAPANAEEANRPDYVLNKYDYFGYGTNSSVHQVNVVALSKLTCFILPNQHGHLLQPKTIWNAEETPEHSLLEQILHLEPLEVDIFRGFTLPEAPTFRQVFGGQFIGQALAAASKTVDCLKMVHSLHAIFLVAGDNNIPIIYQVHRARDGSSFATRKVEAKQKGLVVFTLIASFQKEEVGFEHQAAIMPDVPPPEQLLNLEEIRERRLTDPRFPSQYRNLAAKKKFTPWPIEMRFCEDSASQHKPSLNYWFRARGKLSDDQALHRCVVAYASDLLYSGVSLNPHREKGLKTYSLSLDHSYIESPSAHGGRGFVTGRMFNRQGELIMSLTQEALIRKEKPRGRNLRPKL

SEQ ID NO: 2885 - DNA, 1047 bp, Sorghum bicolor
  misc_feature: Ceres ANNOT ID no. 6026686
  misc_feature: Encodes the peptide sequence at SEQ ID NO 2886
atgccatcaaccttacttgatggtctccctaacgaagttgctctccagtgccttgcacgggtgccattcttgttccatccgatgcttcagttggtttgccgctcttggcgagcatcagtttgcagtggcgaacttctcaaaattcggaatcagattgacgcgacagaagagctcttgtgtgtgttggcgtttgaaccagaaaacatgtggcaactttatgatcccctacgagacaagtggataactctccctgtcatgccatctcagattaggaacatagcccgctttggagtggcctcagttgctggaaagctctacgtaattggtggtggcagtgatcgagttgatccacttactggagatcacgacaggatctttgcaagcaatgaggtttggtcttatgatccgctccaccgagtgtggtcccagagggctcctatgcttgtggctcgagcgatgtttgcttgttgtgcattggatgggaaaataattgttgcaggaggcttcactaactgccgcaaatcaatatcaaaggctgagatctatgaccctgaagctggcctatgggagcctctccctgaccttcgtctggctcacagctctgcatgtactggacttgtcatcaagggtaagatgcatgtattgcataaaggtctatcgacagtgcagattctggaagatggtggcagtcattgggctgttgaggatttttcttggctgcaaggcccaatggcgatggttggtggagagctgtatgtgctgagtaacagctgcattatgaagcaacgtggtgagaatttccctgataagatggtgtcatgcgcatctgagttccagagcaggatcggttttgggatgattggtgtgggtgacaacatatatttggttgggggagtgattggacctgggccgagaaaccaatgcatcaagccgctatctgatgttgatatcttgaatgtcacaagtgagagaccaacctggagaccagggtcaccgatgacacattgccgagggagcatctgcggctgcgctttgttgaggatttag

SEQ ID NO: 2886 - protein, 348 aa, Sorghum bicolor
  misc_feature: Ceres ANNOT ID no. 6026686
  misc_feature (92)..(148): Pfam Id: Kelch_1 Pfam Desc: Kelch motif
  misc_feature (150)..(196): Pfam Id: Kelch_1 Pfam Desc: Kelch motif
  misc_feature (280)..(334): Pfam Id: Kelch_1 Pfam Desc: Kelch motif
  misc_feature (150)..(196): Pfam Id: Kelch_2 Pfam Desc: Kelch motif
  misc_feature (4)..(51): Pfam Id: F-box Pfam Desc: F-box domain
  misc_feature (3)..(348): NCBI GI: 42572771 NCBI Desc: kelch repeat-containing f-box family protein [arabidopsis thaliana]
  misc_feature (9)..(239): NCBI GI: 4966346 NCBI Desc: contains two pf01344 kelch motif domains. [arabidopsis thaliana]
  misc_feature (1)..(215): NCBI GI: 3176664 NCBI Desc: contains similarity to beta scruin gbz47541 from limulus polyphemus. ests gbt04493 and gbaa585955 come from this gene. [arabidopsis thaliana]
  misc_feature (3)..(254): NCBI GI: 92881986 NCBI Desc: cyclin-like f-box [medicago truncatula]
  misc_feature (5)..(258): NCBI GI: 86991208 NCBI Desc: kelch-motif containing protein [oryza rufipogon]
  misc_feature: The sequence is a functional homolog of SEQ ID NO. 315 in the 11/188,298 US application
  misc_feature: The sequence is a functional homolog of SEQ ID NO. 440 in the 11/188,298 US application
MPSTLLDGLPNEVALQCLARVPFLFHPMLQLVCRSWRASVCSGELLKIRNQIDATEELLCVLAFEPENMWQLYDPLRDKWITLPVMPSQIRNIARFGVASVAGKLYVIGGGSDRVDPLTGDHDRIFASNEVWSYDPLHRVWSQRAPMLVARAMFACCALDGKIIVAGGFTNCRKSISKAEIYDPEAGLWEPLPDLRLAHSSACTGLVIKGKMHVLHKGLSTVQILEDGGSHWAVEDFSWLQGPMAMVGGELYVLSNSCIMKQRGENFPDKMVSCASEFQSRIGFGMIGVGDNIYLVGGVIGPGPRNQCIKPLSDVDILNVTSERPTWRPGSPMTHCRGSICGCALLRI

SEQ ID NO: 2887 - DNA, 2997 bp, Sorghum bicolor
  misc_feature: Ceres ANNOT ID no. 6026704
  misc_feature: Encodes the peptide sequence at SEQ ID NO 2888
atggtggcgactactcgagctctgctcgtctcctgcttccacggcggtggcggtggcggtggcggcggctcagagatgagcagccgcctctccctgcgcccgcggtacccgtcaatgccgcggcgcccgaagggggtggcggttgctggcggcggaggagacggcgacctggaggccgcggtcggtacgggggatgaggaggaggagaaggtggcggtgttctcggtgtccgggatgacctgcgccgcgtgcgcggggtcggtggagaaggccgtgaagcggctcccgggcatccacgacgccgccgtcgacgtcctctggggccgcgcgcaggtcgtcttctgcccagcctttgtctcggagaacaaaattacagaagccattgaggatgttggttttgaagctaaattgattgatgaggaggtcaaggaaaagaatgttctactatgcaggttacatataaaaggaatggcctgcaagtattgcacaagcacagttgaatttgccttgcaagcttctcctggggttcaaagagcttcagttgcattggctactgaagaggctgagatccgttatgatcgcaggattatttctgctagccagctaatccaagcagtggaagaaactggctttgaagcgatactagtgacgacaggagaagaccagagcaggatagaccttaaaatggatggtgttctcgatgagacattgataatgatcttgaaaagctctgtacaggcccttcctggtgtggaaaacattacattcaactctgagctacacaaggtcaccatctcatacaagcctgaccagacaggtccccgggacctcatcgaagtcatcaattcagccacatttggtcatgtcaatgcatcaatatatctggaagcagatggaagggaccagcataggtatggggaaatcaaacgatacaggcagtctttcttgtggagcttaatattcaccattccagtttttctcacctccatggtgttcatgtatatcccttggctgaaggatgggctggaaaaaaaagttgtcaatatgatgagcattggtgaattagttcggtggattttgtcaacaccggtccaatttgttatcggtcgcaaattttatgctggtgcttacaaggcaatgtgccgtggctcaccgaacatggatgtccttattgctctagggacaaacacggcttacttctactcagtttactcagttcttcgagcagctacctctgagaattacatgtcaactgatttttttgagactagttccatgcttatatcatttatccttcttggaaagtaccttgagatcttggcaaaaggaaaaacctctgaggctattgccaagctgatggatcttgcaccggaaactgcaacactgttaatgtatgaccatgaaggaaatgtggtaggagagaaggagattgacagcaggttaattcagaaaaatgatgtgatcaaagtagtcccgggtggaaaagttgcttctgatggatttgttatttggggccagagccatgtgaatgaaagcatggttactggagaatcacggccagtagcaaagagaaagggtgacactgtaattggagggacagtgaatgagaatggtgtgctccatgtccgggctacatttgtgggatcagagggtgcactggcacagattgtaaggctagttgagtcagcgcaaatggcaaaagctcctgtccagaagtttgctgatcacatatctagagtctttgttcccctggtgattcttttttcaatgcttacttggctcacatggtttgtcgcggggaggctccatagctaccctcactcatggataccacaatccatggatagctttcagctcgctcttcagtttgggatatcggttatggtgattgcctgtccttgcgccctagggctggctactccaactgctgtgatggttgcaaccggagttggtgcctcacatggtgttctgatcaagggtgggcaagctctggagagtgcacagaaggtcgactgcatcgtttttgacaagacagggacgcttactattgggaagcctgtcgttgttgacacaaagcttcttaaaaacatggtcttgcgtgaattctacgactatgctgctgcagcagaagtcaacagtgagcaccccctggcaaaagcgatagtggagcatgccaaaaagttgcatccagaagaaaaccacatttggcctgaagcaagggaattcatttcagtaactgggcaaggtgtcaaggtggatgttagtgacaagagtgtcattgtgggaaacaagagctttatgctgtcttctggcattgatatctccttggaagctttggaaatcctcatggaagaagaggagaaggcaaggacagggattattgtggccatcgaccaagaagttgttggcataatctccgtatctgatccgataaaaccaaatgcccatgaagtgatatcatacctgaagtccatgaatgtggagagtataatggtgactggcgacaactgggggacagctaatgctatcggcaaagaggttggcattgaaaagattattgctgaagcgaaaccagagcagaaggctgagagggtgaaggaacttcagttgtctggaagaaccgtggcaatggttggcgatggaatcaacgactccccagcacttgtctcggctgacgtggggctggcaatcggcgcaggaacagatgtcgccatcgaagctgccgacattgtcctcatgaagagcaacctggaggatgtgatcaccgccatcgacctgtccagaaaaaccttcttccgcatacgaatgaactacgtctgggcgctcgggtacaacgtcatcggcataccgattgctgcaggggtgctcttcccatccactgggtttcgcttgccgccctgggttgccggtgctgcaatggcagcttcgtccgtcagtgtcgtctgctggtccctgctgttgaggtactacaaggctccaaagattgttggcagttga

SEQ ID NO: 2888 - protein, 998 aa, Sorghum bicolor
  misc_feature: Ceres ANNOT ID no. 6026704
  misc_feature (426)..(666): Pfam Id: E1-E2_ATPase Pfam Desc: E1-E2 ATPase
  misc_feature (670)..(901): Pfam Id: Hydrolase Pfam Desc: haloacid dehalogenase-like hydrolase
  misc_feature (73)..(137): Pfam Id: HMA Pfam Desc: Heavy-metal-associated domain
  misc_feature (151)..(215): Pfam Id: HMA Pfam Desc: Heavy-metal-associated domain
  misc_feature (1)..(995): NCBI GI: 115459844 NCBI Desc: os04g0556000 [oryza sativa (japonica cultivar-group)]
  misc_feature (1)..(843): NCBI GI: 38345590 NCBI Desc: osjnbb0012e24.8 [oryza sativa (japonica cultivar-group)]
  misc_feature (35)..(994): NCBI GI: 6633848 NCBI Desc: f2k11.18 [arabidopsis thaliana]
  misc_feature (20)..(993): NCBI GI: 92897307 NCBI Desc: heavy metal transport/detoxification protein [medicago truncatula]
  misc_feature (54)..(729): NCBI GI: 115444507 NCBI Desc: os02g0172600 [oryza sativa (japonica cultivar-group)]
MVATTRALLVSCFHGGGGGGGGGSEMSSRLSLRPRYPSMPRRPKGVAVAGGGGDGDLEAAVGTGDEEEEKVAVFSVSGMTCAACAGSVEKAVKRLPGIHDAAVDVLWGRAQVVFCPAFVSENKITEAIEDVGFEAKLIDEEVKEKNVLLCRLHIKGMACKYCTSTVEFALQASPGVQRASVALATEEAEIRYDRRIISASQLIQAVEETGFEAILVTTGEDQSRIDLKMDGVLDETLIMILKSSVQALPGVENITFNSELHKVTISYKPDQTGPRDLIEVINSATFGHVNASIYLEADGRDQHRYGEIKRYRQSFLWSLIFTIPVFLTSMVFMYIPWLKDGLEKKVVNMMSIGELVRWILSTPVQFVIGRKFYAGAYKAMCRGSPNMDVLIALGTNTAYFYSVYSVLRAATSENYMSTDFFETSSMLISFILLGKYLEILAKGKTSEAIAKLMDLAPETATLLMYDHEGNVVGEKEIDSRLIQKNDVIKVVPGGKVASDGFVIWGQSHVNESMVTGESRPVAKRKGDTVIGGTVNENGVLHVRATFVGSEGALAQIVRLVESAQMAKAPVQKFADHISRVFVPLVILFSMLTWLTWFVAGRLHSYPHSWIPQSMDSFQLALQFGISVMVIACPCALGLATPTAVMVATGVGASHGVLIKGGQALESAQKVDCIVFDKTGTLTIGKPVVVDTKLLKNMVLREFYDYAAAAEVNSEHPLAKAIVEHAKKLHPEENHIWPEAREFISVTGQGVKVDVSDKSVIVGNKSFMLSSGIDISLEALEILMEEEEKARTGIIVAIDQEVVGIISVSDPIKPNAHEVISYLKSMNVESIMVTGDNWGTANAIGKEVGIEKIIAEAKPEQKAERVKELQLSGRTVAMVGDGINDSPALVSADVGLAIGAGTDVAIEAADIVLMKSNLEDVITAIDLSRKTFFRIRMNYVWALGYNVIGIPIAAGVLFPSTGFRLPPWVAGAAMAASSVSVVCWSLLLRYYKAPKIVGS

SEQ ID NO: 2889 - DNA, 2163 bp, Sorghum bicolor
  misc_feature: Ceres ANNOT ID no. 6026716
  misc_feature: Encodes the peptide sequence at SEQ ID NO 2890
atgagggcggcgcccttcagtgccgacgggagcggggcggggaccatagaggcgctgctttggccggacgggaagggcggcggcggcggaggggacctgctggtggagccgacgtcggtgctggactgcagacggagcccgagcccgccgtactcgacatcgacgctgtcttcgtccctgggcggcgccgcgggggactcctcttccggcgtggcggcggtttcggacaacagcgccgccgccgccgccgaagccaccaaatgggcggcgccaggcgagcacggcggcggcggcggtggaggcggaggcgggggcgggaggaaggaggagtggtccggcggtgagctgccgcccataccggggaccctggacgtcgggttcgtcggggaggagggctgggacgccatgctcggcgacgccacggcggtggccggtcaggaccagacgttcctcaactggatcatgaccgcgccgggcgacatggagccgccagcgccgccgctcctcggcaatgccgccggctttgggttcccgacctcggacccgctcgggttctccctgcagcatcacccaggcggcggcggcggcgcctcggccggggcgctggcctccgacctgtcgtcccccggcgcgaggtcgctcaccagcagcagcggcagcagcagcaaggccacttccactttcggcctcctaccaaccgaggccgtgcttcagccgccgccgccggcggccacgaccatgcctttccacgacggtggcgacataaagcccccgcttcttggagtcccgtcggcaaatctactcctcaatcaacaccagacgttgccggcggcctccttcttcatgccgctcccctccttccccgaccatcagcaccagccacatctcccgcccccgccgaagcgccaccactctatgcccgacaacctgttcctcctccaaaaccagctccaaccgccgccgcagggtctaccgttcccaccagtgcataacaccgggcccttccagctccagccatcgctgcaaccgccgcgaggagcgttgaaaacaaccccggcggcgcagcaacatcaacagcttctggacgagcttgctgcggcggcaaaggcggctgaggtcggcaactccatcggcgcgctcgagatattggcgcggctcaatcagcagcttcccccagtcgggaagcctttcctccgctccgcttcctacctcaaggaggccctcctcctcgcgctctcggacggccaccagggctccacccgcctaacctctccgatcgacgtcgtcctcaagctcggtgcatacaagtctttctccgacctctcgcctgtgctccagttcgccaatttcacggccactcaggcgcttctcgacgagatcgcctcaaccacttcatcgtgtatccgcatcattgatttcgaccttggtgttggcggccagtgggcttcctttctgcaggagcttgcacaccgccgtggaactgggaatgtcaccctgccaatgttgaagctcacggccttcgtctcaagtgcttcccaccacccgcttgagctgcatcttactcgggagaacctctcacaatttgctgcggaccttggcattccatttgagttcactgccatcaatctcgatgcatttgatccagcggaactcattcctcctactgccgatgaggttgtcgctgtttgcctccctgttggttgctctgcacgcatgccaccgcttccaatgttgcttcagttagtgaaacaacttgctcctaagattgctgtggctattgaccatggcagtgaccggggtgacctcccattttcacagcacttcatgaattgcttccagtcttgtatgttccttctcgactcacttgatgctgctggcactaatgcggatgctgccagtaagattgagaggtttctgatccaatcgagagtagaggatgcagtacttggccggcgtaaagctgaaaaggcaatggcttggcgggcagtgtttacatcagccgggtttgctccagtgccgctcagcaaccttgcagaagcacaagctgactgcctcttgaagcgggtgcaggtccgtggattccatgtggagaagtgtggaatgggtctagcactctactggcagcgcggtgagctcgtgtctgtctcggcatggcggtgctga

SEQ ID NO: 2890 - protein, 720 aa, Sorghum bicolor
  misc_feature: Ceres ANNOT ID no. 6026716
  misc_feature (339)..(635): Pfam Id: GRAS Pfam Desc: GRAS family transcription factor
  misc_feature (1)..(720): NCBI GI: 38345583 NCBI Desc: osjnbb0012e24.1 [oryza sativa (japonica cultivar-group)]
  misc_feature (1)..(720): NCBI GI: 50251746 NCBI Desc: scl1 protein [oryza sativa (japonica cultivar-group)]
  misc_feature (183)..(720): NCBI GI: 50251747 NCBI Desc: scl1 protein [oryza sativa (japonica cultivar-group)]
  misc_feature (459)..(720): NCBI GI: 4056615 NCBI Desc: scl1 protein [oryza sativa]
  misc_feature (274)..(720): NCBI GI: 115483306 NCBI Desc: os10g0551200 [oryza sativa (japonica cultivar-group)]
  misc_feature: Useful for making plants with altered alkaloid content
  misc_feature: Useful for making plants with modulated salt sensitivity
  misc_feature: Functional homolog of the protein sequence given in SEQ ID NO 13318
  misc_feature: GREAT-hit functional homolog of the protein sequence encoded by LOCUS at4g00150
MRAAPFSADGSGAGTIEALLWPDGKGGGGGGDLLVEPTSVLDCRRSPSPPYSTSTLSSSLGGAAGDSSSGVAAVSDNSAAAAAEATKWAAPGEHGGGGGGGGGGGGRKEEWSGGELPPIPGTLDVGFVGEEGWDAMLGDATAVAGQDQTFLNWIMTAPGDMEPPAPPLLGNAAGFGFPTSDPLGFSLQHHPGGGGGASAGALASDLSSPGARSLTSSSGSSSKATSTFGLLPTEAVLQPPPPAATTMPFHDGGDIKPPLLGVPSANLLLNQHQTLPAASFFMPLPSFPDHQHQPHLPPPPKRHHSMPDNLFLLQNQLQPPPQGLPFPPVHNTGPFQLQPSLQPPRGALKTTPAAQQHQQLLDELAAAAKAAEVGNSIGALEILARLNQQLPPVGKPFLRSASYLKEALLLALSDGHQGSTRLTSPIDVVLKLGAYKSFSDLSPVLQFANFTATQALLDEIASTTSSCIRIIDFDLGVGGQWASFLQELAHRRGTGNVTLPMLKLTAFVSSASHHPLELHLTRENLSQFAADLGIPFEFTAINLDAFDPAELIPPTADEVVAVCLPVGCSARMPPLPMLLQLVKQLAPKIAVAIDHGSDRGDLPFSQHFMNCFQSCMFLLDSLDAAGTNADAASKIERFLIQSRVEDAVLGRRKAEKAMAWRAVFTSAGFAPVPLSNLAEAQADCLLKRVQVRGFHVEKCGMGLALYWQRGELVSVSAWRC

SEQ ID NO: 2891 - DNA, 393 bp, Sorghum bicolor
  misc_feature: Ceres ANNOT ID no. 6026718
  misc_feature: Encodes the peptide sequence at SEQ ID NO 2892
  misc_feature: Down-regulated in shoot tissues in response to methyl jasmonate treatment
  misc_feature: Down-regulated in root tissues in response to methyl jasmonate treatment
  misc_feature: Down-regulated in root tissues in response to aminocyclopropane carboxylic treatment
  misc_feature: Down-regulated in shoot tissues in response to aminocyclopropane carboxylic treatment
  misc_feature: Down-regulated in shoot tissues in response to salicylic acid treatment
atggcatccaaggccgtcctcttcttggctcttaacctcctgttcttcacagtggccaacgcctgcggcagctgcccgaccccgacgccgccaccgccaccgcctcctgctactaccccaccccctccatccagcggcaagtgcccgctgaatgcgctcaagttcggcgtgtgcgccaatgtgctcggcctcgtcaaaggcgaggttggcaaggtgcctgctgagccatgctgcaccctcctcgatggccttgtagacttcgaggccgccgtctgcctctgcaccgccatcaaggccaacgtgctcggcatcgtcatcgatgtccctgtcaagctcagcgccctcgtcaactactgtggcaagtgcgtgcccaagggctacatctgtgcgtaa

SEQ ID NO: 2892 - protein, 130 aa, Sorghum bicolor
  misc_feature: Ceres ANNOT ID no. 6026718
  misc_feature (48)..(129): Pfam Id: Tryp_alpha_amyl Pfam Desc: Protease inhibitor/seed storage/LTP family
  misc_feature (1)..(130): NCBI GI: 4240033 NCBI Desc: zmgr1a [zea mays]
  misc_feature (1)..(130): NCBI GI: 4240035 NCBI Desc: zmgr1b [zea mays]
  misc_feature (1)..(121): NCBI GI: 115459826 NCBI Desc: os04g0554800 [oryza sativa (japonica cultivar-group)]
  misc_feature (1)..(129): NCBI GI: 39748094 NCBI Desc: lipid transfer protein-like protein [oryza sativa (japonica cultivar-group)]
  misc_feature (1)..(129): NCBI GI: 58578282 NCBI Desc: extensin-like protein [capsicum chinense]
  misc_feature: Useful for making plants with modulated biomass
  misc_feature: Useful for making plants with modulated flowering time
  misc_feature: Functional homolog of the protein sequence given in SEQ ID NO 13584
  misc_feature: Down-regulated in shoot tissues in response to methyl jasmonate treatment
  misc_feature: Down-regulated in root tissues in response to methyl jasmonate treatment
  misc_feature: Down-regulated in root tissues in response to aminocyclopropane carboxylic treatment
  misc_feature: Down-regulated in shoot tissues in response to aminocyclopropane carboxylic treatment
  misc_feature: Down-regulated in shoot tissues in response to salicylic acid treatment
MASKAVLFLALNLLFFTVANACGSCPTPTPPPPPPPATTPPPPSSGKCPLNALKFGVCANVLGLVKGEVGKVPAEPCCTLLDGLVDFEAAVCLCTAIKANVLGIVIDVPVKLSALVNYCGKCVPKGYICA

SEQ ID NO: 2893 - DNA, 399 bp, Sorghum bicolor
  misc_feature: Ceres ANNOT ID no. 6026722
  misc_feature: Encodes the peptide sequence at SEQ ID NO 2894
atggcaggcaacaacaaggcctcctcggtcgcgctgttcctcgccgtgaatctggcggtgttcgccatggcaagcgcatgcggtggcaactgccccaccccgtccaccccgtcgacgccgaccccgacgccggcctcgttcggcaagtgcccccgtgacgcgctcaagttgggtgtgtgcgccaacgtgctgggcctgatcaaggccaaggtgggcgtgccgccgacggagccatgctgcccgctgctggaggggctcgtcgacctcgaggccgcactctgcctctgcaccgccatcaagggcaatatcctcggcatcaacctcaacctgcccatcgatctcagcctcatcctcaaccactgcggcaagagcgtgcccaccggcttcaagtgcctctaa

SEQ ID NO: 2894 - protein, 132 aa, Sorghum bicolor
  misc_feature: Ceres ANNOT ID no. 6026722
  misc_feature (50)..(131): Pfam Id: Tryp_alpha_amyl Pfam Desc: Protease inhibitor/seed storage/LTP family
  misc_feature (1)..(131): NCBI GI: 39748094 NCBI Desc: lipid transfer protein-like protein [oryza sativa (japonica cultivar-group)]
  misc_feature (3)..(131): NCBI GI: 110816009 NCBI Desc: hyprp2 [gossypium hirsutum]
  misc_feature (1)..(131): NCBI GI: 1199774 NCBI Desc: extensin like protein [populus nigra]
  misc_feature (4)..(131): NCBI GI: 124484377 NCBI Desc: extensin like protein [ipomoea nil]
  misc_feature (4)..(131): NCBI GI: 60542797 NCBI Desc: arachidonic acid-induced dea1 [capsicum chinense]
  misc_feature: Useful for making plants with modulated biomass
  misc_feature: Useful for making plants with modulated flowering time
  misc_feature: Functional homolog of the protein sequence given in SEQ ID NO 13584
  misc_feature: Useful for making plants with modulated oxidative stress sensitivity
  misc_feature: Functional homolog of the protein sequence given in SEQ ID NO 13086
  misc_feature: Useful for making plants with modulated salt sensitivity
  misc_feature: Functional homolog of the protein sequence given in SEQ ID NO 13766
MAGNNKASSVALFLAVNLAVFAMASACGGNCPTPSTPSTPTPTPASFGKCPRDALKLGVCANVLGLIKAKVGVPPTEPCCPLLEGLVDLEAALCLCTAIKGNILGINLNLPIDLSLILNHCGKSVPTGFKCL

SEQ ID NO: 2895 - DNA, 393 bp, Sorghum bicolor
  misc_feature: Ceres ANNOT ID no. 6026726
  misc_feature: Encodes the peptide sequence at SEQ ID NO 2896
atggcaggcaagcaggcctcggtcgcgctgttcctggccgtgaacatggtggtgttcgccatggccagcgcctgcggtggccactgccccacgccggcgacaccgtcgacgccgaccccgacgcccgcctcgttcggcaagtgcccccgcgacgcgctcaagctgggcgtgtgcgccaacctgctgggcctgataaaggccaaggtgggcgtgccgcccacggagccatgctgcccgctgctgaaggggctcgtcaacctcgaggccgccgtgtgcctgtgcactgctatcaagggtagcattctcggcatcaacctcaacctgcccgtcgaccttagcctcatcctcaaccactgcggcaagaccgtgcccaccggattcaagtgcctctaa

SEQ ID NO: 2896 - protein, 130 aa, Sorghum bicolor
  misc_feature: Ceres ANNOT ID no. 6026726
  misc_feature (48)..(129): Pfam Id: Tryp_alpha_amyl Pfam Desc: Protease inhibitor/seed storage/LTP family
  misc_feature (1)..(129): NCBI GI: 39748094 NCBI Desc: lipid transfer protein-like protein [oryza sativa (japonica cultivar-group)]
  misc_feature (30)..(129): NCBI GI: 45758393 NCBI Desc: hyprp [fragaria x ananassa]
  misc_feature (1)..(129): NCBI GI: 1199774 NCBI Desc: extensin like protein [populus nigra]
  misc_feature (1)..(129): NCBI GI: 110816009 NCBI Desc: hyprp2 [gossypium hirsutum]
  misc_feature (1)..(129): NCBI GI: 124484377 NCBI Desc: extensin like protein [ipomoea nil]
  misc_feature: Useful for making plants with modulated biomass
  misc_feature: Useful for making plants with modulated flowering time
  misc_feature: Functional homolog of the protein sequence given in SEQ ID NO 13584
  misc_feature: Useful for making plants with modulated oxidative stress sensitivity
  misc_feature: Functional homolog of the protein sequence given in SEQ ID NO 13086
  misc_feature: Useful for making plants with modulated salt sensitivity
  misc_feature: Functional homolog of the protein sequence given in SEQ ID NO 13766
MAGKQASVALFLAVNMVVFAMASACGGHCPTPATPSTPTPTPASFGKCPRDALKLGVCANLLGLIKAKVGVPPTEPCCPLLKGLVNLEAAVCLCTAIKGSILGINLNLPVDLSLILNHCGKTVPTGFKCL

SEQ ID NO: 2897 - DNA, 726 bp, Sorghum bicolor
  misc_feature: Ceres ANNOT ID no. 6026728
  misc_feature: Encodes the peptide sequence at SEQ ID NO 2898
atgggcagtacgctgcttcgggtctatccttctgagctcaagattccctatgaggtcaagaagcagcggtcttgctgcatggagctgacgaacaggaccggccagtacgtggccttcaaggtgaaaacaacgaacccaaggaaatactctgtgaggcacgcctgcggtatacttcttccccggagctcgtgcaatctcacaggtgctccaatggaaatgctatctgatcaccactgcaaggacaagttccttgtgcaaagtgtcgtggtgcgggatggggcgacgatgaaagacttccttcccgaactgttcgttaaagcaccaggtagggtaattgaggagttcaagctgcgcgtggtgtacgttgctgctaatcctccatcaccggttccagaggaagaagaggaagaggattcatcccctcggtcagaggtgatagtctgtgaagagaaaagatcacatgtatttaatgctgcacctacttatatacgggcatctggagaagaactttcatgtgctgaggttacctctgtaaaatcaaggatggctgaagagaaggaatgtgcaattgcggtagaagaaaaactgaaccttcaatacaaaatggaactgctcgaagaaaccagatcatctcaacaacaagaaggattctcactgatgtttgtagtgttcgtcttcatgtcatctgtgttcattggacacttaatgaatgacatcaaggtttag

SEQ ID NO: 2898 - protein, 241 aa, Sorghum bicolor
  misc_feature: Ceres ANNOT ID no. 6026728
  misc_feature (5)..(109): Pfam Id: Motile_Sperm Pfam Desc: MSP (Major sperm protein) domain
  misc_feature (1)..(241): NCBI GI: 116310410 NCBI Desc: osigba0143n19.13 [oryza sativa (indica cultivar-group)]
  misc_feature (5)..(236): NCBI GI: 92872094 NCBI Desc: major sperm protein [medicago truncatula]
  misc_feature (2)..(236): NCBI GI: 6688926 NCBI Desc: vap27 [nicotiana plumbaginifolia]
  misc_feature (1)..(236): NCBI GI: 115459632 NCBI Desc: os04g0534400 [oryza sativa (japonica cultivar-group)]
  misc_feature (1)..(236): NCBI GI: 116310461 NCBI Desc: osigba0159i10.10 [oryza sativa (indica cultivar-group)]
  misc_feature: The sequence is a functional homolog of SEQ ID NO. 356 in the 11/188,298 US application
MGSTLLRVYPSELKIPYEVKKQRSCCMELTNRTGQYVAFKVKTTNPRKYSVRHACGILLPRSSCNLTGAPMEMLSDHHCKDKFLVQSVVVRDGATMKDFLPELFVKAPGRVIEEFKLRVVYVAANPPSPVPEEEEEEDSSPRSEVIVCEEKRSHVFNAAPTYIRASGEELSCAEVTSVKSRMAEEKECAIAVEEKLNLQYKMELLEETRSSQQQEGFSLMFVVFVFMSSVFIGHLMNDIKV

SEQ ID NO: 2899 - DNA, 1428 bp, Sorghum bicolor
  misc_feature: Ceres ANNOT ID no. 6026730
  misc_feature: Encodes the peptide sequence at SEQ ID NO 2900
atggggtggtccgcggggctgtgttggtggctcgtggcggcggtgtgggtggcggctgcggcggcgttggtggcggcggagggtgaggtcgaggtcgcggtcgcggtcggggcggcgccgaggcggcacgcctacgcgtccatgatgtacatgggcacgccacgggactacgagttctacgtcgccacgcgcgtcatgatgcggtccctgcgccggctcagcgccgacgccgaccgcgtcgtgatcgcgtccctcgacgtcccgccgctctgggtccaggcgctgaaagatgatggtgtgaaggtggtctctgtggagaatttgaaaaatccttatgagaaacaagaaaatttcaacatgcgattcaagttgactctaaacaagctgtatgcatggagcttgatttcatatgagcgagttgttatgcttgactctgacaacattttcctccaaaatactgatgagttatttcagtgtggtcaattctgtgctgtcttcatcaatccctgtatcttccatacaggtctcttcgttcttcagccctcaatggatgtttttaaaaacatgctacatgagctagcggttggacgtgaaaacccagatggtgccgaccaaggcttccttgctagttatttcccagacttgcttgatcagccaatgttccatccaccagctaatggtacaaaacttcagggtacttatcgcctccctctaggctaccagatggatgcgtcttactattatctgaagcttcgctggagtattccatgtggaccgaacagtgtgattacatttccgagtgctccatggtttaagccatggtactggtggtcttggccagttttacctttggggctctcgtggcatgaacaacgtcgtgaaaacctagggtattcatcggagataccagtagtattaattcaggctgtactgtacattggagtcatagcagtgacccgactggcgcggcctagcttgtccaagatgtgctacaaccgaagaatggagaaaaacactatgttcttgctctcccttctgagagtagtggcagcttggtccatacttgctgcctacaccatacccttcttcatcatcccaaggaccgtgcatccactgcttggctggcctctctacttgctcggttctttctctctttcttccatcgtgatcaacgttttcctcctccacccgatgaccgtactcacaacatggtttggattcatcggcgcactattggtgatggccttcccttggtatctaaatggtgttgttagggcattggcagtgtttgcgtatgctttctgctgtgcgcccttgatctgggcatctttggtcaagacaatgagctccttgcatgtcctgattgagagggatgcgttcaggctcggagaacctaaccagaacgccgagttcacaaagctatactga

SEQ ID NO: 2900 - protein, 475 aa, Sorghum bicolor
  misc_feature: Ceres ANNOT ID no. 6026730
  misc_feature (56)..(278): Pfam Id: Glyco_transf_8 Pfam Desc: Glycosyl transferase family 8
  misc_feature (1)..(475): NCBI GI: 116310407 NCBI Desc: osigba0143n19.10 [oryza sativa (indica cultivar-group)]
  misc_feature (48)..(475): NCBI GI: 38345479 NCBI Desc: osjnba0010h02.17 [oryza sativa (japonica cultivar-group)]
  misc_feature (39)..(475): NCBI GI: 92872087 NCBI Desc: glycosyl transferase, family 8 [medicago truncatula]
  misc_feature (42)..(253): NCBI GI: 7268410 NCBI Desc: glucosyltransferase like protein [arabidopsis thaliana]
  misc_feature (20)..(293): NCBI GI: 116310214 NCBI Desc: osigba0145m07.6 [oryza sativa (indica cultivar-group)]
  misc_feature: Useful for making plants with altered cell wall content and/or composition
  misc_feature: GREAT-hit functional homolog of the protein sequence encoded by LOCUS at2g35710
  misc_feature: Functional homolog of the protein sequence encoded by LOCUS at4g16600
  misc_feature: Useful for making plants with altered carbohydrate content
  misc_feature: Functional homolog of the protein sequence given in SEQ ID NO 13809
  misc_feature: Useful for making plants with altered cell wall content and/or composition
  misc_feature: Functional homolog of the protein sequence given in SEQ ID NO 13810
MGWSAGLCWWLVAAVWVAAAAALVAAEGEVEVAVAVGAAPRRHAYASMMYMGTPRDYEFYVATRVMMRSLRRLSADADRVVIASLDVPPLWVQALKDDGVKVVSVENLKNPYEKQENFNMRFKLTLNKLYAWSLISYERVVMLDSDNIFLQNTDELFQCGQFCAVFINPCIFHTGLFVLQPSMDVFKNMLHELAVGRENPDGADQGFLASYFPDLLDQPMFHPPANGTKLQGTYRLPLGYQMDASYYYLKLRWSIPCGPNSVITFPSAPWFKPWYWWSWPVLPLGLSWHEQRRENLGYSSEIPVVLIQAVLYIGVIAVTRLARPSLSKMCYNRRMEKNTMFLLSLLRVVAAWSILAAYTIPFFIIPRTVHPLLGWPLYLLGSFSLSSIVINVFLLHPMTVLTTWFGFIGALLVMAFPWYLNGVVRALAVFAYAFCCAPLIWASLVKTMSSLHVLIERDAFRLGEPNQNAEFTKLY

SEQ ID NO: 2901 - DNA, 1740 bp, Sorghum bicolor
  misc_feature: Ceres ANNOT ID no. 6026741
  misc_feature: Encodes the peptide sequence at SEQ ID NO 2902
atgtgcgaatctctatcatccctgatgccaccatctccatcaccaccacaaccgtctaggccgccgggacagtcaccggagtacaagcacttctgtcgagtatgcaacaaggggttcacgtgcggcagtgcgctcggtgggcatatgagagcccacggcgctagtgacgtcgacggcttcggcgccgacgatgacttgctcggcgatgaggcgtccacacgatgcctagctgcagatcagtgggacacggtgggaacgtcggcgactcatgcgtacgcgcttcgggcgaatccgaacaggctgatcaggagctgccagctgtgcaaaaactgtgggaaggagttcacgtcatgggagctttttcttcaacatggtaaatgcaattcagaggatgaggaagaagaagaggaggtggatgggttgggctcgctacgttcaccgtcgcctccctcggacgccgacagtgaggaggatccaacggtggcagccgcatggtcaaaaggaaagcgatcgcgccgcgtcagagcggaggagacttctaccgtggcgccgccggagcggtgcacattaggagaggaggaggacctcgcaaattgtctcgtcatgctctcatcctacaaatccaacagcaagcagcagacgactattactgcaacggatcatcatgagcctgcatgtgcatctaccaagaaaggtgatggagagccaccattgcaagtgcaaccaatctcttttttcacacagacacaagagtcagttatggcactgccttcgccagtagctatggtgccacagtacatatcacccgcatcacgtggagtttttgagtgcaaggcatgtaagaaggtgttcacctcgcaccaagcacttggtgggcaccgggccagccataagaaagtgaaaggctgttttgctgccaagtttgagagcaatgctagtgaaccaacacgccattcaacggtcattgataccaacaatggcaacggcactagcaatggcaaggctactgctgtcgatgaaggcaatgcaggtgcaagcacagatgccacaagagttttcgctacaactggcgtcgaggccaatgtagggatgagtactgaggcaacatcatcactgtcaatggcgcttttgcccatcggacacaatccatcagccgccaccacgctcgccgtcgcagcgcaatgcaagaaaaatgccaagatgcatgagtgttcagtatgtcaccgcctgttcacctctgggcaggcactcggaggccacaagcgatgccactggctcacctcaaacacatcggatccttgcaacccggtggccaatgtgatcccacccctaactgaagatctcgtcggcgtagtcaaacaccagctcagcctccggccgatggtggacgcgcctgagccagtgctcgacctcacaatcgcggcaaacccggtagcactagctgcttccacggcgcgacctgaggccaccaacagctctttccgtctcgacgtagcaccggtgcacttgccgccactggtcgtcgccgttccaggtaatgttagccatcagaagaaggatgtagcgacgagcagccatgccacggatgcggtggcggaggaagacgaggcggacagcaccacagccaagagagctaagattagcgacctcaaagacatggtgagcatggacggtgagcccatggaaccatggcttcaggttggcattggttcctcatcggccgcaggagatgatagttga

SEQ ID NO: 2902 - protein, 579 aa, Sorghum bicolor
  misc_feature: Ceres ANNOT ID no. 6026741
  misc_feature (1)..(445): NCBI GI: 116310401 NCBI Desc: osigba0143n19.4 [oryza sativa (indica cultivar-group)]
  misc_feature (1)..(445): NCBI GI: 38345472 NCBI Desc: osjnba0010h02.10 [oryza sativa (japonica cultivar-group)]
  misc_feature (1)..(445): NCBI GI: 115459808 NCBI Desc: os04g0552400 [oryza sativa (japonica cultivar-group)]
  misc_feature (152)..(576): NCBI GI: 63259083 NCBI Desc: cys2/his2 zinc-finger transcription factor [silene latifolia]
  misc_feature (24)..(245): NCBI GI: 1786142 NCBI Desc: pethy;zpt4-1 [petunia x hybrida]
  misc_feature: The plant is abnormally small.
  misc_feature: The sequence is a functional homolog of SEQ ID NO 1010 in the 10/666,642US patent application
  misc_feature: The sequence is a functional homolog of SEQ ID NO 1011 in the 10/666,642US patent application
  misc_feature: The sequence is a functional homolog of SEQ ID NO 1012 in the 10/666,642US patent application
  misc_feature: The sequence is a functional homolog of SEQ ID NO 1092 in the 10/666,642US patent application
  misc_feature: The sequence is a functional homolog of SEQ ID NO 1093 in the 10/666,642US patent application
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1212 in the 10/412,699US patent application
  misc_feature: The sequence is a functional homolog of SEQ ID NO 1213 in the 10/412,699US patent application
  misc_feature: The sequence is a functional homolog of SEQ ID NO 1214 in the 10/412,699US patent application
  misc_feature: The sequence is a functional homolog of SEQ ID NO 1289 in the 10/666,642US patent application
  misc_feature: The sequence is a functional homolog of SEQ ID NO 1290 in the 10/666,642US patent application
  misc_feature: The sequence is a functional homolog of SEQ ID NO 1291 in the 10/666,642US patent application
  misc_feature: The sequence is a functional homolog of SEQ ID NO 1292 in the 10/666,642US patent application
  misc_feature: The sequence is a functional homolog of SEQ ID NO 134 in the 10/286,264US patent application
  misc_feature: The sequence is a functional homolog of SEQ ID NO 2 in the 10/374,780US patent application
  misc_feature: The sequence is a functional homolog of SEQ ID NO 228 in the 10/666,642US patent application
  misc_feature: The sequence is a functional homolog of SEQ ID NO 464 in the 11/435,388US patent application
  misc_feature: The sequence is a functional homolog of SEQ ID NO 623 in the 10/374,780US patent application
  misc_feature: The sequence is a functional homolog of SEQ ID NO 624 in the 10/374,780US patent application
  misc_feature: The sequence is a functional homolog of SEQ ID NO 625 in the 10/374,780US patent application
  misc_feature: The sequence is a functional homolog of SEQ ID NO 626 in the 10/374,780US patent application
  misc_feature: The sequence is a functional homolog of SEQ ID NO 830 in the 10/666,642US patent application
  misc_feature: The sequence is a functional homolog of SEQ ID NO 831 in the 10/666,642US patent application
  misc_feature: The sequence is a functional homolog of SEQ ID NO 832 in the 10/666,642US patent application
  misc_feature: The sequence is a functional homolog of SEQ ID NO 833 in the 10/666,642US patent application
  misc_feature: The sequence is a functional homolog of SEQ ID NO 896 in the 10/412,699US patent application
  misc_feature: The sequence is a functional homolog of SEQ ID NO 903 in the 10/374,780US patent application
  misc_feature: The sequence is a functional homolog of SEQ ID NO 904 in the 10/374,780US patent application
  misc_feature: The sequence is a functional homolog of SEQ ID NO 905 in the 10/374,780US patent application
  misc_feature: The sequence is a functional homolog of SEQ ID NO 907 in the 10/374,780US patent application
  misc_feature: Useful for making plants with modulated biomass
  misc_feature: Useful for making plants with modulated growth and phenotype characteristics
  misc_feature: The sequence is a functional homolog of SEQ ID NO 134 in the 20030093837 US patent application
  misc_feature: The sequence is a functional homolog of SEQ ID NO 12 in the 20040045049 US patent application
  misc_feature: The sequence is a functional homolog of SEQ ID NO 1212 in the 20040045049 US patent application
  misc_feature: The sequence is a functional homolog of SEQ ID NO 1213 in the 20040045049 US patent application
  misc_feature: The sequence is a functional homolog of SEQ ID NO 1214 in the 20040045049 US patent application
  misc_feature: The sequence is a functional homolog of SEQ ID NO 623 in the 20060162006 US patent application
  misc_feature: The sequence is a functional homolog of SEQ ID NO 624 in the 20060162006 US patent application
  misc_feature: The sequence is a functional homolog of SEQ ID NO 625 in the 20060162006 US patent application
  misc_feature: The sequence is a functional homolog of SEQ ID NO 626 in the 20060162006 US patent application
  misc_feature: The sequence is a functional homolog of SEQ ID NO 907 in the 20060162006 US patent application
  misc_feature: The sequence is a functional homolog of SEQ ID NO 1010 in the 20070033671 US patent application
  misc_feature: The sequence is a functional homolog of SEQ ID NO 1012 in the 20070033671 US patent application
  misc_feature: The sequence is a functional homolog of SEQ ID NO 1092 in the 20070033671 US patent application
  misc_feature: The sequence is a functional homolog of SEQ ID NO 1093 in the 20070033671 US patent application
  misc_feature: The sequence is a functional homolog of SEQ ID NO 830 in the 20070033671 US patent application
  misc_feature: The sequence is a functional homolog of SEQ ID NO 831 in the 20070033671 US patent application
  misc_feature: The sequence is a functional homolog of SEQ ID NO 832 in the 20070033671 US patent application
  misc_feature: The sequence is a functional homolog of SEQ ID NO 833 in the 20070033671 US patent application
  misc_feature: Functional homolog of the protein sequence given in SEQ ID NO 13580
  misc_feature: The sequence is a functional homolog of SEQ ID NO 1010 in the 10/666,642 US patent application
  misc_feature: The sequence is a functional homolog of SEQ ID NO 1011 in the 10/666,642 US patent application
  misc_feature: The sequence is a functional homolog of SEQ ID NO. 457 in the 11/188,298 US application
  misc_feature: The sequence is a functional homolog of SEQ ID NO. 351 in the 11/188,298 US application
MCESLSSLMPPSPSPPQPSRPPGQSPEYKHFCRVCNKGFTCGSALGGHMRAHGASDVDGFGADDDLLGDEASTRCLAADQWDTVGTSATHAYALRANPNRLIRSCQLCKNCGKEFTSWELFLQHGKCNSEDEEEEEEVDGLGSLRSPSPPSDADSEEDPTVAAAWSKGKRSRRVRAEETSTVAPPERCTLGEEEDLANCLVMLSSYKSNSKQQTTITATDHHEPACASTKKGDGEPPLQVQPISFFTQTQESVMALPSPVAMVPQYISPASRGVFECKACKKVFTSHQALGGHRASHKKVKGCFAAKFESNASEPTRHSTVIDTNNGNGTSNGKATAVDEGNAGASTDATRVFATTGVEANVGMSTEATSSLSMALLPIGHNPSAATTLAVAAQCKKNAKMHECSVCHRLFTSGQALGGHKRCHWLTSNTSDPCNPVANVIPPLTEDLVGVVKHQLSLRPMVDAPEPVLDLTIAANPVALAASTARPEATNSSFRLDVAPVHLPPLVVAVPGNVSHQKKDVATSSHATDAVAEEDEADSTTAKRAKISDLKDMVSMDGEPMEPWLQVGIGSSSAAGDDS

SEQ ID NO: 2903 - DNA, 867 bp, Sorghum bicolor
  misc_feature: Ceres ANNOT ID no. 6026746
  misc_feature: Encodes the peptide sequence at SEQ ID NO 2904
atggctactccagtgacattccgagatggcgtattcgcggtgctgccaatcctgacacttcttgtaagccccatttcctgctatgagaatccgaggtccgtgtctcttaggaatcgcactaccaccagccggtacacctcaacgccggccagagccgccgatcgatggtactcgggcggcgcgacgtggtatgggagcccttacggcgccggcagcgacggcggtgcgtgcggctatcaaggtaccgtcagccagcgcccgttctcgtcgatgatcgccgccggcggtccttcacttttcaagaacggcaatggctgcggcgcatgctatcagatcaagtgcgccggcaacaaagcctgttccgttcggccagtgactgttaccatcaccgactcctgccctggtggcgtctgcctcgccaggacggcgcactttgacatgagcggcactgccttcggcgccatggccaaccgcggcatggccgaccgcctccgcgccgccggaatcctcaagatccaatacaagagggtgtcgtgcaactacaataatggcgccatgggaggaattgccttcaaggtggaccggggctccaacccgttctacctcgccgtgctgatccagtacctgaacggcgacggtgacctcgccgcggtgcacatcatgcagcagggcggcgcgtggacgccgatgcagcactcgtggggcgccatgtggcgcgccaactccaacaccggcaagccgctgcgcgccccgttctcggtccgactcatctccggctccggcaaggtgctcgtcgtcaggaacgccatccccgccggttggcgcgccggtatgacatactggtcaacggtgaactacgccacctaa

SEQ ID NO: 2904 - protein, 288 aa, Sorghum bicolor
  misc_feature: Ceres ANNOT ID no. 6026746
  misc_feature (92)..(174): Pfam Id: DPBB_1 Pfam Desc: Rare lipoprotein A (RlpA)-like double-psi beta-barrel
  misc_feature (189)..(271): Pfam Id: Pollen_allerg_1 Pfam Desc: Pollen allergen
  misc_feature (11)..(287): NCBI GI: 38345470 NCBI Desc: osjnba0010h02.8 [oryza sativa (japonica cultivar-group)]
  misc_feature (11)..(287): NCBI GI: 16303229 NCBI Desc: beta-expansin 5 [oryza sativa]
  misc_feature (11)..(287): NCBI GI: 75144405 NCBI Desc: expansin-b5 precursor (osexpb5) (beta-expansin-5) (osaexpb1.19)
  misc_feature (11)..(287): NCBI GI: 8118428 NCBI Desc: beta-expansin [oryza sativa]
  misc_feature (11)..(287): NCBI GI: 116310399 NCBI Desc: osigba0143n19.2 [oryza sativa (indica cultivar-group)]
  misc_feature: Useful for making plants with altered cell wall content and/or composition
  misc_feature: Functional homolog of the protein sequence encoded by LOCUS at2g45110
  misc_feature: Useful for making plants with altered carbohydrate content
  misc_feature: Functional homolog of the protein sequence given in SEQ ID NO 13767
  misc_feature: Useful for making plants with altered cell wall content and/or composition
  misc_feature: Functional homolog of the protein sequence given in SEQ ID NO 13768
MATPVTFRDGVFAVLPILTLLVSPISCYENPRSVSLRNRTTTSRYTSTPARAADRWYSGGATWYGSPYGAGSDGGACGYQGTVSQRPFSSMIAAGGPSLFKNGNGCGACYQIKCAGNKACSVRPVTVTITDSCPGGVCLARTAHFDMSGTAFGAMANRGMADRLRAAGILKIQYKRVSCNYNNGAMGGIAFKVDRGSNPFYLAVLIQYLNGDGDLAAVHIMQQGGAWTPMQHSWGAMWRANSNTGKPLRAPFSVRLISGSGKVLVVRNAIPAGWRAGMTYWSTVNYAT

SEQ ID NO: 2905 - DNA, 1890 bp, Sorghum bicolor
  misc_feature: Ceres ANNOT ID no. 6026753
  misc_feature: Encodes the peptide sequence at SEQ ID NO 2906
atgtctcaacacaccattgccgccatgcacgccgccgtgcaccaccaccaccctggccaccgcgcaccgccgcctcgccgctgctctcgcggccacgggcgcagcagcgtcgccgtccgcgccgcggccgccaccaccgtcaccagcaccccgggcgccgcggcgacagcgccggactcgccgtccgcgtcgttctgggactacaacctcctgttccggtcgcagcgcgccgagtgccgcgaccccgtcgcgctccgcgtcaccgagggcgcgatcccggcggacttcccgtcgggcacctactacctcgccggtccggggatgttcaccgacgaccacgggtccaccgtgcacccgctcgacggccacggctacctccgctcgttccgcttcggctccgacggcgcgccggcgcgctactccgcgcggtacgtggagacggcggcgaagcgggaggagcacgacgcgccgcgctcgtcgtggcggttcacgcaccggggccccttctcggtgctgcagggcgggacccgggtgggcaacgtgaaggtgatgaagaacgtggccaacaccagcgtgctgcgctggggcggccgcgtgctctgcctctgggaaggcggcgagccgtacgagctggacccgcggacgctggagaccatcggcccgttcgacatcctcggccgcctcgccaccggcggcgaagcggcacgagacgacgacagcagcgaggctgcgcgtctcgggcgccggcggccgtggctgcaggaggcagggatcgacgtggccgcgcgcctgctgcgaccggtcctcggtggtgtcttcagcatgccggccaagcggctgctcgcgcactacaagatcgaccaggagaggaaccggctgctcatggtggcctgcaacgccgaggacatgctcctcccgcgctccaacttcactttctacgagttcgacgccgacttcgcgctggtgcagacgcgggagtttgtcttgccggaccacctgatgatccacgactggaccttcacggacagccactacgtcctcctcggcaacagaatcaggctggacattccaggttcgctgctggcgctcacgggcactcacccaatgatcgcggccctcgccgtggacccgagccggcagtccacgcccgtctacctgctgccgcgctccccggaggccgaggcccccggccgcgactggagcgtgcccatcgaggcgccatcgcagatgtggtccatgcacgtcggcaacgccttcgaggagcgcaacgcccggggcggcatcaacattcagctccacatgtccggctgctcttaccagtggttcaacttccacaggatgtttggttacaattggcagaacaagaagctggacccgtccttcatgaacatagccaagggcagggaatggctacctcgtcttgtacaggtgtccatcgacctcgacaagagaggaacgtgccgaggatgctccgtccggagattgtccgaccagtggaccaggccggcggacttcccggcgatcaacccaggcttcgccaaccggaggaaccggttcatctacgccggcggcgcctccggttcacgcagattcttgccgtacttccccttcgacagcgtcgtcaaggtagacgtcgctgatggatcagcgcggtcgtggtcagtcgccgggcgcaagttcgttggtgagccggtcttcgtcccgaccggcagtagcgaggatgacggctatgttctgcttgtcgagtatgcagtgtctgatcacaggtgccatctggtggtgctggacgcaaggaagatcggggaaagggacgcagttgtggcaaaacttgaggtgcccaagcacctcaccttcccaatgggattccatgggttctgggcagatgaatga

SEQ ID NO: 2906 - protein, 629 aa, Sorghum bicolor
  misc_feature: Ceres ANNOT ID no. 6026753
  misc_feature (53)..(629): Pfam Id: RPE65 Pfam Desc: Retinal pigment epithelial membrane protein
  misc_feature (53)..(629): NCBI GI: 116310129 NCBI Desc: osigba0122f23.2 [oryza sativa (indica cultivar-group)]
  misc_feature (59)..(493): NCBI GI: 90019042 NCBI Desc: dioxygenase ramosus5 [pisum sativum]
  misc_feature (67)..(234): NCBI GI: 119484919 NCBI Desc: retinal pigment epithelial membrane protein [lyngbya sp. pcc 8106]
  misc_feature (89)..(231): NCBI GI: 119509407 NCBI Desc: retinal pigment epithelial membrane protein [nodularia spumigena ccy9414]
  misc_feature (47)..(231): NCBI GI: 16331020 NCBI Desc: lignostilbene-alpha,beta-dioxygenase [synechocystis sp. pcc 6803]
  misc_feature: Useful for making plants with modulated biomass
  misc_feature: Useful for making plants with modulated drought sensitivity
  misc_feature: GREAT-hit functional homolog of the protein sequence given in SEQ ID NO 13423
  misc_feature: GREAT-hit functional homolog of the protein sequence given in SEQ ID NO 13425
  misc_feature: Useful for making plants with modulated biomass
  misc_feature: Functional homolog of the protein sequence given in SEQ ID NO 13425
MSQHTIAAMHAAVHHHHPGHRAPPPRRCSRGHGRSSVAVRAAAATTVTSTPGAAATAPDSPSASFWDYNLLFRSQRAECRDPVALRVTEGAIPADFPSGTYYLAGPGMFTDDHGSTVHPLDGHGYLRSFRFGSDGAPARYSARYVETAAKREEHDAPRSSWRFTHRGPFSVLQGGTRVGNVKVMKNVANTSVLRWGGRVLCLWEGGEPYELDPRTLETIGPFDILGRLATGGEAARDDDSSEAARLGRRRPWLQEAGIDVAARLLRPVLGGVFSMPAKRLLAHYKIDQERNRLLMVACNAEDMLLPRSNFTFYEFDADFALVQTREFVLPDHLMIHDWTFTDSHYVLLGNRIRLDIPGSLLALTGTHPMIAALAVDPSRQSTPVYLLPRSPEAEAPGRDWSVPIEAPSQMWSMHVGNAFEERNARGGINIQLHMSGCSYQWFNFHRMFGYNWQNKKLDPSFMNIAKGREWLPRLVQVSIDLDKRGTCRGCSVRRLSDQWTRPADFPAINPGFANRRNRFIYAGGASGSRRFLPYFPFDSVVKVDVADGSARSWSVAGRKFVGEPVFVPTGSSEDDGYVLLVEYAVSDHRCHLVVLDARKIGERDAVVAKLEVPKHLTFPMGFHGFWADE

SEQ ID NO: 2907 - DNA, 1050 bp, Sorghum bicolor
  misc_feature: Ceres ANNOT ID no. 6026755
  misc_feature: Encodes the peptide sequence at SEQ ID NO 2908
atgctcctcacgaaaccccacctctccaactcgttcctcccagtcccatccccgccgccctcgagtcccactctcagcttcagctccaaccatgccaggccccttgccgcccctatttgccggcgcagccgcctccgcatctccgccacatccacggctgcgccggctccttccgcggcggcggcggccgctgccaccgcggcgctgagccgagtggacgtgctctcggaggcgctccctttcatccagcgattcaagggcaagacggtggtggtcaagtacggcggtgcggcgatgaagtccccggagctgcaggcgtccgtgatccgcgacctcgtgctcctctcctgcgtcggcctccgccccgtgctcgtccacggcgggggcccggagattaactcctggctgctgcgcgtcggcgtcgagccgcagttccgcgacggcctccgcgtcacggacgcgctcaccatggaggtcgtcgagatggtgctcgtggggacggtcaacaagaacctcgtctccctcatcaacattgcgggaggcaccgccgttggcctctgcggcaaggacgcgcgcctcatcaccgtgcgcccgtccccaaacgcagcggcgctgggattcgtcggcgaggtctcgcgcgtggacgccgccgtcctccatcccatcatcgccgcgggacatatcccagttatcgccaccgtggccgccgacgagactgggcaggcctataacatcaatgccgatacggcggctggtgagatagcagctgccgtgggcgccgagaagctgctgctgctcacggatgtgtctgggattctggcggaccgtaatgaccctgggagcctggtgaaggagatcgacattgctggggtgcggcagatggtggccgacgggaaggtagctggtgggatgatacccaaagtggaatgctgcgttcgcgcccttgcacaaggtgtacacaccgctagtatcattgatgggcgtgtcccacactcccttctgcttgagattctcacagacgagggcacaggcaccatgatcactggctga

SEQ ID NO: 2908 - protein, 349 aa, Sorghum bicolor
  misc_feature: Ceres ANNOT ID no. 6026755
  misc_feature (88)..(326): Pfam Id: AA_kinase Pfam Desc: Amino acid kinase family
  misc_feature (1)..(349): NCBI GI: 116310128 NCBI Desc: osigba0122f23.1 [oryza sativa (indica cultivar-group)]
  misc_feature (1)..(349): NCBI GI: 14140161 NCBI Desc: acetylglutamate kinase-like protein [oryza sativa]
  misc_feature (88)..(349): NCBI GI: 57999648 NCBI Desc: n-acetyl glutamate kinase 2 [oryza sativa (japonica cultivar-group)]
  misc_feature (41)..(349): NCBI GI: 92875742 NCBI Desc: acetylglutamate kinase [medicago truncatula]
  misc_feature (21)..(349): NCBI GI: 21593646 NCBI Desc: acetylglutamate kinase-like protein [arabidopsis thaliana]
  misc_feature (67)..(349): SWISSPROT Homolog: EC 2.7.2.8 Acetylglutamate kinase
MLLTKPHLSNSFLPVPSPPPSSPTLSFSSNHARPLAAPICRRSRLRISATSTAAPAPSAAAAAAATAALSRVDVLSEALPFIQRFKGKTVVVKYGGAAMKSPELQASVIRDLVLLSCVGLRPVLVHGGGPEINSWLLRVGVEPQFRDGLRVTDALTMEVVEMVLVGTVNKNLVSLINIAGGTAVGLCGKDARLITVRPSPNAAALGFVGEVSRVDAAVLHPIIAAGHIPVIATVAADETGQAYNINADTAAGEIAAAVGAEKLLLLTDVSGILADRNDPGSLVKEIDIAGVRQMVADGKVAGGMIPKVECCVRALAQGVHTASIIDGRVPHSLLLEILTDEGTGTMITG

SEQ ID NO: 2909 - DNA, 765 bp, Sorghum bicolor
  misc_feature: Ceres ANNOT ID no. 6026758
  misc_feature: Encodes the peptide sequence at SEQ ID NO 2910
atggagcacgagcaggtggtgtcgcctcaggtgtcagagggctgctgcacctgcagcagcagcagctttagcaacaccaccaccaccagcggcggcggcggctccctgaacgcgtcgtcgccgagctccagcgacgactccggcggcggtggcaacaagggcacgaagcggccgcggagggacctgaagcacccgacgtaccgcggcgtgcgcatgcggacctggggcaagtgggtgtccgagatccgggagccccgcaagaagtcgcgcatctggctcggcacgttcgacaacccggagatggcggcccgcgcgcacgacgccgccgccgtcgccatcaagggccgagccgcgcacctcaactttcccgacctggcacacgagctgccacgcgccgcgtcggcggcgcccaaggacgtgcaggccgccgccgcgctcgccgcggccactgtggtggtggcggcttcacccgccgtcgtcccgtcctcctgcggccacgacgatgccgacgccgagacggaggacctgccgccgcctgagcgggcaatgccggaatgcgagagtgtgaatcaagctcagcttgagcagctgggtggcgacattgacagtggactggggtttacgttcttggacgtgccagacgctcttctagacttcgggcacatgttgtcgccgctgccgcttccgtcttactgtggctcgccgtgggatgacatcgccgatgacctctgcttcgaggagccattgctgctttgggaacactga

SEQ ID NO: 2910 - protein, 254 aa, Sorghum bicolor
  misc_feature: Ceres ANNOT ID no. 6026758
  misc_feature (65)..(116): Pfam Id: AP2 Pfam Desc: AP2 domain
  misc_feature (1)..(254): NCBI GI: 116310705 NCBI Desc: osigba0134h18.5 [oryza sativa (indica cultivar-group)]
  misc_feature (45)..(253): NCBI GI: 21908034 NCBI Desc: dre binding factor 2 [zea mays]
  misc_feature (17)..(254): NCBI GI: 60547461 NCBI Desc: hvcbf7 [hordeum vulgare subsp. vulgare]
  misc_feature (45)..(253): NCBI GI: 25990951 NCBI Desc: dreb-like protein [zea mays]
  misc_feature (29)..(185): NCBI GI: 32455220 NCBI Desc: transcription factor [oryza sativa (japonica cultivar-group)]
  misc_feature: The plant is abnormally small.
  misc_feature: The sequence is a functional homolog of SEQ ID NO 1050 in the 10/666,642US patent application
  misc_feature: The sequence is a functional homolog of SEQ ID NO 1222 in the 10/374,780US patent application
  misc_feature: The sequence is a functional homolog of SEQ ID NO 1226 in the 10/374,780US patent application
  misc_feature: The sequence is a functional homolog of SEQ ID NO 1227 in the 10/374,780US patent application
  misc_feature: The sequence is a functional homolog of SEQ ID NO 1233 in the 10/374,780US patent application
  misc_feature: The sequence is a functional homolog of SEQ ID NO 1234 in the 10/374,780US patent application
  misc_feature: The sequence is a functional homolog of SEQ ID NO 1411 in the 10/412,699US patent application
  misc_feature: The sequence is a functional homolog of SEQ ID NO 159 in the 11/479,226US patent application
  misc_feature: The sequence is a functional homolog of SEQ ID NO 164 in the 11/375,241US patent application
  misc_feature: The sequence is a functional homolog of SEQ ID NO 2218 in the 10/374,780US patent application
  misc_feature: The sequence is a functional homolog of SEQ ID NO 2233 in the 10/666,642US patent application
  misc_feature: The sequence is a functional homolog of SEQ ID NO 36 in the 10/412,699US patent application
  misc_feature: The sequence is a functional homolog of SEQ ID NO 466 in the 11/435,388US patent application
  misc_feature: The sequence is a functional homolog of SEQ ID NO 492 in the 10/225,066US patent application
  misc_feature: The sequence is a functional homolog of SEQ ID NO 706 in the 11/435,388US patent application
  misc_feature: The sequence is a functional homolog of SEQ ID NO 712 in the 11/435,388US patent application
  misc_feature: The sequence is a functional homolog of SEQ ID NO 776 in the 11/435,388US patent application
  misc_feature: The sequence is a functional homolog of SEQ ID NO 778 in the 11/435,388US patent application
  misc_feature: The sequence is a functional homolog of SEQ ID NO 780 in the 11/435,388US patent application
  misc_feature: The sequence is a functional homolog of SEQ ID NO 96 in the 10/714,887US patent application
  misc_feature: The sequence is a functional homolog of SEQ ID NO 96 in the 11/435,388US patent application
  misc_feature: Useful for making plants with altered Lignin content
  misc_feature: Useful for making plants with modulated biomass
  misc_feature: Useful for making plants with modulated growth and phenotype characteristics
  misc_feature: Functional homolog of the protein sequence given in SEQ ID NO 13073
  misc_feature: The sequence is a functional homolog of SEQ ID NO 1411 in the 20040045049 US patent application
  misc_feature: The sequence is a functional homolog of SEQ ID NO 36 in the 20040045049 US patent application
  misc_feature: The sequence is a functional homolog of SEQ ID NO 96 in the 20060015972 US patent application
  misc_feature: The sequence is a functional homolog of SEQ ID NO 1226 in the 20060162006 US patent application
  misc_feature: The sequence is a functional homolog of SEQ ID NO 1227 in the 20060162006 US patent application
  misc_feature: The sequence is a functional homolog of SEQ ID NO 1233 in the 20060162006 US patent application
  misc_feature: The sequence is a functional homolog of SEQ ID NO 1234 in the 20060162006 US patent application
  misc_feature: The sequence is a functional homolog of SEQ ID NO 776 in the 20060272060 US patent application
  misc_feature: The sequence is a functional homolog of SEQ ID NO 778 in the 20060272060 US patent application
  misc_feature: The sequence is a functional homolog of SEQ ID NO 780 in the 20060272060 US patent application
  misc_feature: The sequence is a functional homolog of SEQ ID NO 1050 in the 20070033671 US patent application
MEHEQVVSPQVSEGCCTCSSSSFSNTTTTSGGGGSLNASSPSSSDDSGGGGNKGTKRPRRDLKHPTYRGVRMRTWGKWVSEIREPRKKSRIWLGTFDNPEMAARAHDAAAVAIKGRAAHLNFPDLAHELPRAASAAPKDVQAAAALAAATVVVAASPAVVPSSCGHDDADAETEDLPPPERAMPECESVNQAQLEQLGGDIDSGLGFTFLDVPDALLDFGHMLSPLPLPSYCGSPWDDIADDLCFEEPLLLWEH

SEQ ID NO: 2911 - DNA, 1014 bp, Sorghum bicolor
  misc_feature: Ceres ANNOT ID no. 6026764
  misc_feature: Encodes the peptide sequence at SEQ ID NO 2912
atggctcgagcacctggcggcgcccggaggcggggcggaggcggaggcagcggcaggagggacgtggcggcgggcgggggcgaggcggtgcggaaggggcactggacggcggaggaggacgcggtgctgctggagcacgtgcgcgtgcacgggccccgggactggagctccattcgatccaaaggcttcctgccgcgcaccggcaagtcctgccgcctccgctgggtgaacaagctcaggccagacctcaagactggctgcaaattctctgcagaggaggagcgggtggtgctggagctgcaggcgcagttcgggaacaagtgggcgaggatctccacctacttgccgggcaggacggacaacgacgtcaagaacttctggagcacccgccagaagcggctcgccaggctgctgggaacgcctctccgcggccggtccagcaggagcaggaacaggagcgggagcgccaaggcgcaggcgcctgttgcctcttctctggagccgcgacccgccgccgtggttccctgtctggatcaagttccattggagggcagctcctctggtgttcacccatgcagagcagcaataccattcatggacgctttcggtggagcactgccgctggcctccgatagccacgcgtgctcgtcgtcaaacgctgccgcactgccaccgctgctgccgttcgaccagcctccgtaccctctgctcgacttcccagggctatcggcggcgggctggaacatggctccagctgggttcgccaacgccggcggcgctatggaccatctcgcctaccaggagctgctcccggtgacgcaacccgctccaatgatgctcccgttcttcggcacggagtacccgcacggcggcgtcaagaccgagcttccggacgcggcgcccgacaacttcttcgacgacctgccgccggacatgttcgactcgcttgatcagccgccgccgccgccgccgccaccaccactgtcaccgcctgcgacgagctctggattttga

SEQ ID NO: 2912 - protein, 337 aa, Sorghum bicolor
  misc_feature: Ceres ANNOT ID no. 6026764
  misc_feature (32)..(79): Pfam Id: Myb_DNA-binding Pfam Desc: Myb-like DNA-binding domain
  misc_feature (86)..(131): Pfam Id: Myb_DNA-binding Pfam Desc: Myb-like DNA-binding domain
  misc_feature (1)..(334): NCBI GI: 116310702 NCBI Desc: osigba0134h18.2 [oryza sativa (indica cultivar-group)]
  misc_feature (1)..(334): NCBI GI: 115459768 NCBI Desc: os04g0549500 [oryza sativa (japonica cultivar-group)]
  misc_feature (1)..(286): NCBI GI: 61656675 NCBI Desc: osjnba0065h10.16 [oryza sativa (japonica cultivar-group)]
  misc_feature (12)..(142): NCBI GI: 1707640 NCBI Desc: transcription factor gamyb [oryza sativa (indica cultivar-group)]
  misc_feature (12)..(142): NCBI GI: 73919622 NCBI Desc: transcription factor gamyb (osgamyb)
  misc_feature: The sequence is a functional homolog of SEQ ID NO 126 in the 10/412,699 US patent application
  misc_feature: The sequence is a functional homolog of SEQ ID NO 36 in US patent 7193132
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: Useful for making plants with modulated nitrogen use efficiency
  misc_feature: Functional homolog of the protein sequence given in SEQ ID NO 13807
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO. 395 in the 11/188,298 US application
MARAPGGARRRGGGGGSGRRDVAAGGGEAVRKGHWTAEEDAVLLEHVRVHGPRDWSSIRSKGFLPRTGKSCRLRWVNKLRPDLKTGCKFSAEEERVVLELQAQFGNKWARISTYLPGRTDNDVKNFWSTRQKRLARLLGTPLRGRSSRSRNRSGSAKAQAPVASSLEPRPAAVVPCLDQVPLEGSSSGVHPCRAAIPFMDAFGGALPLASDSHACSSSNAAALPPLLPFDQPPYPLLDFPGLSAAGWNMAPAGFANAGGAMDHLAYQELLPVTQPAPMMLPFFGTEYPHGGVKTELPDAAPDNFFDDLPPDMFDSLDQPPPPPPPPPLSPPATSSGF

SEQ ID NO: 2913 - DNA, 303 bp, Sorghum bicolor
  misc_feature: Ceres ANNOT ID no. 6026765
  misc_feature: Encodes the peptide sequence at SEQ ID NO 2914
atggacgaccgaggcggcggcggcggcggggaggccgagaggtggccgtggtgggcggctgcgagtgcggctcaggccgcggccggggtcgcgtggttccgacgcggcaggggcggaacggctgtggcgatgccgttcaaggcattcgccatcgcctccctcttcgtcggggcgggcgccaccgccgtctccgctggggtgcttgccgcgggcgtcggatcggtggaggagatgaagggcgtgggcgcgagcatccggcggtggatgggagctcctcctcgccgagcgggaggtagtgactaa

SEQ ID NO: 2914 - protein, 100 aa, Sorghum bicolor
  misc_feature: Ceres ANNOT ID no. 6026765
  misc_feature (6)..(100): NCBI GI: 115459766 NCBI Desc: os04g0549400 [oryza sativa (japonica cultivar-group)]
  misc_feature: The plant produces a reduced number of seeds.
  misc_feature: Useful for biocontainment applications
  misc_feature: Useful for making plants with modulated nitrogen use efficiency
  misc_feature: GREAT-hit functional homolog of the protein sequence given in SEQ ID NO 13218
MDDRGGGGGGEAERWPWWAAASAAQAAAGVAWFRRGRGGTAVAMPFKAFAIASLFVGAGATAVSAGVLAAGVGSVEEMKGVGASIRRWMGAPPRRAGGSD

SEQ ID NO: 2915 - DNA, 1608 bp, Sorghum bicolor
  misc_feature: Ceres ANNOT ID no. 6026776
  misc_feature: Encodes the peptide sequence at SEQ ID NO 2916
  misc_feature: Down-regulated in shoot tissues in response to salicylic acid treatment
atggcgctcgccttcgacgagttcgggcgccccttcatcatcctgcgggagcaggagaagaagacgcgactgcgggggctcgacgcgcagaaggccaacatcgccgcgggcaaggccgtcgcgcggatcctccgcacctcgctcggccccaagggcatggacaagatgctccagtcccccgacggcgacgtcatcatcacaaatgatggggcaaccatcttggagcagatggatgttgacaaccagattgcgaagctgatggtggagctgtcccgtagtcaagactatgaaatcggggatggtactaccggcgtggtagtcatggcaggggcgctcctcgagcaggctgagaagcttctggaacgtggtattcaccccattagggtggctgaaggctatgagatggcatcaagggttgcttttgatcacctagaacgtatatcccaaaagtttgagttcactgctgacaacattgagcccctggttcagacatgcatgacaactctatcctcaaagattgtcaaccgttgcaagcgggcattggcagagattgctgtcaaagcagttcttgcggttgcagatttggagaggaaggatgttaacttggatttaattaaagtagaaggcaaggttggtgggaagctggaggacactgagcttgtatatggaattattgttgacaaagatatgagccatccacaaatgccaaagagaattgaggatgctaagattgccatcctgacttgcccatttgagcctccgaagcctaagacaaagcataaggttgacattgatactgtcgagaaattccagacactgcgtgagcaagagcagaaatacttcgatgaaatggttcagaagtgcaaggatgctggtgcaaccctggttatttgtcagtggggttttgatgatgaagccaatcatttgttgatgcacagaaatctgccagctgtcagatgggttggtggtgttgaattggaattgattgccattgctacaggaggaaggattgttcctagattccaagagttgagccctgaaaagcttgggaaggctggattagtcagagaaaaagcatttggaacaacaaaggaccggatgctttacattgagcagtgtgccaattccagagctgtaactattttcattcgtggtggaaacaaaatgatgattgaggagaccaagcgtagtcttcatgatgctctttgtgtggcaaggaatcttatccggaataactcaattgtgtacggcggtggctcagcagagatatcttgttcaattgctgttgaaactgctgcagatcgtcaccctggagttgagcagtatgctatcaggtcatttgctgatgcattagatgctgttccactagccttggctgaaaacagtggtttgtcaccaattgataccttaaccgcagtaaaagcccaacaagttaaggagagcaacccccactgcggtatagactgcaatgatgttggcaccaacgacatgaaagaacagaacgtcttcgagacccttattggcaagcagcaacagatcttgcttgccactcaggtggtgaagatgatcttgaagatcgacgatgtcatctcaccgtccgagtactga

SEQ ID NO: 2916 - protein, 535 aa, Sorghum bicolor
  misc_feature: Ceres ANNOT ID no. 6026776
  misc_feature (40)..(534): Pfam Id: Cpn60_TCP1 Pfam Desc: TCP-1/cpn60 chaperonin family
  misc_feature (1)..(535): NCBI GI: 1587206 NCBI Desc: t complex protein
  misc_feature (1)..(535): NCBI GI: 435175 NCBI Desc: t complex polypeptide 1 [avena sativa]
  misc_feature (1)..(535): NCBI GI: 435173 NCBI Desc: t complex polypeptide 1 [avena sativa]
  misc_feature (1)..(535): NCBI GI: 140054120 NCBI Desc: groel-like chaperone, atpase [medicago truncatula]
  misc_feature (3)..(534): NCBI GI: 27924333 NCBI Desc: cct5-prov protein [xenopus laevis]
  misc_feature: Down-regulated in shoot tissues in response to salicylic acid treatment
MALAFDEFGRPFIILREQEKKTRLRGLDAQKANIAAGKAVARILRTSLGPKGMDKMLQSPDGDVIITNDGATILEQMDVDNQIAKLMVELSRSQDYEIGDGTTGVVVMAGALLEQAEKLLERGIHPIRVAEGYEMASRVAFDHLERISQKFEFTADNIEPLVQTCMTTLSSKIVNRCKRALAEIAVKAVLAVADLERKDVNLDLIKVEGKVGGKLEDTELVYGIIVDKDMSHPQMPKRIEDAKIAILTCPFEPPKPKTKHKVDIDTVEKFQTLREQEQKYFDEMVQKCKDAGATLVICQWGFDDEANHLLMHRNLPAVRWVGGVELELIAIATGGRIVPRFQELSPEKLGKAGLVREKAFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLSPIDTLTAVKAQQVKESNPHCGIDCNDVGTNDMKEQNVFETLIGKQQQILLATQVVKMILKIDDVISPSEY

SEQ ID NO: 2917 - DNA, 1155 bp, Sorghum bicolor
  misc_feature: Ceres ANNOT ID no. 6026780
  misc_feature: Encodes the peptide sequence at SEQ ID NO 2918
atgccgccgccgccgccggtcctggtggaggagcacgtcgaggagatcctcctccgcttctcgccacaacatcccgcgttcctattccgcgccgcgctcgtctgcaagcgctggtgccgcctcatctccagccccggcttccgacgcaggtaccgcgagttccaccgcacgcccccgatgctggcgatcctcgtcaacgccgaggtcgattccgacggctccagcgtgtcccgcttcgtgcccggaagacccgccttctgcctgccgctcctcgagtcccgcagatggcgcgtgctcgacgcacgccacggccgcgtcctcacccgccgcgtcggccgggagccagcagcggaggctgccggcgtcgaactccaagtctgtgatcccatcaccatggagcggcggatggtgcccatcccgtcgccgcgggtgctctgtttggctgcggcggttctctgctcttccacccccgatgcgggcgcctgcgatcaccttgattgccatcgtggacccttcctcgtggttttcgtgggctgccttcatctcgataggaggaccttcatctacaccttctcatctgaaactgctgcatggaacggcccaatcttcactcagctctcaatcagcgccactcctccacggatgaccagcaagtgtgtggggaatgcgctctactttgggtttccaatgtcagacacaatcctcaagtacgaccttcaatcgggacacatctctgggattgaattcccaactgaatgttccttcaatcagtcaaatgtgttcataaccacggagggtggtggactggggattgccagcgtacatcactacgcgctccacacatggtccagggacgatgctgttgggtggatgcaaaccagagccattgagatccagagcctgctccctgtcgacacgctcttggggtcagctgaacctcgtgtggctggctttgcagatcgctttggtatggttttcttgttggtgaacaatgtgctctacttagttcatctctcgacctataaggcgacgaagattttcaggggcattggcataagtatcaacagtgttgtcccttacatgaacttttacactccagctttgggagcatcctgtacaaatgaggggccaagtgctggtggctcaagtgcatga

SEQ ID NO: 2918 - protein, 384 aa, Sorghum bicolor
  misc_feature: Ceres ANNOT ID no. 6026780
  misc_feature (3)..(53): Pfam Id: F-box Pfam Desc: F-box domain
  misc_feature (5)..(374): NCBI GI: 115470391 NCBI Desc: os07g0122900 [oryza sativa (japonica cultivar-group)]
  misc_feature (5)..(384): NCBI GI: 115437584 NCBI Desc: os01g0557400 [oryza sativa (japonica cultivar-group)]
  misc_feature (4)..(366): NCBI GI: 115475786 NCBI Desc: os08g0299900 [oryza sativa (japonica cultivar-group)]
  misc_feature (1)..(177): NCBI GI: 38567955 NCBI Desc: osjnbb0115i21.11 [oryza sativa (japonica cultivar-group)]
  misc_feature (25)..(366): NCBI GI: 115481210 NCBI Desc: os10g0158700 [oryza sativa (japonica cultivar-group)]
MPPPPPVLVEEHVEEILLRFSPQHPAFLFRAALVCKRWCRLISSPGFRRRYREFHRTPPMLAILVNAEVDSDGSSVSRFVPGRPAFCLPLLESRRWRVLDARHGRVLTRRVGREPAAEAAGVELQVCDPITMERRMVPIPSPRVLCLAAAVLCSSTPDAGACDHLDCHRGPFLVVFVGCLHLDRRTFIYTFSSETAAWNGPIFTQLSISATPPRMTSKCVGNALYFGFPMSDTILKYDLQSGHISGIEFPTECSFNQSNVFITTEGGGLGIASVHHYALHTWSRDDAVGWMQTRAIEIQSLLPVDTLLGSAEPRVAGFADRFGMVFLLVNNVLYLVHLSTYKATKIFRGIGISINSVVPYMNFYTPALGASCTNEGPSAGGSSA

SEQ ID NO: 2919 - DNA, 1485 bp, Sorghum bicolor
  misc_feature: Ceres ANNOT ID no. 6026809
  misc_feature: Encodes the peptide sequence at SEQ ID NO 2920
atggagatttgcctttctgcagtcctcggtgagcttactacaagatccataaactttgtcctcagaaaactctcgaagacaccagcactccaagttgaggatcgcctggacaaggtccttctcagaatgcagggcattgtcgacgaggccatggggcggcgcatcacaaaccaagctatgctccagcagcttgacatgctgagagacgccatgcatcgaggatattacatgatcgaagcctacagatgccaatctcacagcaaagagaaggccaaggaacacattgtgagtcactctttacaatcctccaaagcaatttcggtgcaaaacttctgtttctccagtggtactagtacacagattttggaagaaatgaatgttgtgctcgacagtttgagctccatgctccttgatgccagtgagctgatcctcttcttggagagctatcctcgcatgtaccgtgagccttacagcatgcatatcctgttgagcaactgcatgtttgggcgccagatggagacagaactcatcatcaaattcctgctgcacaaagagccagatagtactgaagaattggaggtcttaccgattgtcggtcctggcagagttgggaaaagcacccttgttgcccatgtgtgtaaggatgaaagaatccgcaaccatttctctgaaatcttcttcctgcacaaacatgattttatagatggtgagcatccttttttcaaagaaaggtgtgagatgaagcatcaaagtagcgtgtcgaactcgaataatgagaggagactgttagttgttgagttaattggggatctctatgaagacacatgggataggttgtattcttcttttaaacggagcgtccaaagcagtagtaaaatcataatcacaagttggtctgacaagatcataaagtttggaacaactcaagcgctaactctgaagtatctatcccaggaggcatattggtatttcttcaagacacttacatttggaagcctagatcccatgacccatccaaggcttacaggcatagccatggagatatccaggacactgaatggttccctcattgctgcaaacgtcacttctcttgtgctgaggggcaacattgacatcggcttctggtgcaaggttttggcattcttaagagggtcttaccagaagcatatctcacgatttggcgaccatccaattgatcttatgaaccaaaataggcctgcaagttttgaaagaattgctgcacactctgaagatttcattgttcattgtgagcatcaacgctcttcacaagaggatgttctggagataaaactccacgatcttgtgtatggaagcattaagccacagggaaaatttgaggtcctagcatggaaatctgtgataccaccctactatagctatgtttatgctagtgaaattccagagctaaaaacaaaagctgccaagaggaagcgatgtatgaaaaatgaagtcccgccttgttag

SEQ ID NO: 2920 - protein, 494 aa, Sorghum bicolor
  misc_feature: Ceres ANNOT ID no. 6026809
  misc_feature (153)..(441): Pfam Id: NB-ARC Pfam Desc: NB-ARC domain
  misc_feature (1)..(491): NCBI GI: 22831028 NCBI Desc: fusarium resistance protein i2c-5-like [oryza sativa (japonica cultivar-group)]
  misc_feature (1)..(485): NCBI GI: 115439635 NCBI Desc: os01g0721800 [oryza sativa (japonica cultivar-group)]
  misc_feature (1)..(485): NCBI GI: 18461229 NCBI Desc: p0690b02.14 [oryza sativa (japonica cultivar-group)]
  misc_feature (1)..(485): NCBI GI: 57899231 NCBI Desc: fusarium resistance protein i2c-5-like [oryza sativa (japonica cultivar-group)]
  misc_feature (1)..(434): NCBI GI: 22831034 NCBI Desc: fusarium resistance protein i2c-5-like [oryza sativa (japonica cultivar-group)]
MEICLSAVLGELTTRSINFVLRKLSKTPALQVEDRLDKVLLRMQGIVDEAMGRRITNQAMLQQLDMLRDAMHRGYYMIEAYRCQSHSKEKAKEHIVSHSLQSSKAISVQNFCFSSGTSTQILEEMNVVLDSLSSMLLDASELILFLESYPRMYREPYSMHILLSNCMFGRQMETELIIKFLLHKEPDSTEELEVLPIVGPGRVGKSTLVAHVCKDERIRNHFSEIFFLHKHDFIDGEHPFFKERCEMKHQSSVSNSNNERRLLVVELIGDLYEDTWDRLYSSFKRSVQSSSKIIITSWSDKIIKFGTTQALTLKYLSQEAYWYFFKTLTFGSLDPMTHPRLTGIAMEISRTLNGSLIAANVTSLVLRGNIDIGFWCKVLAFLRGSYQKHISRFGDHPIDLMNQNRPASFERIAAHSEDFIVHCEHQRSSQEDVLEIKLHDLVYGSIKPQGKFEVLAWKSVIPPYYSYVYASEIPELKTKAAKRKRCMKNEVPPC

SEQ ID NO: 2921 - DNA, 1479 bp, Sorghum bicolor
  misc_feature: Ceres ANNOT ID no. 6026812
  misc_feature: Encodes the peptide sequence at SEQ ID NO 2922
atggagattttcctttctgctgtcctcagtgagatggcaaccagatccatacatttcatcatcagcaaatgctccatattgcaagcacaagatgtggatgaccgcctccacaaggtcctgctccgggcacaggtcatcatcgacgaggccatgggacggcagatcacaaaccaagctatgctccagaagctggacatactgagagactccatgcaccaaggctattacatgctcgacagtttcaggtaccaatttatcaacgcggaggatgacagagatcagctcatgagtcaatcgttgtctccctccaaagtaaattattttaaatatttctatcacttgaaaagaaagatacaaatatttgaacagctacaaaagatgctacacaatttgagatccatgatccttgatatggaagaggtggtcatttttttgaccagctaccgccgctcataccgccagccttatagcatgcatatcctgctgggcaattgcttgtttggtcgtcagatggaagtagaacttgcaatcaactttcttttgcacacacaaccccagggtcctccagaattggaggtcatgccgattgtgggtccaggcaaagttggcaagagcactcttgttgctcatgtttgcaaggatgaaagagtctgtgaccgtttctctaaaatcctgtggttgtgtgaccatgattttaaaggtgatgagctggctttcatagaagaatgtacagtgaaacttcaaaatcttgtgactaacctgaacaaggacgagagattactagttgtggttgaattagtcggcgatcccacagaagatgaatggaatagtttgtattctacttctaaacggtgcatgccaaggggtagtaaaatcatagtcacaagccgatcagataaaattgttaggtttggaacaacgcgggctataactctgaagtttcttacccaagaggcattctggtatttcttcaagatccttgtatttggtagtgtggatcctgatatgcacccaaggcttgtgcaattggccatggagatagccaagatgctaaaaggtttcatcactggtgcaaatgtcatatcttctttactgagggacaactttgaaatccacttttggtacaaggttcttatgttctttagaggattcatcaagaagtgcatctccaaatttggtgaacatccatcagatcgtctgagccaagacagacctgcaaagctaggaagaatggcgataccttctgaagaattattggtttatcaatatcaatgctcttcgcagaaggagattccaaagataggaatactagatgtggtgtttggaagtgttaagcctcatggaaaatttgatatgctactatggaggtcccatatacccccctattatagttatgtctattcttgtgagattagagaactaaaaattacaggtgccaagaggaagcgtcctatgagaagtggagccgctgtttgctaa

SEQ ID NO: 2922 - protein, 492 aa, Sorghum bicolor
  misc_feature: Ceres ANNOT ID no. 6026812
  misc_feature (148)..(417): Pfam Id: NB-ARC Pfam Desc: NB-ARC domain
  misc_feature (1)..(480): NCBI GI: 22831028 NCBI Desc: fusarium resistance protein i2c-5-like [oryza sativa (japonica cultivar-group)]
  misc_feature (1)..(431): NCBI GI: 22831034 NCBI Desc: fusarium resistance protein i2c-5-like [oryza sativa (japonica cultivar-group)]
  misc_feature (1)..(489): NCBI GI: 115439635 NCBI Desc: os01g0721800 [oryza sativa (japonica cultivar-group)]
  misc_feature (1)..(483): NCBI GI: 57899231 NCBI Desc: fusarium resistance protein i2c-5-like [oryza sativa (japonica cultivar-group)]
  misc_feature (1)..(483): NCBI GI: 18461224 NCBI Desc: p0690b02.9 [oryza sativa (japonica cultivar-group)]
MEIFLSAVLSEMATRSIHFIISKCSILQAQDVDDRLHKVLLRAQVIIDEAMGRQITNQAMLQKLDILRDSMHQGYYMLDSFRYQFINAEDDRDQLMSQSLSPSKVNYFKYFYHLKRKIQIFEQLQKMLHNLRSMILDMEEVVIFLTSYRRSYRQPYSMHILLGNCLFGRQMEVELAINFLLHTQPQGPPELEVMPIVGPGKVGKSTLVAHVCKDERVCDRFSKILWLCDHDFKGDELAFIEECTVKLQNLVTNLNKDERLLVVVELVGDPTEDEWNSLYSTSKRCMPRGSKIIVTSRSDKIVRFGTTRAITLKFLTQEAFWYFFKILVFGSVDPDMHPRLVQLAMEIAKMLKGFITGANVISSLLRDNFEIHFWYKVLMFFRGFIKKCISKFGEHPSDRLSQDRPAKLGRMAIPSEELLVYQYQCSSQKEIPKIGILDVVFGSVKPHGKFDMLLWRSHIPPYYSYVYSCEIRELKITGAKRKRPMRSGAAVC

SEQ ID NO: 2923 - DNA, 813 bp, Sorghum bicolor
  misc_feature: Ceres ANNOT ID no. 6026845
  misc_feature: Encodes the peptide sequence at SEQ ID NO 2924
atggggcgcggcaaggtgcagctcaagcggatagagaacaagataaaccggcaggtgaccttctccaagcgccgcaacgggctgctcaagaaggcgcacgagatctccgtcctctgcgacgccgaggtcgccgtcatcgtcttctcccccaagggcaagctctatgagtacgccaccgactcccgcatggacaaaattctcgaacgttatgagcgatattcctatgctgaaaaggctcttatttcagctgaatctgaaagtgagggaaactggtgccacgaatacaggaaactgaaggccaaaattgagaccattcaaaaatgccacaagcacctgatgggagaggatctagagtctttgaatcccaaagagctccaacaactagagcagcagctggagagctcactgaagcacatcagatcaagaaagagccaccttatggctgagtctatttctgaactacagaagaaggagaggtcactgcaggaggagaacaaggctctacagaaggaacttgcggagaggcagaaggcggccgcgagcaggcagcagcagcaggtgcagtgggaccagcagacacagacccaggcccagacaagctcatcatcgtcctccttcatgatgaggcaggatcagcagggtctgccgcctccacaaaacatatgcttcccgccgctgataatcggagagagaggtgaagaggtggctgcggcggcgcagcagcagcagccaccaccagggcaggcgcagcagcaagcgcagctccgcatcgcaggtctgccgccatggatgctgagccacctcaatgcataa

SEQ ID NO: 2924 - protein, 270 aa, Sorghum bicolor
  misc_feature: Ceres ANNOT ID no. 6026845
  misc_feature (75)..(174): Pfam Id: K-box Pfam Desc: K-box region
  misc_feature (9)..(59): Pfam Id: SRF-TF Pfam Desc: SRF-type transcription factor (DNA-binding and dimerisationdomain)
  misc_feature (1)..(270): NCBI GI: 12002141 NCBI Desc: mads box protein 3 [zea mays]
  misc_feature (1)..(270): NCBI GI: 939785 NCBI Desc: mads box protein
  misc_feature (1)..(270): NCBI GI: 95981890 NCBI Desc: mads-box transcription factor taagl29 [triticum aestivum]
  misc_feature (1)..(270): NCBI GI: 28630955 NCBI Desc: mads2 [lolium perenne]
  misc_feature (1)..(270): NCBI GI: 91207146 NCBI Desc: mads-box transcription factor 15 (osmads15) (protein apetala1-like a) (fdrmads3) (rmads215)
  misc_feature: Abnormal phyllotaxy, leaf number higher than wild-type
  misc_feature: The plant flowers significantly earllier than wild-type.
  misc_feature: The plant flowers significantly late compared to wild-type.
  misc_feature: The plant is abnormally large.
  misc_feature: The plant produces a reduced number of seeds.
  misc_feature: The sequence is a functional homolog of SEQ ID NO 1056 in the 10/225,066US patent application
  misc_feature: The sequence is a functional homolog of SEQ ID NO 1110 in the 10/225,066US patent application
  misc_feature: The sequence is a functional homolog of SEQ ID NO 1368 in the 10/666,642US patent application
  misc_feature: The sequence is a functional homolog of SEQ ID NO 14 in the 10/666,642US patent application
  misc_feature: The sequence is a functional homolog of SEQ ID NO 1470 in the 10/666,642US patent application
  misc_feature: The sequence is a functional homolog of SEQ ID NO 166 in the 10/374,780US patent application
  misc_feature: The sequence is a functional homolog of SEQ ID NO 18 in the 10/412,699US patent application
  misc_feature: The sequence is a functional homolog of SEQ ID NO 1812 in the 10/412,699US patent application
  misc_feature: The sequence is a functional homolog of SEQ ID NO 188 in the 10/412,699US patent application
  misc_feature: The sequence is a functional homolog of SEQ ID NO 1882 in the 10/412,699US patent application
  misc_feature: The sequence is a functional homolog of SEQ ID NO 194 in the 10/412,699US patent application
  misc_feature: The sequence is a functional homolog of SEQ ID NO 1949 in the 10/412,699US patent application
  misc_feature: The sequence is a functional homolog of SEQ ID NO 1951 in the 10/412,699US patent application
  misc_feature: The sequence is a functional homolog of SEQ ID NO 1953 in the 10/412,699US patent application
  misc_feature: The sequence is a functional homolog of SEQ ID NO 2191 in the 10/666,642US patent application
  misc_feature: The sequence is a functional homolog of SEQ ID NO 2274 in the 10/374,780US patent application
  misc_feature: The sequence is a functional homolog of SEQ ID NO 2278 in the 10/374,780US patent application
  misc_feature: The sequence is a functional homolog of SEQ ID NO 284 in the 10/666,642US patent application
  misc_feature: The sequence is a functional homolog of SEQ ID NO 350 in the 10/374,780US patent application
  misc_feature: The sequence is a functional homolog of SEQ ID NO 409 in the 11/479,226US patent application
  misc_feature: The sequence is a functional homolog of SEQ ID NO 422 in the 11/435,388US patent application
  misc_feature: The sequence is a functional homolog of SEQ ID NO 46 in the 10/666,642US patent application
  misc_feature: The sequence is a functional homolog of SEQ ID NO 568 in the 10/412,699US patent application
  misc_feature: The sequence is a functional homolog of SEQ ID NO 704 in the 10/225,066US patent application
  misc_feature: The sequence is a functional homolog of SEQ ID NO 731 in the 10/666,642US patent application
  misc_feature: The sequence is a functional homolog of SEQ ID NO 782 in the 10/225,066US patent application
  misc_feature: The sequence is a functional homolog of SEQ ID NO 944 in the 10/412,699US patent application
  misc_feature: Useful for biocontainment applications
  misc_feature: Useful for making plants with altered alkaloid content
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated phosphate use efficiency
  misc_feature: Functional homolog of the protein sequence given in SEQ ID NO 12958
  misc_feature: GREAT-hit functional homolog of the protein sequence given in SEQ ID NO 13016
  misc_feature: Functional homolog of the protein sequence given in SEQ ID NO 13161
  misc_feature: GREAT-hit functional homolog of the protein sequence given in SEQ ID NO 13166
  misc_feature: The sequence is a functional homolog of SEQ ID NO 18 in the 20040045049 US patent application
  misc_feature: The sequence is a functional homolog of SEQ ID NO 1812 in the 20040045049 US patent application
  misc_feature: The sequence is a functional homolog of SEQ ID NO 188 in the 20040045049 US patent application
  misc_feature: The sequence is a functional homolog of SEQ ID NO 1882 in the 20040045049 US patent application
  misc_feature: The sequence is a functional homolog of SEQ ID NO 194 in the 20040045049 US patent application
  misc_feature: The sequence is a functional homolog of SEQ ID NO 1949 in the 20040045049 US patent application
  misc_feature: The sequence is a functional homolog of SEQ ID NO 1951 in the 20040045049 US patent application
  misc_feature: The sequence is a functional homolog of SEQ ID NO 1953 in the 20040045049 US patent application
  misc_feature: The sequence is a functional homolog of SEQ ID NO 422 in the 20060272060 US patent application
  misc_feature: The sequence is a functional homolog of SEQ ID NO 14 in the 20070033671 US patent application
  misc_feature: The sequence is a functional homolog of SEQ ID NO 1470 in the 20070033671 US patent application
  misc_feature: The sequence is a functional homolog of SEQ ID NO 2191 in the 20070033671 US patent application
  misc_feature: The sequence is a functional homolog of SEQ ID NO 46 in the 20070033671 US patent application
  misc_feature: The sequence is a functional homolog of SEQ ID NO 731 in the 20070033671 US patent application
  misc_feature: Functional homolog of the protein sequence given in SEQ ID NO 13564
  misc_feature: The sequence is a functional homolog of SEQ ID NO 6 in US patent 7279615
  misc_feature: Useful for biocontainment applications
  misc_feature: Useful for making plants with modulated flowering time
  misc_feature: Functional homolog of the protein sequence given in SEQ ID NO 13016
  misc_feature: Useful for making plants with modulated biomass
  misc_feature: Useful for making plants with modulated phosphate use efficiency
  misc_feature: Functional homolog of the protein sequence given in SEQ ID NO 13166
  misc_feature: The sequence is a functional homolog of SEQ ID NO 2 in US patent 7273968
  misc_feature: Useful for making plants with altered alkaloid content
  misc_feature: Functional homolog of the protein sequence given in SEQ ID NO 13525
  misc_feature: The sequence is a functional homolog of SEQ ID NO 730 in the 10/666,642 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 46 in the 10/666,642 US patent application
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: The sequence is a functional homolog of SEQ ID NO 4 in US patent 7057087
  misc_feature: Useful for making plants with altered terpenoid content
  misc_feature: Functional homolog of the protein sequence given in SEQ ID NO 13021
  misc_feature: The sequence is a functional homolog of SEQ ID NO 1701 in the 10/412,699 US patent application
  misc_feature: The sequence is a functional homolog of SEQ ID NO 1949 in the 10/412,699 US patent application
  misc_feature: The sequence is a functional homolog of SEQ ID NO 1955 in the 10/412,699 US patent application
  misc_feature: Useful for making plants with altered lignin content
  misc_feature: Functional homolog of the protein sequence given in SEQ ID NO 12944
  misc_feature: Useful for making plants with modulated nitrogen use efficiency
  misc_feature: Functional homolog of the protein sequence given in SEQ ID NO 12982
  misc_feature: The sequence is a functional homolog of SEQ ID NO 1965 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1963 in the 10/412,699 US patent application
  misc_feature: The sequence is a functional homolog of SEQ ID NO 1967 in the 10/412,699 US patent application
  misc_feature: The sequence is a functional homolog of SEQ ID NO. 518 in the 11/188,298 US application
  misc_feature: The sequence is a functional homolog of SEQ ID NO. 361 in the 11/188,298 US application
  misc_feature: The sequence is a functional homolog of SEQ ID NO. 273 in the 11/188,298 US application
  misc_feature: The sequence is a functional homolog of SEQ ID NO. 359 in the 11/188,298 US application
  misc_feature: The sequence is a functional homolog of SEQ ID NO. 420 in the 11/188,298 US application
  misc_feature: The sequence is a functional homolog of SEQ ID NO. 377 in the 11/188,298 US application
  misc_feature: The sequence is a functional homolog of SEQ ID NO. 491 in the 11/188,298 US application
MGRGKVQLKRIENKINRQVTFSKRRNGLLKKAHEISVLCDAEVAVIVFSPKGKLYEYATDSRMDKILERYERYSYAEKALISAESESEGNWCHEYRKLKAKIETIQKCHKHLMGEDLESLNPKELQQLEQQLESSLKHIRSRKSHLMAESISELQKKERSLQEENKALQKELAERQKAAASRQQQQVQWDQQTQTQAQTSSSSSSFMMRQDQQGLPPPQNICFPPLIIGERGEEVAAAAQQQQPPPGQAQQQAQLRIAGLPPWMLSHLNA

SEQ ID NO: 2925 - DNA, 2022 bp, Sorghum bicolor
  misc_feature: Ceres ANNOT ID no. 6026855
  misc_feature: Encodes the peptide sequence at SEQ ID NO 2926
atggcgggcggcgaccgggagcgggacgcggaggaggagacgcggaaccagatgatgcagaacctcttcggggaccagtcggaggacgaggaagacgcggacgacgacgacgacgtcgtcgaggtcgtcgacgaggacgacggccaccagcaacagctgcagtcgcccccgcaccaccaccaggagctggacgacgacgccgaagacgacgaggaggacgacgcccgcagccacgcgcacgcccgccacggcggataccactctgaagaagtggatggggaggcagagaatggaggggaaggtgaaggcgaaagtgaggggcaagttggaatggaagaggaaagtgaaggcgaagctcatcgtgccgatcttgatcaaggagaaagtgatggggataaagtccagagctccccagaaagagaactcgatgaccagaggatggaacctgatgcaggaggaatggatagtgaagatgaaggctaccagcagaggacagtatctagcagaagaaggggagttgttgcctctgaatcagagggatctgaagataattactatgctgatggagctcaagaagacgaggaacctcgccaaacaaggaaacaaagctctccgatggaggaagaaagagatcatgaagtagttcgtgatgtgtttggtgagagtgatgaagatgaaccagctccatatcgcgctcgtcatgaaattgatgaagaatctcatagatctcccatggatgatgaaggccagtatgagaaggacatgcaaccagatgacgatgtggctgatgaagatatgcgatatgaatctgatgataatcgtgaactgaaaacaaaagagaaaccagtcggtccaccgctagacttggtggttccatttaagcaaccaccagctcaacctgataaaatgaatgtgatcaaggtatcgaacattatggggatcgaccctaaaccctttaatccaaaaacatatgtggaagaagatgtttttgttacagatgaatctgggactaagaaaaggatacggctagaggacaatattgtgcggtggagaactgttaggaatgcagatggcactacatcttgtgaaagcaatgcacgctttgtaaaatggaaggatggaagtatgcagcttctgattggcaatgaggttcttgacatatctgtacatgaggcacatcatgaccagtcccatctgtttttgaggcatgggaagggaattctacaatcacaaggaaggcttttgcgcaaaatgcgatttatgccatcctccttgtcttcaaagtcacatcgcttattaactgccctggttgattctcagaataagaaaaccgttaagatgcaaaaatggtttgagactaaggatcctgagaaagcgaaaatggaaagagaaaggaatcagagccaaactattcgagcccattcgatccttcaacgcaaaagagaaaaagtgaaccgcaagtacacacaacctgcccggccaaggcgacaactttctccagggttcttagaagacgctctagatgaggatgaggagccagactatggttctcggcgaatgacaggtcgtagacgttttgaggatgaattggaggctgaagcactagctgagaggcgtatcattaacgcaaagaagtcaaatatgagcagaaatgttcctcgcaaaccactgtaccctcctgctcgtccaccaagacgtcaagctgatgaatactcagagagtgagcgggaggagtcagagtatgaaaccgacggcgaggatattgagcattcaccgcctcgtggaagggaggatgagctggatgaggaggaagaatatgaggaagatgttgaagaagaagcgcctctgtcagatgaagaaatggaggcaccgaaacggaaaagagaatcagtgggtggtggccacaggcgcgaggagctggtgtccgaggatgacgacgacgacgattctccaccaaggaagcagccggctgttcagcatcgtagaaagactgtcatgtttgatgacagcgacgacgactaa

SEQ ID NO: 2926 - protein, 673 aa, Sorghum bicolor
  misc_feature: Ceres ANNOT ID no. 6026855
  misc_feature (235)..(596): Pfam Id: Leo1 Pfam Desc: Leo1-like protein
  misc_feature (1)..(479): NCBI GI: 115470253 NCBI Desc: os07g0109600 [oryza sativa (japonica cultivar-group)]
  misc_feature (66)..(673): NCBI GI: 30697488 NCBI Desc: leo1-like family protein [arabidopsis thaliana]
  misc_feature (66)..(673): NCBI GI: 21929715 NCBI Desc: vernalization independence 4 [arabidopsis thaliana]
  misc_feature (2)..(613): NCBI GI: 46309501 NCBI Desc: senescence downregulated leo1-like [danio rerio]
  misc_feature (7)..(609): NCBI GI: 51980343 NCBI Desc: similar to senescence downregulated leo1-like [rattus norvegicus]
MAGGDRERDAEEETRNQMMQNLFGDQSEDEEDADDDDDVVEVVDEDDGHQQQLQSPPHHHQELDDDAEDDEEDDARSHAHARHGGYHSEEVDGEAENGGEGEGESEGQVGMEEESEGEAHRADLDQGESDGDKVQSSPERELDDQRMEPDAGGMDSEDEGYQQRTVSSRRRGVVASESEGSEDNYYADGAQEDEEPRQTRKQSSPMEEERDHEVVRDVFGESDEDEPAPYRARHEIDEESHRSPMDDEGQYEKDMQPDDDVADEDMRYESDDNRELKTKEKPVGPPLDLVVPFKQPPAQPDKMNVIKVSNIMGIDPKPFNPKTYVEEDVFVTDESGTKKRIRLEDNIVRWRTVRNADGTTSCESNARFVKWKDGSMQLLIGNEVLDISVHEAHHDQSHLFLRHGKGILQSQGRLLRKMRFMPSSLSSKSHRLLTALVDSQNKKTVKMQKWFETKDPEKAKMERERNQSQTIRAHSILQRKREKVNRKYTQPARPRRQLSPGFLEDALDEDEEPDYGSRRMTGRRRFEDELEAEALAERRIINAKKSNMSRNVPRKPLYPPARPPRRQADEYSESEREESEYETDGEDIEHSPPRGREDELDEEEEYEEDVEEEAPLSDEEMEAPKRKRESVGGGHRREELVSEDDDDDDSPPRKQPAVQHRRKTVMFDDSDDD

SEQ ID NO: 2927 - DNA, 1665 bp, Sorghum bicolor
  misc_feature: Ceres ANNOT ID no. 6026856
  misc_feature: Encodes the peptide sequence at SEQ ID NO 2928
atgccgccgccgtctgcgtctgacaccgtcatcgacccgcgcagcggctactgcgcgtcgacgaagacattccacagcttgcgcacgccggagccgccgctgccttcaccagacctcccgctctccttcccggccttcgccctatccttcctcccctccccgctgcccgcggccccgtcccgcccagcgcttgtcgacgcggggaccggcgagtccgtcccgttcgggaccttcctttccaggctccgcgcgctcgccgccgcgctgcgctccaggctccgcctcgccccgggcgacgtcgcgttcgtgctcgcgccggccggcgtccacgtccccgtgctctactacgcgctcatgtccgtcggcgccgtcgtgtcgcccgccaacccgtccctcaccgccgccgaggtctcccgcctgctcgcgctctccaacccgtccgtcgcgttcgccgtctccggcaccaggggaaagctccctccgggcctccgcaccgtgctgctcgactccccgacgttcctatcgttcctgatgcatgatgagcccgaggacggggacgcggtagtggtggtccggcagtcggacccagcggcggtgctgtactcctcgggcaccacggggcgcgccaaggcggtcgtgctcacccaccgcaacctcatcgcctccaacgccacgcgggcgcccgtggccgggggcacgctcatgctcgccgtgccgctcttccacatctacggcttcgccttctgcctcagggcggcgtcggcggcgcacacgctgttgctgcacacggccaggggcaggttcgacgccgccgcggtgctagctgcgatggggaggttcggcgtcacgcgcctcgcgctggcgccgccggcgctgctggccatcgtgcgcgccgccgaggaggaggcggacgcgggcgcggccgccgcccgcgtcgccacgctcaaggcggtgaattgcggcggcgcgcccgtctcggctgacctcattgcccgcttctcgcgcatgttccccggcgtcagcgttagccaggggtatggtctcacggagactacagccggtttctgccgtgctgttggtgaggaagaaagcgcgcgagttggatccgttggccgtctttcatggggcgctgaagtgaagattgttcatccagaaacaagggctgccctgcctcctggtgtgtcaggggagctttgggtccgaggcccttttgtaatgaaaggttaccttggtgaggaggattctacatctgagatcttcgacagtgaaggatggttgaggacaggagatctctgttatattgaccaagacgggtttgtttacattgttgaccgactgaaagagttaattaagtacaaaggctaccaggtgcctcctgcagaactcgaaagcctgcttcagacacacccagatattgttgaagctgcagttgtcccataccctgatgatgaggctggagagttgccggtagcattcgtcgtgagacgcccaggaagtcacttgaacgaatcacatatcaaagaattcgttgccagtcaggttgtgcactacaagagaatccaccatgtttttcttgtggattcaataccgaaaaatgcggcgggtaaaattttacgcaaggacttggccaagctagcattgtggcgtatcagctccaagctatag

SEQ ID NO: 2928 - protein, 554 aa, Sorghum bicolor
  misc_feature: Ceres ANNOT ID no. 6026856
  misc_feature (74)..(477): Pfam Id: AMP-binding Pfam Desc: AMP-binding enzyme
  misc_feature (10)..(554): NCBI GI: 29888154 NCBI Desc: 4-coumarate-coa ligase-like protein [arabidopsis thaliana]
  misc_feature (10)..(554): NCBI GI: 36312839 NCBI Desc: 4-coumarate coa ligase isoform 4 [arabidopsis thaliana]
  misc_feature (11)..(546): NCBI GI: 29893225 NCBI Desc: 4-coumarate-coa ligase-like protein [arabidopsis thaliana]
  misc_feature (11)..(464): NCBI GI: 8778603 NCBI Desc: f5m15.17 [arabidopsis thaliana]
  misc_feature (7)..(550): NCBI GI: 29888141 NCBI Desc: 4-coumarate-coa ligase-like protein [arabidopsis thaliana]
  misc_feature: Useful for making plants with altered cell wall content and/or composition
  misc_feature: Functional homolog of the protein sequence encoded by LOCUS at5g63380
MPPPSASDTVIDPRSGYCASTKTFHSLRTPEPPLPSPDLPLSFPAFALSFLPSPLPAAPSRPALVDAGTGESVPFGTFLSRLRALAAALRSRLRLAPGDVAFVLAPAGVHVPVLYYALMSVGAVVSPANPSLTAAEVSRLLALSNPSVAFAVSGTRGKLPPGLRTVLLDSPTFLSFLMHDEPEDGDAVVVVRQSDPAAVLYSSGTTGRAKAVVLTHRNLIASNATRAPVAGGTLMLAVPLFHIYGFAFCLRAASAAHTLLLHTARGRFDAAAVLAAMGRFGVTRLALAPPALLAIVRAAEEEADAGAAAARVATLKAVNCGGAPVSADLIARFSRMFPGVSVSQGYGLTETTAGFCRAVGEEESARVGSVGRLSWGAEVKIVHPETRAALPPGVSGELWVRGPFVMKGYLGEEDSTSEIFDSEGWLRTGDLCYIDQDGFVYIVDRLKELIKYKGYQVPPAELESLLQTHPDIVEAAVVPYPDDEAGELPVAFVVRRPGSHLNESHIKEFVASQVVHYKRIHHVFLVDSIPKNAAGKILRKDLAKLALWRISSKL

SEQ ID NO: 2929 - DNA, 1662 bp, Sorghum bicolor
  misc_feature: Ceres ANNOT ID no. 6026861
  misc_feature: Encodes the peptide sequence at SEQ ID NO 2930
atggcgccggctccgtgcgacctcgaaatcgacccgcgcagcggctactgcgcggcgacgaggacgttccacagcctgcgttcgccggcgccgctacctccgccagacctcccgctctccttcccgaccttcgcgctgtccttcctccccgacccgctgcccccgtcgtcccgcccggcgctcgtcgacgccggcacgggcgaggccgtcccgttcccggccttcctgtccaggacccgcgtgctcgctgccgcgctccgcgcccgcggcggcctctcccccggcgacgtcgccttcgtcctcgcgcccgccgacgtccacgtccccgtgctctactacgcgctcatggccatcggcgccgtcgtgtcccccgccaacccggcgctcaccgccgccgaggtctcccgcctgctcgcgctctccaacccccgcgtcgccttcgccgtcgcgagcaccagggacaagctcccacccgggctccgcaccgtgctcctcgactccccgacgttcctctcgttcctgcacgagtccgagccggagctcgagccacaacaacaggtggtggtccggcagtcggacccggcggcggtgctgtactcgtcgggcaccacggggcgcgccaaggcggtcgtgctcacccaccgcaacctgatgcccagcgtcgccacgcaggcgccggcgccggggccggaggtgtttatggtcgccgtgccgctcttccatatctacggcttcaccttctgcctcagtgtggtgtcggcggcgcacacgctggtgctgcacacgtccaggaggaggttcgacgccacggcggtcctagctgacataccaaggtttggagtaacgcgcctcgcgctggcgccgcccgcgctgctggccatcgtgcgggccgccgaggaggacgcgggcgcggtggccaccgccaccggcctgtccacgctcaaggcggtgagctgcggcggcgccgccgtctcggctaaccacattgcgcgcttctcgcgcaggttccccggcgtaagccttgcccaggggtatggtcttacggagactacatccggtttctgccgtgctgttggagacgaagaaagcgcgcgaattggatccgtgggccgtctttcatggggcgctgaagtgaagattgttcatccggaaacaggggctgccatgcctcctggtgtgccaggggagctttgggtccgaggcccttttgtcatgaaaggttaccttggcgagaaggatgctacatctgagatcttggacagtgaaggatggctgaggacaggagatgtttgttacattgaccaggacgggtttgtttacattgtggacaggctgaaagagttaatcaagtacaaaggctaccaggtgcctcctgcagaactcgaaaacctgcttcaaacacaccgagaaatcgatgaagctgcagttatcccataccctgatgaggaggctggagagttgccggtagcgttcatcgtcagacgcccaggaagtcacttgcacgaatcacacatcaaagagttcgtcgcaaaacaggttgtgcactacaagcgaatccaccatgttttccttgtggattcgataccgaaaaatgcggcgggtaagattctacgcaaggacttggccaagatagcattgcggcgtatcagctccaagctataa

SEQ ID NO: 2930 - protein, 553 aa, Sorghum bicolor
  misc_feature: Ceres ANNOT ID no. 6026861
  misc_feature (71)..(476): Pfam Id: AMP-binding Pfam Desc: AMP-binding enzyme
  misc_feature (10)..(553): NCBI GI: 29888154 NCBI Desc: 4-coumarate-coa ligase-like protein [arabidopsis thaliana]
  misc_feature (10)..(553): NCBI GI: 36312839 NCBI Desc: 4-coumarate coa ligase isoform 4 [arabidopsis thaliana]
  misc_feature (10)..(553): NCBI GI: 29893225 NCBI Desc: 4-coumarate-coa ligase-like protein [arabidopsis thaliana]
  misc_feature (10)..(463): NCBI GI: 8778603 NCBI Desc: f5m15.17 [arabidopsis thaliana]
  misc_feature (1)..(536): NCBI GI: 8778604 NCBI Desc: f5m15.18 [arabidopsis thaliana]
  misc_feature: Useful for making plants with altered cell wall content and/or composition
  misc_feature: Functional homolog of the protein sequence encoded by LOCUS at5g63380
MAPAPCDLEIDPRSGYCAATRTFHSLRSPAPLPPPDLPLSFPTFALSFLPDPLPPSSRPALVDAGTGEAVPFPAFLSRTRVLAAALRARGGLSPGDVAFVLAPADVHVPVLYYALMAIGAVVSPANPALTAAEVSRLLALSNPRVAFAVASTRDKLPPGLRTVLLDSPTFLSFLHESEPELEPQQQVVVRQSDPAAVLYSSGTTGRAKAVVLTHRNLMPSVATQAPAPGPEVFMVAVPLFHIYGFTFCLSVVSAAHTLVLHTSRRRFDATAVLADIPRFGVTRLALAPPALLAIVRAAEEDAGAVATATGLSTLKAVSCGGAAVSANHIARFSRRFPGVSLAQGYGLTETTSGFCRAVGDEESARIGSVGRLSWGAEVKIVHPETGAAMPPGVPGELWVRGPFVMKGYLGEKDATSEILDSEGWLRTGDVCYIDQDGFVYIVDRLKELIKYKGYQVPPAELENLLQTHREIDEAAVIPYPDEEAGELPVAFIVRRPGSHLHESHIKEFVAKQVVHYKRIHHVFLVDSIPKNAAGKILRKDLAKIALRRISSKL

SEQ ID NO: 2931 - DNA, 1149 bp, Sorghum bicolor
  misc_feature: Ceres ANNOT ID no. 6026862
  misc_feature: Encodes the peptide sequence at SEQ ID NO 2932
atggcgccgcggccggcggcggcggcggcgctgatggacgagctcgtggaggagatcctcctccgcattccgccggacgacccagcgcgcctcctccgcgccgcgctcgtctgcaagcgctggtgccgcattgtctccgaccctggattccgccgccggttctgtgagttccaccggaagcccccgatgctcggattcgtctgcaccgccgggccatggtgcacctctggccccctcacctccttcgtctccaccacctccttccgctcgtcccccgcccgcctcgactacagggcggtcgacgcacgccatggccgcgtcctcctccacggcgagatctggaaccataagcggaagcactgggacgattccttggtggtttgggatccaatcacgggggttgagcgtgcgagactaaccttgccgccgcggtccaggcaccaggaggccaaccacagctctggtatctggaatgtggccgtgctctgcgcctccgccgccgttgacgacgcctgtgatcacctcgattgccacagcggacccttcctggttgtctttgtggctaggggcaggcgctggggcaggtctgggatgtgtgcccaagtctactcatccgaggctgctgcgtggagccatcggatctatggtcctcgcctctcagagcatatagaatgggtgccaagcgcgcttgcagggaattcgatgtacttcttgtgtagcaaaagtgttctcaagtttgatctgaccacacgagaaatgtctctgattgacctgccacaagaaacctttagtagcgctatgctcaggacaacagaggatgctgttctgggactagccaacatgtgctcagatggactacacctatggtcaatggaggttggtcctaacgaggttgtaggatgggcacaaagcaaagtcattaagcttacagaattacctccaggtgatccaatagactcactttctttgactggcttcgcacatggccttgatgttattcttgtgtgcacacttgaggggattttcactattgatctgaagtccgtccgggtcacaaaggtgtgccaagatagttctttggcctgtttcactttcccctacatgagcttctacactccagcattgggagcggccgcctctgccgagtga

SEQ ID NO: 2932 - protein, 382 aa, Sorghum bicolor
  misc_feature: Ceres ANNOT ID no. 6026862
  misc_feature (6)..(56): Pfam Id: F-box Pfam Desc: F-box domain
  misc_feature (7)..(373): NCBI GI: 115470391 NCBI Desc: os07g0122900 [oryza sativa (japonica cultivar-group)]
  misc_feature (11)..(375): NCBI GI: 115437584 NCBI Desc: os01g0557400 [oryza sativa (japonica cultivar-group)]
  misc_feature (4)..(375): NCBI GI: 115481076 NCBI Desc: os10g0137700 [oryza sativa (japonica cultivar-group)]
  misc_feature (78)..(373): NCBI GI: 115475786 NCBI Desc: os08g0299900 [oryza sativa (japonica cultivar-group)]
  misc_feature (1)..(248): NCBI GI: 38567955 NCBI Desc: osjnbb0115i21.11 [oryza sativa (japonica cultivar-group)]
  misc_feature: The sequence is a functional homolog of SEQ ID NO. 456 in the 11/188,298 US application
MAPRPAAAAALMDELVEEILLRIPPDDPARLLRAALVCKRWCRIVSDPGFRRRFCEFHRKPPMLGFVCTAGPWCTSGPLTSFVSTTSFRSSPARLDYRAVDARHGRVLLHGEIWNHKRKHWDDSLVVWDPITGVERARLTLPPRSRHQEANHSSGIWNVAVLCASAAVDDACDHLDCHSGPFLVVFVARGRRWGRSGMCAQVYSSEAAAWSHRIYGPRLSEHIEWVPSALAGNSMYFLCSKSVLKFDLTTREMSLIDLPQETFSSAMLRTTEDAVLGLANMCSDGLHLWSMEVGPNEVVGWAQSKVIKLTELPPGDPIDSLSLTGFAHGLDVILVCTLEGIFTIDLKSVRVTKVCQDSSLACFTFPYMSFYTPALGAAASAE

SEQ ID NO: 2933 - DNA, 1056 bp, Sorghum bicolor
  misc_feature: Ceres ANNOT ID no. 6026863
  misc_feature: Encodes the peptide sequence at SEQ ID NO 2934
atggctccgcggccgccgccggcggagctgatggacgagctcgtggaggagatcctcctccgcatcccgccagacgaccccacgcgcctcctccgcgccgcgctcgtctgcaagcgctggtgccgcatcgtctccgccgccggcttccgcctccgattccgtgagttccaccgcacgccccccatcctcggattcctccacaaccaccggctgtcctacactttggtctccaccacctcatccttccgcccgccccctgccgcctgccccaactcctaccgcgcgaccgacgcgcgccacggccgcgtcctcctcagccgccaccgttgttatcggaataccttggcgattgctttcgtggtttgggatccaatcaggggccagagtacggaactgcccttgctaccgtcgtctgatacctggaacgcggcggtgctctgcgccgccgtcggcgcctgtgaccacctcgactgtcaacacgggcctgaattccttgtcgtctttgtgggcacaggcaacggcaatggcaatggcgggacatttgcccatgtctactcatcggaggctgctgcatggagcaagcgaatctctgcgcagcacctccacgaggatatccgttcgctgccaagtgccctcgcagggaatgcgctctacttcgtgtgtagcacaattatcctcaagtatgaccttgctgctcgagaaatgtctgtgattcacttgccaggagaatttcgaacaacagaggacggtggactgggactcgccagcatccgctcacatcgactatacctccacgaatggtcaatcgaggatgcaggatgggtacaaagcaaagtcattaagcttacaaaattacttcctgatgaaaccttaggctcacttcggctgactggctttgcacacggccttgatattattcttgtggcggcaattgagaggactttcactattgacctgaagtctctccaggtcacaaaggtctgtgaagaaggttggtgctatggcattttcccctacatgagcttctgcaatccaggtagtagagtaagactctag

SEQ ID NO: 2934 - protein, 351 aa, Sorghum bicolor
  misc_feature: Ceres ANNOT ID no. 6026863
  misc_feature (5)..(55): Pfam Id: F-box Pfam Desc: F-box domain
  misc_feature (7)..(347): NCBI GI: 115470391 NCBI Desc: os07g0122900 [oryza sativa (japonica cultivar-group)]
  misc_feature (4)..(288): NCBI GI: 115437584 NCBI Desc: os01g0557400 [oryza sativa (japonica cultivar-group)]
  misc_feature (3)..(138): NCBI GI: 38567955 NCBI Desc: osjnbb0115i21.11 [oryza sativa (japonica cultivar-group)]
  misc_feature (2)..(250): NCBI GI: 115481076 NCBI Desc: os10g0137700 [oryza sativa (japonica cultivar-group)]
  misc_feature (23)..(262): NCBI GI: 115481210 NCBI Desc: os10g0158700 [oryza sativa (japonica cultivar-group)]
MAPRPPPAELMDELVEEILLRIPPDDPTRLLRAALVCKRWCRIVSAAGFRLRFREFHRTPPILGFLHNHRLSYTLVSTTSSFRPPPAACPNSYRATDARHGRVLLSRHRCYRNTLAIAFVVWDPIRGQSTELPLLPSSDTWNAAVLCAAVGACDHLDCQHGPEFLVVFVGTGNGNGNGGTFAHVYSSEAAAWSKRISAQHLHEDIRSLPSALAGNALYFVCSTIILKYDLAAREMSVIHLPGEFRTTEDGGLGLASIRSHRLYLHEWSIEDAGWVQSKVIKLTKLLPDETLGSLRLTGFAHGLDIILVAAIERTFTIDLKSLQVTKVCEEGWCYGIFPYMSFCNPGSRVRL

SEQ ID NO: 2935 - DNA, 834 bp, Sorghum bicolor
  misc_feature: Ceres ANNOT ID no. 6026864
  misc_feature: Encodes the peptide sequence at SEQ ID NO 2936
atggcactcgttgtgatgtgtgggcagccatgcagcggcaaatcagcagccgcttcttgcctttctgcggcactgcgctcctcctcgcctgaccttactgtccgtatcattgatgagtcatccctccatctcgggcgcaacgatagttacaaagatatggttgtggagaaaaacttgagaggagttcttagatcagaagttgacaggtctgtgtcacgtgacagcataattatcgtcgactctttgaacaatattaaggggtaccgttatgagttgtggtgtcttgcgcgtgcatctggtgtaagatattgtgtgcttttttgtgatacagaagtggaccattgtagggaatggaacagcaaccgccaggagaaaggagaatttgaagatcttgtaaggagatttgagaagccagataggcgtaatcgttgggattcccctctttttgaattgtttccatctagagatgaaatagtagaaacggctcctgttattgctgaggctgtgtcgtatttgacaaagaaagtggattccaaaacaagagacgtaaaagttctccagcctacaatagccactcagacggttcgaacaacagaggctaattccctctatgagatggacaaagctacacaggaggtggtcaatgcaattgttgaagcacaatcttgcggtcttgggcttagatctgttggcctgcctgagctccgaagcctgcgtcgaactttcatcaagctggcagggcagtacagtctgagtgggccacctccaccgacagatgctgatagcgcaaagaggatgtttgtcgactacttaaaccgtgaagttggtgcatga

SEQ ID NO: 2936 - protein, 277 aa, Sorghum bicolor
  misc_feature: Ceres ANNOT ID no. 6026864
  misc_feature (1)..(272): Pfam Id: KTI12 Pfam Desc: Chromatin associated protein KTI12
  misc_feature (1)..(232): NCBI GI: 23504265 NCBI Desc: drl1 protein [arabidopsis thaliana]
  misc_feature (1)..(272): NCBI GI: 28850452 NCBI Desc: similar to similarity to s. cerevisiae kti12 protein [schizosaccharomyces pombe] [dictyostelium discoideum]
  misc_feature (1)..(275): NCBI GI: 62858797 NCBI Desc: loc549045 [xenopus tropicalis]
  misc_feature (1)..(219): NCBI GI: 44980839 NCBI Desc: abl049cp [eremothecium gossypii]
  misc_feature (1)..(219): NCBI GI: 45185181 NCBI Desc: abl049cp [eremothecium gossypii]
MALVVMCGQPCSGKSAAASCLSAALRSSSPDLTVRIIDESSLHLGRNDSYKDMVVEKNLRGVLRSEVDRSVSRDSIIIVDSLNNIKGYRYELWCLARASGVRYCVLFCDTEVDHCREWNSNRQEKGEFEDLVRRFEKPDRRNRWDSPLFELFPSRDEIVETAPVIAEAVSYLTKKVDSKTRDVKVLQPTIATQTVRTTEANSLYEMDKATQEVVNAIVEAQSCGLGLRSVGLPELRSLRRTFIKLAGQYSLSGPPPPTDADSAKRMFVDYLNREVGA

SEQ ID NO: 2937 - DNA, 1935 bp, Sorghum bicolor
  misc_feature: Ceres ANNOT ID no. 6026868
  misc_feature: Encodes the peptide sequence at SEQ ID NO 2938
atggaagagcagcaagtcaagccattggatctgccacccactagtttggacaaccaggattcagctgcaactcctgttaccagtgcagaccctgttcgtccggctgcaactgattctcccagtaaggttgctggtgccgctcctgctgctgtttcttcacctaccgctgctcctgcagaagatgctgcagggcgtgaggcaccagcatccgtgttttctgcatctggtttatcctcctgggctaagaacctcaaaattccccagccttcatcaggtcaagaatcacctactggaaagaatacctttgcccgtttaacaagtggccttggactgcgtatgtctccaaaagcgccacagcaagatgagggtgctgaaggaagcacatccccaacaacaggacagcctggggtttttggttctttgacaaaaggcattgtggattcctctaagaatgctgtaaaggcagtgcaagtcaaggctcgccacatggtctcacagaataaaagacgataccaggaaggaggatttgatttagacatgacatatattactgagaacataattgctatgggttttcctgctggtgatttgagttcagggctttttggatattttgagggtttctaccgcaaccacatggaggaagtcatcaggttctttgaaatgcaccataaggtgtacaatctttgttctgaaaggctatatgatgcatctctttttgaaggaaaggtggcctgctttccttttgatgatcacaactgtcctccaatacaacttgtcatatcattctgccatagtgcctactcatggttgaaggaggatatagagaatgtggtggttgtccattgcaaagctggtaaggcaaggacaggattgatgatctcaagtcttcttctgtttctaaagttctttcctactgctgaggagtccattgaatactataaccagaaaagatgtgtagatggaaaagggcttattctcccaagtcagattagatacgtgaagtattttgagcgcatcttaacttacttcaatggtgaaaatcagccaccccgaaggtgtatgcttagaggctttcgtcttcatagatgcccctattggattaggccatcaattacagtctctaatcacaatggtgtacttttttctacaaagaagcatccaagaacaaaagaactaatgccagaagatttctggtttagtgcaccaaagaaggggattatggtttttgcattgccaggagaacctggcttagccgaggtagctggtgatttcaagatccagtttcatgatcgacagggagatttttactgctggttaaatacaacaatgatggagaacagggtgactttgaatcccactgatcttgatgattttgacaagagaaaattgccatcacctgggttccaggttgaggttgtcctggtagattacgatggctcgcaaccaccaaaaccaaaaccagccactggacctgctgataataaatctgatgctgattcatcggctagcacggtcgcgaaagaaaataatgctgcacctgcagaatccaacaagggaactggaagcaatgataaagatgaagtgttctctgatagtgacggggaggatggatcatccaagggaagaaaggagaagattgccagcggcggtcaaaacagtgtaaatgctgcgaaaccatctgaaacaagcaacgtgcagaaggaggtatcagctgctgctagtagactggataaagtagctataaccagcgaacaaggaaccacaaaggcacctgatgcatctctcaaaactgaagtcagcagcaagaccagctccctaaccacagcaccacctacagctgctgacaattccagcatgagcgaattcaaggcgattgcagcagatgcatcggtgttctcgttcggagatgaggaggattatgaaagtgagtag

SEQ ID NO: 2938 - protein, 644 aa, Sorghum bicolor
  misc_feature: Ceres ANNOT ID no. 6026868
  misc_feature (36)..(644): NCBI GI: 27447974 NCBI Desc: pten-like protein [arabidopsis thaliana]
  misc_feature (161)..(387): NCBI GI: 60465967 NCBI Desc: 3-phosphatidylinositol 3-phosphatase [dictyostelium discoideum]
  misc_feature (161)..(387): NCBI GI: 18542385 NCBI Desc: pten 3-phosphoinositide phosphatase alpha [dictyostelium discoideum]
  misc_feature (161)..(387): NCBI GI: 19852006 NCBI Desc: pten [dictyostelium discoideum]
  misc_feature (151)..(644): NCBI GI: 19549663 NCBI Desc: cg5671-pe, isoform e [drosophila melanogaster]
MEEQQVKPLDLPPTSLDNQDSAATPVTSADPVRPAATDSPSKVAGAAPAAVSSPTAAPAEDAAGREAPASVFSASGLSSWAKNLKIPQPSSGQESPTGKNTFARLTSGLGLRMSPKAPQQDEGAEGSTSPTTGQPGVFGSLTKGIVDSSKNAVKAVQVKARHMVSQNKRRYQEGGFDLDMTYITENIIAMGFPAGDLSSGLFGYFEGFYRNHMEEVIRFFEMHHKVYNLCSERLYDASLFEGKVACFPFDDHNCPPIQLVISFCHSAYSWLKEDIENVVVVHCKAGKARTGLMISSLLLFLKFFPTAEESIEYYNQKRCVDGKGLILPSQIRYVKYFERILTYFNGENQPPRRCMLRGFRLHRCPYWIRPSITVSNHNGVLFSTKKHPRTKELMPEDFWFSAPKKGIMVFALPGEPGLAEVAGDFKIQFHDRQGDFYCWLNTTMMENRVTLNPTDLDDFDKRKLPSPGFQVEVVLVDYDGSQPPKPKPATGPADNKSDADSSASTVAKENNAAPAESNKGTGSNDKDEVFSDSDGEDGSSKGRKEKIASGGQNSVNAAKPSETSNVQKEVSAAASRLDKVAITSEQGTTKAPDASLKTEVSSKTSSLTTAPPTAADNSSMSEFKAIAADASVFSFGDEEDYESE

SEQ ID NO: 2939 - DNA, 3042 bp, Sorghum bicolor
  misc_feature: Ceres ANNOT ID no. 6026886
  misc_feature: Encodes the peptide sequence at SEQ ID NO 2940
  misc_feature: Up-regulated in root tissues in response to methyl jasmonate treatment
atgggatccgaccgcgccgagctcgcgcgcctctgcagcgcccgcaactggtccaaggccatccgcctcctcgactccatcctggtccgatccccgtcgtccatccacgacctctgcaaccgggccttctgctactcccagctcgagctccacaagcacgtcgtcaaggactgcgaccgcgcgctgctgctcgaccccgccctgcttcaggcctacgttctcaaaggcaaggcactgtcttcattagataaaaaagaggatgctctagctgcttggaagcaaggatatgaaatcgctgtccgtgacacgacagacttgaaacaattgcttgagctggaagaattggtttcttctgttaaaatttgcgagacaaccgagtctgcagaccatgtcatggattcgtcgacttgtgataccaaagttgttatctcagaagatcgtgttgctgacaagtcgctcgctgcaactacaatggctgatacaaaaactgttgtctgtgaggaggccattggcagttccaaagtttcgtcaaatggtgataccaagttaacgaactataataaaaaaacggaccataataaagtctctagcagtccagtgaaagacaccacagggactcaagcccccaagaaggccccaaagtcagataagaaaaacaaagcaaaggcagtgaaagaaataaatggccgagctgaaggtgtaactgtcagaactagtgctgatgaaagcgaaaccattttgctagatcaaacactctttgctacaaaaatttcaaaggcgtcaaaatcaataagcttggatttccgactttcaagaggcattgcacaggtaaatgaaggaaggtatgaccaagcgatatccatttttgatcagatattgcgagaaactcctacgtatcctgaggcactgattggaaggggcacagcttatgcatttcaaagagaattggattctgctatttctgatttcactaaggctatacaatctaacccatcggctggggaggcatggaagcgacggggacaagctcgcgctgctttaggagagttcaaggaggccattgaagacttgactaaagcattggaatttgaaccaaattctcctgatattttacatgaaagaggaattgtgaacttcaaattcaaggactacaactctgcactcgaagatctttcgacatgtgtgaagcgtgacaagaagaacagctctgctcacacttatttaggtcttacgctttcatcactcggagagtacaaacgcgctgaagatgagcatctcattggtttaaagtatgacgagagtttccttgactgttgggctcaccttgcccagctttatcttgatctggcatatccagagaaattgttgaactgccttgagaaagctattcaagttgattcaaggtttgcaaaagcataccatcttcgtggaattctctatcatggaatgggtcgacataggagtgctattaaagaattatcaattgctttgacatatgaaggttcaagtatagagtgcctatacttacgtgcctcatgccatcatgccattggagaatataaagctgcaataaaagattatgatgatgtacttgatttggaacttgattccatggataaatttgtgttgcaatgtttgtccttctaccagaaggaaatggctctatatattgcttcaaaggccaatttggagttctctcagttcaacattgatgatgatgttgacccactatttaaggaatattggtgcaaacgattacatcccaaaaatgtggctgaaaaggtttatcgccagccaccattgcggatctcattgagaaatgggcgccttaacaagcaagacttcaaattcacaaagcatcaaacaacccttcttctagctgcagattcaattgggaagaagattcaatacaattgccgtggcttcttaccaaatcaacgtcagtaccgcatggctgggttggctgctattgagattgctcagaaagtgtccaaggcttggcgctttctaaggaatccgaagaacattgcaaagttagttaggaaaagggataaacttaacatgagccagaacaggggaggttattgtagcactagcactttggctggatctccaacttccagcccaaatgaagacaggatctcctctgggatctctctttcctggcaggatgtctataacattgctgttaagtggagacaaatttctgaaccttgtgatccagttgtttgggtcaacaagctaagtgaagagttcaattctggatttggttctcataccccaatgctccttggtcaagcaaaagttgttcgctactatccatattaccaaagagtcttggaaactgcgaagactataatgcttgacttgaagtatgtcaataatgcagaggaccgtgcaatttttcttacagatattgagaagctgaaaaagatagaagttgcatcgtcatgctcagatttgtaccatgtagttggtgagacctactgggttgctacaagatgtgatagtatggcatttcgggggaggcgtcttgaagggacaagaattaccactcaaaacatgggcaagacaggatttgattttgcaatacgaacaccttgcacaccatcgagatgggaggagtatgatgaagaaatgactgcagcctgggaggctatttgtgaagcatattgtaatgacacaaaccccacacgagaccctggtatgcttgatgctgtgaaggacgcaatattacggatgacatattactggtacaattttatgcctctttcgagaggctcagctgttgttgggtacgtagtgttgctcggtttattcctggcagcaaacatggatatcactgccagcattccacccgatgtccaagttgattgggaggcgatcctgtctccagaccctgacacatttgttgacgctatcaagccctggctgtacccatccacaaaaataagcaggtgcttgaaagattacacggacgtcagcatcgcgttcaacacaacaggttcagttgtagcggccctaacttctgttgacccatag

SEQ ID NO: 2940 - protein, 1013 aa, Sorghum bicolor
  misc_feature: Ceres ANNOT ID no. 6026886
  misc_feature (300)..(333): Pfam Id: TPR_1 Pfam Desc: Tetratricopeptide repeat
  misc_feature (334)..(367): Pfam Id: TPR_1 Pfam Desc: Tetratricopeptide repeat
  misc_feature (504)..(537): Pfam Id: TPR_1 Pfam Desc: Tetratricopeptide repeat
  misc_feature (300)..(333): Pfam Id: TPR_2 Pfam Desc: Tetratricopeptide repeat
  misc_feature (334)..(367): Pfam Id: TPR_2 Pfam Desc: Tetratricopeptide repeat
  misc_feature (1)..(1012): NCBI GI: 34393726 NCBI Desc: tetratricopeptide repeat(tpr)-containing protein-like [oryza sativa (japonica cultivar-group)]
  misc_feature (3)..(945): NCBI GI: 144923982 NCBI Desc: tetratricopeptide-like helical [medicago truncatula]
  misc_feature (123)..(663): NCBI GI: 67474444 NCBI Desc: tpr repeat protein [entamoeba histolytica hm-1:imss]
  misc_feature (701)..(900): NCBI GI: 42761489 NCBI Desc: similar to oryza sativa (japonica cultivar-group). oj1513_f02.22 protein [dictyostelium discoideum]
  misc_feature (160)..(663): NCBI GI: 67469147 NCBI Desc: tpr repeat protein [entamoeba histolytica hm-1:imss]
  misc_feature: Up-regulated in root tissues in response to methyl jasmonate treatment
MGSDRAELARLCSARNWSKAIRLLDSILVRSPSSIHDLCNRAFCYSQLELHKHVVKDCDRALLLDPALLQAYVLKGKALSSLDKKEDALAAWKQGYEIAVRDTTDLKQLLELEELVSSVKICETTESADHVMDSSTCDTKVVISEDRVADKSLAATTMADTKTVVCEEAIGSSKVSSNGDTKLTNYNKKTDHNKVSSSPVKDTTGTQAPKKAPKSDKKNKAKAVKEINGRAEGVTVRTSADESETILLDQTLFATKISKASKSISLDFRLSRGIAQVNEGRYDQAISIFDQILRETPTYPEALIGRGTAYAFQRELDSAISDFTKAIQSNPSAGEAWKRRGQARAALGEFKEAIEDLTKALEFEPNSPDILHERGIVNFKFKDYNSALEDLSTCVKRDKKNSSAHTYLGLTLSSLGEYKRAEDEHLIGLKYDESFLDCWAHLAQLYLDLAYPEKLLNCLEKAIQVDSRFAKAYHLRGILYHGMGRHRSAIKELSIALTYEGSSIECLYLRASCHHAIGEYKAAIKDYDDVLDLELDSMDKFVLQCLSFYQKEMALYIASKANLEFSQFNIDDDVDPLFKEYWCKRLHPKNVAEKVYRQPPLRISLRNGRLNKQDFKFTKHQTTLLLAADSIGKKIQYNCRGFLPNQRQYRMAGLAAIEIAQKVSKAWRFLRNPKNIAKLVRKRDKLNMSQNRGGYCSTSTLAGSPTSSPNEDRISSGISLSWQDVYNIAVKWRQISEPCDPVVWVNKLSEEFNSGFGSHTPMLLGQAKVVRYYPYYQRVLETAKTIMLDLKYVNNAEDRAIFLTDIEKLKKIEVASSCSDLYHVVGETYWVATRCDSMAFRGRRLEGTRITTQNMGKTGFDFAIRTPCTPSRWEEYDEEMTAAWEAICEAYCNDTNPTRDPGMLDAVKDAILRMTYYWYNFMPLSRGSAVVGYVVLLGLFLAANMDITASIPPDVQVDWEAILSPDPDTFVDAIKPWLYPSTKISRCLKDYTDVSIAFNTTGSVVAALTSVDP

SEQ ID NO: 2941 - DNA, 1437 bp, Sorghum bicolor
  misc_feature: Ceres ANNOT ID no. 6026891
  misc_feature: Encodes the peptide sequence at SEQ ID NO 2942
atggcgaggaagccgctggactacgaggagctgaacgagaacgtcaagaaggtgcagtacgcggtgcgcggggagctctacctccgcgcctccgagctccagaaggagggcaagaagatcatcttcaccaacgtcggcaacccgcatgctctcggccagaaaccgctcaccttcgggcgccaggtggtggcgctgtgccaggctccgttcctcctcgatgatccccacgtcggcctcatgttcccggcggatgccatcgctagggccaagcactacctcgccatggctaagggcggtctaggtgcgtacagtgattcccgtggtatccctggaattaggaaggaagttgctgacttcatctacaagcgtgatggatatccgactgatccagaactcatttacctgacagacggtgccagcaaaggtgtgatgcaaatactgaacaccatcatcagaaacgagagggatgggatcttggtccctgttcctcaatacccactttattctgcttccattgccctatatggtggtgctctggtcccgtactacttggaagaagaggctaactggagccttgactttgtaaatatccgaaaaacagtggcagaggcacggtcgaagggaatcactgttcgagcaatggtgattataaatccaggaaatcccactggccaatgccttagtgaaccgaatataaaggaagttctgcaattttgctaccatgaaaacttagttctgcttgcagatgaagtgtatcagcagaacgtctttcaagatgagcgcccatttataagctcaagaaaggttatgttcgacatgggcccgccactaagcagggagcttcagcttgtttctttccacactgtgtccaaagggaactggggagagtgtggacaacgtggtggatactttgaaatgacaaatcttcctcccaagacagtagatgagatctacaaggttgcatcaatagcactgagtccaaatgttcctgggcaaatttttatgggagtaatggttaaccctccgaaacctggagatatctcataccccaagttcgccgctgaaagcaagtccgtccatgaatctttgaggaggagagcacgcatgatgacagatggtttcaacagttgccgaaatgtcgtgtgcaatttcacagaaggagctatgtactctttcccccaaataaggctgccaccaagagccattgaggcggcaaaaagagctggcaaagcagcagacgttttctactgtctaaagctcctggaggcaacaggaatttccactgttccgggctctggttttgggcaaaaggaaggggtgttccaccttcggacaactatccttccagctgaggaagacttccctgccatcatgtcgagcttcaagaagttcaacgactcattcatggagcaatacgagggctactccagaatgtga

SEQ ID NO: 2942 - protein, 478 aa, Sorghum bicolor
  misc_feature: Ceres ANNOT ID no. 6026891
  misc_feature (60)..(461): Pfam Id: Aminotran_1_2 Pfam Desc: Aminotransferase class I and II
  misc_feature (3)..(478): NCBI GI: 29569153 NCBI Desc: alanine aminotransferase [oryza sativa (indica cultivar-group)]
  misc_feature (1)..(478): NCBI GI: 71842524 NCBI Desc: alat1 [vitis vinifera]
  misc_feature (1)..(475): NCBI GI: 71842522 NCBI Desc: alat1 [vitis labrusca]
  misc_feature (1)..(478): NCBI GI: 140041700 NCBI Desc: aminotransferase, class i and ii [medicago truncatula]
  misc_feature (1)..(478): NCBI GI: 27363280 NCBI Desc: at1g23310/f26f24_4 [arabidopsis thaliana]
  misc_feature (9)..(472): SWISSPROT Homolog: EC 2.6.1.2 Alanine aminotransferase 2
  misc_feature: Useful for making plants with modulated nitrogen use efficiency
  misc_feature: GREAT-hit functional homolog of the protein sequence given in SEQ ID NO 12914
  misc_feature: GREAT-hit functional homolog of the protein sequence encoded by LOCUS at1g23310
  misc_feature: Useful for making plants with modulated nitrogen use efficiency
  misc_feature: Functional homolog of the protein sequence given in SEQ ID NO 13808
  misc_feature: The sequence is a functional homolog of SEQ ID NO. 526 in the 11/188,298 US application
  misc_feature: The sequence is a functional homolog of SEQ ID NO. 286 in the 11/188,298 US application
MARKPLDYEELNENVKKVQYAVRGELYLRASELQKEGKKIIFTNVGNPHALGQKPLTFGRQVVALCQAPFLLDDPHVGLMFPADAIARAKHYLAMAKGGLGAYSDSRGIPGIRKEVADFIYKRDGYPTDPELIYLTDGASKGVMQILNTIIRNERDGILVPVPQYPLYSASIALYGGALVPYYLEEEANWSLDFVNIRKTVAEARSKGITVRAMVIINPGNPTGQCLSEPNIKEVLQFCYHENLVLLADEVYQQNVFQDERPFISSRKVMFDMGPPLSRELQLVSFHTVSKGNWGECGQRGGYFEMTNLPPKTVDEIYKVASIALSPNVPGQIFMGVMVNPPKPGDISYPKFAAESKSVHESLRRRARMMTDGFNSCRNVVCNFTEGAMYSFPQIRLPPRAIEAAKRAGKAADVFYCLKLLEATGISTVPGSGFGQKEGVFHLRTTILPAEEDFPAIMSSFKKFNDSFMEQYEGYSRM

SEQ ID NO: 2943 - DNA, 723 bp, Sorghum bicolor
  misc_feature: Ceres ANNOT ID no. 6026906
  misc_feature: Encodes the peptide sequence at SEQ ID NO 2944
atggcagcagcagcagcagcaatggcatcctccctcctccccgtcctcctcctcgtcgtggcgctgtcgtcgccgccgtgggtggtcgtcgtcctggcggcggacgccgacgacggcaccacgcacctgcacttcttcatgcacgacatcgtggccgggagcaacccgacggcggtgcaggtggtgaagggccccgccgccacggggtcgatcgtcccggggctggcgttcggcgacaccacggtgatcgacgacgcgctgacggagacgtcgtcgccgacgtccgccgccgtgggccgcgcgcagggcttctacatgatgtcgtcgcagtcggggctcgtgctgatggtgtgcgccaacctgctgctcaccacgggggaccacaacggcagcacgctcgcggtggtgggccgggacgacgtggccgccgacgtgcgggagctctccgtcgtcggcggcacgggcaagttcaggatggccaccgggtacgtgctgtggaagacgtccagcatgagcgggcccgacgccaccatcgagctcgacgtgcacgtgaggacgacggcgactgcagccacgggtagcggcgccgccatcgacggcggcggcggcagcatcaccactggtgcctcctcggccgccggcgccaagcgggttggagcagggtgggtcagtgcgtgcgtcgtcgccgttgttgttgcggtagttggatccggggtatggtga

SEQ ID NO: 2944 - protein, 240 aa, Sorghum bicolor
  misc_feature: Ceres ANNOT ID no. 6026906
  misc_feature (16)..(186): Pfam Id: Dirigent Pfam Desc: Dirigent-like protein
  misc_feature (4)..(184): NCBI GI: 77552297 NCBI Desc: dirigent-like protein [oryza sativa (japonica cultivar-group)]
  misc_feature (8)..(209): NCBI GI: 34394264 NCBI Desc: disease resistance response protein-like protein [oryza sativa (japonica cultivar-group)]
  misc_feature (6)..(190): NCBI GI: 40253353 NCBI Desc: disease resistance response protein-like [oryza sativa (japonica cultivar-group)]
  misc_feature (26)..(168): NCBI GI: 115486441 NCBI Desc: os11g0644700 [oryza sativa (japonica cultivar-group)]
  misc_feature (28)..(191): NCBI GI: 28812108 NCBI Desc: disease resistance response protein-like protein [oryza sativa (japonica cultivar-group)]
MAAAAAAMASSLLPVLLLVVALSSPPWVVVVLAADADDGTTHLHFFMHDIVAGSNPTAVQVVKGPAATGSIVPGLAFGDTTVIDDALTETSSPTSAAVGRAQGFYMMSSQSGLVLMVCANLLLTTGDHNGSTLAVVGRDDVAADVRELSVVGGTGKFRMATGYVLWKTSSMSGPDATIELDVHVRTTATAATGSGAAIDGGGGSITTGASSAAGAKRVGAGWVSACVVAVVVAVVGSGVW

SEQ ID NO: 2945 - DNA, 738 bp, Sorghum bicolor
  misc_feature: Ceres ANNOT ID no. 6026907
  misc_feature: Encodes the peptide sequence at SEQ ID NO 2946
atggccaccaccgcgcccatcctccccctcatcctcctcctcctcctctccacgtcgtccgccgtcctgacgacgacgctggcggcggacgcggacagcaacggcaccacccacctgagcttgttcatgcacgacatcacgtcgggcagcaacccaacggcggtgaaggtgatcaagggtccgggcaccaccctgacggcgccaacactcggcatgacgttcggcgacacgacggtgatcgacgacccggtgacggcgacctcgtcgccgacgtccgcggagctgggccggatgcagggcatctacatgctggcgtcgcagtcgggcgcggcgctgatggtgtgcgccaacctgctgctcacgtcgggcgcccacaacgggagcacgctcgcgctgatgggacgcgacgacaccggcgaggatgtccgcgagatccccgtcgtcggcggcaccggcacgttccggatggccaccgggtacgtgctgtggaagacgccggaagggatcaacggcaccgacgccaccgtccagctcgatgtgtatgtcaccacggacggcaacgccgtcgacgcgctcgcgcctgcgtctggtggtggtgactcgtcgtccggaggcggagggtcgccggggtcaggagggtcgtccaagtccagctccgggtctgcggccacggcgaggacgatgaccgccgggtgggtcgtcgccgcagtggttggatcctcatgggtttggtggtga

SEQ ID NO: 2946 - protein, 245 aa, Sorghum bicolor
  misc_feature: Ceres ANNOT ID no. 6026907
  misc_feature (12)..(184): Pfam Id: Dirigent Pfam Desc: Dirigent-like protein
  misc_feature (39)..(198): NCBI GI: 34394264 NCBI Desc: disease resistance response protein-like protein [oryza sativa (japonica cultivar-group)]
  misc_feature (28)..(182): NCBI GI: 77552297 NCBI Desc: dirigent-like protein [oryza sativa (japonica cultivar-group)]
  misc_feature (8)..(190): NCBI GI: 40253353 NCBI Desc: disease resistance response protein-like [oryza sativa (japonica cultivar-group)]
  misc_feature (7)..(182): NCBI GI: 6227011 NCBI Desc: f12p19.3 [arabidopsis thaliana]
  misc_feature (23)..(181): NCBI GI: 28812108 NCBI Desc: disease resistance response protein-like protein [oryza sativa (japonica cultivar-group)]
MATTAPILPLILLLLLSTSSAVLTTTLAADADSNGTTHLSLFMHDITSGSNPTAVKVIKGPGTTLTAPTLGMTFGDTTVIDDPVTATSSPTSAELGRMQGIYMLASQSGAALMVCANLLLTSGAHNGSTLALMGRDDTGEDVREIPVVGGTGTFRMATGYVLWKTPEGINGTDATVQLDVYVTTDGNAVDALAPASGGGDSSSGGGGSPGSGGSSKSSSGSAATARTMTAGWVVAAVVGSSWVWW

SEQ ID NO: 2947 - DNA, 633 bp, Sorghum bicolor
  misc_feature: Ceres ANNOT ID no. 6026908
  misc_feature: Encodes the peptide sequence at SEQ ID NO 2948
atggccatcagcagcagcagcagcggctcggtcgtcgtcgcaagcaacaggcgcctcctgctcgttgtcgccttcgctctggcctgcctctcggcgtcgccgtcggcggtggtgtcggcccgccggcgccccgtgcggctgcgcctgtacatgcacgacatcgtgggcgggccggggcagacggcggtgcggctggtgaagggtccggggccggagaacccgtcgatgcacccggggaactacttcggcgacacggtggcggtggacgacctcctcacggcgggcctcgccgttgactcggcgcccgtcggccgcgcgcaggggacctacatgacgggctccatgagccgcccggtgttcgtggtcgccgtgacgctgctgctcacggcggggccctataacgggagcacgctcgtggtggccggccgcgacgacacctcgctgccggtgagggagctcgccgtggtcggcgggacgggggcgctgcgacgggcggcagggcacgtgctgtggagcacggccagggtggagtccgcgctgcacgccgtgctgctgctggatgtgcacgcgtccgtgccggcgccgagcaaggctgctgctgcggcggcggagttgctcgtcaggtctgcctga

SEQ ID NO: 2948 - protein, 210 aa, Sorghum bicolor
  misc_feature: Ceres ANNOT ID no. 6026908
  misc_feature (24)..(192): Pfam Id: Dirigent Pfam Desc: Dirigent-like protein
  misc_feature (9)..(210): NCBI GI: 34394264 NCBI Desc: disease resistance response protein-like protein [oryza sativa (japonica cultivar-group)]
  misc_feature (1)..(204): NCBI GI: 40253353 NCBI Desc: disease resistance response protein-like [oryza sativa (japonica cultivar-group)]
  misc_feature (20)..(206): NCBI GI: 28812108 NCBI Desc: disease resistance response protein-like protein [oryza sativa (japonica cultivar-group)]
  misc_feature (13)..(191): NCBI GI: 77552297 NCBI Desc: dirigent-like protein [oryza sativa (japonica cultivar-group)]
  misc_feature (20)..(175): NCBI GI: 115486441 NCBI Desc: os11g0644700 [oryza sativa (japonica cultivar-group)]
MAISSSSSGSVVVASNRRLLLVVAFALACLSASPSAVVSARRRPVRLRLYMHDIVGGPGQTAVRLVKGPGPENPSMHPGNYFGDTVAVDDLLTAGLAVDSAPVGRAQGTYMTGSMSRPVFVVAVTLLLTAGPYNGSTLVVAGRDDTSLPVRELAVVGGTGALRRAAGHVLWSTARVESALHAVLLLDVHASVPAPSKAAAAAAELLVRSA

SEQ ID NO: 2949 - DNA, 2019 bp, Sorghum bicolor
  misc_feature: Ceres ANNOT ID no. 6026910
  misc_feature: Encodes the peptide sequence at SEQ ID NO 2950
atggcggacacggtgcagtaccgcctggagcggatgacggacgagctggacgacctggagcgcaggggcctcttcacgcgcgctgagctctccgacgtcgtccgcaagcgccgcgacttcgagtaccgcctccgccgccactccccgctccgccaggacttcctcgactacatcgcctacgagctccgcctcgactccctccgcaacctccgcaagcgcgccatcatacgcgccgccgctgacgaggatgacgagccccgtgatggcgctcgcagcagcgacgacgaggagggaggcgggaggaagaggaagaagaaggataaatccaagaagaagtggaagaagtccgtctccgacgtcgccggcgtcctccgcgtcctcgacatctaccggatggccaccgtcaggttcaagggcgacctcgacctctggttccgctacctcgagttctgccgcgacaagaaacacggcaggatgaagcaggttctggcacaagctattcgcttccatcccaaggttcccgggctttggatctacgcggcagcatgggaattcgatcagaacctgaacgtcgccgcggcacgtgcactgatgcagagcggtctcaggtcttgtcctcagtctgaggatatgtggatcgagtatcttcgcatggagcttacctaccttaacaagctcaaggctcgaaaggttgctcttggagaggatgtcaagacgctgcaaaagaacgataaagattcaggccagtggaaagaggaaaacaaggaactgtttatgccactgaatgaacaggacgaagatcccaaggagccgggcttgtctggagatgccctggaggagaaggaagacctgttttggcgtcaagggttgttaatcattcagactatatatcaaggtgcagtggaagctcttccatcaagcttaaccttgcggaagaagttcttagagatattaaacagtgttgacttggcacattctgatgagttgaaactggaggtcctggatgaccttaagagagatttctatcatagtgaggactactgggattggttggctaggcttcagcttagcaactcgaacagttccagtaattcgaatagaaaggatgctatatcgaataggttgaacagatcaatccaggtgtatgatgaagctgtcagaaggctatcaaattccaaaatgtactcattgtatgcaaagttttggatggatgttctataccctgacagagaagattccatcacattattcgaggattctgagtttgatgcttcagagttcacttcatccatactgaaagtttatgaaaatgcagaatcatgtggatgtcttactgaggatcttgcttgccaatacatatcactttacttgaaactagaaagactggaggaagctaagactcttgcagaaaagctttgcgacggccctctttcaaatgctgcaaaattgtggagcctgagagcttcaatggagataaattcaattgcgactgctcctggcagttcttccttgagcaaggagaacttgagctctctgtttgatctatttagcactgtactttctaagttgtctgtaactgagactgagggattgtggcatatggccatgaaattatttttccatgataaggtcttcttcgagaagttggtgaagatttcaacgctatcattaagtttggcaggtggcagtgattcaggagcatctgtttcttctgctatcgttgggtggtatttgcaaagagatggtatgaagcatgctaggaagatgtacaagagatttcttgctttacctcggccaagcctcaagttcatgcagtactgcatagagctggaggcgaaccttgcatcactcggagaccatggcgcccttacaaatgctcggcggctatatgattcagcgctcgacctgtatccccaggaaagggaagtgtggaggaactactacaacctggagctgaagagtctgccaacgccgtgtactcgcgtgctcgcaaggtgctcggtgactccactgccctga

SEQ ID NO: 2950 - protein, 672 aa, Sorghum bicolor
  misc_feature: Ceres ANNOT ID no. 6026910
  misc_feature (9)..(91): Pfam Id: U3_assoc_6 Pfam Desc: U3 small nucleolar RNA-associated protein 6
  misc_feature (103)..(653): NCBI GI: 92887953 NCBI Desc: ribosomal protein l29 [medicago truncatula]
  misc_feature (103)..(230): NCBI GI: 29476988 NCBI Desc: mgc53963 protein [xenopus laevis]
  misc_feature (103)..(230): NCBI GI: 57525257 NCBI Desc: similar to hepatocellular carcinoma-associated antigen 66 [gallus gallus]
  misc_feature (100)..(230): NCBI GI: 62857421 NCBI Desc: loc549609 [xenopus tropicalis]
  misc_feature (103)..(238): NCBI GI: 123231387 NCBI Desc: utp6, small subunit (ssu) processome component, homolog (yeast) [danio rerio]
MADTVQYRLERMTDELDDLERRGLFTRAELSDVVRKRRDFEYRLRRHSPLRQDFLDYIAYELRLDSLRNLRKRAIIRAAADEDDEPRDGARSSDDEEGGGRKRKKKDKSKKKWKKSVSDVAGVLRVLDIYRMATVRFKGDLDLWFRYLEFCRDKKHGRMKQVLAQAIRFHPKVPGLWIYAAAWEFDQNLNVAAARALMQSGLRSCPQSEDMWIEYLRMELTYLNKLKARKVALGEDVKTLQKNDKDSGQWKEENKELFMPLNEQDEDPKEPGLSGDALEEKEDLFWRQGLLIIQTIYQGAVEALPSSLTLRKKFLEILNSVDLAHSDELKLEVLDDLKRDFYHSEDYWDWLARLQLSNSNSSSNSNRKDAISNRLNRSIQVYDEAVRRLSNSKMYSLYAKFWMDVLYPDREDSITLFEDSEFDASEFTSSILKVYENAESCGCLTEDLACQYISLYLKLERLEEAKTLAEKLCDGPLSNAAKLWSLRASMEINSIATAPGSSSLSKENLSSLFDLFSTVLSKLSVTETEGLWHMAMKLFFHDKVFFEKLVKISTLSLSLAGGSDSGASVSSAIVGWYLQRDGMKHARKMYKRFLALPRPSLKFMQYCIELEANLASLGDHGALTNARRLYDSALDLYPQEREVWRNYYNLELKSLPTPCTRVLARCSVTPLP

SEQ ID NO: 2951 - DNA, 645 bp, Sorghum bicolor
  misc_feature: Ceres ANNOT ID no. 6026914
  misc_feature: Encodes the peptide sequence at SEQ ID NO 2952
atggccaccaagatctacatcgtgtactactcgacgtggggccacgtggcgacgctagcggaggagatcaagaaaggcgcggacgccgtccccggcgtggaggccacggtgtggcgcgtggtcgagacgcttccagaggacgtgctagggaagatgggagcggcgccggcgcatgaggatcacccggtgatctccccacgagacctcgcagacgccgacggcgtgctgctgggctttccgacgcggttcggcatgatggcggcgcagatgaaggcattcatagacgccaccggtgggctgtggcagagccaggcactggcggggaagcccgccggcgtgttcctctccacaggcactcagggtggtggccaggagaccaccgcgctcaccgccgtcacgcagctcgtgcaccacggcatgctcttcgttcctctgggttacaccttcggcgctggcatgtttggcgtcgacgaggtcaggggtggcagcccctacggcgctgggacctttgccggtgccgatggcagcagaacaccctccgaggtcgagctcgccgtggccagacaccagggcacctacttcgctggcatcgccaagaagcttaagcacatgaatagacgtaaggtccagatccaaagcatctag

SEQ ID NO: 2952 - protein, 214 aa, Sorghum bicolor
  misc_feature: Ceres ANNOT ID no. 6026914
  misc_feature (7)..(139): Pfam Id: Flavodoxin_1 Pfam Desc: Flavodoxin
  misc_feature (3)..(175): Pfam Id: FMN_red Pfam Desc: NADPH-dependent FMN reductase
  misc_feature (1)..(202): NCBI GI: 58500257 NCBI Desc: quinone reductase 2 [triticum monococcum]
  misc_feature (1)..(202): NCBI GI: 124488474 NCBI Desc: benzoquinone reductase [gossypium hirsutum]
  misc_feature (1)..(202): NCBI GI: 12484052 NCBI Desc: quinone-oxidoreductase qr2 [triphysaria versicolor]
  misc_feature (1)..(202): NCBI GI: 89276317 NCBI Desc: quinone oxidoreductase [gymnadenia conopsea]
  misc_feature (1)..(202): NCBI GI: 90811717 NCBI Desc: quinone-oxidoreductase qr2 [striga asiatica]
MATKIYIVYYSTWGHVATLAEEIKKGADAVPGVEATVWRVVETLPEDVLGKMGAAPAHEDHPVISPRDLADADGVLLGFPTRFGMMAAQMKAFIDATGGLWQSQALAGKPAGVFLSTGTQGGGQETTALTAVTQLVHHGMLFVPLGYTFGAGMFGVDEVRGGSPYGAGTFAGADGSRTPSEVELAVARHQGTYFAGIAKKLKHMNRRKVQIQSI

SEQ ID NO: 2953 - DNA, 3057 bp, Sorghum bicolor
  misc_feature: Ceres ANNOT ID no. 6026915
  misc_feature: Encodes the peptide sequence at SEQ ID NO 2954
atgggttcagacaagcagattggtagcccgcgcccgctcttgggaaccctcaagatgggcagagtcaggactatcctgacacatacatacccgtaccctcacgagcactccaggcatattatgactgcagtgattattgcctgtctcttttttatatcgtctgacaacatgcatacgctgatacataaattggacaacaatatcaagtggtggtccatgtatgtttgcctcattggcttcttctatttcttctcgtctccttttcttggaagaaccattcagccaagctactcaaattttaaccgttggtatgttgcttggatttgctttgcatccctgtaccatcttcctagcttccagtcaatgggggttgatatgcgcatgaacctttcacttttcttgacaatttatttctcctcggtccttttcatcattgcctttcatatcatatttattggtctctggtacattgggttggttgcacgcttggcaggaacgaggccaggaatatggacaattctccagaactgtacagtcatcagtattgcatgctgtgtattctacagtcattgtgggaatcgtgctgtgcacaagagcaaatcttttggtagtagttctgatcccagtttgcttgctttccttaaaaatgaaaacggaagcacctggatatcaaattttctccgtatgaatcagttgaaagatgagatatgttcatcttggtttgctcctgttggatctgcaagtgactatcctattctggcaaaatgggttatttacggggagttagtttgcagtggatcctgtgctggcccatcagatgaaatatctcctttgtactcattgtgggctacatttgttggcctttatatcgctaactttgttgtggagagatcgactggatgggctcttacccacccgtcaacagatttggaggatgagaagctgaagaggcatatgaaaccagatttcctggacatggtaccttggtattcagggacatcagctgatttattcaagacagcatttgatcttatggtctctgtgactctttttgtcgggcgatttgacatgcgcatgatgcaggctgcaatgaaaggaccaacagacaatacttcaaatgatgacctattgtatgactacttcaatgaaagggaagacctttggtttgactttgttgcagacaccggtgatggagggaattcgtcatatacagttgcccggctgttagcccaaccatctattaggactgttatcggtggctctatgcatactcttccacgtgggaacttacttattatcggcggagatcttgcgtacccaaacccttcatcatttacatatgagaggcgcttctttaggccttttgagtatgctctacagcctccaccttggtacagggatgaacatatagctttggataagcctgagcttcctcctggtgtatcaaagatgactgaatatgatgggccacagtgtttcataattcctggaaaccatgactggtttgatgggcttcatacttttatgagatatatatgtcataaaagctggttaggtggatggtttctgcctcagaagaagagttattttgcattgcatcttcccaagggttggtggatatttggtcttgatttatctctccatggcgatgttgatgtgtaccaattcaagttctttgctgatgtttgtcggaataaggttggagagaatgattctgtgattgtagtaacacatgagccaaactggcttcttgattggtattggaatgagactacaggcaagaatgtatcacatttaattcaggaatacctgaaaggaagatgtaaacttcgcatggcaggggatttacaccattttatgaggcactctgccactcaatcagaaaaaactaattttgtgcaacacttacttgtcaatggatgtggtggcgcctttttgcacccaacacatgttttcagaaactttgagaggttctctggaaccacctatgaatgcaaggcagcttatccatcttatgatgagtctagtgggattgcattgggtaacatattgaagttccgcaaaaagaattggcagtttgacatcattggtggttttatatacttcatactggtgttttcaatgttcccgcagtgtaatcttgttcatatcttaaatgaagaaacttggtctgggcgtctgaaaagcttctcaggcacaatatggagtgctttgctttatatttttgagcactcttatgtctcttcagtaggaagtcttactttactgatggcctcatattcattcgtaccatccaaactatcaaggaggagaagagctattataggcggcctccatgttttggcccatttaactgcagcgctacttttaatgttgctgctggagttgggcattgaaatttgtattcgtaatcatttattggcaacttcaggttatcacactttgtatgaatggtatcgatccatggaaagtgagcattttccagatcctactggtcttcgtgctcgtttggagcaatggactctgggactgtacccagcatgtataaaataccttatgtcagcctttgacgtccctgaggtcatggctgtgacaagaataaatatatgcaagaacggaatgatgtctctttcacgtagtgttctgatcatgtactatacttctgtgtttatctatttctggattttctcgaccccagttgtttctctcatatttggtagctacctgtacatctgcatcaactggttccacatacactttgatgaagccttctcatcactgcgcattgcaaactacaaatctttcacaaggtttcatattaagaaggatggtgatctggaaatatttactcttgcagttgacaaggtcccaaagggctggaagttggatccgaggtgggaatcagagggaagagggcctcatcagctcagccatgaccggaagcatccaagcaagtggaggtcagcctcatcaccggaccctgtgagatctgtacgggttgtcgaccatttcaccattgaaagaacaagaacctcagatacggagccctcttcctga

SEQ ID NO: 2954 - protein, 1018 aa, Sorghum bicolor
  misc_feature: Ceres ANNOT ID no. 6026915
  misc_feature (387)..(619): Pfam Id: Metallophos Pfam Desc: Calcineurin-like phosphoesterase
MGSDKQIGSPRPLLGTLKMGRVRTILTHTYPYPHEHSRHIMTAVIIACLFFISSDNMHTLIHKLDNNIKWWSMYVCLIGFFYFFSSPFLGRTIQPSYSNFNRWYVAWICFASLYHLPSFQSMGVDMRMNLSLFLTIYFSSVLFIIAFHIIFIGLWYIGLVARLAGTRPGIWTILQNCTVISIACCVFYSHCGNRAVHKSKSFGSSSDPSLLAFLKNENGSTWISNFLRMNQLKDEICSSWFAPVGSASDYPILAKWVIYGELVCSGSCAGPSDEISPLYSLWATFVGLYIANFVVERSTGWALTHPSTDLEDEKLKRHMKPDFLDMVPWYSGTSADLFKTAFDLMVSVTLFVGRFDMRMMQAAMKGPTDNTSNDDLLYDYFNEREDLWFDFVADTGDGGNSSYTVARLLAQPSIRTVIGGSMHTLPRGNLLIIGGDLAYPNPSSFTYERRFFRPFEYALQPPPWYRDEHIALDKPELPPGVSKMTEYDGPQCFIIPGNHDWFDGLHTFMRYICHKSWLGGWFLPQKKSYFALHLPKGWWIFGLDLSLHGDVDVYQFKFFADVCRNKVGENDSVIVVTHEPNWLLDWYWNETTGKNVSHLIQEYLKGRCKLRMAGDLHHFMRHSATQSEKTNFVQHLLVNGCGGAFLHPTHVFRNFERFSGTTYECKAAYPSYDESSGIALGNILKFRKKNWQFDIIGGFIYFILVFSMFPQCNLVHILNEETWSGRLKSFSGTIWSALLYIFEHSYVSSVGSLTLLMASYSFVPSKLSRRRRAIIGGLHVLAHLTAALLLMLLLELGIEICIRNHLLATSGYHTLYEWYRSMESEHFPDPTGLRARLEQWTLGLYPACIKYLMSAFDVPEVMAVTRINICKNGMMSLSRSVLIMYYTSVFIYFWIFSTPVVSLIFGSYLYICINWFHIHFDEAFSSLRIANYKSFTRFHIKKDGDLEIFTLAVDKVPKGWKLDPRWESEGRGPHQLSHDRKHPSKWRSASSPDPVRSVRVVDHFTIERTRTSDTEPSS

SEQ ID NO: 2955 - DNA, 2364 bp, Sorghum bicolor
  misc_feature: Ceres ANNOT ID no. 6026922
  misc_feature: Encodes the peptide sequence at SEQ ID NO 2956
atgtccgcgcgaggggtgcgcccgggggtgctgcaacacaaggagaacaacccggcggacgcgcagcccgggaagcgccagcgcaccgccgggaccgggagggcgccgctcgccgccgcgccgccgccggaggagcccatggtgttcgcgggcagggaggacgtcgaagccctcctcaacgagaagatgaaagggaagaacaagatggactacaaggggaagagcgagcagatgatggaatacatcaagaaggttcgagcctgtatcagatggcttcttgagagggaagacataaatcttgctgaaatcaagaggatcaatggtcagcttgaggcgacacacaaacaacattctgagataggtggataccaaccttttgaaataatcgtgacatggatacttgctttcttctacattcttctgactgaatttttattgcttcatatagtggctgacttggagaataatattgaagaaacaaaatcagtatacgaggaacttcaaaaacaatgtgcatctctacaagaggctctgaagatagtggaggccgaaaaaatggatgccctgagctctctaagagatgaaagggaagcaaggatgggtgtggaatctttgcggaatggacttttggaagatctgaacagggtgaagttggaggagaaacgccttactgaccagattaagatgcttcaggacacaaataagaggcttcaagaatataacacaagcttgcagcaatacaatagcaacctccaagcagatgcaacaaagaatgctgaaacaatagcaaagttgcaaaaggagaagaatactatggttgagacaatgaatggtctgaaagatcatgctaactcggtaaaaatgcaactagacattgcaaagtctttgcaaaatgaagctgcaaagcaaaagaccgatttattgaaggaagttgaaagtcttagaatggagcttcagcatgtaagggaggaacgtgacactaaatctgctcaagtagattctttgctggctgaaattggaacttacaaagaaaagactggaaaaactgccattcagttagacagtgccatggccaaaacgtctgctctcgaggaaacatgttcgtcccaaagaaagatgatagagacattggaaattaagcttgcagctgccaatgaaaagttaaagaggtctgatatgacggcctcagaaaccatgactgagtatgagaacatgaagaaaatgttggagagtgctctgtcacgccttgaagaggctgagcaaacaattctggatggagagaagttacggaaaaagttacataacacaattcttgagttgaagggaaacatcagggtattttgtagagtaaggcctttgctgccaaatgaatcaggagcggtctcatatccaaagagtggagaaaacttaggccgaggcattgagttgttacataatgcacaaggatattcatttacttttgataaagtatttgatcattcagcatcacaagaacacgtgttcatagaaatatctcaactcgtccaaagtgccctagatggctataaggtttgcatatttgcctacgggcaaactggttccggtaaaacatatacaatgatgggcaatcctgagttcgaagatcaaaaaggaatgatacctcgatctctggagcagatttttcaagcaagccaggcacttaactcacagggttggagatataagatgcaggcctcaatgttggagatttacaatgagaccatacgcgacttgcttgtgacaaatcgcatggctgctcaggatggtggtcctacaaagtacagtatcaagcatgatgccaatggtaacacaatcgtgtcagaccttacagtcgttgatgtaactactatcaacgaagtttcttctctcctcaggcgggctgctcagagcagatcagttgggagaacacaaatgaatgaagaatcatccagaagtcactgtgttttcactcttcggatattcggtgtaaatgagggaacggatcaacaagtgcaaggagtgctcaatcttatagatctagcaggcagtgagcgtctgaacaaaagtggtgccactggtgatcggctgaaagaaactctggctatcaataaaagcttgtcatgcttaagtgatgtcatcttctcgattgcaaagaaagaggaacatgttccgttcaggaactcaaaactgacatatctgcttcagccgtgtctcggaggggactccaagacgctgatgtttgtgaatctggctcctgaagtatcatcggctgcggagtctctttgctcactccggtttgctgcaagggtgaactcctgcgagatcgggatcccccggcgccaaacccaaacgcggagctcacaatga

SEQ ID NO: 2956 - protein, 787 aa, Sorghum bicolor
  misc_feature: Ceres ANNOT ID no. 6026922
  misc_feature (449)..(773): Pfam Id: Kinesin Pfam Desc: Kinesin motor domain
  misc_feature (151)..(785): NCBI GI: 115460740 NCBI Desc: os04g0629700 [oryza sativa (japonica cultivar-group)]
  misc_feature (152)..(784): NCBI GI: 7267279 NCBI Desc: kinesin-like protein [arabidopsis thaliana]
  misc_feature (152)..(784): NCBI GI: 34849893 NCBI Desc: at4g05190 [arabidopsis thaliana]
  misc_feature (158)..(784): NCBI GI: 303502 NCBI Desc: kinesin-like motor protein heavy chain [arabidopsis thaliana]
  misc_feature (158)..(786): NCBI GI: 144923762 NCBI Desc: kinesin, motor region; prefoldin [medicago truncatula]
MSARGVRPGVLQHKENNPADAQPGKRQRTAGTGRAPLAAAPPPEEPMVFAGREDVEALLNEKMKGKNKMDYKGKSEQMMEYIKKVRACIRWLLEREDINLAEIKRINGQLEATHKQHSEIGGYQPFEIIVTWILAFFYILLTEFLLLHIVADLENNIEETKSVYEELQKQCASLQEALKIVEAEKMDALSSLRDEREARMGVESLRNGLLEDLNRVKLEEKRLTDQIKMLQDTNKRLQEYNTSLQQYNSNLQADATKNAETIAKLQKEKNTMVETMNGLKDHANSVKMQLDIAKSLQNEAAKQKTDLLKEVESLRMELQHVREERDTKSAQVDSLLAEIGTYKEKTGKTAIQLDSAMAKTSALEETCSSQRKMIETLEIKLAAANEKLKRSDMTASETMTEYENMKKMLESALSRLEEAEQTILDGEKLRKKLHNTILELKGNIRVFCRVRPLLPNESGAVSYPKSGENLGRGIELLHNAQGYSFTFDKVFDHSASQEHVFIEISQLVQSALDGYKVCIFAYGQTGSGKTYTMMGNPEFEDQKGMIPRSLEQIFQASQALNSQGWRYKMQASMLEIYNETIRDLLVTNRMAAQDGGPTKYSIKHDANGNTIVSDLTVVDVTTINEVSSLLRRAAQSRSVGRTQMNEESSRSHCVFTLRIFGVNEGTDQQVQGVLNLIDLAGSERLNKSGATGDRLKETLAINKSLSCLSDVIFSIAKKEEHVPFRNSKLTYLLQPCLGGDSKTLMFVNLAPEVSSAAESLCSLRFAARVNSCEIGIPRRQTQTRSSQ

SEQ ID NO: 2957 - DNA, 714 bp, Sorghum bicolor
  misc_feature: Ceres ANNOT ID no. 6026923
  misc_feature: Encodes the peptide sequence at SEQ ID NO 2958
atggcgacttatctcaacgcaccgccggcagctaccaccatggctgcaagctactgccatgccttctccggcggcagcctccgtctgctccggccgagccgacccacgctgcacgtgacgtgccaagcctcctcgtcctcctcccagcagcagccgtccccgtccaggaggtcagcctgcctcggcctcggcctcagcttcgcgtgcgccgtcctgctccgcccacgcgccgtcgccgccgcaaccgacggcggcgacgaggagccggccaacaacggctggtggctcaccgagttccccttgccaacgcccaagatcgtcaacaaggagatcaacaacgccgagacagggacgcggtccttcatcaagaacggcatctacatggcggacatcggccccagcttcgcggcgcacgcgtaccggctgcgcagcacggccttcgacctgctggcgctggaggacctgctcggcaaggacgcctccaactacgtcaacaagtacctccgactcaagtccaccttcatgtactacgacttcgacaagctcatctccgccgccgacgacaagcccaccttcgtcgacctcgccaaccgcctcttcgacagcttcgagacgctccaggaggccgtcaccgccaaggacgacgacaggataagcggccgctacgcagagaccaaggtcatcctccaggagctcatggcgaagatggcctag

SEQ ID NO: 2958 - protein, 237 aa, Sorghum bicolor
  misc_feature: Ceres ANNOT ID no. 6026923
  misc_feature (23)..(237): Pfam Id: PsbQ Pfam Desc: Oxygen evolving enhancer protein 3 (PsbQ)
  misc_feature (122)..(236): NCBI GI: 79325205 NCBI Desc: calcium ion binding [arabidopsis thaliana]
  misc_feature (122)..(232): NCBI GI: 8131595 NCBI Desc: oxygen evolving enhancer protein 3 [bruguiera gymnorrhiza]
  misc_feature (112)..(236): NCBI GI: 34810268 NCBI Desc: chain a, crystal structure of psbq polypeptide of photosystem ii from higher plants
  misc_feature (111)..(236): NCBI GI: 51457944 NCBI Desc: photosystem ii oxygen-evolving complex protein 3 [lycopersicon esculentum]
  misc_feature (25)..(236): NCBI GI: 755802 NCBI Desc: 16 kda protein of the photosynthetic oxygen- evolving protein (oec) [spinacia oleracea]
MATYLNAPPAATTMAASYCHAFSGGSLRLLRPSRPTLHVTCQASSSSSQQQPSPSRRSACLGLGLSFACAVLLRPRAVAAATDGGDEEPANNGWWLTEFPLPTPKIVNKEINNAETGTRSFIKNGIYMADIGPSFAAHAYRLRSTAFDLLALEDLLGKDASNYVNKYLRLKSTFMYYDFDKLISAADDKPTFVDLANRLFDSFETLQEAVTAKDDDRISGRYAETKVILQELMAKMA

SEQ ID NO: 2959 - DNA, 585 bp, Sorghum bicolor
  misc_feature: Ceres ANNOT ID no. 6026925
  misc_feature: Encodes the peptide sequence at SEQ ID NO 2960
atggcaacaatgtccaaggccgccatcctcgccgtcgtggttgctctggcggtgcagctcgccgccgcggcggaccaccccgtgggaggcgacggctcctgggacgccagcggcaacggctacgacgcctggtccgccaagcagacgttcaagcaaggcgacaccttgtcgttcaagttcgcgtcgtcgcacgacgtcacggaggtgaccaaggccggctacgacgcctgctccggcggcagcaacgccgtcaagtcctacaccggcaccagcgccaccgtgaagctgtccgcgccagggaagcgctacttcatctgcagcgtgccgggccactgcgccgcgggcatgaagctcgaggtcaccgtcaccgcgcccgcgccatcgtccaagagcaagccccgccaccagaggagcgtcgccccgaccccggcacccgcgccggccaccgacggcgagctgcccaacgtggcctcgcccgacgccgcgccgtcccccaagtcgtcggacgccgccaccatcgccatgctcggaggcaaggctgtcgtggggctcgctgtcgccgtggccgccgccttggccatgtga

SEQ ID NO: 2960 - protein, 194 aa, Sorghum bicolor
  misc_feature: Ceres ANNOT ID no. 6026925
  misc_feature (34)..(116): Pfam Id: Cu_bind_like Pfam Desc: Plastocyanin-like domain
  misc_feature (7)..(194): NCBI GI: 14140127 NCBI Desc: uclacyanin 3-like protein [oryza sativa]
  misc_feature (5)..(193): NCBI GI: 115472611 NCBI Desc: os07g0542900 [oryza sativa (japonica cultivar-group)]
  misc_feature (1)..(184): NCBI GI: 115474721 NCBI Desc: os08g0137800 [oryza sativa (japonica cultivar-group)]
  misc_feature (1)..(149): NCBI GI: 115474719 NCBI Desc: os08g0137400 [oryza sativa (japonica cultivar-group)]
  misc_feature (10)..(184): NCBI GI: 8515096 NCBI Desc: phytocyanin homolog [pinus taeda]
MATMSKAAILAVVVALAVQLAAAADHPVGGDGSWDASGNGYDAWSAKQTFKQGDTLSFKFASSHDVTEVTKAGYDACSGGSNAVKSYTGTSATVKLSAPGKRYFICSVPGHCAAGMKLEVTVTAPAPSSKSKPRHQRSVAPTPAPAPATDGELPNVASPDAAPSPKSSDAATIAMLGGKAVVGLAVAVAAALAM

SEQ ID NO: 2961 - DNA, 1887 bp, Sorghum bicolor
  misc_feature: Ceres ANNOT ID no. 6026930
  misc_feature: Encodes the peptide sequence at SEQ ID NO 2962
  misc_feature: Down-regulated in shoot tissues in response to salicylic acid treatment
atggacctagaccccgagggcatcttccgcgacgacagcgatgaagacgaagacaacgtccaggagagggaggctaacaaggatatggttgtctaccttgtcgacgcctcgcccaaaatgttcacccctgctaccacccaggacaatgaaaagcaggagacatattttcataccattgttaactgcatcacagagtctctcaagacacaaattattggtagatcttatgatgaagtcgcaatatgtttctttaacactaaagagaagaagaatttacaggactcagctggtgtttatgtttataatgttggagacagagagcaacttgatagacccactgcaaaactcatcaaagatttttcttgcatagaagattcttttatgagcaccattggaagtcgatttggaataacagctggatctcgggagaataccctgtataatgctctttgggttgctcaggcgctgctgcgcaagggatctgtgaagaccgtcagtaaacgaattcttatattcaccaatgaagatgatccttttggtactgttacaggagcagtgaaaactgatatgattaggacaacaattcaacgtgcaaaggatgcacaagatcttggcctgtctattgaacttcttccacttagccagcctgatgagcagttcgacatgtccctattttatgcagatttgattggcctggatggagatgagataaccgagtatttgccatctgctggtgataagctagaggatatggctaatcaactgagaaaacgaataatgaggaagcgcagagttaaaactctttcatttgcaattaccaatgatgtgtgcatagaagtgaatacatatgcgctggtccgtcctactactccagggaaaatcacatggcttgattcactaagtaaccttccattaaaggctgagaggtctttcatatgcaatgatactggggctctacttcaggatccacagacacgtttccagatgtacaatgacacaattgtcaaattttctgtacttgaactctctgaggttaaaagggttgcaagccatcatcttcgccttttaggtttcaagccattggattgcttgaaagattaccataacttaagaccatcggcatttatttatccgagtgatgagcgtatatttggaagcactcgtgtttttgttgctttacatagctcaatgttacgtcttggaaggtttgcacttgcattttatgggaatccaactcgaccacagctcgtagcccttgttgctcaagaagaggttacttcctctggtggccagttggaaccgcctggcatgcacatgatctatcttccatactccgatgatattagatatcctgaagaatttcatgtgacttctgatgatgcaccgcgtgcaacaaatgaacaaatcaagaaagctttgaatcttttgaaacgtattgatctgaaaaagttctctgcatgccaatttgctaacccagctttgcaaagacactatgggatcttggaggctttagctttaggcgaagatgagatgcctgatataaaggatgataccctgcctgacgaagaaggcttatctaggccaggggtagtcaatgctattgaggaattcaagacttcagtctatggtgaaaattatgaccaagaggaggcagaagcagcagcagggaaagcttcccgtggtgatgcttcaaaaaagcggaagcaaatcactgatgcagctgtgcagatgagtgctgcttatgattgggcagaacttgcagacaatggaaaactgaaggaaatgactgtggtagaattgaaatcctacctgaccgcgcatggcctcccggtttctggtaagaaagaggtacttgtcagcaggatcttgactcatctaggcatgtga

SEQ ID NO: 2962 - protein, 628 aa, Sorghum bicolor
  misc_feature: Ceres ANNOT ID no. 6026930
  misc_feature (29)..(265): Pfam Id: Ku_N Pfam Desc: Ku70/Ku80 N-terminal alpha/beta domain
  misc_feature (268)..(472): Pfam Id: Ku Pfam Desc: Ku70/Ku80 beta-barrel domain
  misc_feature (480)..(572): Pfam Id: Ku_C Pfam Desc: Ku70/Ku80 C-terminal arm
  misc_feature (592)..(626): Pfam Id: SAP Pfam Desc: SAP domain
  misc_feature (1)..(627): NCBI GI: 112982629 NCBI Desc: ku70 homolog [populus nigra]
  misc_feature (1)..(627): NCBI GI: 62320632 NCBI Desc: ku70-like protein [arabidopsis thaliana]
  misc_feature (11)..(622): NCBI GI: 45382537 NCBI Desc: ku70 protein [gallus gallus]
  misc_feature (11)..(626): NCBI GI: 114215700 NCBI Desc: ku70 autoantigen [danio rerio]
  misc_feature (6)..(626): NCBI GI: 21594185 NCBI Desc: thyroid autoantigen [mus musculus]
  misc_feature: Down-regulated in shoot tissues in response to salicylic acid treatment
MDLDPEGIFRDDSDEDEDNVQEREANKDMVVYLVDASPKMFTPATTQDNEKQETYFHTIVNCITESLKTQIIGRSYDEVAICFFNTKEKKNLQDSAGVYVYNVGDREQLDRPTAKLIKDFSCIEDSFMSTIGSRFGITAGSRENTLYNALWVAQALLRKGSVKTVSKRILIFTNEDDPFGTVTGAVKTDMIRTTIQRAKDAQDLGLSIELLPLSQPDEQFDMSLFYADLIGLDGDEITEYLPSAGDKLEDMANQLRKRIMRKRRVKTLSFAITNDVCIEVNTYALVRPTTPGKITWLDSLSNLPLKAERSFICNDTGALLQDPQTRFQMYNDTIVKFSVLELSEVKRVASHHLRLLGFKPLDCLKDYHNLRPSAFIYPSDERIFGSTRVFVALHSSMLRLGRFALAFYGNPTRPQLVALVAQEEVTSSGGQLEPPGMHMIYLPYSDDIRYPEEFHVTSDDAPRATNEQIKKALNLLKRIDLKKFSACQFANPALQRHYGILEALALGEDEMPDIKDDTLPDEEGLSRPGVVNAIEEFKTSVYGENYDQEEAEAAAGKASRGDASKKRKQITDAAVQMSAAYDWAELADNGKLKEMTVVELKSYLTAHGLPVSGKKEVLVSRILTHLGM

SEQ ID NO: 2963 - DNA, 1689 bp, Sorghum bicolor
  misc_feature: Ceres ANNOT ID no. 6027086
  misc_feature: Encodes the peptide sequence at SEQ ID NO 2964
atgtcagccgccgtccgctcccgcgccgcggcggccgcgctctccgccgcgcgccgcatccacgcaggcctcgccgcggagcagaagcagcagggcggcaacagccctggcgcccttcgccgaccttggaccctcttccggcgccagcagcagcagcaacagcaggagcagagccacgttcctcgcgccgccgctcctgtcctggacgccgttgccgaccatagggccggcggctcggacggtggggagcccccagagatctggcgccagcccggagaagcccctgtcgcttccgcgggtgcggacgccatcgggaggatcgacgtggttagggttgcggcccccggcggggaaggctttgatgggaaggacggggccgaggaaagcggggattggggcggctctaacctgggacgacggtttcccacgcccaaggagatttgccgtgggctcgacaaatttgtcatcggccagcagcgagccaagaaggtgttgtcagtagcagtttataatcactataaacgtatttattgtgagtcactcaccagaaggtctgccgcagattgtagtgagagcgattcttgcacgagtgacactgacatggtagagcttgagaaaagcaatattcttgtcatggggccaacaggctcggggaaaacattgctggcaaaaacactagcaagatttgtgaatgtgccctttgttatagctgatgcgacaaccctcactcaggctggatatgttggtgaggatgttgaatctattttgtataagctcctagcggctgctgattttgatgtagctgctgcccagcaaggaatcgtctatattgatgaagttgataaaataacaaagaaggctgagagcatcaatcttagcagagatgtttcaggtgaaggtgtgcaacaagcactgttgaaaatgcttgaaggaacggttgttagtgttcctgagaaaggggccagaaggcacccaagaggtgacaatatccagattgatacaaaaaacattctcttcatctgcggtggtgcttttgtagacttggagaaaactatttcggaaaggagacatgattcttcaattggtttccgagcgcaggttcgttcaaatatgcgatctggtggtgttataaatgctgagatcacatcatcgctactggaatcagttgaaagtggtgatctcattgcgtatggactaatcccagagtttgttggtagatttccaattcttgttagtctatcctccctcagcgaagatcagcttgttgaagttctcacagagccaaagaatgcccttggcaggcagtataccaagttgtttgaaatgaatgatgttaaattgcattttacggaggaagccttacggcttattgccaaaagagcaatagcgaagaatactggggctcgtggtttaaggtccatattagaaagtatattgacagaagctatgtatgagattccagagacacgaactggaaaagataaaatagatgctgtggttgttgacgaggagtctgttggatctgcaaatcagcatggaattggagctaagattctttgcggagaaagagctttggatctctatctggccaagcacaataataaagaatcaatgggtcaacaccaggtgagatcgaacgtggaatctgagatcgatacagaagccccctctagagtggccagcatgtag

SEQ ID NO: 2964 - protein, 562 aa, Sorghum bicolor
  misc_feature: Ceres ANNOT ID no. 6027086
  misc_feature (204)..(410): Pfam Id: AAA_2 Pfam Desc: ATPase family associated with various cellular activities(AAA)
  misc_feature (208)..(410): Pfam Id: AAA Pfam Desc: ATPase family associated with various cellular activities(AAA)
  misc_feature (352)..(562): NCBI GI: 115445641 NCBI Desc: os02g0293500 [oryza sativa (japonica cultivar-group)]
  misc_feature (79)..(562): NCBI GI: 2674203 NCBI Desc: clp protease regulatory subunit clpx [arabidopsis thaliana]
  misc_feature (76)..(562): NCBI GI: 140039862 NCBI Desc: clpx, atpase regulatory subunit [medicago truncatula]
  misc_feature (51)..(562): NCBI GI: 140049786 NCBI Desc: clpx, atpase regulatory subunit [medicago truncatula]
  misc_feature (114)..(531): NCBI GI: 115446761 NCBI Desc: os02g0564400 [oryza sativa (japonica cultivar-group)]
  misc_feature: The sequence is a functional homolog of SEQ ID NO. 462 in the 11/188,298 US application
  misc_feature: The sequence is a functional homolog of SEQ ID NO. 471 in the 11/188,298 US application
MSAAVRSRAAAAALSAARRIHAGLAAEQKQQGGNSPGALRRPWTLFRRQQQQQQQEQSHVPRAAAPVLDAVADHRAGGSDGGEPPEIWRQPGEAPVASAGADAIGRIDVVRVAAPGGEGFDGKDGAEESGDWGGSNLGRRFPTPKEICRGLDKFVIGQQRAKKVLSVAVYNHYKRIYCESLTRRSAADCSESDSCTSDTDMVELEKSNILVMGPTGSGKTLLAKTLARFVNVPFVIADATTLTQAGYVGEDVESILYKLLAAADFDVAAAQQGIVYIDEVDKITKKAESINLSRDVSGEGVQQALLKMLEGTVVSVPEKGARRHPRGDNIQIDTKNILFICGGAFVDLEKTISERRHDSSIGFRAQVRSNMRSGGVINAEITSSLLESVESGDLIAYGLIPEFVGRFPILVSLSSLSEDQLVEVLTEPKNALGRQYTKLFEMNDVKLHFTEEALRLIAKRAIAKNTGARGLRSILESILTEAMYEIPETRTGKDKIDAVVVDEESVGSANQHGIGAKILCGERALDLYLAKHNNKESMGQHQVRSNVESEIDTEAPSRVASM

SEQ ID NO: 2965 - DNA, 1248 bp, Sorghum bicolor
  misc_feature: Ceres ANNOT ID no. 6027093
  misc_feature: Encodes the peptide sequence at SEQ ID NO 2966
atggaaatcgagaggccgccgcagccgccgcctgtcgccgctgctgtggctgcggcggcagccatttccacggtgctcggtgacgacgacctcctgcgcgagatcctcgtacgtctcggcctacccaccagcctcctccgtgccgctctcgtctgccgacgctggctccgccacgcctccgacccggccttcctccgccgattccgtgacctccacccgccccgtctcctcggcgcctacctctccacatcggccggccccgccccgcgcctgcggttcctcccgatccgtccggtcccggagctcgccgccgccgcccgccgcgccggctccttcttcgacgccttcaagggatcctccgccgccgtctacgacagccgcggtggctgcctcctcgtcaccaccttcgacgaccgccacgactccacgcaccaggtctgccgcccgctgtccccgggaggggacaccaccgtggttccgccacccccgccgccgccgccgatccagctcaacaacgacgaggaatgcctcatctaccactacggtgagttccttcgcgacgacggcgacggccgctcctacttctgcgtggtgatggggtttagcgagctgcagaccaccgtgtacttatacgagttgcacgacatcaactgggttgtcaaagcctcggcagccgcgcagctcgctttattgccacccaaatcaagggttatgctcttcgatagcgccaacttctacatgttgtccacaaccaacaggatccttgtgtgtgattttccatcctcaagtatctcagtcatggagctccccaatggggtggagaacaagcccggtggttgtatcatgctttccaggggaggtagatctggaatctttctgatctatgttaaagagtttcagcttcacatcttccaccacaggatgggtgccaatgacccaggcaactggtccctagtggattctgtttctttgcgtcaggtgtgctctaatctggatatggcaagctggcaatttatggatggacctagtgttggtgttaaattatgcgctgttggggacaacgcggagtttgtgctcttggagatatttggtactattgtattcttggatattataagcaggcaagccgagaaggtttatgagctgacaccagaggataaagagttggtcagtgtccgtcccctgatgttgatatggcctcctgttttccctcagttgaaggatgcatattatgaacaaaaggagtga

SEQ ID NO: 2966 - protein, 415 aa, Sorghum bicolor
  misc_feature: Ceres ANNOT ID no. 6027093
  misc_feature (2)..(406): NCBI GI: 115445599 NCBI Desc: os02g0287900 [oryza sativa (japonica cultivar-group)]
  misc_feature (2)..(166): NCBI GI: 38347670 NCBI Desc: osjnba0054d14.5 [oryza sativa (japonica cultivar-group)]
  misc_feature (2)..(166): NCBI GI: 21742220 NCBI Desc: osjnba0087h01.6 [oryza sativa (japonica cultivar-group)]
  misc_feature (2)..(166): NCBI GI: 116309209 NCBI Desc: osigba0139j17.11 [oryza sativa (indica cultivar-group)]
  misc_feature (12)..(403): NCBI GI: 115462089 NCBI Desc: os05g0147700 [oryza sativa (japonica cultivar-group)]
  misc_feature: The sequence is a functional homolog of SEQ ID NO. 456 in the 11/188,298 US application
MEIERPPQPPPVAAAVAAAAAISTVLGDDDLLREILVRLGLPTSLLRAALVCRRWLRHASDPAFLRRFRDLHPPRLLGAYLSTSAGPAPRLRFLPIRPVPELAAAARRAGSFFDAFKGSSAAVYDSRGGCLLVTTFDDRHDSTHQVCRPLSPGGDTTVVPPPPPPPPIQLNNDEECLIYHYGEFLRDDGDGRSYFCVVMGFSELQTTVYLYELHDINWVVKASAAAQLALLPPKSRVMLFDSANFYMLSTTNRILVCDFPSSSISVMELPNGVENKPGGCIMLSRGGRSGIFLIYVKEFQLHIFHHRMGANDPGNWSLVDSVSLRQVCSNLDMASWQFMDGPSVGVKLCAVGDNAEFVLLEIFGTIVFLDIISRQAEKVYELTPEDKELVSVRPLMLIWPPVFPQLKDAYYEQKE

SEQ ID NO: 2967 - DNA, 1158 bp, Sorghum bicolor
  misc_feature: Ceres ANNOT ID no. 6027260
  misc_feature: Encodes the peptide sequence at SEQ ID NO 2968
atgatggctgcggcggcgctgaggccgcacaaggcttcgccggcgcgcgtgcccacgcggtgtgtcgccgcgctctgcgccgcctgcttcatcctcggcgtctgcgtcgtcaacaggtactgggctgttcctgagcatcccggttgcccagacaaggcaggctctgaccgctcgagggccgcgttggaccaagtgtcacagactcgcgaagtcgtcatggcgttggataagacgatatctgacatcgagatgcgcctggctgcggctagagccgcgcaggcgatgagccagggcatgtcaccgggcgactcggagagcgaccagggaactgcgcggcataggatgtcttttgtcatgggcgttttcaccacttttgcaaaccggaagcggagagattcaataaggcagacatggatgccgcaaggtgatcagttgcgaatattggaagagaagggcgttgttatccgttttgttattggacgcagtgcaaatccaaacccggataacgaggtcgaccgtgcaattgatgcagaagataaagaatacaatgatatcttgagaattgatcatgtggaaggctatggagggcttcctatgaagattcagatgtttctttcaactgctcttaccatgtgggatgctgatttctatgtaaaagctgatgataatgtttatgtcaacattggtatcaccagatcgcttttggcgcgacacagggcgaaacctcgggtgtacattggctgcatgaagtctggacccgttattgctaaaaatgactccaagtattatgaaccagatcattggaaatttgggactgagggtaacaactactttaggcatgcaacacggcagctgtatgctgtaaccagggatttggcaacttacatatcagccaaccggcatatcctgcacaagtattcaaacgaagatgtatcatttggctcttggttgattggattggaagtcgagcatgtcgatgagagaagcctttgctgtggtactcccccagactgcgaatggaaagcacaggccgggaacccatgtgcagcgtccttcgactggaactgcactggcatctgcaatccggtggagaggatgacagaggtgcaccggcgatgttgggaaggcattggagccgaagggcacacacagttttga

SEQ ID NO: 2968 - protein, 385 aa, Sorghum bicolor
  misc_feature: Ceres ANNOT ID no. 6027260
  misc_feature (129)..(328): Pfam Id: Galactosyl_T Pfam Desc: Galactosyltransferase
  misc_feature (48)..(376): NCBI GI: 21360399 NCBI Desc: at1g05170/yup8h12_22 [arabidopsis thaliana]
  misc_feature (52)..(373): NCBI GI: 115446789 NCBI Desc: os02g0566800 [oryza sativa (japonica cultivar-group)]
  misc_feature (59)..(376): NCBI GI: 145323746 NCBI Desc: galactosyltransferase family protein [arabidopsis thaliana]
  misc_feature (52)..(376): NCBI GI: 4138265 NCBI Desc: avr9 elicitor response protein [nicotiana tabacum]
  misc_feature (62)..(379): NCBI GI: 115464013 NCBI Desc: os05g0427200 [oryza sativa (japonica cultivar-group)]
  misc_feature: Useful for making plants with altered carbohydrate content
  misc_feature: Functional homolog of the protein sequence given in SEQ ID NO 13812
MMAAAALRPHKASPARVPTRCVAALCAACFILGVCVVNRYWAVPEHPGCPDKAGSDRSRAALDQVSQTREVVMALDKTISDIEMRLAAARAAQAMSQGMSPGDSESDQGTARHRMSFVMGVFTTFANRKRRDSIRQTWMPQGDQLRILEEKGVVIRFVIGRSANPNPDNEVDRAIDAEDKEYNDILRIDHVEGYGGLPMKIQMFLSTALTMWDADFYVKADDNVYVNIGITRSLLARHRAKPRVYIGCMKSGPVIAKNDSKYYEPDHWKFGTEGNNYFRHATRQLYAVTRDLATYISANRHILHKYSNEDVSFGSWLIGLEVEHVDERSLCCGTPPDCEWKAQAGNPCAASFDWNCTGICNPVERMTEVHRRCWEGIGAEGHTQF

SEQ ID NO: 2969 - DNA, 1503 bp, Sorghum bicolor
  misc_feature: Ceres ANNOT ID no. 6027264
  misc_feature: Encodes the peptide sequence at SEQ ID NO 2970
atgacctcctccgactctggtgcgatctcctccgactccggcacaatgatcgagctccatggtttggagcggcggagcgttgcagaccagcgtcgtgcgggtggtcgtgaccagcgagcagagatgagcgaggccagcagcgagcgggacgggctgcgagctttcgtgccggtgccagggagggagaccaacggctggatgctgagccacgcacgtgaagttggccacaagaacctgagacagaggatgtccaatgtgaccgtgtgcgtgcggttcagaccgctgagtcacaaggagaggaaggccaatagtgacaaggtctgcttcaagaaactggactccgagtcttttgttttcaaggatgagagggaagaagatgtcatattcagttttgacaaggttttctatgaagattcccaacagtctgatgtctacaacttccttgcagtgcccattgtttcagatgccatcaatggaataaatggaactataattacttatggtcagactggggcagggaagacgtatagcatggaggggccaagtatcttgcattgcaatgaacagaaaactgggctagtacagcgagttgtggatgagctttttgtatgtttaggatcatcagcaagcacatggactgtgaagctgtcaatggtggagatatatttggaaaaagtgagggaccttcttgacttgtccaaagacaacctgcagatcaaggaaagtaaaacccaaggaatttacatttctggagcaacagagatatctatcctgaacagttcagatgcattagagaacctttctcaaggaattgccaacagagctgttggggaaacacgtatcctctatttgtcaatctggagtcctgaaacagctattctaaagttaatatgggtaacatcagggaagattatacttgttgacttggctggttctgagaaagtcgagaaaactggtgctgaaggacgggttcttgatgaggcaaaaacaatcaataaatctctctcagctctaggaaatgtcatcaatgccttaacgactggtaaacagaatcatgtgcctttccgtgactcaaaacttacgcgcattcttcaagatgcattgcctgtatttcccgtttgtcagcatcttactctgaaccaaacttttcttcagctaaggttgagcctgagggaggaggatgtggatttgctggaggaactgttcttgcaggaaggcatcatcttcgatcccagttccatcacggacatcgactcggcatgccgtgacactgcaagtgaggagatctcgttgctgatgcaagccgtggaggatctcaaagaaactgtggaagagctcacggacgagaacgaaaagctaaggcgcagcctccaagttgcgcaggagatgaccgctcaggcgcagcttgctgccgccgccgctgccggagctgcctggagccgtagtctgcttgatttcgtgccggcagtcctcctccggcgctttgggtttgtaccagactga

SEQ ID NO: 2970 - protein, 500 aa, Sorghum bicolor
  misc_feature: Ceres ANNOT ID no. 6027264
  misc_feature (91)..(383): Pfam Id: Kinesin Pfam Desc: Kinesin motor domain
  misc_feature (72)..(368): NCBI GI: 50725629 NCBI Desc: kinesin 1-like [oryza sativa (japonica cultivar-group)]
  misc_feature (16)..(458): NCBI GI: 115474523 NCBI Desc: os08g0117000 [oryza sativa (japonica cultivar-group)]
  misc_feature (83)..(368): NCBI GI: 21553553 NCBI Desc: kinesin heavy chain-like protein [arabidopsis thaliana]
  misc_feature (84)..(368): NCBI GI: 88180442 NCBI Desc: kinesin heavy chain [chaetomium globosum cbs 148.51]
  misc_feature (85)..(368): NCBI GI: 89309515 NCBI Desc: kinesin motor domain containing protein [tetrahymena thermophila sb210]
MTSSDSGAISSDSGTMIELHGLERRSVADQRRAGGRDQRAEMSEASSERDGLRAFVPVPGRETNGWMLSHAREVGHKNLRQRMSNVTVCVRFRPLSHKERKANSDKVCFKKLDSESFVFKDEREEDVIFSFDKVFYEDSQQSDVYNFLAVPIVSDAINGINGTIITYGQTGAGKTYSMEGPSILHCNEQKTGLVQRVVDELFVCLGSSASTWTVKLSMVEIYLEKVRDLLDLSKDNLQIKESKTQGIYISGATEISILNSSDALENLSQGIANRAVGETRILYLSIWSPETAILKLIWVTSGKIILVDLAGSEKVEKTGAEGRVLDEAKTINKSLSALGNVINALTTGKQNHVPFRDSKLTRILQDALPVFPVCQHLTLNQTFLQLRLSLREEDVDLLEELFLQEGIIFDPSSITDIDSACRDTASEEISLLMQAVEDLKETVEELTDENEKLRRSLQVAQEMTAQAQLAAAAAAGAAWSRSLLDFVPAVLLRRFGFVPD

SEQ ID NO: 2971 - DNA, 330 bp, Sorghum bicolor
  misc_feature: Ceres ANNOT ID no. 6027269
  misc_feature: Encodes the peptide sequence at SEQ ID NO 2972
atggctgcaaaaatacgtgtagtgatgaaatcttttatgagccaaagcaaccaggtctcagggcttattccattcacaaagaaggttggactgcctgaatcacgagccttgtacaccgtgttgcgatcacctcatattgataagaagtccagggagcaattctcgatgcatgtcaagaaacagtttgtggaacagaccgccaaaccacatgagcttcagaagaagttcttctggttaaaacgcctgcgtatacctggggctcagtatgaagtccaaatctctttcaagacacgtctggatatggggaggctaaggtcccaagctccttga

SEQ ID NO: 2972 - protein, 109 aa, Sorghum bicolor
  misc_feature: Ceres ANNOT ID no. 6027269
  misc_feature (4)..(93): Pfam Id: Ribosomal_S10 Pfam Desc: Ribosomal protein S10p/S20e
  misc_feature (1)..(109): NCBI GI: 11177526 NCBI Desc: ribosomal protein s10 [zea mays]
  misc_feature (1)..(109): NCBI GI: 11528351 NCBI Desc: ribosomal protein s10 [zea mays]
  misc_feature (1)..(100): NCBI GI: 115468400 NCBI Desc: os06g0538800 [oryza sativa (japonica cultivar-group)]
  misc_feature (1)..(105): NCBI GI: 1362069 NCBI Desc: ribosomal protein s10 - garden pea mitochondrion
  misc_feature (1)..(105): NCBI GI: 1710792 NCBI Desc: mitochondrial ribosomal protein s10
MAAKIRVVMKSFMSQSNQVSGLIPFTKKVGLPESRALYTVLRSPHIDKKSREQFSMHVKKQFVEQTAKPHELQKKFFWLKRLRIPGAQYEVQISFKTRLDMGRLRSQAP

SEQ ID NO: 2973 - DNA, 1077 bp, Sorghum bicolor
  misc_feature: Ceres ANNOT ID no. 6027270
  misc_feature: Encodes the peptide sequence at SEQ ID NO 2974
atggccggcgcgggaggcggcggcggcggcgtggtccgcgacgtggaggcgctggatggcgtgcgctccatcgtgctaaagccgtcggagtcgctcgatgagtcgcggttcacgaggatcgccgcgccgacttcaacgacccgggcgtccaacctcggcgacgccatcgacgtcgtcaaccagatgttagattggaggttgtcgcatgagaagcccagtgaagattgtgatgaagcagaacttgaccctaaatatagacaatctgtgaagtgcaagatatttctgggcttcacttcaaaccttgtgtcttctggcatccgggatataatccgttttctagctcagcatcacatggtggatgttattgttacaactgctgggggtatagaggaggatctcattaaatgccttgcaccaacttacagaggtgatttttcattacctggagcactactgcggtcaaaaggactgaaccggataggaaatctgttggtgccgaatgataactattgcaagtttgagaactggatcatgccactctttgaccagatgctattcgaacaatctactgagaatgtttggacaccgtcaaaggtgatagctcgtcttggtaaagaaataaatgatgaaagctcctatctttactgggcatacaagaataacatacctgtatactgccctgcattgactgatggatcactcggagacatgctgttctgtcatgcagtccgtaatcctggccttattattgacattgtacaagatatacggctgatgaatggggaagccatccatgcaacaccaaggaagacagggattatagttcttggtggaggccttccaaagcatcatatatgcaatgccaatatgtttcgcagtggtgcagattatgctgtttatattaacacagctcaagagtttgatggtagtgactctggagcacagcctgatgaagcagtctcatggggaaagataaagggttcagctaaacctgtaaaggtgcactgcgatgcaagtatcgctttcccgcttgttgtggctgcgacatttgcacgcaaggttcatggctccaagtga

SEQ ID NO: 2974 - protein, 358 aa, Sorghum bicolor
  misc_feature: Ceres ANNOT ID no. 6027270
  misc_feature (37)..(351): Pfam Id: DS Pfam Desc: Deoxyhypusine synthase
  misc_feature (48)..(353): NCBI GI: 12407779 NCBI Desc: deoxyhypusine synthase [musa acuminata]
  misc_feature (9)..(356): NCBI GI: 52222139 NCBI Desc: deoxyhypusine synthase [lactuca sativa]
  misc_feature (9)..(353): NCBI GI: 53850032 NCBI Desc: deoxyhypusine synthase [symphytum officinale]
  misc_feature (16)..(357): NCBI GI: 53850016 NCBI Desc: deoxyhypusine synthase [heliotropium indicum]
  misc_feature (9)..(357): NCBI GI: 53850006 NCBI Desc: deoxyhypusine synthase [cynoglossum officinale]
  misc_feature (48)..(353): SWISSPROT Homolog: EC 2.5.1.46 Deoxyhypusine synthase
  misc_feature (16)..(358): SWISSPROT Homolog: EC 2.5.1.45 Homospermidine synthase 1
  misc_feature: The sequence is a functional homolog of SEQ ID NO 2 in the 6,538,182 US patent
  misc_feature: The sequence is a functional homolog of SEQ ID NO 6 in US patent 7217866
MAGAGGGGGGVVRDVEALDGVRSIVLKPSESLDESRFTRIAAPTSTTRASNLGDAIDVVNQMLDWRLSHEKPSEDCDEAELDPKYRQSVKCKIFLGFTSNLVSSGIRDIIRFLAQHHMVDVIVTTAGGIEEDLIKCLAPTYRGDFSLPGALLRSKGLNRIGNLLVPNDNYCKFENWIMPLFDQMLFEQSTENVWTPSKVIARLGKEINDESSYLYWAYKNNIPVYCPALTDGSLGDMLFCHAVRNPGLIIDIVQDIRLMNGEAIHATPRKTGIIVLGGGLPKHHICNANMFRSGADYAVYINTAQEFDGSDSGAQPDEAVSWGKIKGSAKPVKVHCDASIAFPLVVAATFARKVHGSK

SEQ ID NO: 2975 - DNA, 3306 bp, Sorghum bicolor
  misc_feature: Ceres ANNOT ID no. 6027273
  misc_feature: Encodes the peptide sequence at SEQ ID NO 2976
  misc_feature: Down-regulated in shoot tissues in response to salicylic acid treatment
atgttcggacttcaggcgagcggcgcggcggcctcgtgggtggtggggcggatgggcaccgacgcccacctctacgatgaccccgacgacgcctccatccccgagctcctcgactcccgcttcgatgctgacaaggtcgacgccctcaagcgcctccttgccctcatcgcccagggcgtcgacgtcgcacacctcttcccgcaggttgtcaagaatgtggcgtcgcagtcgctcgaggtcaagaagctcgtctacctctacctccttcactacgccgacaagcgccaaaacgaagcccttctttctattaacattttccagaaggatttatcagatataaacccattggtgagggcttgggccctgcgcactatggctggcattagactacatgttgttgctccgcttgtgttggttgctatcaagaaatgtgccagggatccatctgcatatgtaaggaaatgtgccgcctatgcgctttgcaagctgtgtgacttgcttccagatgaaagcacagctttggaggagatcgtggacatcttgttcaacgacaattcccctggagtagtcggagctgccgctgttgcatttaagtcagtctgtccaagttgtttagagttagtatcaaaacatttccgaaggctatgtgagacactcccagatatcgaggaatggactcaaattgtcctcattgagatcctcttgcgttatgtaatagccagacacgggttggtcaaggattctttactctttgcttcagatttaccgacggagactcagggcgttacagattcggatgctgttgctagcgtgcccatccaacctgattctatcagcaatggggtttctgatactatatcaagcatcatgctgttccggcactacatcgagcaatgctcaggtccctctgatagagaaggcaataatttaaaattttcatctgtcaccacaaacagcaatgatgatgttgcaattcttttgaaatgtacatcgcctcttctatggagtagaaatagtggagttgtacttgcagcagcaagtgtgcattggatcatggctcctattggggacgttaagagaattgttggcccaattttgtttactctacggtcatctcctgatgcagcatatgtgatgcttggcaacatattagtttttgccaagacaatgccatcattgtttgccccattttatgaggacttctttgtaaatgcttcagatccgtaccagacgagggctttgaagcttgaaatactgacctctattgccacagagcaatctattccggccatttttgaagaatttcaggattacattaaagatccagataggaaatttgtagcagataccgttgcagctattgcattgtgtgcccagaaacttccctctattgccaccgcttgccttgagggacttttgacacttgtattttatgaatcgtttattagtaactcggttcacttagatggagaaaatgctgttttggttcaagcaatcttgtcaatcaaagcaatagtgaaaatggatccagtatcccacgaaaaggtaattgtccgcttggttcgttgttttgacaaaatcaaggatcctgcagcacgatccttgatcgtttgggtgtttggagagtatagcttcatgggtgatctcactacaaagatagttcctcctgttctcaagtatctcgcatggtccttctctgctgaagtggtggaaacgaagcttcaaatcctaaattcttctgccaaggttataatgcgctgtacagaagaacacatggaagaattcaaaaggatagttgcgtatgtcattgagttggctacatgtgacttgaattatgatgttcgtgatcgtgctcgtttactatcaagacttttgccatgctacatgactcaccaagggccctcacatcaacctcagaatggtgatatctataaagagctagccgatcatatatttaatgggaagttgcagccaacatctcattcagcaagcaactatcgcatatatcttccaggttccctttcacaggttgttcttcatgcagcccctggttatgcaccacttccaaagcctcaaagtatggaattaaaccataatgtctcggaagcaaccagaggcaaggccaaactttctggaagtaataactccggtgctgaatctgtaacttcagcatatgagagcagctctgtttatgattcggagagtgaaggtgctgacctatcagacagagatacttttgaatcccatcaggatcaagaagataaccaggatgctccactggtacagatatatgatgctagtatacagcaaggccagacaggtcaaaatactgaggaaaatttggcagatctcatctctactgatttgactgagttgatgtctaagtcagccttggaatcatggcttgatgaggctcctcctgagccagttgttcagaatttgacacagacatcatctgccagagtttcttttacaaacctcaactttgagcgaaaacctaaattacacacattgttagactcatctggcagtaatggcttaagtgctctatatgccttctcgtctgaggtttcacccagatcacgcttgctagtatgtgtggacttatattttgagaatgtcactacacaacagctaacagatataaccattgaagctgaagaggcttctagcagtgtggattctatagaccaaacatcagaaggatcttcgggtgtccctactatcgttcctttggaagagatacattcattggctccacaacaaatggcaaagatggttcttcaggtccattttcatcaccatctcttgcctctaaagctgtctgtgctttgcaatgggaaacggcatccagcaaagcttcatcctgacattgcttattttgttcggcccctacccatggacttaaatactttcctatgcaaggaaaaccaattgaggggaatgtttgagtatgctaggaggtgcaccttcaaagatcatcttcagaagctagagcacgaggacagtgcagagcacagcgataagaaccttcaggtggcccagagtgttgcttcaaagatactgagcaatgctaatgttcaccttgtctcaatggatatgccagtaaccttcagtgttgatgatgcctctggcttgtgttggagattcagcagtgaaatcctgagcacttcaaaaccttgcctgattaccatcctcgcggaagggcatgcctcaggtccactggatcttactgtcaaggtgaactctgaagatacggtgtttgccctgaacctcctgaacagagttgtagtgatcatagattga

SEQ ID NO: 2976 - protein, 1101 aa, Sorghum bicolor
  misc_feature: Ceres ANNOT ID no. 6027273
  misc_feature (29)..(629): Pfam Id: Adaptin_N Pfam Desc: Adaptin N terminal region
  misc_feature (131)..(167): Pfam Id: HEAT Pfam Desc: HEAT repeat
  misc_feature (165)..(1101): NCBI GI: 115442533 NCBI Desc: os01g0973300 [oryza sativa (japonica cultivar-group)]
  misc_feature (17)..(1096): NCBI GI: 7076791 NCBI Desc: adaptor protein/ adaptin-like [arabidopsis thaliana]
  misc_feature (125)..(1096): NCBI GI: 42572695 NCBI Desc: adaptin family protein [arabidopsis thaliana]
  misc_feature (2)..(544): NCBI GI: 33589466 NCBI Desc: re01344p [drosophila melanogaster]
  misc_feature (2)..(544): NCBI GI: 8071835 NCBI Desc: ruby [drosophila melanogaster]
  misc_feature: Down-regulated in shoot tissues in response to salicylic acid treatment
MFGLQASGAAASWVVGRMGTDAHLYDDPDDASIPELLDSRFDADKVDALKRLLALIAQGVDVAHLFPQVVKNVASQSLEVKKLVYLYLLHYADKRQNEALLSINIFQKDLSDINPLVRAWALRTMAGIRLHVVAPLVLVAIKKCARDPSAYVRKCAAYALCKLCDLLPDESTALEEIVDILFNDNSPGVVGAAAVAFKSVCPSCLELVSKHFRRLCETLPDIEEWTQIVLIEILLRYVIARHGLVKDSLLFASDLPTETQGVTDSDAVASVPIQPDSISNGVSDTISSIMLFRHYIEQCSGPSDREGNNLKFSSVTTNSNDDVAILLKCTSPLLWSRNSGVVLAAASVHWIMAPIGDVKRIVGPILFTLRSSPDAAYVMLGNILVFAKTMPSLFAPFYEDFFVNASDPYQTRALKLEILTSIATEQSIPAIFEEFQDYIKDPDRKFVADTVAAIALCAQKLPSIATACLEGLLTLVFYESFISNSVHLDGENAVLVQAILSIKAIVKMDPVSHEKVIVRLVRCFDKIKDPAARSLIVWVFGEYSFMGDLTTKIVPPVLKYLAWSFSAEVVETKLQILNSSAKVIMRCTEEHMEEFKRIVAYVIELATCDLNYDVRDRARLLSRLLPCYMTHQGPSHQPQNGDIYKELADHIFNGKLQPTSHSASNYRIYLPGSLSQVVLHAAPGYAPLPKPQSMELNHNVSEATRGKAKLSGSNNSGAESVTSAYESSSVYDSESEGADLSDRDTFESHQDQEDNQDAPLVQIYDASIQQGQTGQNTEENLADLISTDLTELMSKSALESWLDEAPPEPVVQNLTQTSSARVSFTNLNFERKPKLHTLLDSSGSNGLSALYAFSSEVSPRSRLLVCVDLYFENVTTQQLTDITIEAEEASSSVDSIDQTSEGSSGVPTIVPLEEIHSLAPQQMAKMVLQVHFHHHLLPLKLSVLCNGKRHPAKLHPDIAYFVRPLPMDLNTFLCKENQLRGMFEYARRCTFKDHLQKLEHEDSAEHSDKNLQVAQSVASKILSNANVHLVSMDMPVTFSVDDASGLCWRFSSEILSTSKPCLITILAEGHASGPLDLTVKVNSEDTVFALNLLNRVVVIID

SEQ ID NO: 2977 - DNA, 1569 bp, Sorghum bicolor
  misc_feature: Ceres ANNOT ID no. 6027293
  misc_feature: Encodes the peptide sequence at SEQ ID NO 2978
atgcgcggggagagcgagagtcccctcctcctccaccgcagcgccgacgccatggaaaggggcggcgagcaccaccaccacccgcttagcgtattcctccgggacgcgaggctcgccttcagatgggacgagctcgggcaggagatcatgaagatcgcggtgcccggcgcgctcgcgctcatggctgacccagtcgcctccctcgtcgacaccgccttcattggccacataggtcccgttgaacttggagctgtaggtgtatcaattgctgtgtttaatcaagtctcaagaattgcagtgttcccccttgttagtgtcacaacatcatttgttgctgaggaggatgctatgtccaattgcagagacaatgacaaaataaatcaagaaaacgaatgcagtgtttctgttagcgaaatggaggaactaatttctcctgaaggtgctagtgccactaccagcatatcatcttttgaaactgattcatgtgaggtcagtgttgagcaaaagaggaaaaatattccatcagtctctacagcactattacttggtggggttcttggcctacttgaaaccgtactgcttgttttctctgcaaaacctatcttaggctacatgggtgtcacaccggattctgctatgatgaagcccgcattgcagtacttggttctcagatctcttggtgctcctgctgtcctgttatctctggcaacacaaggagtctttcgcggatttaaggatacaaagacgcctctatatgcaactgtggctggagatgcaatcaatatagttttggatccaatatttatctttgtcttccaatatggtgttagtggtgccgccattgctcatgttatatcacaatatttcattgcatccatactcttatggaggttaaggctgcatgttgatttgttgccacctagctttaaacatctgcagtttggccggtttcttaaaaatggttttctgttacttgcacgagttattgccgcaacattttgtgtgacactatctgcgtcaatggctgcacgacaaggttcaactccaatggctgcattccagatctgcttgcaaacctggttggcttgctcacttcttgctgatggattggcttttgctggacaggccatacttgcaagtgcatttgctcgtaaggactatccaaaggctactgccacagcttctcgtatcttgcagctggctttggtcctgggacttatcctaagcatacttcttggtattggtctgcgcataggatctagattatttacatctgatcagggtgtactgcatcatatctacataggaataccgtttgtctgtcttactcaaccaatcaatgctttggcttttgtttttgatggtatcaattatggagcatcagattttggatatgctgcctattcaatggtccttgttgctattgtcagtatcatttgcatcctcactcttgaaagttatagtgggtttattggaatctggatagctttggtgatctacatgagcctccggatgtttgctggattttggaggctttctcatgcacctcaccacgtcactaagcgctag

SEQ ID NO: 2978 - protein, 522 aa, Sorghum bicolor
  misc_feature: Ceres ANNOT ID no. 6027293
  misc_feature (55)..(267): Pfam Id: MatE Pfam Desc: MatE
  misc_feature (324)..(483): Pfam Id: MatE Pfam Desc: MatE
  misc_feature (27)..(512): NCBI GI: 42571819 NCBI Desc: mate efflux family protein [arabidopsis thaliana]
  misc_feature (41)..(512): NCBI GI: 42562670 NCBI Desc: mate efflux family protein [arabidopsis thaliana]
  misc_feature (22)..(512): NCBI GI: 140057542 NCBI Desc: ribosomal protein s2; multi antimicrobial extrusion protein mate [medicago truncatula]
  misc_feature (29)..(515): NCBI GI: 115451571 NCBI Desc: os03g0216700 [oryza sativa (japonica cultivar-group)]
  misc_feature (116)..(512): NCBI GI: 92877171 NCBI Desc: multi antimicrobial extrusion protein mate [medicago truncatula]
  misc_feature: The sequence is a functional homolog of SEQ ID NO 3 in US patent 7189891
  misc_feature: The sequence is a functional homolog of SEQ ID NO 6 in US patent 7189891
MRGESESPLLLHRSADAMERGGEHHHHPLSVFLRDARLAFRWDELGQEIMKIAVPGALALMADPVASLVDTAFIGHIGPVELGAVGVSIAVFNQVSRIAVFPLVSVTTSFVAEEDAMSNCRDNDKINQENECSVSVSEMEELISPEGASATTSISSFETDSCEVSVEQKRKNIPSVSTALLLGGVLGLLETVLLVFSAKPILGYMGVTPDSAMMKPALQYLVLRSLGAPAVLLSLATQGVFRGFKDTKTPLYATVAGDAINIVLDPIFIFVFQYGVSGAAIAHVISQYFIASILLWRLRLHVDLLPPSFKHLQFGRFLKNGFLLLARVIAATFCVTLSASMAARQGSTPMAAFQICLQTWLACSLLADGLAFAGQAILASAFARKDYPKATATASRILQLALVLGLILSILLGIGLRIGSRLFTSDQGVLHHIYIGIPFVCLTQPINALAFVFDGINYGASDFGYAAYSMVLVAIVSIICILTLESYSGFIGIWIALVIYMSLRMFAGFWRLSHAPHHVTKR

SEQ ID NO: 2979 - DNA, 1332 bp, Sorghum bicolor
  misc_feature: Ceres ANNOT ID no. 6027294
  misc_feature: Encodes the peptide sequence at SEQ ID NO 2980
atggagtggctggatgagtacgagaagctggtgatccggatgaacatgccccgggtcgtcatcgacaatgccatctgtcccacggccacgctggtgcaggtggacagcgccaggaagagagggttgctgctggaggccgtgcaggtgctcgctgacctcgacctctccatcaacaaggcctacatctcctccgacggccgctggttcatggatgtcttccacgtcaccgaccgcctcggccgcaagctcaccgacgacagcgtcatcacctacatccagcagtctctggggacgtggaacgagcctgcccggccggcggcgctcgagggtctgacggcgctggaactcacgggacccgaccgcacggggctgctctccgaggtcttcgccgtgctggccgacatgcagtgcagcgtggtggacgcccgtgcgtggacgcaccgcggccgcctcgcgtgcgtcgtcttcctccgcggggaggagttggcctcgggcgcgagcgcggacgacgacgacagggtggcgcgcatcctcgctcgcctcggccacctcctccgcggcgacggcgaggccccgggcgccgtggctgccgtgcccgccgcgggcgtcgcgcacgccgaccgctgcctccaccagctcatggccgcggacctcgaccgcgcgccgtcgttcccggccccagcactgtccccagccgtgtccgtacagagctgggccgagcgcgggtactccgtcgtcaccgtactgtgccgcgaccggcccaagctgctgttcgacgtggtctgcacgctccacgacatggactacgtcgtcttccacggcaccgtcgataccgctggtgaccgagcgcgccaggagttctacatccgccgcgccgacgggagccccatccggtccgaggccgagagggagcggctcaaccaatgcctccaagccgccattgaacggagatcgctggagggcgtgagactggagctgtgcacgccggaccggccgggattgctgtcggaggtgacgcggaccttccgcgagaacgggctgctcgtcgtccaggcggaggtgtcgacgaagggcgatctggcctcgaacgtgttctacgtaaccgacgctgccggcaaggcggcggaccagagcgccatcgacgccgtcagggagagggtcggcatggaccgcctcgtcgtgagcgaggagccccggccgccgcaagtgttctcgaaggacgggccaggcgaccgtgacgacagcgtcggcggcggccttggtctggtctaccttggcaacctggtgaagaggaacctgtacaacctcggcctcatcaagtcctgctcgtga

SEQ ID NO: 2980 - protein, 443 aa, Sorghum bicolor
  misc_feature: Ceres ANNOT ID no. 6027294
  misc_feature (30)..(93): Pfam Id: ACT Pfam Desc: ACT domain
  misc_feature (112)..(183): Pfam Id: ACT Pfam Desc: ACT domain
  misc_feature (244)..(311): Pfam Id: ACT Pfam Desc: ACT domain
  misc_feature (322)..(388): Pfam Id: ACT Pfam Desc: ACT domain
  misc_feature (1)..(443): NCBI GI: 92892048 NCBI Desc: protein f5o11.14 [imported] - arabidopsis thaliana [medicago truncatula]
  misc_feature (5)..(441): NCBI GI: 20466646 NCBI Desc: translation factor ef-1 alpha-like protein [arabidopsis thaliana]
  misc_feature (5)..(441): NCBI GI: 22138104 NCBI Desc: acr7 [arabidopsis thaliana]
  misc_feature (5)..(441): NCBI GI: 7269125 NCBI Desc: translation factor ef-1 alpha-like protein [arabidopsis thaliana]
  misc_feature (5)..(443): NCBI GI: 22138098 NCBI Desc: acr4 [arabidopsis thaliana]
MEWLDEYEKLVIRMNMPRVVIDNAICPTATLVQVDSARKRGLLLEAVQVLADLDLSINKAYISSDGRWFMDVFHVTDRLGRKLTDDSVITYIQQSLGTWNEPARPAALEGLTALELTGPDRTGLLSEVFAVLADMQCSVVDARAWTHRGRLACVVFLRGEELASGASADDDDRVARILARLGHLLRGDGEAPGAVAAVPAAGVAHADRCLHQLMAADLDRAPSFPAPALSPAVSVQSWAERGYSVVTVLCRDRPKLLFDVVCTLHDMDYVVFHGTVDTAGDRARQEFYIRRADGSPIRSEAERERLNQCLQAAIERRSLEGVRLELCTPDRPGLLSEVTRTFRENGLLVVQAEVSTKGDLASNVFYVTDAAGKAADQSAIDAVRERVGMDRLVVSEEPRPPQVFSKDGPGDRDDSVGGGLGLVYLGNLVKRNLYNLGLIKSCS

SEQ ID NO: 2981 - DNA, 306 bp, Sorghum bicolor
  misc_feature: Ceres ANNOT ID no. 6027296
  misc_feature: Encodes the peptide sequence at SEQ ID NO 2982
atggcggcgggaaagctgggacagctgatgacgaggctgcacctggctcggagccgatcgccggcgtcggcagcggcggacgtgccgcggggccacctggcggtgtacgtcggcgaggggcggaagcggctggtgatcccgacggcgtgcctgagccacccggcgttcgtgacgctgctgaagcgggtggaggatgagttcggcttcgaccaccgctgcggcggcctcaccatcccctgcgcgtccgaaggcgacttcgccgacatcgtcagcgccgtggacgaccaccaccaccaccgtcactga

SEQ ID NO: 2982 - protein, 101 aa, Sorghum bicolor
  misc_feature: Ceres ANNOT ID no. 6027296
  misc_feature (6)..(94): Pfam Id: Auxin_inducible Pfam Desc: Auxin responsive protein
  misc_feature (8)..(91): NCBI GI: 51969274 NCBI Desc: auxin-induced protein - like protein [arabidopsis thaliana]
  misc_feature (15)..(91): NCBI GI: 140063858 NCBI Desc: auxin responsive saur protein [medicago truncatula]
  misc_feature (9)..(94): NCBI GI: 140066076 NCBI Desc: auxin responsive saur protein [medicago truncatula]
  misc_feature (22)..(94): NCBI GI: 140066073 NCBI Desc: auxin responsive saur protein [medicago truncatula]
  misc_feature (22)..(94): NCBI GI: 255573 NCBI Desc: orf 15a [glycine max]
  misc_feature: Useful for making plants with modulated cold sensitivity
  misc_feature: Functional homolog of the protein sequence given in SEQ ID NO 13454
  misc_feature: Useful for making plants with modulated cold sensitivity
  misc_feature: Functional homolog of the protein sequence given in SEQ ID NO 13454
  misc_feature: Useful for making plants with modulated nitrogen use efficiency
  misc_feature: Functional homolog of the protein sequence given in SEQ ID NO 13811
  misc_feature: The sequence is a functional homolog of SEQ ID NO. 505 in the 11/188,298 US application
  misc_feature: The sequence is a functional homolog of SEQ ID NO. 402 in the 11/188,298 US application
MAAGKLGQLMTRLHLARSRSPASAAADVPRGHLAVYVGEGRKRLVIPTACLSHPAFVTLLKRVEDEFGFDHRCGGLTIPCASEGDFADIVSAVDDHHHHRH

SEQ ID NO: 2983 - DNA, 318 bp, Sorghum bicolor
  misc_feature: Ceres ANNOT ID no. 6027313
  misc_feature: Encodes the peptide sequence at SEQ ID NO 2984
atggcggggaagctggggcagctgatgatgaggctgcacctcgcgaggagaagccgatcaccgtcgtcgtcgtcggtgccggacgtgccgcggggccacctggcggtgtacgtcggcgaggggcggaagcggctggtgatcccgacggcgtgcctcagccacccggcgttcgtgacgctgctgaagcgggtggaggacgagttcggcttcgaccaccgctgcggcggcctcaccatcccctgcgcgtcggaaggcgacttcgccgacatcgtcgccgccgctgtggacgagcaccaccactcacgacgacgactttga

SEQ ID NO: 2984 - protein, 105 aa, Sorghum bicolor
  misc_feature: Ceres ANNOT ID no. 6027313
  misc_feature (5)..(95): Pfam Id: Auxin_inducible Pfam Desc: Auxin responsive protein
  misc_feature (10)..(90): NCBI GI: 140066084 NCBI Desc: auxin responsive saur protein [medicago truncatula]
  misc_feature (12)..(92): NCBI GI: 51969274 NCBI Desc: auxin-induced protein - like protein [arabidopsis thaliana]
  misc_feature (7)..(84): NCBI GI: 140066073 NCBI Desc: auxin responsive saur protein [medicago truncatula]
  misc_feature (18)..(92): NCBI GI: 416642 NCBI Desc: indole-3-acetic acid induced protein arg7
  misc_feature (18)..(92): NCBI GI: 287570 NCBI Desc: orf [vigna radiata]
  misc_feature: Useful for making plants with modulated cold sensitivity
  misc_feature: Functional homolog of the protein sequence given in SEQ ID NO 13454
  misc_feature: Useful for making plants with modulated cold sensitivity
  misc_feature: Functional homolog of the protein sequence given in SEQ ID NO 13454
  misc_feature: Useful for making plants with modulated salt sensitivity
  misc_feature: Functional homolog of the protein sequence given in SEQ ID NO 13813
  misc_feature: Useful for making plants with modulated nitrogen use efficiency
  misc_feature: Functional homolog of the protein sequence given in SEQ ID NO 13811
  misc_feature: The sequence is a functional homolog of SEQ ID NO. 505 in the 11/188,298 US application
  misc_feature: The sequence is a functional homolog of SEQ ID NO. 402 in the 11/188,298 US application
MAGKLGQLMMRLHLARRSRSPSSSSVPDVPRGHLAVYVGEGRKRLVIPTACLSHPAFVTLLKRVEDEFGFDHRCGGLTIPCASEGDFADIVAAAVDEHHHSRRRL

SEQ ID NO: 2985 - DNA, 894 bp, Sorghum bicolor
  misc_feature: Ceres ANNOT ID no. 6027315
  misc_feature: Encodes the peptide sequence at SEQ ID NO 2986
atggccggcctcctgcggctcgccgcggcccgatccgcgtcgcggctcgcccccggccgcggcccacaccggaggctagcggcggcagcgatggaggagtgctggtcggactgggaggacgaggacgaggaggaggcggcccgccgcgcgcgcgcctcggcgccggcgccggggctcgaccccgccggtggcgggccagggggcgtgcagtgggtcgtcatgggccgcccgggcccgcagaagcacgcccacgccgcgcgcctcgccgaggtgctcgccgtgccttacatctccatgggcacgctcgtcaggcaggagctcagccccgcctcgcacctctacaggaagattgcaaactcggtaaatgaggggaggcttgttccggaggacatcatatttgggttgctgacgaagcggcttgaggacggatacaacaagggtgaaactgggttcattcttgatgggattccacgcacccgtatgcaagctgagattcttgatgagattgtggatgttgatttggttctgaattttaagtgtgctgatgactgtttcatgaagaagcgatcaaggggcgatatctgctcccactgtggacagctctttgatgtcagcaattcagcatctatgaactgcagccccagccttgggagttatacatggcattctcaggtagaacctgctggtgttgtaggcctggaagcctcaaggatggagaggatgcgcacttatgctaagcagaccaagcagctggaagattactacaagaagcagaggaaaattgtggaactgaagacatctgctcgccctggggaaacatggcaggggctcgtagccgccttgcacctccagcatctggactcacccccaacaccgcacaaactcaccgcgtaa

SEQ ID NO: 2986 - protein, 297 aa, Sorghum bicolor
  misc_feature: Ceres ANNOT ID no. 6027315
  misc_feature (73)..(260): Pfam Id: ADK Pfam Desc: Adenylate kinase
  misc_feature (7)..(297): NCBI GI: 77999238 NCBI Desc: adenylate kinase family-like protein [solanum tuberosum]
  misc_feature (24)..(297): NCBI GI: 77745507 NCBI Desc: adenylate kinase family-like protein [solanum tuberosum]
  misc_feature (1)..(183): NCBI GI: 23308271 NCBI Desc: at3g01820/f28j7_15 [arabidopsis thaliana]
  misc_feature (69)..(292): NCBI GI: 25990718 NCBI Desc: adenylate kinase [solanum tuberosum]
  misc_feature (7)..(283): NCBI GI: 90265247 NCBI Desc: h0624f09.8 [oryza sativa (indica cultivar-group)]
MAGLLRLAAARSASRLAPGRGPHRRLAAAAMEECWSDWEDEDEEEAARRARASAPAPGLDPAGGGPGGVQWVVMGRPGPQKHAHAARLAEVLAVPYISMGTLVRQELSPASHLYRKIANSVNEGRLVPEDIIFGLLTKRLEDGYNKGETGFILDGIPRTRMQAEILDEIVDVDLVLNFKCADDCFMKKRSRGDICSHCGQLFDVSNSASMNCSPSLGSYTWHSQVEPAGVVGLEASRMERMRTYAKQTKQLEDYYKKQRKIVELKTSARPGETWQGLVAALHLQHLDSPPTPHKLTA

SEQ ID NO: 2987 - DNA, 1290 bp, Sorghum bicolor
  misc_feature: Ceres ANNOT ID no. 6027318
  misc_feature: Encodes the peptide sequence at SEQ ID NO 2988
atggagtccctggaggcgctcgtggcgcacatccagggcctatccggcagccccgaggaggtggcgcacctccacagcctcctcaagcaggcggacggcgactccctgcgcgcccacgccgccgcgctgcttcccttcctcgcgcacctcagccccgagacccactccctcggctacctctacctcctggaggcgtgcgcgacctccggttccaatctgagcgacttcggcggcggggacttcctggtcaccatcgccggcttcctcaccgcgtgctcggcggaccagatacgcctggcgcccgacaaattcctgaatgtgtgtagggtgctcaaggatcaggtgatgcagctcaacatgcctatcagagggatcgccccgctgcgggcggcggtccgtaagatccagtcttcgcccgagcagctgactccactccacgcggactaccttctcctgtgcctgctggcgaagcagtacaaggctggactcagcgtcctggaagatgacatattcgaagtcgatcagccaaaggacctgttcctctattgctactacggagggatgatttacattgggctcaagaagtttcctaaagctttggagcttcttcacaatgctgttactgctccaatgtcaatgctgaacgcgattgctatagaagcttacaagaagtatgtcctagtttcactcattgtgaatggacaggtcccatcatttcctaagtatacatccgtatcaggtcaaaggagtatgaaaattcacgcccagatttatgttgagctatctacaagctatagcaacggtcgctacactgatttagagatatttgtccaagcaaattcggcaacatttcaatctgacaacaacctagggctggtgaagcaagtgctctcctcgatgtacaaacggaacatccaaaggctgacccagacttatttaactctttcacttgaagatattgctaggtctgttcaacttgaaacaccaagggatgctgaaatgcatgtacttcgcatgatcgaagatggagagatccatgcaaccataaaccagaaggatggaatggtcagctttcatgaagatcctgaacaatataaaagtgtcgagatggtggagcatattgactcgtctatccagagattgacggcattgtccaagaagttggcttcaattgatgagaacatgtcatgtgatcctgcatatttgatgaagacgggaagggatcgtggaagattcgatggaagattcgactacgatgactatgactctgttccgcacaagtttttttga

SEQ ID NO: 2988 - protein, 429 aa, Sorghum bicolor
  misc_feature: Ceres ANNOT ID no. 6027318
  misc_feature (256)..(360): Pfam Id: PCI Pfam Desc: PCI domain
  misc_feature (1)..(428): NCBI GI: 140051798 NCBI Desc: proteasome component region pci [medicago truncatula]
  misc_feature (1)..(428): NCBI GI: 21360467 NCBI Desc: at5g14250/f18o22_40 [arabidopsis thaliana]
  misc_feature (1)..(340): NCBI GI: 79327852 NCBI Desc: cop13 (constitutive photomorphogenic 13) [arabidopsis thaliana]
  misc_feature (3)..(405): NCBI GI: 39795809 NCBI Desc: cop9 constitutive photomorphogenic homolog subunit 3 [danio rerio]
  misc_feature (3)..(405): NCBI GI: 53292634 NCBI Desc: cop9 constitutive photomorphogenic homolog subunit 3 [danio rerio]
  misc_feature: Useful for making plants with modulated low light sensitivity
  misc_feature: GREAT-hit functional homolog of the protein sequence given in SEQ ID NO 13381
  misc_feature: Useful for making plants with modulated light quality sensitivity
  misc_feature: Useful for making plants with modulated low light sensitivity
  misc_feature: Functional homolog of the protein sequence given in SEQ ID NO 13381
MESLEALVAHIQGLSGSPEEVAHLHSLLKQADGDSLRAHAAALLPFLAHLSPETHSLGYLYLLEACATSGSNLSDFGGGDFLVTIAGFLTACSADQIRLAPDKFLNVCRVLKDQVMQLNMPIRGIAPLRAAVRKIQSSPEQLTPLHADYLLLCLLAKQYKAGLSVLEDDIFEVDQPKDLFLYCYYGGMIYIGLKKFPKALELLHNAVTAPMSMLNAIAIEAYKKYVLVSLIVNGQVPSFPKYTSVSGQRSMKIHAQIYVELSTSYSNGRYTDLEIFVQANSATFQSDNNLGLVKQVLSSMYKRNIQRLTQTYLTLSLEDIARSVQLETPRDAEMHVLRMIEDGEIHATINQKDGMVSFHEDPEQYKSVEMVEHIDSSIQRLTALSKKLASIDENMSCDPAYLMKTGRDRGRFDGRFDYDDYDSVPHKFF

SEQ ID NO: 2989 - DNA, 2409 bp, Sorghum bicolor
  misc_feature: Ceres ANNOT ID no. 6027332
  misc_feature: Encodes the peptide sequence at SEQ ID NO 2990
  misc_feature: Up-regulated in shoot tissues in response to salicylic acid treatment
atgatggatgggaggcggcattcggtggacatccccgtctcgagggccctggtggccatcatgcggtccagatccctgagggacccggacaccaactcgctggccaagttctccgccaagaagaccatctgggagggctgctccatcgacgaggacgagcagcaggagggggcgagcaacaacaagaccacctacggcaggcacagcttcagctacaacgcgtacgatcacctccagcggaggagggaggagtttggggacagcctcaggtccggccggctcgccgactcgcccatcaacatcatcaaggccaatgccatggccaaggcggtgctccataaccagagctgttgctccgccatctccgggatgtcatcgaggggcgcaaaggacaggagttttggtttggtgggtgatggggaggagcttggccggaggggggaggccagcacgttccaggagagctccaggagtttgcttcagaagtaccggcccaaatctttctccgagcttgttgggcacggtgttattgctcagtctctttcgggtgctgttctgaaagggaagcttgctcctatctatcttttccatggtccgcacggcgtgggcaagacgtccatggctagaacatttgcagctgcgctcaattgccgttcccctggtgggaaccagccgtgtggccgctgtgacgagtgcgtggccatattctcgggaagcagtagcagtgtggtagagattgatgcttccaaacttgattgcaaatctagggtcgcggccttgctcaggaatgcctgtgaagttcctgcctcttcacacttcaaggttatgatcgttgatgattgccagcacatggacaaggagggatggtactctatctacaatagccttgaagggattcctgagagcacgatctttgttatgatcacatctgatattgataagctaccaagcaattccatagggtggtgccagagctacaggttttgcaagatagatgatgcagagattgcccgcaggttgatcaagatttgtactaaagaaggcatggaattcgaagctgaggcactggaccttcttgctcgcaaggctaacggttccattcgagatgcaattcaaatgcttgaccaactaactctacttggaaagaggatcagcaaatcagttacacatgagctgataggtgatgtctcagacgaggaattgcttgatcttctcaatctggccatgtcatcagatgctgctacaattgtgaggagggccagggagcttttgagctcaaaagtcgaccctctgcagttattagctcagcttgcaaatcttatcatggatattttagctgggaagcacccttcagattcttcagaagttagaagagttaatggaaaacatacatctgctgacgtggatgtacacaaacttaggaatgctttggaaatactctctgaaactgaaaagcaattaaagaccacaaaaaatcagtctacatggcttactgctgcattgttacagtttaatatgagggaaccctactgtctagatgatactgcagtttcaagcatgtttactgaaagtcagacagatgatgggactgcagtactgaaagatgagagcttagatacaagttcccatctttgttcccagaacaaagttagttctctagacatgaatttaggagatccagatgtattggagacgatatggatgaaagctcttgaaaactgttcatcccctccacttcaaaatttactgcggaaggatgggaagttgtcgtctctgtatacaacccaaggtgtcgcagttgctgagctacagttctgccatcctgaggttgtcccaacatcagagagcttctggaagccactatgtgcatctctgcagaatttgctgaggtgcaacgtcgacatccgaatcaacctttctcctatctctggcagcagggctggatccaaggactcatccgtcagccttgtcatggaatcaagagaagaccgtcaggcgcaggacccagtcacctcaaactgcagaaccgtcgtgtcatcgagaagagactgcccttccccactcgtggggcaagccaaggagaagccgcctcacatcctggggtgtctccatggcggcgcagatggtgacacagtggataccgagccgaggatcctgagctaccagaaaatctctgtcgtccctgcagcatccacaccaggaaacgctcccctcaaagccaccgctggagacacatcaaaggttgatgaaggcagagttcgtcgtggctgctgctcgctccttctaccctgcagtgtttgtgccccccttcggaagtcccggacgcgggagaaacgccgagccaagctgttcagctgctgcttctgcaagatcggaccagactgcaaaacgaaggcagaagcagggtag

SEQ ID NO: 2990 - protein, 802 aa, Sorghum bicolor
  misc_feature: Ceres ANNOT ID no. 6027332
  misc_feature (193)..(383): Pfam Id: AAA Pfam Desc: ATPase family associated with various cellular activities(AAA)
  misc_feature (222)..(504): Pfam Id: DNA_pol3_delta Pfam Desc: DNA polymerase III, delta subunit
  misc_feature (86)..(536): NCBI GI: 20197093 NCBI Desc: similar to prokaryotic dna polymerase iii gamma subunit [arabidopsis thaliana]
  misc_feature (139)..(509): NCBI GI: 7262689 NCBI Desc: contains similarity to dna pol iii gamma and tau from chlamydia trachomatis gbae001306.1 and contains an aaa (atpase) pf00004 domain. [arabidopsis thaliana]
  misc_feature (139)..(593): NCBI GI: 30683811 NCBI Desc: dna polymerase-related [arabidopsis thaliana]
  misc_feature (157)..(637): NCBI GI: 79530257 NCBI Desc: atp binding / nucleoside-triphosphatase/ nucleotide binding [arabidopsis thaliana]
  misc_feature (162)..(502): NCBI GI: 86605279 NCBI Desc: dna polymerase iii, subunits gamma and tau [cyanobacteria bacterium yellowstone a-prime]
  misc_feature: Up-regulated in shoot tissues in response to salicylic acid treatment
MMDGRRHSVDIPVSRALVAIMRSRSLRDPDTNSLAKFSAKKTIWEGCSIDEDEQQEGASNNKTTYGRHSFSYNAYDHLQRRREEFGDSLRSGRLADSPINIIKANAMAKAVLHNQSCCSAISGMSSRGAKDRSFGLVGDGEELGRRGEASTFQESSRSLLQKYRPKSFSELVGHGVIAQSLSGAVLKGKLAPIYLFHGPHGVGKTSMARTFAAALNCRSPGGNQPCGRCDECVAIFSGSSSSVVEIDASKLDCKSRVAALLRNACEVPASSHFKVMIVDDCQHMDKEGWYSIYNSLEGIPESTIFVMITSDIDKLPSNSIGWCQSYRFCKIDDAEIARRLIKICTKEGMEFEAEALDLLARKANGSIRDAIQMLDQLTLLGKRISKSVTHELIGDVSDEELLDLLNLAMSSDAATIVRRARELLSSKVDPLQLLAQLANLIMDILAGKHPSDSSEVRRVNGKHTSADVDVHKLRNALEILSETEKQLKTTKNQSTWLTAALLQFNMREPYCLDDTAVSSMFTESQTDDGTAVLKDESLDTSSHLCSQNKVSSLDMNLGDPDVLETIWMKALENCSSPPLQNLLRKDGKLSSLYTTQGVAVAELQFCHPEVVPTSESFWKPLCASLQNLLRCNVDIRINLSPISGSRAGSKDSSVSLVMESREDRQAQDPVTSNCRTVVSSRRDCPSPLVGQAKEKPPHILGCLHGGADGDTVDTEPRILSYQKISVVPAASTPGNAPLKATAGDTSKVDEGRVRRGCCSLLLPCSVCAPLRKSRTREKRRAKLFSCCFCKIGPDCKTKAEAG

SEQ ID NO: 2991 - DNA, 477 bp, Sorghum bicolor
  misc_feature: Ceres ANNOT ID no. 6027345
  misc_feature: Encodes the peptide sequence at SEQ ID NO 2992
atggccgccgccgccgccgccgccgtagccgtctcgtcgtcgcgtccgcctctccttctccaatccacctccaacgccaccttcgtttccttcccgaggcggacgctccccgccaccaccctcgccctctccgccccctcccagctgtcgctggtgccggcggccaaccccaagtaccacaacgcgaaggtggacgcgggcgacgaggacgtggaaggggaggagctcctgcggcggttcaactggcaggtgtcccgcgcgggcgtcatggaggagatcaggcggcggcggaggcacgaggacgctcgggacaagcgcaagcgcaaggcgcgatcggcggcgcggaggttccgccggaggcgattcaagggcccataccctttcagtgatgatcagggggcgaaggagcaggctactgatgacgaggagaatgacaactgggagctccctgcaggagagttgccttcttacaggtag

SEQ ID NO: 2992 - protein, 158 aa, Sorghum bicolor
  misc_feature: Ceres ANNOT ID no. 6027345
  misc_feature (72)..(116): Pfam Id: Ribosomal_S21 Pfam Desc: Ribosomal protein S21
  misc_feature (60)..(156): NCBI GI: 17154781 NCBI Desc: ribosome-like protein [cucumis sativus]
  misc_feature (60)..(156): NCBI GI: 18655399 NCBI Desc: at3g27160/myf5_3 [arabidopsis thaliana]
  misc_feature (59)..(154): NCBI GI: 79546640 NCBI Desc: structural constituent of ribosome [arabidopsis thaliana]
  misc_feature (62)..(120): NCBI GI: 33863293 NCBI Desc: 30s ribosomal protein s21 [prochlorococcus marinus str. mit 9313]
  misc_feature (72)..(120): NCBI GI: 86608705 NCBI Desc: ribosomal protein s21 [cyanobacteria bacterium yellowstone b-prime]
MAAAAAAAVAVSSSRPPLLLQSTSNATFVSFPRRTLPATTLALSAPSQLSLVPAANPKYHNAKVDAGDEDVEGEELLRRFNWQVSRAGVMEEIRRRRRHEDARDKRKRKARSAARRFRRRRFKGPYPFSDDQGAKEQATDDEENDNWELPAGELPSYR

SEQ ID NO: 2993 - DNA, 1362 bp, Sorghum bicolor
  misc_feature: Ceres ANNOT ID no. 6027377
  misc_feature: Encodes the peptide sequence at SEQ ID NO 2994
atggccatgccattaccagttaacaaaaaacaaactggcattgtcaaaaacttattacaggatgagaggagtgctggggataaggcgatcgatgactggctcccgatcacctcgtccaggaatgccaagtggtggtactctgccttccacaacgtcaccgccatggtcggcgccggcgtgctcagccttccctacgccatgtccaagctcggctggggacctggcattgtggtgttgatactgtcgtggatcatcacattgtacacgatgtggcagatggttgagatgcacgagatggtccccgggaagcggttcgatcggtaccatgagctcgggcagcacgcgtttgggcagaagctgggcctgtggatcgtcgtgccgcagcagctcatcgtcgaggtgggcggggacatcgtgttcatggtcaccggaggcaagtcactgaagaagttccacgacgtgatctgcgacggcaagtgcaaggacatcaagctcacctacttcatcatgatcttcgcctcctgccacttcgtcctctcccagctccccaacttcaactccatctccggcgtctccctcgcagctgctgtcatgtcactcagttactcaacaatagcttggggagtgtcgctgcataaggggaagttgccggacgtggactaccacgttctggcggcgacgacatcagagaaggcgttcaactactttggggcattgggggatgtggcgtttgcatacgcggggcacaatgtggtgcttgagatccaggccaccatcccatcgacgccggagaatccatccaagaagcccatgtggaagggtgtcgtcgtcgcctacatcatggttgccgtctgctacttccctgtctcattctttggatactgggcctttggcaaccaagttgatgataacatcctcatcacactcaacaaacccaagtggctcatcgccctcgccaacatgatggtcgttatccatgtcattggcagctaccagattttcgccatgccggtgtttgacatgatagagacggtcctggtgaagaaactgcatttccctcccggccttgcactccgtttgattgcccggagcacctatgttgcgttaacaacgtttgtagccatcactatccccttcttcggtggattgctcggtttcttcggtggattcgcctttgcaccgacaacttattttcttccctgcatcatgtggcttgcaatctacaagcccaaaaggttcagcctctcatggttcaccaactgggtctgcattcttcttggagtggtcctgatgatcctggcaccgatcggagcactccggcagatcatcttgtctgccaagacataccgattctactcctaa

SEQ ID NO: 2994 - protein, 453 aa, Sorghum bicolor
  misc_feature: Ceres ANNOT ID no. 6027377
  misc_feature (40)..(440): Pfam Id: Aa_trans Pfam Desc: Transmembrane amino acid transporter protein
  misc_feature (21)..(453): NCBI GI: 2576361 NCBI Desc: lysine and histidine specific transporter [arabidopsis thaliana]
  misc_feature (17)..(452): NCBI GI: 1906549 NCBI Desc: amino acid permease [nicotiana sylvestris]
  misc_feature (39)..(451): NCBI GI: 140046054 NCBI Desc: amino acid/polyamine transporter ii [medicago truncatula]
  misc_feature (39)..(453): NCBI GI: 92871429 NCBI Desc: amino acid/polyamine transporter ii [medicago truncatula]
  misc_feature (40)..(453): NCBI GI: 92871428 NCBI Desc: amino acid/polyamine transporter ii [medicago truncatula]
  misc_feature: Useful for making plants with altered oil content
  misc_feature: Useful for making plants with modulated biomass
  misc_feature: Useful for making plants with modulated heat sensitivity
  misc_feature: GREAT-hit functional homolog of the protein sequence given in SEQ ID NO 13361
  misc_feature: GREAT-hit functional homolog of the protein sequence given in SEQ ID NO 13434
  misc_feature: GREAT-hit functional homolog of the protein sequence given in SEQ ID NO 13448
  misc_feature: Useful for making plants with altered oil content
  misc_feature: Functional homolog of the protein sequence given in SEQ ID NO 13448
  misc_feature: The sequence is a functional homolog of SEQ ID NO. 313 in the 11/188,298 US application
  misc_feature: The sequence is a functional homolog of SEQ ID NO. 438 in the 11/188,298 US application
MAMPLPVNKKQTGIVKNLLQDERSAGDKAIDDWLPITSSRNAKWWYSAFHNVTAMVGAGVLSLPYAMSKLGWGPGIVVLILSWIITLYTMWQMVEMHEMVPGKRFDRYHELGQHAFGQKLGLWIVVPQQLIVEVGGDIVFMVTGGKSLKKFHDVICDGKCKDIKLTYFIMIFASCHFVLSQLPNFNSISGVSLAAAVMSLSYSTIAWGVSLHKGKLPDVDYHVLAATTSEKAFNYFGALGDVAFAYAGHNVVLEIQATIPSTPENPSKKPMWKGVVVAYIMVAVCYFPVSFFGYWAFGNQVDDNILITLNKPKWLIALANMMVVIHVIGSYQIFAMPVFDMIETVLVKKLHFPPGLALRLIARSTYVALTTFVAITIPFFGGLLGFFGGFAFAPTTYFLPCIMWLAIYKPKRFSLSWFTNWVCILLGVVLMILAPIGALRQIILSAKTYRFYS

SEQ ID NO: 2995 - DNA, 1383 bp, Sorghum bicolor
  misc_feature: Ceres ANNOT ID no. 6027378
  misc_feature: Encodes the peptide sequence at SEQ ID NO 2996
atggcggcagtccagccgtccatggagacgacgcagcaagggccgccgccggcggccaactattctccggccagggatggcggcaggagcgccgaggagaaggcggcggagatcgacaactggctccccatcaacgcgtcgaggaacgccaagtggtggtactctgcgttccataacgtcaccgccatggtcggcgccggcgtgctcggccttccctacgccatgtccgagctcggctggggcgctggcgtcacgattatgatcttgtcatggatcatcacgctgtacacgctgtggcagatggtggagatgcacgagatggtccctggcaagcgcttcgaccggtaccacgagctcgggcagcacgcgttcggcgagcggctgggcctgtggatcgtcgtgccgcagcagctcgtcgtcgaggtcggcgtcaacatcgtctacatggtcaccggcggcacgtcgctgaagaagttccacgacaccgtctgcgagagctgcaagcaactcaagctcacctacttcatcatgatcttcgcctccgtccacttcgtcctctcccagctccccaacttcaactccatctccggcgtgtccctcgccgccgccgtcatgtcgctcagctactccaccatcgcgtggggcgcgtcggtggacaaggggaaagcggcgaacgtcgactacgggatgcgcgcgacgacgacgcctgggaaggtgttcggtttcttgggagcgctaggcaccgtggcgttcgcctacgccgggcacaacgtggtgctggagatccaggccaccatcccgtcgacgccggagaagccgtccaagaagcccatgtggaagggcgtcgtcgtcgcctacatcgtcgtcgcgctgtgctacttccctgtgtcattcgtcggttactgggcctttggcaatactgttgacagcgacatcctcatcacgctctccaggcctaagtggctcattgccctcgccaacatgatggtcgtcatccatgtcattggcagctaccagatttatgcgatgccggtgttcgacatgatggagacggtgctggtgaagaagctgcggttccctcctggcctgatgctccgtctgattgcccgtactgtttatgttgcgttcacaatgttcatagccatcaccttccccttttttgatggattgctaagtttctttggtggattcgcgttcgcaccgacaacttatttccttccctgcatcatgtggctcgcaatctacaagcccaaaaggttcagcctctcatggttcaccaactggatctgcattattcttggagtgcttctgatggtactggcgccgattggaggactccggaacatcattattagtgccaagacataccatttctaccagtaa

SEQ ID NO: 2996 - protein, 460 aa, Sorghum bicolor
  misc_feature: Ceres ANNOT ID no. 6027378
  misc_feature (48)..(447): Pfam Id: Aa_trans Pfam Desc: Transmembrane amino acid transporter protein
  misc_feature (19)..(459): NCBI GI: 2576361 NCBI Desc: lysine and histidine specific transporter [arabidopsis thaliana]
  misc_feature (28)..(459): NCBI GI: 1906549 NCBI Desc: amino acid permease [nicotiana sylvestris]
  misc_feature (47)..(458): NCBI GI: 140046054 NCBI Desc: amino acid/polyamine transporter ii [medicago truncatula]
  misc_feature (29)..(428): NCBI GI: 2443875 NCBI Desc: amino acid permease [arabidopsis thaliana]
  misc_feature (29)..(459): NCBI GI: 92871429 NCBI Desc: amino acid/polyamine transporter ii [medicago truncatula]
  misc_feature: Useful for making plants with altered oil content
  misc_feature: Useful for making plants with modulated biomass
  misc_feature: Useful for making plants with modulated heat sensitivity
  misc_feature: Functional homolog of the protein sequence given in SEQ ID NO 13361
  misc_feature: GREAT-hit functional homolog of the protein sequence given in SEQ ID NO 13434
  misc_feature: GREAT-hit functional homolog of the protein sequence given in SEQ ID NO 13448
  misc_feature: Useful for making plants with altered oil content
  misc_feature: Functional homolog of the protein sequence given in SEQ ID NO 13448
  misc_feature: The sequence is a functional homolog of SEQ ID NO. 313 in the 11/188,298 US application
  misc_feature: The sequence is a functional homolog of SEQ ID NO. 438 in the 11/188,298 US application
MAAVQPSMETTQQGPPPAANYSPARDGGRSAEEKAAEIDNWLPINASRNAKWWYSAFHNVTAMVGAGVLGLPYAMSELGWGAGVTIMILSWIITLYTLWQMVEMHEMVPGKRFDRYHELGQHAFGERLGLWIVVPQQLVVEVGVNIVYMVTGGTSLKKFHDTVCESCKQLKLTYFIMIFASVHFVLSQLPNFNSISGVSLAAAVMSLSYSTIAWGASVDKGKAANVDYGMRATTTPGKVFGFLGALGTVAFAYAGHNVVLEIQATIPSTPEKPSKKPMWKGVVVAYIVVALCYFPVSFVGYWAFGNTVDSDILITLSRPKWLIALANMMVVIHVIGSYQIYAMPVFDMMETVLVKKLRFPPGLMLRLIARTVYVAFTMFIAITFPFFDGLLSFFGGFAFAPTTYFLPCIMWLAIYKPKRFSLSWFTNWICIILGVLLMVLAPIGGLRNIIISAKTYHFYQ

SEQ ID NO: 2997 - DNA, 1407 bp, Sorghum bicolor
  misc_feature: Ceres ANNOT ID no. 6027392
  misc_feature: Encodes the peptide sequence at SEQ ID NO 2998
atgggggcgttcttgagctccgccgccaccaaggaggaccagcagtgggtgcacggcgaggctccgagaccagattcctccaagaagatgcggctttcgacccctctctgcagccacggccacccgaggctgatcccggggctcccggatgagatctctatgcaaatcctcgcgaggatgccgcggatggagtacctcaaggccaagatggtctcgtggagctggaaggcggcggtaactggcgcagagctgtaccggctgaggaaggagctcggcgtggccgaagagtggctgtacatactgatgaagatggcagatgatcagaagctggtttggcatgctttcgatccggttagcaaccagtggcagaggctgccacttatgcctgggatcagtcatagcagagtctatgggttgggcttgggggatctggtgagcgctggcataagtatctttgacattatcagaggctggcttggtcagaaggaattgctaggcagtataccattctgtggctgtgccgtcggcgcggttgatggttgcctctatgttttgggtgggttctctagagcttccacggtgaaatgcgtgtggaggtatgatcccgctgtcaattcatggcaggaggtgagcccgatgagcaccgggcgtgccttttgcaagactagcctgttgaacaacaagctgtatgttgttggcggtgtcagcaaaggcaagaatgggttagctccgctaaaatccgctgaagtgtttgacccagcaactggggtttgggctgaggtgccagatatgttattctccaaatcgcaagctctaccgatggccttagctgatctactgaagcctattgctactggagtgacctcgtaccgagggaagctatatgttcctcagagcctttattcctggccctttgctgttgatgttggtggagagatctttgatccggagagaaattcatgggaacaaatgcctacaggcatgggtgaaggttggcctgcaaggcaggctggaacgaaattgagcgttgttatagatggcaatctgtatgccttggagccagcaacttcttctggcagtgcaaagataaagatgtacgatgctcaagaggatacttggaaggttgctgtaagccaggtacccgttggtgcctttgccgagtcagatagtccttatttgcttgttggatttcttggaaagctccatttgatcatcaaggatgtgggtagcaaaatcaatgtcatgcaaacggactctctggagccattggattcgccagccctttcggctggcacaacatgtcaagtcccagatgtctccttggagcaggcagatgtttggaaagccatcgcgtcgaagagtatcacagctgctgaacttgtcagctgtcaggttctcagcatttga

SEQ ID NO: 2998 - protein, 468 aa, Sorghum bicolor
  misc_feature: Ceres ANNOT ID no. 6027392
  misc_feature (169)..(214): Pfam Id: Kelch_1 Pfam Desc: Kelch motif
  misc_feature (216)..(265): Pfam Id: Kelch_1 Pfam Desc: Kelch motif
  misc_feature (169)..(214): Pfam Id: Kelch_2 Pfam Desc: Kelch motif
  misc_feature (216)..(265): Pfam Id: Kelch_2 Pfam Desc: Kelch motif
  misc_feature (43)..(90): Pfam Id: F-box Pfam Desc: F-box domain
  misc_feature (1)..(468): NCBI GI: 15219186 NCBI Desc: kelch repeat-containing f-box family protein [arabidopsis thaliana]
  misc_feature (42)..(249): NCBI GI: 92868686 NCBI Desc: cyclin-like f-box; serine/threonine protein phosphatase, bsu1 [medicago truncatula]
  misc_feature (38)..(267): NCBI GI: 92881986 NCBI Desc: cyclin-like f-box [medicago truncatula]
  misc_feature (23)..(263): NCBI GI: 86991220 NCBI Desc: kelch-motif containing protein [oryza rufipogon]
  misc_feature (23)..(263): NCBI GI: 86991186 NCBI Desc: kelch-motif containing protein [oryza sativa (japonica cultivar-group)]
  misc_feature: The sequence is a functional homolog of SEQ ID NO. 315 in the 11/188,298 US application
  misc_feature: The sequence is a functional homolog of SEQ ID NO. 440 in the 11/188,298 US application
MGAFLSSAATKEDQQWVHGEAPRPDSSKKMRLSTPLCSHGHPRLIPGLPDEISMQILARMPRMEYLKAKMVSWSWKAAVTGAELYRLRKELGVAEEWLYILMKMADDQKLVWHAFDPVSNQWQRLPLMPGISHSRVYGLGLGDLVSAGISIFDIIRGWLGQKELLGSIPFCGCAVGAVDGCLYVLGGFSRASTVKCVWRYDPAVNSWQEVSPMSTGRAFCKTSLLNNKLYVVGGVSKGKNGLAPLKSAEVFDPATGVWAEVPDMLFSKSQALPMALADLLKPIATGVTSYRGKLYVPQSLYSWPFAVDVGGEIFDPERNSWEQMPTGMGEGWPARQAGTKLSVVIDGNLYALEPATSSGSAKIKMYDAQEDTWKVAVSQVPVGAFAESDSPYLLVGFLGKLHLIIKDVGSKINVMQTDSLEPLDSPALSAGTTCQVPDVSLEQADVWKAIASKSITAAELVSCQVLSI

SEQ ID NO: 2999 - DNA, 1188 bp, Sorghum bicolor
  misc_feature: Ceres ANNOT ID no. 6027393
  misc_feature: Encodes the peptide sequence at SEQ ID NO 3000
atggccggctccaagccccttccgctccgcctcgcggcgccgctggccctcgccctcctcctcgcgctcgccctcgtcgccaacttcctctgggccgcctcctctcgtcgagtctccccgctctcggcctcctcttccagaacggtgatgcggaagcgcgcaaaggcggtggggcacctgaacgcgacgtacgcagacctgccggcgccgcactgggactgggaggagatgcccgcagcgcccgtgccacgcctcgacggggcgtcggttcagattgggaatctcctctacgtcttcgccggatacggggacatcgaccatgtccattctcatgttgatgtttataatttcacttctaacacatgggccgaaaggtttgatatgcccaaggagatggcacattctcatttaggaatggcctcagatggtagatacatttatgcagtttcaggacagtatggaccacagtgccgcgcctcgatcaatcgcaactttgtttttgacacagagactagagagtggcatgagttgccccctttaccacttcctagctactcagcttggcgtgggcggctccatgtgatgggtggaggcaaagaggaccgccatgaacctggattggagcattggagccttgctgtcaaggacggcaaggcactggagaacgagtggcaagctgaagtacccataccacgaggtggacctcatagggcatgtgttgtagctaatgacaaactatttgtgattggtggacaagagggagactttatgcctaaaccaggatcacctatttttaaatgtgcacggaggcatgaggttgtgtatggcgatgtgtatatgctagatgatggttccaagtggaagcaactgtctccaatgccaaagccagattcccacattgaatttgcatgggttgtcgttaacaactccatagtaattgttggaggaactacagagaagcatcctatcaccaaaaagatgattcttgttggtgaagtcttctgttttgatttggaatcgttgacctggtcagtcattgggcgcatgcctttccgaatcaagacagccttagctgggtactgggaggggtggctctattttacttctgggcagcgagatcgtgggcctgataatccagctccaaagaaagttgttggaagtatgtggagaacgaggctacacttgtga

SEQ ID NO: 3000 - protein, 395 aa, Sorghum bicolor
  misc_feature: Ceres ANNOT ID no. 6027393
  misc_feature (83)..(129): Pfam Id: Kelch_1 Pfam Desc: Kelch motif
  misc_feature (133)..(181): Pfam Id: Kelch_1 Pfam Desc: Kelch motif
  misc_feature (60)..(395): NCBI GI: 90265262 NCBI Desc: h0302e05.10 [oryza sativa (indica cultivar-group)]
  misc_feature (60)..(395): NCBI GI: 38344229 NCBI Desc: oj991113_30.6 [oryza sativa (japonica cultivar-group)]
  misc_feature (60)..(395): NCBI GI: 115459086 NCBI Desc: os04g0487100 [oryza sativa (japonica cultivar-group)]
  misc_feature (11)..(393): NCBI GI: 15912245 NCBI Desc: at3g27220/k17e12_4 [arabidopsis thaliana]
  misc_feature (72)..(370): NCBI GI: 113940834 NCBI Desc: kelch repeat [herpetosiphon aurantiacus atcc 23779]
MAGSKPLPLRLAAPLALALLLALALVANFLWAASSRRVSPLSASSSRTVMRKRAKAVGHLNATYADLPAPHWDWEEMPAAPVPRLDGASVQIGNLLYVFAGYGDIDHVHSHVDVYNFTSNTWAERFDMPKEMAHSHLGMASDGRYIYAVSGQYGPQCRASINRNFVFDTETREWHELPPLPLPSYSAWRGRLHVMGGGKEDRHEPGLEHWSLAVKDGKALENEWQAEVPIPRGGPHRACVVANDKLFVIGGQEGDFMPKPGSPIFKCARRHEVVYGDVYMLDDGSKWKQLSPMPKPDSHIEFAWVVVNNSIVIVGGTTEKHPITKKMILVGEVFCFDLESLTWSVIGRMPFRIKTALAGYWEGWLYFTSGQRDRGPDNPAPKKVVGSMWRTRLHL

SEQ ID NO: 3001 - DNA, 1797 bp, Sorghum bicolor
  misc_feature: Ceres ANNOT ID no. 6027412
  misc_feature: Encodes the peptide sequence at SEQ ID NO 3002
atgggaggttttgaagatgatgaaccaccctcaaaacgcgcaagagcatcctcagtagaatctgcaagtttaccagattatttctcgttttcgaaatccgtcaatcctttgggaagtacaatggctagacctttgccttcccaagggaaagaagttatggttggttccaagggtgttattaagaaggaggaatttgttaggataatcaccaaaactctgtatagtcttggatatgaaaaaagtggagcagttctggaggaggaatctgggattattttacataaacctatggtgaatcttttcagagagcaggtgattgatgggaattgggataatgcggtggttaccttgaataagattggccttcaagatgaaaacatcgtgaaatctgcgtcatttttgatattggagcagaaattctttgaacttctaagaaatgacgatgtcatgggtgctatgaagactttacgatgtgagatcacaccccttggtgttaatagaaaaagagtgcatgaactgtcgacttgtatgatttcttgttctccacagcagttgttccttggtttttcaaagcttggaattgattcttctagttctcggtggaagcttctagaggaattgcaaaaggtgctccctccaactgtgatggtgcctgagaggaggttagaaaatttagttgagcaagcacttactgtacaaagggatgcttgctatttccataattctgttgatgggttgtccctctacactgaccatcactgtgggaaagaccagataccgtctcgcacgctacaggttttgcatgcacatcacgatgaagtgtggtttatccagttttcaaacaacggaaagtatttagcctcagcgtcaaatgataaatctgcaattatatgggaggttgatgaagatggagagctattactgaggcatacattgattggtcatcagaagtcggtgatgatggtcgcatggagccctgatgattgccagcttctcacatgtgggcaggaagaagccatcagacgctgggatgttgaatctggcaaatgtcttcatgtttatgcaaagcctgttggtttgatatcatgtgcttggtttccagatggaaaacaaatattgtctggtctagctgatgaaaacttttgcatttgggatttagatggtaatgaagtagattgctggaaagggcagagatcaacaagaacatctgattttgctgtagcaaaagatggaaatcttataataagcatgagtagggagagcacaattcttctatttgatagggagacaaaacaagagaggttaattgaagagggtagtacaattacttcattttctctatcagaagatggtgatttcctgcttgtaaatcttataagcgaagagattcatttgtggaacataagaaatgatcctgttcgagtcaaccggtacaagggccataagcgcaaccggtttgtgataaggtcttgttttggtggatctgagcaggcgttcattgctagtgggagtgaagattcacaggtctacatatggcatcgagccactggtgatctcattgagactcttgctggtcactcgggcacagtcaactgcgtaagttggaaccctacgaatccccacatgcttgcatcagctagtgacgatcacacagttcgtatatggggggcaaagaaggccagtcttaagcgcaaggatgttgggagcagcaactgcaacagtaacggtttccactcgaatggcaatgctcatggcaacggtttcgttcaccagtgcaatgggaacagcaccaaatga

SEQ ID NO: 3002 - protein, 598 aa, Sorghum bicolor
  misc_feature: Ceres ANNOT ID no. 6027412
  misc_feature (261)..(299): Pfam Id: WD40 Pfam Desc: WD domain, G-beta repeat
  misc_feature (306)..(344): Pfam Id: WD40 Pfam Desc: WD domain, G-beta repeat
  misc_feature (348)..(385): Pfam Id: WD40 Pfam Desc: WD domain, G-beta repeat
  misc_feature (517)..(556): Pfam Id: WD40 Pfam Desc: WD domain, G-beta repeat
  misc_feature (1)..(595): NCBI GI: 9759350 NCBI Desc: wd-repeat protein-like [arabidopsis thaliana]
  misc_feature (53)..(559): NCBI GI: 9758551 NCBI Desc: wd-repeat protein-like [arabidopsis thaliana]
  misc_feature (127)..(556): NCBI GI: 134047968 NCBI Desc: wd repeat protein 26
  misc_feature (127)..(556): NCBI GI: 62089360 NCBI Desc: wd repeat domain 26 variant [homo sapiens]
  misc_feature (127)..(556): NCBI GI: 119590126 NCBI Desc: wd repeat domain 26, isoform cra_a [homo sapiens]
  misc_feature: The sequence is a functional homolog of SEQ ID NO. 502 in the 11/188,298 US application
  misc_feature: The sequence is a functional homolog of SEQ ID NO. 485 in the 11/188,298 US application
MGGFEDDEPPSKRARASSVESASLPDYFSFSKSVNPLGSTMARPLPSQGKEVMVGSKGVIKKEEFVRIITKTLYSLGYEKSGAVLEEESGIILHKPMVNLFREQVIDGNWDNAVVTLNKIGLQDENIVKSASFLILEQKFFELLRNDDVMGAMKTLRCEITPLGVNRKRVHELSTCMISCSPQQLFLGFSKLGIDSSSSRWKLLEELQKVLPPTVMVPERRLENLVEQALTVQRDACYFHNSVDGLSLYTDHHCGKDQIPSRTLQVLHAHHDEVWFIQFSNNGKYLASASNDKSAIIWEVDEDGELLLRHTLIGHQKSVMMVAWSPDDCQLLTCGQEEAIRRWDVESGKCLHVYAKPVGLISCAWFPDGKQILSGLADENFCIWDLDGNEVDCWKGQRSTRTSDFAVAKDGNLIISMSRESTILLFDRETKQERLIEEGSTITSFSLSEDGDFLLVNLISEEIHLWNIRNDPVRVNRYKGHKRNRFVIRSCFGGSEQAFIASGSEDSQVYIWHRATGDLIETLAGHSGTVNCVSWNPTNPHMLASASDDHTVRIWGAKKASLKRKDVGSSNCNSNGFHSNGNAHGNGFVHQCNGNSTK

SEQ ID NO: 3003 - DNA, 3495 bp, Sorghum bicolor
  misc_feature: Ceres ANNOT ID no. 6027566
  misc_feature: Encodes the peptide sequence at SEQ ID NO 3004
atgctgcagcgggtggcgagcaacgcctactcgtggtggtgggcgagccacatcaggaccacccagtccaagtggctcgacgcaaacctgcaggatatggagaatcgagtcaagatcatgcttaaactcctcggacaggaggccgattcctttggcaagagggccgagatgtattaccacaccagaccagtggtgataagccatgtggaggaactctacagggcttacagagctctcgtcgaacgctatgaccacatatccaaggagctccacaaggccaaccacaccattgctactgcttgtccagaagaggtgcaatatgcaatgttagaagaggaggatcaggatttccccaaagcaatcacaccaatcaacttgcacaagtccacgggccaagagattctcaatgcaaagagacaaggtccgtcagggaggaacaagctaccctccgatccagacataagcactgaggaggcacgagaagagatcgacagacttcagaagtctatacttgttctgcaaactgagaaagagtatgttaagagttcttacgagagtggtattgctcggtactgggagatcgagaagcagattgcagatacacaaaaggaaatctgtgttattcaggacaaatttgatgcacatgcagccattggtgacgatgaagcccgtgtcttgatgacagtaacagctcttagatcttgtcagggaaccatttctgagcttatacgtcattttgaggagctgatcaggcttgcagctgtggagttggaaaaaacaaagtctctccgagcacagctgcatgctatggatggcaatactgacacatcttcaagagaggcaagcagcacaggcacatcggtgaacgcaaggtcttacccggttacccagacaatacttgagttgcagcccatatatgagaaacttgaaaagttttttgccagtggttctgaatcctttgcagaggagattgcagagaatgttgatgaacttgttgataaagtcatcaacttggagctcaagttcccaaaacaaacagcacaaatcaatcaactcatacaagagaatgagaacctaaagaataaactggatgagttacaagatgagatggcacttcgtgatgaccaaagtgacttaaatgaacagattaagaaattagaggatgagtttagcacagtccgagttcttgaaagatcaataattgaggaagaagcctctgtcagcgtaggcttttctgaagtttttagctgcataattaatatctcaaaggcacttgaatctgttggtcctaaagacctgcataatttgtcaactgtggtaggggatggtgcaacggttttaaaagatgtggttctggagcactctacagaagagagcaagggtggggatttcagagacatagatgcaccaactctaagtcatagtttgggccaagatagagaagatgtctcggaagtggttaatgataatggtaacgatggcatccatggctcaaggaatgctaatgaggaaaaaatccctgggagttgcttaatgcagcaagttagatacaaatcgtctacacattctgagaaccatattaatcaggttgtcagttcagaaaatgaaaacagagttcatgattcaggtgagggcaatgttgatagctcaccaggagaagtattccagagttcatcagaaaatgagaatggaagtagaaacttcgctaaaggcgaaattgtgagaggcgaatatccattgggaattgtcagacagactcatctcctccactcagatagtatggatacttctgacaagaaatatggctctaatgaagcttctcagtcactaatggaagttgctgagggaaatattggtgatggaagttcttttaccagcaatagtgtaatccaggaggaaggacttggagatagtaaatcacaaaataccagtgggcatattagtccaattgcttcctcagagttgtacagtttaaaggaaaaagattccctagaagaatcctcattgctagaagctacgtgtttcagtggtgccgataagagcctacacttggggcatgcaaatgaagcacaatctgttgaagaattgccagaccaaggtggtcaactaaatgggtcagaaaatattgaaagtttgaacgaatgcagccaagttggattgcctaaagaggatgattgtatttcattaggtcatgttgataatatccaagatatgaagaacaggtattcctcagaagtgagggatgaaacttctctctgtgtgccagctggagattctgagcaagttctgacaaacttagataagaagagttcacatggcaaagagcttgcaagcgatgcaactacctcgaacaaccatgaaggaaggagtcagggtgaaaattctggtttgatgggagaggaatttgtacctagttggcaagaatttcttcttgatgggcttgaaggtagagaagcaatcctactagctgactatacttcagttctgcggaactacaaagaaacaaagagaaggcttaccgaactggaaaagaaaaaccaggagcatcttgaagagacaaaagcagttatacgggagttaaggaatgcaaattccatgaagtatgttgagattcggtcactaagagatctcctggattcctcggagatgcctcccagtaaagtgggtagtaactcaaacggtttcttaagtgtgagatcttttagagaagctgacagatcaaatggcactttgggtagagatatttcaactatggaggaaagcagttctagcaacattgatgcacctaacaacacgtctctttttgaagcgaggttcagaaatgacattgacactttggtggaggaaaatttgcagttcatggtaaggtatagcatggcttgccatcacatggaggagtttgacagaagatacgaggcagtacagaaagaaaaggagaacatggacgataataagactggagaacctgaaactcgaccagagcctgaaccagctgaaaagaagttgagagagctccgaactgaactggatgtatggtttgagcagaacacacttctcgatcaagaagtgcagcttaagtctgcatctctttgcagactgcaagaggagatagccaaagccctgcgtggtagcttggagatggacagagccaagttgtttacaccatatgaagctgccaagtttcaaggggaggtcctaaacatgcagcaatctaccagcaggattgagaacgagctgcaggcagcgtcagaacgaatgagggggcttcaagccaaggttaaccacgccctagagaagctacgtgagagttttgagttttcatcccaacacttgtcgcagccagagactgaaagtagttatgggaaacagttcaagcattttccaagtaggacaagggtaccgttgcggaacttcctgtttggaacaaagcgaaagaagaaatcaatatttacatgcatcaatcccacactccagaaacagttcagcgatttgtga

SEQ ID NO: 3004 - protein, 1164 aa, Sorghum bicolor
  misc_feature: Ceres ANNOT ID no. 6027566
  misc_feature (11)..(84): Pfam Id: KIP1 Pfam Desc: KIP1-like protein
  misc_feature (1)..(459): NCBI GI: 115440897 NCBI Desc: os01g0835800 [oryza sativa (japonica cultivar-group)]
  misc_feature (1)..(460): NCBI GI: 13936326 NCBI Desc: kinase interacting protein 1 [petunia integrifolia]
  misc_feature (1)..(428): NCBI GI: 20453212 NCBI Desc: at5g10500/f12b17_150 [arabidopsis thaliana]
  misc_feature (1)..(485): NCBI GI: 42561868 NCBI Desc: kinase interacting family protein [arabidopsis thaliana]
  misc_feature (32)..(485): NCBI GI: 2160165 NCBI Desc: f21m12.11 gene product [arabidopsis thaliana]
MLQRVASNAYSWWWASHIRTTQSKWLDANLQDMENRVKIMLKLLGQEADSFGKRAEMYYHTRPVVISHVEELYRAYRALVERYDHISKELHKANHTIATACPEEVQYAMLEEEDQDFPKAITPINLHKSTGQEILNAKRQGPSGRNKLPSDPDISTEEAREEIDRLQKSILVLQTEKEYVKSSYESGIARYWEIEKQIADTQKEICVIQDKFDAHAAIGDDEARVLMTVTALRSCQGTISELIRHFEELIRLAAVELEKTKSLRAQLHAMDGNTDTSSREASSTGTSVNARSYPVTQTILELQPIYEKLEKFFASGSESFAEEIAENVDELVDKVINLELKFPKQTAQINQLIQENENLKNKLDELQDEMALRDDQSDLNEQIKKLEDEFSTVRVLERSIIEEEASVSVGFSEVFSCIINISKALESVGPKDLHNLSTVVGDGATVLKDVVLEHSTEESKGGDFRDIDAPTLSHSLGQDREDVSEVVNDNGNDGIHGSRNANEEKIPGSCLMQQVRYKSSTHSENHINQVVSSENENRVHDSGEGNVDSSPGEVFQSSSENENGSRNFAKGEIVRGEYPLGIVRQTHLLHSDSMDTSDKKYGSNEASQSLMEVAEGNIGDGSSFTSNSVIQEEGLGDSKSQNTSGHISPIASSELYSLKEKDSLEESSLLEATCFSGADKSLHLGHANEAQSVEELPDQGGQLNGSENIESLNECSQVGLPKEDDCISLGHVDNIQDMKNRYSSEVRDETSLCVPAGDSEQVLTNLDKKSSHGKELASDATTSNNHEGRSQGENSGLMGEEFVPSWQEFLLDGLEGREAILLADYTSVLRNYKETKRRLTELEKKNQEHLEETKAVIRELRNANSMKYVEIRSLRDLLDSSEMPPSKVGSNSNGFLSVRSFREADRSNGTLGRDISTMEESSSSNIDAPNNTSLFEARFRNDIDTLVEENLQFMVRYSMACHHMEEFDRRYEAVQKEKENMDDNKTGEPETRPEPEPAEKKLRELRTELDVWFEQNTLLDQEVQLKSASLCRLQEEIAKALRGSLEMDRAKLFTPYEAAKFQGEVLNMQQSTSRIENELQAASERMRGLQAKVNHALEKLRESFEFSSQHLSQPETESSYGKQFKHFPSRTRVPLRNFLFGTKRKKKSIFTCINPTLQKQFSDL

SEQ ID NO: 3005 - DNA, 795 bp, Sorghum bicolor
  misc_feature: Ceres ANNOT ID no. 6027567
  misc_feature: Encodes the peptide sequence at SEQ ID NO 3006
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
atggcgacggcggcggcacccgatgactccaccgtcagagagacgacgaaagcttctgaggaggtgctgcccccaaccctgggttccggttctcaaccaccaaacctcttcgatggcacaacaaggctctacatctcctacatatgcccatatgtgcagagagtttggatagctaggaacttcaaggggttacaagacaagattcagctggttgccatagatttgcaagacaagcctgcttggttcctcgagaaagtttacccgccgggcaagatccccgtcctagagcacaatggcaacatcatagcagagtccttggatctactcagctacctggacgccaactttgagggccctaagctgtttcctggtgatcaggaccctgccaagcaagcttttgctgatgagttgattgccaacagcgattccgtcatcacagccttcttcaaggcaggccgtgcctatgcccaaggacaaggagatgatgatattagtaagatacttgctcctgctcttgacaaggtggaggagtccctaggacgtttctctgatgggccattcctcctggggcagtccatgagcgcagtcgacatggtttatgcgccctttgtcgaacgcttcaaggatttcttcgctgcagtgaagcactacgatataacacaagcaaggcctaaactcaaggagtggatagaggagctgaacaagatagatgcctacgcagtgacctggggggatcgccgtctgcagcttgctgccttgatgaacaagttcgggatacaaagcccagtagcctga

SEQ ID NO: 3006 - protein, 264 aa, Sorghum bicolor
  misc_feature: Ceres ANNOT ID no. 6027567
  misc_feature (2)..(259): NCBI GI: 85700990 NCBI Desc: glutathione s-transferase [oryza sativa (indica cultivar-group)]
  misc_feature (22)..(256): NCBI GI: 11385579 NCBI Desc: in2-1 protein [glycine max]
  misc_feature (1)..(245): NCBI GI: 7939638 NCBI Desc: xig [oryza sativa]
  misc_feature (18)..(242): NCBI GI: 37051105 NCBI Desc: glutathione s-transferase [pisum sativum]
  misc_feature (1)..(245): NCBI GI: 22347 NCBI Desc: in2-1 [zea mays]
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
MATAAAPDDSTVRETTKASEEVLPPTLGSGSQPPNLFDGTTRLYISYICPYVQRVWIARNFKGLQDKIQLVAIDLQDKPAWFLEKVYPPGKIPVLEHNGNIIAESLDLLSYLDANFEGPKLFPGDQDPAKQAFADELIANSDSVITAFFKAGRAYAQGQGDDDISKILAPALDKVEESLGRFSDGPFLLGQSMSAVDMVYAPFVERFKDFFAAVKHYDITQARPKLKEWIEELNKIDAYAVTWGDRRLQLAALMNKFGIQSPVA

SEQ ID NO: 3007 - DNA, 774 bp, Sorghum bicolor
  misc_feature: Ceres ANNOT ID no. 6027576
  misc_feature: Encodes the peptide sequence at SEQ ID NO 3008
atggagggcggcctgagcccggagcggcacgcggcggcggagccggtgcggtcgcggtggacgcccaagccggagcagatactcatcctcgagtccatcttcaacagcggcatggtgaacccgcccaaggacgagaccgtccgcatccgcaagctgctggagcgcttcggcgccgtcggcgacgccaacgtcttctactggttccagaaccgccgctcccggtcccgccggcgccagcgccagctgcaggcgcaggcggcggcagcggcagccgcaggctcctcgtcctcgtccggatcgccccccacgaccggcctcgcgccgggacacgcggcggcttcgtcgacgatggggatgttcgcgcacggcgccgcctacggctcgtccgcgtccacgtcgtggccgccctcgccgccgccgtcgtccgccgcgatgatgggcgacctggactacggaggcggcgacgacctgttcgccatctcgcggcagatgggctacgccaacggcggtggctccggctcggcgtcctcggcggccgtcgcccaccacgagcagcagctttactactcgccgtgccagccagcgagcatgacggtgttcatcaatggcgtggcgacggaggtgccgcgggggccgatcgacctgcggtccatgttcgggcaggacgtgatgctggtgcactccaccgccggcctcctccccgtcaacgagtatggcgtcctcacgcagagcctgcagatgggcgagagctacttcctggctgcatcgatctag

SEQ ID NO: 3008 - protein, 257 aa, Sorghum bicolor
  misc_feature: Ceres ANNOT ID no. 6027576
  misc_feature (16)..(77): Pfam Id: Homeobox Pfam Desc: Homeobox domain
  misc_feature (1)..(253): NCBI GI: 115474147 NCBI Desc: os07g0684900 [oryza sativa (japonica cultivar-group)]
  misc_feature (6)..(255): NCBI GI: 124360469 NCBI Desc: homeodomain-related [medicago truncatula]
  misc_feature (12)..(253): NCBI GI: 61217578 NCBI Desc: wuschel-related homeobox 11
  misc_feature (12)..(253): NCBI GI: 145338074 NCBI Desc: dna binding / transcription factor [arabidopsis thaliana]
  misc_feature (15)..(79): NCBI GI: 89330217 NCBI Desc: wox11/12b protein [zea mays]
  misc_feature: The plant is abnormally small.
  misc_feature: The plant produces a reduced number of seeds.
  misc_feature: The sequence is a functional homolog of SEQ ID NO 1474 in the 10/666,642US patent application
  misc_feature: The sequence is a functional homolog of SEQ ID NO 16 in the 10/225,066US patent application
  misc_feature: The sequence is a functional homolog of SEQ ID NO 166 in the 10/225,066US patent application
  misc_feature: The sequence is a functional homolog of SEQ ID NO 1881 in the 11/479,226US patent application
  misc_feature: The sequence is a functional homolog of SEQ ID NO 2144 in the 10/374,780US patent application
  misc_feature: The sequence is a functional homolog of SEQ ID NO 2666 in the 10/374,780US patent application
  misc_feature: Useful for biocontainment applications
  misc_feature: Useful for making plants with modulated biomass
  misc_feature: Useful for making plants with modulated growth and phenotype characteristics
  misc_feature: Functional homolog of the protein sequence given in SEQ ID NO 12941
  misc_feature: The sequence is a functional homolog of SEQ ID NO 16 in the 20050160493 US patent application
  misc_feature: The sequence is a functional homolog of SEQ ID NO 166 in the 20050160493 US patent application
MEGGLSPERHAAAEPVRSRWTPKPEQILILESIFNSGMVNPPKDETVRIRKLLERFGAVGDANVFYWFQNRRSRSRRRQRQLQAQAAAAAAAGSSSSSGSPPTTGLAPGHAAASSTMGMFAHGAAYGSSASTSWPPSPPPSSAAMMGDLDYGGGDDLFAISRQMGYANGGGSGSASSAAVAHHEQQLYYSPCQPASMTVFINGVATEVPRGPIDLRSMFGQDVMLVHSTAGLLPVNEYGVLTQSLQMGESYFLAASI

SEQ ID NO: 3009 - DNA, 1728 bp, Sorghum bicolor
  misc_feature: Ceres ANNOT ID no. 6027595
  misc_feature: Encodes the peptide sequence at SEQ ID NO 3010
atgccgcgcgccccgcgccggcagtccggcgaggcgcgccggggcgcctacaagtcgcgcgtagacttcagccgctcgcgccgccgccgcgaggatgacctcctcgccctccgccgcctcgaccgcgacgcggggctcttcaagcgccgccgcgacgagcccagtcctgctgtccctgcctccgatccggctcctgtacccgtcgaagcagccccacctgcaggcatcacccgtccgatactcactccttcctcgccgccagacgtagcggctccccgtaatgccgccgagacagaggtgcggcaagccttgcttagggttcgctcaacttatttcgagtgttttaaaagttcggtaaagcagccaaagggcaaaggcctgtcagagctggtcgacaaactatgttcagatgacaccaccagtcagctcgaagccacagtccagttcaggaaacttctttcagatgagaagaactcaactgtgataaaaatcatccgagcggatgtcctgcctagatttgctgagtttctttcaagacatgggcttccccagctccaaatggaggctgcctgggttcttaccaacatagctgcatctgattatacactgctggttgcagaatgtggtgcagttccaaggttggtggaactattaggatcaccaaatgcaaatatcaggcatcaggctatctggtgtcttgggaatatagctgctgacttgcctagctgcagagacattctttttgatcatggtgctcttacgcctttactttctcaatttagagaagacatgaagattccagttctgagaactgctatgtgggccctttcaaatctttgttttggaaaattgccagccgaagtgcaagtgaaaccaatactagaaattatcagccagcttatttattctgctgacgagaagatactggcagatgcatgctggactgtttactacatatgtggcggtaaaggtgatgctgtccaagatgtattagatgctggggtctctaatgttcttctccctgtcattttggcactcgcaagaatttcagcgggagatgataagcaagttgaggtcttagtagagagtggcattctcaattgcttagcgcagttgctagcacgaaattacccaaagaacatcaagaaacaagcatgtctaattgtttctaatattgctgctggtagcaagaatcagattcaggcagtaatcgatgcagacatcataacccctctcgttgtcttgctaaggacatcagagacagatattaaaaaggaggctgcttgggctatatcaaatgctgcatctagtggttcaagtgatcaaattcagtatttggtcagccggggatgtttagagcccctctgcagcatcctcacctacagcgatcctgacctcgtatatacgtgtcttgaaggtcttgagaatatactccaggcaggtgaggcggggaagaagggcgaggaatcagggatgaacccatatgccgagtttattctagagtgcggaggtctagagaaactagaggacctgcaggatttcgacagcgacagaatctacgagctagtcatgaagctgctgcagagctactgggaggaagaagtaggtgagagtgatgatccgaacatcccaggttcaaacgattcgtcagataccgtggaagcagcatccgaagatgcacctcagccacctgtaccgccgccctcgggtgcagatgaagccgagtga

SEQ ID NO: 3010 - protein, 575 aa, Sorghum bicolor
  misc_feature: Ceres ANNOT ID no. 6027595
  misc_feature (157)..(198): Pfam Id: Arm Pfam Desc: Armadillo/beta-catenin-like repeat
  misc_feature (199)..(238): Pfam Id: Arm Pfam Desc: Armadillo/beta-catenin-like repeat
  misc_feature (240)..(281): Pfam Id: Arm Pfam Desc: Armadillo/beta-catenin-like repeat
  misc_feature (353)..(394): Pfam Id: Arm Pfam Desc: Armadillo/beta-catenin-like repeat
  misc_feature (396)..(436): Pfam Id: Arm Pfam Desc: Armadillo/beta-catenin-like repeat
  misc_feature (439)..(479): Pfam Id: Arm Pfam Desc: Armadillo/beta-catenin-like repeat
  misc_feature (125)..(575): NCBI GI: 115474205 NCBI Desc: os07g0688300 [oryza sativa (japonica cultivar-group)]
  misc_feature (130)..(564): NCBI GI: 13752560 NCBI Desc: importin alpha 1 [capsicum annuum]
  misc_feature (130)..(550): NCBI GI: 79317456 NCBI Desc: protein transporter [arabidopsis thaliana]
  misc_feature (101)..(563): NCBI GI: 119866035 NCBI Desc: impa1 [nicotiana benthamiana]
  misc_feature (136)..(550): NCBI GI: 81075707 NCBI Desc: importin alpha 1-like [solanum tuberosum]
MPRAPRRQSGEARRGAYKSRVDFSRSRRRREDDLLALRRLDRDAGLFKRRRDEPSPAVPASDPAPVPVEAAPPAGITRPILTPSSPPDVAAPRNAAETEVRQALLRVRSTYFECFKSSVKQPKGKGLSELVDKLCSDDTTSQLEATVQFRKLLSDEKNSTVIKIIRADVLPRFAEFLSRHGLPQLQMEAAWVLTNIAASDYTLLVAECGAVPRLVELLGSPNANIRHQAIWCLGNIAADLPSCRDILFDHGALTPLLSQFREDMKIPVLRTAMWALSNLCFGKLPAEVQVKPILEIISQLIYSADEKILADACWTVYYICGGKGDAVQDVLDAGVSNVLLPVILALARISAGDDKQVEVLVESGILNCLAQLLARNYPKNIKKQACLIVSNIAAGSKNQIQAVIDADIITPLVVLLRTSETDIKKEAAWAISNAASSGSSDQIQYLVSRGCLEPLCSILTYSDPDLVYTCLEGLENILQAGEAGKKGEESGMNPYAEFILECGGLEKLEDLQDFDSDRIYELVMKLLQSYWEEEVGESDDPNIPGSNDSSDTVEAASEDAPQPPVPPPSGADEAE

SEQ ID NO: 3011 - DNA, 1608 bp, Sorghum bicolor
  misc_feature: Ceres ANNOT ID no. 6027601
  misc_feature: Encodes the peptide sequence at SEQ ID NO 3012
atgtcgctccgtgtgctgaaccctaacgcccaggtgctcaacaagtcggaggcgctgcacatgaccatcaacgccgccaagggcctccaggacgtgctcaagaccaacctcggccccaagggcaccatcaagatgcttgtgggtggagctggtgacctgaagctgactaaggatgggaacaccctcttgaaggaaatgcaaattcagaacccaactgcaatcatgattgcaaggacggctgtggcacaggatgacacaagtggtgatggcacaacctccactgtgctttttattggggagctaatgaagcagtctgagcggtgcatagatgaaggtactcatccaagattcttggtcgatggttttgatgttgctaagagagcatgtcttgattttcttgaaaagttcaagacgccagtcgttattggtgaagaaccggacagagacaccttgaaaatgatagcaagaacaactcttaggacgaagttgtatgaaggattggctgatcagttgacggatattgttgtgaatgcagttctgtgcatcagcaaaccagatgaaccaatcgatctttttatggtggaaataatgcacatgcgccacaaatttgatgttgacacccgcctggttgaaggtctggtcctggaccacggttctcgtcaccctgacatgaagcgcagggcagagaactgttacatcttgacctgcaatgtctcattagaatatgagaaaagtgaaatcaatgcaggatttttttactcaaatgcagaacaaagggagaagatggttgctgcagagagacgccaagttgatgaacgtgtcaaacggattattgagttgaaaaataaggtttgtgctggaggtgataaaaactttgttgtgataaatcagaagggcattgaccctccatctctggatctccttgctagagctgggataattgctctccgaagagcaaagaggagaaatatggagaggcttgtgctagcatgcggtggtgaagctgtcaattccgttgatgacttgactgaagattgtctaggctgggctggtcttgtctatgagcatgttcttggagaagaaaagtacacttttgtggagaatgtgaaaaacccacgctcttgtaccatactgattaaaggacctaatgaccataccatcgcacaaatcaaggatgctgtccgtgatggtctaagatctgttaagaacacaattgaggatgaagcagttgtgctgggtgctggtgcttttgaggttgcggcaaagaagcatcttattgacaacgtgaagaaaaccgtcaaaggacgagcacaacttggggtggaggcgtttgcagaagctcttcttgttatacccaagactttagctgaaaactctggtttagatacccaagatgtgattgtttctctccagaacgagcatgaccgtggattagttgtgggattgaaccatcactctggggaaccgattgatccccagatggaaggcatctttgataattactctgtgaaacgccagatcatcaactctggacccatcattgcatctcaattgctgcttgtggatgaagtgatcagagcaggccgcaacatgaggaaaccgacttag

SEQ ID NO: 3012 - protein, 535 aa, Sorghum bicolor
  misc_feature: Ceres ANNOT ID no. 6027601
  misc_feature (29)..(529): Pfam Id: Cpn60_TCP1 Pfam Desc: TCP-1/cpn60 chaperonin family
  misc_feature (1)..(535): NCBI GI: 9755653 NCBI Desc: tcp-1 chaperonin-like protein [arabidopsis thaliana]
  misc_feature (2)..(533): NCBI GI: 119628377 NCBI Desc: chaperonin containing tcp1, subunit 6a (zeta 1), isoform cra_a [homo sapiens]
  misc_feature (2)..(533): NCBI GI: 41152046 NCBI Desc: chaperonin containing tcp1, subunit 6a (zeta 1) [danio rerio]
  misc_feature (2)..(533): NCBI GI: 62089036 NCBI Desc: chaperonin containing tcp1, subunit 6a isoform a variant [homo sapiens]
  misc_feature (2)..(533): NCBI GI: 3201994 NCBI Desc: chaperonin cct6 [oryctolagus cuniculus]
MSLRVLNPNAQVLNKSEALHMTINAAKGLQDVLKTNLGPKGTIKMLVGGAGDLKLTKDGNTLLKEMQIQNPTAIMIARTAVAQDDTSGDGTTSTVLFIGELMKQSERCIDEGTHPRFLVDGFDVAKRACLDFLEKFKTPVVIGEEPDRDTLKMIARTTLRTKLYEGLADQLTDIVVNAVLCISKPDEPIDLFMVEIMHMRHKFDVDTRLVEGLVLDHGSRHPDMKRRAENCYILTCNVSLEYEKSEINAGFFYSNAEQREKMVAAERRQVDERVKRIIELKNKVCAGGDKNFVVINQKGIDPPSLDLLARAGIIALRRAKRRNMERLVLACGGEAVNSVDDLTEDCLGWAGLVYEHVLGEEKYTFVENVKNPRSCTILIKGPNDHTIAQIKDAVRDGLRSVKNTIEDEAVVLGAGAFEVAAKKHLIDNVKKTVKGRAQLGVEAFAEALLVIPKTLAENSGLDTQDVIVSLQNEHDRGLVVGLNHHSGEPIDPQMEGIFDNYSVKRQIINSGPIIASQLLLVDEVIRAGRNMRKPT

SEQ ID NO: 3013 - DNA, 378 bp, Sorghum bicolor
  misc_feature: Ceres ANNOT ID no. 6027605
  misc_feature: Encodes the peptide sequence at SEQ ID NO 3014
atggcaagtacagcatgctttgtgattgtcagtaagaatgacatcccgatctatgaggcagaagttggatctgcacccaaaaaagaagatttgtcttatcaccatcagtttatcctgcatgctgcgttagatgttgttcaggacctagcatggaccacaaatgcaatgttcctgaagtcagttgatagattcaatgaccttgtggtattcatgttgcttcatgactcacgtagtgaagatggaataaaaagcttttttcaagaggtccatgaactttacatcaagatattcctcaacccgctttacctgcccggttctcgcatcacatcctctcatttcgataccaaggtcagggccctcgcaaggaagtacctgtaa

SEQ ID NO: 3014 - protein, 125 aa, Sorghum bicolor
  misc_feature: Ceres ANNOT ID no. 6027605
  misc_feature (9)..(123): Pfam Id: Sedlin_N Pfam Desc: Sedlin, N-terminal conserved region
  misc_feature (1)..(125): NCBI GI: 32490260 NCBI Desc: osjnbb0116k07.2 [oryza sativa (japonica cultivar-group)]
  misc_feature (1)..(125): NCBI GI: 145337812 NCBI Desc: intracellular transporter [arabidopsis thaliana]
  misc_feature (27)..(125): NCBI GI: 115459286 NCBI Desc: os04g0503800 [oryza sativa (japonica cultivar-group)]
  misc_feature (4)..(125): NCBI GI: 6165480 NCBI Desc: spbc11g11.04 [schizosaccharomyces pombe]
  misc_feature (1)..(125): NCBI GI: 119619239 NCBI Desc: trafficking protein particle complex 2, isoform cra_c [homo sapiens]
  misc_feature: Useful for biocontainment applications
  misc_feature: GREAT-hit functional homolog of the protein sequence given in SEQ ID NO 12968
  misc_feature: Useful for biocontainment applications
  misc_feature: Functional homolog of the protein sequence given in SEQ ID NO 12968
MASTACFVIVSKNDIPIYEAEVGSAPKKEDLSYHHQFILHAALDVVQDLAWTTNAMFLKSVDRFNDLVVFMLLHDSRSEDGIKSFFQEVHELYIKIFLNPLYLPGSRITSSHFDTKVRALARKYL

SEQ ID NO: 3015 - DNA, 990 bp, Sorghum bicolor
  misc_feature: Ceres ANNOT ID no. 6027607
  misc_feature: Encodes the peptide sequence at SEQ ID NO 3016
atggctgatgctagctcaaggactgacacatcaatcgttttagacgacatcgacaagaatcagaggatggagaatggaagtggtgcggttctaccttctaattcttcagataggtccgacaggtctgacaaacctctggaccaaaagacaatgcgacggcttgcccaaaatcgtgaggcagcaagaaaaagtcggctgaggaaaaagcagctggagagcagtaagctgaaacttgcacaactggagcaggaactccagaaagctcgccagcagggaatcttcatttccagctctggagaccaaacccatgccatgagtggaaatggagcattgacttttgacatagaatatgctagatggctagaggaccaaaataagcagataaatgagttgaggactgcagtgaatgctcatgcaagtgacagtgatctacgacttattgtagatggcataatggcacattatgatgaaatattcaaggtcaaaggtgttgctgcgaaggctgatgtatttcatatactttcaggcatgtggaagacacctgctgaaaggtgcttcctgtggcttgggggttttcgtccatctgaacttttaaagctcctagcgaatcacctcgagcccctaaccgagcagcaaatgctgggtttgaacaacctccagcaatcttcccagcaggcagaggatgcactgtcacagggcatggaagcactgcagcaatctttggcagagactttggctggatctcttggtccatcaggttcttcaggaaatgtggcaaactacatgggtcagatggccatggccatgggcaaacttgggacgctcgagaattttcttcgccaggctgacaacctgcgacaacagacattgcatcaaatgcagcgtattctaacgatccgacaggcttctcgtgctcttcttgccatccatgactacttttcacggttgcgtgctctaagttctctgtggcttgctaggccgcgagaataa

SEQ ID NO: 3016 - protein, 329 aa, Sorghum bicolor
  misc_feature: Ceres ANNOT ID no. 6027607
  misc_feature (1)..(329): NCBI GI: 33146487 NCBI Desc: bzip transcription factor [oryza sativa (japonica cultivar-group)]
  misc_feature (1)..(329): NCBI GI: 17025920 NCBI Desc: bzip transcription factor [oryza sativa]
  misc_feature (1)..(329): NCBI GI: 17025918 NCBI Desc: bzip transcription factor [oryza sativa]
  misc_feature (1)..(329): NCBI GI: 140065712 NCBI Desc: bzip transcription factor, bzip_1 [medicago truncatula]
  misc_feature (1)..(329): NCBI GI: 15148924 NCBI Desc: tga-type basic leucine zipper protein tga2.1 [phaseolus vulgaris]
  misc_feature: The sequence is a functional homolog of SEQ ID NO 1494 in the 10/374,780US patent application
  misc_feature: The sequence is a functional homolog of SEQ ID NO 156 in the 10/412,699US patent application
  misc_feature: The sequence is a functional homolog of SEQ ID NO 1564 in the 10/412,699US patent application
  misc_feature: The sequence is a functional homolog of SEQ ID NO 164 in the 10/412,699US patent application
  misc_feature: The sequence is a functional homolog of SEQ ID NO 1754 in the 10/412,699US patent application
  misc_feature: The sequence is a functional homolog of SEQ ID NO 178 in the 10/412,699US patent application
  misc_feature: The sequence is a functional homolog of SEQ ID NO 1788 in the 10/412,699US patent application
  misc_feature: The sequence is a functional homolog of SEQ ID NO 1792 in the 10/412,699US patent application
  misc_feature: The sequence is a functional homolog of SEQ ID NO 1794 in the 10/412,699US patent application
  misc_feature: The sequence is a functional homolog of SEQ ID NO 1978 in the 10/374,780US patent application
  misc_feature: The sequence is a functional homolog of SEQ ID NO 2026 in the 10/374,780US patent application
  misc_feature: The sequence is a functional homolog of SEQ ID NO 2030 in the 10/374,780US patent application
  misc_feature: The sequence is a functional homolog of SEQ ID NO 2032 in the 10/374,780US patent application
  misc_feature: The sequence is a functional homolog of SEQ ID NO 206 in the 10/225,068US patent application
  misc_feature: The sequence is a functional homolog of SEQ ID NO 353 in the 11/479,226US patent application
  misc_feature: The sequence is a functional homolog of SEQ ID NO 354 in the 10/412,699US patent application
  misc_feature: The sequence is a functional homolog of SEQ ID NO 356 in the 10/412,699US patent application
  misc_feature: The sequence is a functional homolog of SEQ ID NO 369 in the 11/479,226US patent application
  misc_feature: The sequence is a functional homolog of SEQ ID NO 380 in the 10/412,699US patent application
  misc_feature: The sequence is a functional homolog of SEQ ID NO 389 in the 11/479,226US patent application
  misc_feature: The sequence is a functional homolog of SEQ ID NO 40 in the 10/374,780US patent application
  misc_feature: The sequence is a functional homolog of SEQ ID NO 534 in the 10/225,066US patent application
  misc_feature: The sequence is a functional homolog of SEQ ID NO 776 in the 10/225,066US patent application
  misc_feature: The sequence is a functional homolog of SEQ ID NO 823 in the 11/479,226US patent application
  misc_feature: The sequence is a functional homolog of SEQ ID NO 831 in the 11/479,226US patent application
  misc_feature: The sequence is a functional homolog of SEQ ID NO 930 in the 11/435,388US patent application
  misc_feature: The sequence is a functional homolog of SEQ ID NO 934 in the 11/435,388US patent application
  misc_feature: The sequence is a functional homolog of SEQ ID NO 936 in the 11/435,388US patent application
  misc_feature: Useful for making plants with modulated growth and phenotype characteristics
  misc_feature: The sequence is a functional homolog of SEQ ID NO 156 in the 20040045049 US patent application
  misc_feature: The sequence is a functional homolog of SEQ ID NO 1564 in the 20040045049 US patent application
  misc_feature: The sequence is a functional homolog of SEQ ID NO 178 in the 20040045049 US patent application
  misc_feature: The sequence is a functional homolog of SEQ ID NO 1788 in the 20040045049 US patent application
  misc_feature: The sequence is a functional homolog of SEQ ID NO 1792 in the 20040045049 US patent application
  misc_feature: The sequence is a functional homolog of SEQ ID NO 1794 in the 20040045049 US patent application
  misc_feature: The sequence is a functional homolog of SEQ ID NO 1494 in the 10/374,780 US patent application
  misc_feature: The sequence is a functional homolog of SEQ ID NO 1564 in the 10/412,699 US patent application
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1788 in the 10/412,699 US patent application
  misc_feature: The sequence is a functional homolog of SEQ ID NO 2026 in the 10/374,780 US patent application
  misc_feature: The sequence is a functional homolog of SEQ ID NO 354 in the 10/412,699 US patent application
  misc_feature: The sequence is a functional homolog of SEQ ID NO 823 in the 11/479,226 US patent application
  misc_feature: The sequence is a functional homolog of SEQ ID NO 930 in the 11/435,388 US patent application
  misc_feature: The sequence is a functional homolog of SEQ ID NO 1878 in the 10/412,699 US patent application
  misc_feature: The sequence is a functional homolog of SEQ ID NO 2138 in the 10/374,780 US patent application
  misc_feature: The sequence is a functional homolog of SEQ ID NO 372 in the 10/225,066 US patent application
  misc_feature: The sequence is a functional homolog of SEQ ID NO 878 in the 11/435,388 US patent application
  misc_feature: The sequence is a functional homolog of SEQ ID NO 242 in the 10/374,780 US patent application
  misc_feature: The sequence is a functional homolog of SEQ ID NO 764 in the 10/412,699 US patent application
  misc_feature: The sequence is a functional homolog of SEQ ID NO 826 in the 10/225,066 US patent application
  misc_feature: The sequence is a functional homolog of SEQ ID NO 950 in the 11/435,388 US patent application
  misc_feature: The sequence is a functional homolog of SEQ ID NO 96 in the 11/375,241 US patent application
  misc_feature: Useful for making plants with modulated biomass
  misc_feature: Functional homolog of the protein sequence given in SEQ ID NO 13416
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
MADASSRTDTSIVLDDIDKNQRMENGSGAVLPSNSSDRSDRSDKPLDQKTMRRLAQNREAARKSRLRKKQLESSKLKLAQLEQELQKARQQGIFISSSGDQTHAMSGNGALTFDIEYARWLEDQNKQINELRTAVNAHASDSDLRLIVDGIMAHYDEIFKVKGVAAKADVFHILSGMWKTPAERCFLWLGGFRPSELLKLLANHLEPLTEQQMLGLNNLQQSSQQAEDALSQGMEALQQSLAETLAGSLGPSGSSGNVANYMGQMAMAMGKLGTLENFLRQADNLRQQTLHQMQRILTIRQASRALLAIHDYFSRLRALSSLWLARPRE

SEQ ID NO: 3017 - DNA, 795 bp, Sorghum bicolor
  misc_feature: Ceres ANNOT ID no. 6027622
  misc_feature: Encodes the peptide sequence at SEQ ID NO 3018
atgggagttcagacaatgtcgtcccactcccacggcgacgacgcccgccgcggcctcccgctccccctcccgcggcagggctccgtctacggcctcaccctcaccgaggtggagacgcagctgggcgagccgctgcggaccatgaacctcgacgacctcctgcgcaccgtgctccctgccgcccccgcccccaacgcggccaagaagacggtggacgaggtgtggcgcgacatccagagcgccggggcccgcggcggcggagcccgccagccctccatgggcgagatgacgctcgaggacttcctctcccgcgccggcgtcgccgtcgacaccgccccgcattggatgcaccagtacccgccgcagcagcagtacgcgctgcagctcggcgccgccgcccccggccccggcccggctctcgacgccgcgtaccgcgaccgcccggtgggggttttcctctccaactcgcactcgcaggtggccgggcggaagcgcggcgccgcggcggccgtgcccggggacggcgtcgtggagaggacggtggagcggcggcagaagcgcatgatcaagaaccgcgagtccgcggccaggtcccgggccaggaagcaggcgtacaccaacgagctggagaacaagatcgcccggctggaggaggagaacgagcgtctcaggaagctcaagatgttggaaccactggagccaccaccggagcagcacgagcggctgccattgccgcaaccggagaggaagcagcagcaccaccacctccggcgaacgaattccgccagtttctga

SEQ ID NO: 3018 - protein, 264 aa, Sorghum bicolor
  misc_feature: Ceres ANNOT ID no. 6027622
  misc_feature (178)..(241): Pfam Id: bZIP_1 Pfam Desc: bZIP transcription factor
  misc_feature (179)..(232): Pfam Id: bZIP_2 Pfam Desc: Basic region leucine zipper
  misc_feature (1)..(264): NCBI GI: 115474165 NCBI Desc: os07g0686100 [oryza sativa (japonica cultivar-group)]
  misc_feature (115)..(264): NCBI GI: 59896064 NCBI Desc: bzip transcription factor [malus x domestica]
  misc_feature (113)..(262): NCBI GI: 87162867 NCBI Desc: camp response element binding (creb) protein [medicago truncatula]
  misc_feature (119)..(264): NCBI GI: 111115694 NCBI Desc: aba responsive element binding factor 3 [hordeum vulgare subsp. vulgare]
  misc_feature (135)..(264): NCBI GI: 145652371 NCBI Desc: transcription factor bzip119 [glycine max]
  misc_feature: The sequence is a functional homolog of SEQ ID NO 1537 in the 10/412,699US patent application
  misc_feature: The sequence is a functional homolog of SEQ ID NO 1538 in the 10/412,699US patent application
  misc_feature: The sequence is a functional homolog of SEQ ID NO 1539 in the 10/412,699US patent application
  misc_feature: The sequence is a functional homolog of SEQ ID NO 1540 in the 10/412,699US patent application
  misc_feature: The sequence is a functional homolog of SEQ ID NO 1541 in the 10/412,699US patent application
  misc_feature: The sequence is a functional homolog of SEQ ID NO 1542 in the 10/412,699US patent application
  misc_feature: The sequence is a functional homolog of SEQ ID NO 1761 in the 10/374,780US patent application
  misc_feature: The sequence is a functional homolog of SEQ ID NO 1836 in the 10/412,699US patent application
  misc_feature: The sequence is a functional homolog of SEQ ID NO 2524 in the 10/374,780US patent application
  misc_feature: The sequence is a functional homolog of SEQ ID NO 60 in the 10/286,264US patent application
  misc_feature: The sequence is a functional homolog of SEQ ID NO 706 in the 10/412,699US patent application
  misc_feature: The sequence is a functional homolog of SEQ ID NO 916 in the 10/225,066US patent application
  misc_feature: Useful for making plants with modulated growth and phenotype characteristics
  misc_feature: The sequence is a functional homolog of SEQ ID NO 60 in the 20030093837 US patent application
  misc_feature: The sequence is a functional homolog of SEQ ID NO 1537 in the 20040045049 US patent application
  misc_feature: The sequence is a functional homolog of SEQ ID NO 1538 in the 20040045049 US patent application
  misc_feature: The sequence is a functional homolog of SEQ ID NO 1539 in the 20040045049 US patent application
  misc_feature: The sequence is a functional homolog of SEQ ID NO 1540 in the 20040045049 US patent application
  misc_feature: The sequence is a functional homolog of SEQ ID NO 1542 in the 20040045049 US patent application
  misc_feature: The sequence is a functional homolog of SEQ ID NO 1761 in the 20060162006 US patent application
  misc_feature: The sequence is a functional homolog of SEQ ID NO. 337 in the 11/188,298 US application
  misc_feature: The sequence is a functional homolog of SEQ ID NO. 512 in the 11/188,298 US application
MGVQTMSSHSHGDDARRGLPLPLPRQGSVYGLTLTEVETQLGEPLRTMNLDDLLRTVLPAAPAPNAAKKTVDEVWRDIQSAGARGGGARQPSMGEMTLEDFLSRAGVAVDTAPHWMHQYPPQQQYALQLGAAAPGPGPALDAAYRDRPVGVFLSNSHSQVAGRKRGAAAAVPGDGVVERTVERRQKRMIKNRESAARSRARKQAYTNELENKIARLEEENERLRKLKMLEPLEPPPEQHERLPLPQPERKQQHHHLRRTNSASF

SEQ ID NO: 3019 - DNA, 2565 bp, Sorghum bicolor
  misc_feature: Ceres ANNOT ID no. 6027625
  misc_feature: Encodes the peptide sequence at SEQ ID NO 3020
atggccggtgtgccgccgccgccgcggcagctcgaggtgcggcgcttcgcggccgcccgcgccggcgagctccgctcgctctacgcagccgtgtcgtcccgactcgacgacgccggcggtcggcagcagccccgttccgcgcgccgccgcaccacagggcacctccctaacaagcgccgccgccggggacccggagaggtcggtaccgaggacgacgggggcctcccgccgcggaaacagtcgaggagggtgaggcggcggcgggagctcgccggcaaccccgcggaggggttctcggtcgccggcgacggcgcgaggcggctgcgcacgcacctgtggtatgcgaaaaggttctccatggagaggcggtggggattcatcttgcctgtcggcacacaggggagtgggaggggctcaaggaatgttctcaagcaactgaaaaatggcacgactatccttgatgctggctacttcattccaattgagctagatggtccagaggatgccctgttatccattctcagaatggttctgcgcccatctccttcagaaaaaacacctgatttgaagcatctacaagatcaagttatgcgaggtgtttgctatgagaatgctatgctttgggatgttaggagtctgcattctcaaattgttggaccagtaacgtatatgtggcgtccattcgcaagagcagatgacaaatctgggattgaaggagatccgtgcccttctcactgcattcacgacgaaagcggcagttcctcacgacgccagttgtggatatggattcatcctgctgcactcgatgaaggaattagtgcaataagatttgcatgtgagagacagattcaagattctggtggtgtggtcaaatgttgctcattagagggaaaaatcgcaagattggaagtcaatggatgcaaggctatgcaatctcttaagaagatttttcatccaacgaatgcaagtaagatcaacatgatatcaacaagtgatatctccacatcaactgatactcccctggattcctctactgtccctcatcttttgaaagcttctgtcattgataatgctgagactcttcagcctggtgctatactatccatggtagttcatgaccccagggaggtttcagttaagggaatagattcttctcaattggtctcccttggcaagcagagcaaagatttgggggaagatgtagccccagatgctaatgaggcatcatcagaggttgcaaatatattgccattgatgtggatgcaccctgggaagcatgatatattcctttctgactgtagggaactgtgggactccaggcaaagcataaatcctcctgtgtcagatgaggttctttgtaaggagaagcactgtgaacgtattaagtttttctgcttggattcacgaaatgatcaagggcaaacaacccaagagaaggataacctcattcgatcctgcccggttattcttttgaaacatgccagagagggaatgcctgctctagggtggtccatcattctacctttgagttgggtgaaacctttctggctctttctagtatctcatggtgcccgtgcaattggcttaagggagagacggtggattgcatcaaagttcagaatgccatgctttccttatgattatccagacagcaaagcgtatgcatcgtatgcgtccaaagaagctgctgattttgataaagtatctgagcgctgccctgttgccaagagacctccaagagttcctgtgcctcctttatggcattgtatcatgacttcttttcataaagatgatgtcatattgggttttcctgaagtagacgacttagtgcgcgctaatatgatattacccaaaagcttatctgtacattccaaatctggagatgcagaaccattgcaagcaaatgttgcatccttgcaacttcatgtgccaagaaccgcccaaatgttgagacaatatgtggaagaatttgatatgaaatatctgatttcatcatctgacatgaacgtggattctgatcaacccaacttagcttctaatgacactgtcaaaatgccacgattggtgagtgaattatgccttacaagggttctgatccgagctttcaaggaaggttcttttgaagagggtgctgttgtttgtgccccgcttccttcagatctttcagcttggaaaatcagatcaaaggaagaagaggaagaatgcgtagaaaaatgggaactccagcttcctcattcccatgttagttcttatttctcctggtttgatcctagcaccagcagccttcagttgcctacagatgacgccgcacgggtggcattcaggtggccgataggctttgtcaccagtggcttcatccacggaagtaacgggcaagacgcagtcgcggtcgcattctgcgaggcaaagcttctggcagtactgaggcgacagcaatgggcgcatgaaagcttgcagagccgggagatctgcgtcctcgtcaggaacgcaagatcaggtgcgtaccgacgagcgctggccactatcgtcctggagcatcaggaatcagacctggagtttctgtag

SEQ ID NO: 3020 - protein, 854 aa, Sorghum bicolor
  misc_feature: Ceres ANNOT ID no. 6027625
  misc_feature (16)..(166): Pfam Id: POP1 Pfam Desc: Ribonucleases P/MRP protein subunit POP1
  misc_feature (502)..(598): Pfam Id: POPLD Pfam Desc: POPLD (NUC188) domain
  misc_feature (214)..(724): NCBI GI: 115486617 NCBI Desc: os11g0677500 [oryza sativa (japonica cultivar-group)]
  misc_feature (8)..(420): NCBI GI: 145331427 NCBI Desc: ribonuclease p [arabidopsis thaliana]
  misc_feature (436)..(590): NCBI GI: 145331429 NCBI Desc: ribonuclease p [arabidopsis thaliana]
  misc_feature (8)..(235): NCBI GI: 23097256 NCBI Desc: processing of precursors 1 homolog isoform 1 [mus musculus]
  misc_feature (8)..(235): NCBI GI: 119612182 NCBI Desc: processing of precursor 1, ribonuclease p/mrp subunit (s. cerevisiae) [homo sapiens]
MAGVPPPPRQLEVRRFAAARAGELRSLYAAVSSRLDDAGGRQQPRSARRRTTGHLPNKRRRRGPGEVGTEDDGGLPPRKQSRRVRRRRELAGNPAEGFSVAGDGARRLRTHLWYAKRFSMERRWGFILPVGTQGSGRGSRNVLKQLKNGTTILDAGYFIPIELDGPEDALLSILRMVLRPSPSEKTPDLKHLQDQVMRGVCYENAMLWDVRSLHSQIVGPVTYMWRPFARADDKSGIEGDPCPSHCIHDESGSSSRRQLWIWIHPAALDEGISAIRFACERQIQDSGGVVKCCSLEGKIARLEVNGCKAMQSLKKIFHPTNASKINMISTSDISTSTDTPLDSSTVPHLLKASVIDNAETLQPGAILSMVVHDPREVSVKGIDSSQLVSLGKQSKDLGEDVAPDANEASSEVANILPLMWMHPGKHDIFLSDCRELWDSRQSINPPVSDEVLCKEKHCERIKFFCLDSRNDQGQTTQEKDNLIRSCPVILLKHAREGMPALGWSIILPLSWVKPFWLFLVSHGARAIGLRERRWIASKFRMPCFPYDYPDSKAYASYASKEAADFDKVSERCPVAKRPPRVPVPPLWHCIMTSFHKDDVILGFPEVDDLVRANMILPKSLSVHSKSGDAEPLQANVASLQLHVPRTAQMLRQYVEEFDMKYLISSSDMNVDSDQPNLASNDTVKMPRLVSELCLTRVLIRAFKEGSFEEGAVVCAPLPSDLSAWKIRSKEEEEECVEKWELQLPHSHVSSYFSWFDPSTSSLQLPTDDAARVAFRWPIGFVTSGFIHGSNGQDAVAVAFCEAKLLAVLRRQQWAHESLQSREICVLVRNARSGAYRRALATIVLEHQESDLEFL

SEQ ID NO: 3021 - DNA, 1782 bp, Sorghum bicolor
  misc_feature: Ceres ANNOT ID no. 6027632
  misc_feature: Encodes the peptide sequence at SEQ ID NO 3022
atggccttctggtggccgctgctggtgctcgccgccgcatacgcgctctgccgcctgctcctcttccttatcccgccaaccgtcccatccatcgacgtcgacgcttccgacgtgttggctaaggaggacagcttcatctacataccgagaaagggtaaagcagctcagactgacaaggtccaatgctatgaaccagcgaccatgaaatacttggggtactttcctgcgttgactcctgatgaggtcaaggaacatgttgctcaagccaggaaagctcaaaagatatgggcaaaaagcagcttcaagcaaaggcgccagtttcttcgaatccttctcaagtatatacttgaacatcaggatctcatatgcgaggtatcatctcgggacactggaaagactatggttgatgcttcattaggcgagataatgaccacatgtgagaagattacctggcttttagacgagggtgagaagtggttgaaacctgaatacagatctactgggagatcaatgctgcataagagagccaaagttgagttttaccctcttggagtgattggtgcaattgtatcttggaattatcccttccataatgtttttaatccaatgctggctgcagtattctccggtaatgcagcagttattaaggtctcagaatatgcgagctggtcaggctgcttttattttcgtatcatacaagcagctctttcagctgttggtgcacctgagaatctggtgcacgtaataactggttttgcggaaacaggccaagctcttgtatcatcagtagacaaaataatatttgtgggatctcctggtgttggaaaaatgatcatgaaaggggcatcagagactctaatacctgtaactcttgagcttggtggcaaagattcatttattgtgtgtgaagatgtagatttacccagtgttgttcaagttgctgttagagctgctctgcaatctagtgggcagaattgcgctggtgctgaaagattttatgttcacaacgacatctattctgccttcgtttcgcaagtagcgaagatagtcaaatctatatgtgttggtcccccattatcaggcagatatgacatgggtgcaatctgtatgatggagcactctgagaaacttcagagtcttgttaatgatgctctagacaaaggtgctgaaattgctgtcagagggagctttgggaatcttggtgaagatgcagtcgatcaatttttccctccaactgtcctggtgaatgttgatcacacaatgaaaattatgcaagaagaggcatttggcccaattctaccaatcatgaaattcaattctgatgaagaggctatcaaacttgcaaacgactcaaagtatggtcttggttgtgctgttttttctggcgaccagaagcgtgctatcagaatagcatcccaaatacactgtggggtagcagcaatcaatgattttgcttcaagttacatgtgtcagtctttgccattcggtggtgttaaagacagtggatttgggagatttgctggtgtagaaggcttgcgagcttgctgccttgtgaagtctgttgtagaagatagattatggccatatattaaaacagtgatcccgaaacctatccagtatcctgtctcagagcatggatttgagttccagcagttgcttgtggagactctgtatggctatagcatgtgggacaggttgcggtcccttgtgaatcttataaagatggttaccgagcagaactctgcctcagtttcaaatgcgacgacgaagaaaaggcgatga

SEQ ID NO: 3022 - protein, 593 aa, Sorghum bicolor
  misc_feature: Ceres ANNOT ID no. 6027632
  misc_feature (53)..(521): Pfam Id: Aldedh Pfam Desc: Aldehyde dehydrogenase family
  misc_feature (1)..(593): NCBI GI: 50509286 NCBI Desc: betaine aldehyde dehydrogenase-like [oryza sativa (japonica cultivar-group)]
  misc_feature (1)..(581): NCBI GI: 124359955 NCBI Desc: aldehyde dehydrogenase [medicago truncatula]
  misc_feature (1)..(591): NCBI GI: 110735945 NCBI Desc: betaine aldehyde dehydrogenase like protein [arabidopsis thaliana]
  misc_feature (40)..(576): NCBI GI: 60469592 NCBI Desc: aldehyde dehydrogenase [dictyostelium discoideum]
  misc_feature (54)..(574): NCBI GI: 126138960 NCBI Desc: meiotic sister-chromatid recombination aldehyde dehydrogenase [pichia stipitis cbs 6054]
  misc_feature (1)..(591): SWISSPROT Homolog: EC 1.2.1.3 Aldehyde dehydrogenase 22A1 precursor
  misc_feature: The sequence is a functional homolog of SEQ ID NO. 537 in the 11/188,298 US application
  misc_feature: The sequence is a functional homolog of SEQ ID NO. 428 in the 11/188,298 US application
  misc_feature: The sequence is a functional homolog of SEQ ID NO. 475 in the 11/188,298 US application
  misc_feature: The sequence is a functional homolog of SEQ ID NO. 304 in the 11/188,298 US application
  misc_feature: The sequence is a functional homolog of SEQ ID NO. 435 in the 11/188,298 US application
  misc_feature: The sequence is a functional homolog of SEQ ID NO. 437 in the 11/188,298 US application
  misc_feature: The sequence is a functional homolog of SEQ ID NO. 442 in the 11/188,298 US application
  misc_feature: The sequence is a functional homolog of SEQ ID NO. 477 in the 11/188,298 US application
MAFWWPLLVLAAAYALCRLLLFLIPPTVPSIDVDASDVLAKEDSFIYIPRKGKAAQTDKVQCYEPATMKYLGYFPALTPDEVKEHVAQARKAQKIWAKSSFKQRRQFLRILLKYILEHQDLICEVSSRDTGKTMVDASLGEIMTTCEKITWLLDEGEKWLKPEYRSTGRSMLHKRAKVEFYPLGVIGAIVSWNYPFHNVFNPMLAAVFSGNAAVIKVSEYASWSGCFYFRIIQAALSAVGAPENLVHVITGFAETGQALVSSVDKIIFVGSPGVGKMIMKGASETLIPVTLELGGKDSFIVCEDVDLPSVVQVAVRAALQSSGQNCAGAERFYVHNDIYSAFVSQVAKIVKSICVGPPLSGRYDMGAICMMEHSEKLQSLVNDALDKGAEIAVRGSFGNLGEDAVDQFFPPTVLVNVDHTMKIMQEEAFGPILPIMKFNSDEEAIKLANDSKYGLGCAVFSGDQKRAIRIASQIHCGVAAINDFASSYMCQSLPFGGVKDSGFGRFAGVEGLRACCLVKSVVEDRLWPYIKTVIPKPIQYPVSEHGFEFQQLLVETLYGYSMWDRLRSLVNLIKMVTEQNSASVSNATTKKRR

SEQ ID NO: 3023 - DNA, 1170 bp, Sorghum bicolor
  misc_feature: Ceres ANNOT ID no. 6027634
  misc_feature: Encodes the peptide sequence at SEQ ID NO 3024
atggagagcaggaacgtagtggtgtgcgacaatggtaccgggtatgtgaagtgtggctttgctggtgagaactttcctacatctgtgttcccttgtgttgtcggaagacctctacttcgctatgaggagtcacttcaggagcaagaattgacggatattgttgttggagcagcttgtgctgacttgagacatcaacttgatgtatcatatcctgtcaccaatggcattgttcaaaattgggatgatatgggccatatttgggataatgccttctacagtgagctcaaggtcgatccatcagagtgtaaaatcctactgacagatccaccactcaatcccgtgaaaaaccgagaaaaaatgatcgagaccatgttcgagaaatataattttgctggggtcttcatccagatccaagcagttctttcgctgtacgctcaaggcttgctaactggacttgtgatagattctggtgacggtgttactcatgtggttcctgtagttgatggatactcttatcctcatctgacaaagagaatgaatgtagctggaagacatataacctcttatcttgttgacctactatcaaggagagggtatgctatgaacaaatctgctgactttgagacggtcagagaaataaaagagaagctatgctatataagctatgattacaaacgagaataccagctaggacttgagaccacaatccttgtgaaaagttacactcttccagatggaagagtcattaaagtgggcactgaacgatttcaagctcctgaagctcttttcactcctgaactgatagatgttgaaggtgatgggatggcagatatggcattccgttgcattcaggaaatggatatcgacaaccggatgacgctctatcaacatattgtcctgagtggaggaagtacaatgtaccctggtctaccaagtcggttggagaaggaaattcttgatcgctatcttgatgtagttttgaagggaaacaaagatggcctgaagaaattacgactgcggatagaggatcctcctcggagaaagcacatggtgtacctgggaggtgcagtgcttgctggaatcatgaaggatgcacctgagttctggataaccaggcaggagtatcaggaagaaggtgtagcgtgcctaaggaagtgcggacagtcataa

SEQ ID NO: 3024 - protein, 389 aa, Sorghum bicolor
  misc_feature: Ceres ANNOT ID no. 6027634
  misc_feature (1)..(388): Pfam Id: Actin Pfam Desc: Actin
  misc_feature (1)..(389): NCBI GI: 21489931 NCBI Desc: tpa: actin-related protein 2; atarp2 [arabidopsis thaliana]
  misc_feature (1)..(389): NCBI GI: 3818624 NCBI Desc: actin related protein 2; arp2 [arabidopsis thaliana]
  misc_feature (1)..(385): NCBI GI: 60473259 NCBI Desc: actin related protein 2 [dictyostelium discoideum]
  misc_feature (1)..(385): NCBI GI: 4093161 NCBI Desc: actin related protein 2 [dictyostelium discoideum]
  misc_feature (2)..(387): NCBI GI: 61367670 NCBI Desc: arp2 actin-related protein 2-like [synthetic construct]
  misc_feature: The plant is abnormally small.
  misc_feature: Useful for making plants with modulated biomass
  misc_feature: Functional homolog of the protein sequence given in SEQ ID NO 13060
MESRNVVVCDNGTGYVKCGFAGENFPTSVFPCVVGRPLLRYEESLQEQELTDIVVGAACADLRHQLDVSYPVTNGIVQNWDDMGHIWDNAFYSELKVDPSECKILLTDPPLNPVKNREKMIETMFEKYNFAGVFIQIQAVLSLYAQGLLTGLVIDSGDGVTHVVPVVDGYSYPHLTKRMNVAGRHITSYLVDLLSRRGYAMNKSADFETVREIKEKLCYISYDYKREYQLGLETTILVKSYTLPDGRVIKVGTERFQAPEALFTPELIDVEGDGMADMAFRCIQEMDIDNRMTLYQHIVLSGGSTMYPGLPSRLEKEILDRYLDVVLKGNKDGLKKLRLRIEDPPRRKHMVYLGGAVLAGIMKDAPEFWITRQEYQEEGVACLRKCGQS

SEQ ID NO: 3025 - DNA, 1167 bp, Sorghum bicolor
  misc_feature: Ceres ANNOT ID no. 6027638
  misc_feature: Encodes the peptide sequence at SEQ ID NO 3026
atggcgtccagagaccttcgcggcagccctagatccgcgccgcgtcgccatggggcggcggcgcccaaggacggctccgacctgctcagcccgcggttccggtcggccgccgagctggccgggtgggacgaggagtccgtcctcgccgcgatggtcgtcgaggacacccccgtgcgcgagtcccgtcgcaagaggcgggcctccacctcctccgccggcggcagcgccggatccagcaccagaaagaggaggcctcgtaggcagtttccggccaagattccgccggtggttctcgcgctcgacgacgaagacgacaagacggacactgcggaagacggcaaatcggaagtgaaggccaccaaggaggaagagaaggttgtccttgtgggcgacaaggaggcgtcaggatctggcgagaaggcagcggccaccggcaacatgccgtgtatggatcgcctccgggaggagctctcttgcgcgatttgcctggagatctgctttgagccgaccaccacgccttgtgggcacagcttctgcatgaaatgcttaagacatgctgcagcgaagtgtgggaaacggtgtccaaaatgcaggcaattaatcagcaactcaagatcgtgcaccatcaacactgtactctggaacaccattcagctcttgtttcctagtgaagttgaggcaagaaagagttcaacctcatcaccttcaccatgcggcaaggatgtgaaccgtagcccactgagagctaataggttctcacaaggtggcaccggtatgagaactagagctaggagcagcagcagcttcatcaccgaaggtagaacaagaagcagctacaggacgttcctcgaacctggcagtacaacaagaaccaacactagcgcgaacttcatcagcacacatggcaacacaagaagcagtaacagcaggagtaggggcttcgtctcggcctcgcagctgctgttgccaaggagcacagtaggatcagaacaatctgaagatgctgcgttggcttacaggttgcaacaggaggagttcatgaatgcctttgaggagcctgagcaggagaggcagacacggaacgccgtgtccacagcacgagacactctgagagaaatcgcctcccgggccatccgcctccgtgctgctcgaggctggcctgtttaa

SEQ ID NO: 3026 - protein, 388 aa, Sorghum bicolor
  misc_feature: Ceres ANNOT ID no. 6027638
  misc_feature (159)..(197): Pfam Id: zf-C3HC4 Pfam Desc: Zinc finger, C3HC4 type (RING finger)
  misc_feature (8)..(269): NCBI GI: 15232143 NCBI Desc: zinc finger (c3hc4-type ring finger) family protein [arabidopsis thaliana]
  misc_feature (156)..(234): NCBI GI: 119574035 NCBI Desc: ring finger protein 168, isoform cra_b [homo sapiens]
  misc_feature (155)..(230): NCBI GI: 42571537 NCBI Desc: zinc finger (c3hc4-type ring finger) family protein [arabidopsis thaliana]
  misc_feature (150)..(235): NCBI GI: 119623665 NCBI Desc: tripartite motif-containing 31, isoform cra_d [homo sapiens]
  misc_feature (153)..(381): NCBI GI: 119609740 NCBI Desc: tripartite motif-containing 65, isoform cra_b [homo sapiens]
MASRDLRGSPRSAPRRHGAAAPKDGSDLLSPRFRSAAELAGWDEESVLAAMVVEDTPVRESRRKRRASTSSAGGSAGSSTRKRRPRRQFPAKIPPVVLALDDEDDKTDTAEDGKSEVKATKEEEKVVLVGDKEASGSGEKAAATGNMPCMDRLREELSCAICLEICFEPTTTPCGHSFCMKCLRHAAAKCGKRCPKCRQLISNSRSCTINTVLWNTIQLLFPSEVEARKSSTSSPSPCGKDVNRSPLRANRFSQGGTGMRTRARSSSSFITEGRTRSSYRTFLEPGSTTRTNTSANFISTHGNTRSSNSRSRGFVSASQLLLPRSTVGSEQSEDAALAYRLQQEEFMNAFEEPEQERQTRNAVSTARDTLREIASRAIRLRAARGWPV

SEQ ID NO: 3027 - DNA, 1290 bp, Sorghum bicolor
  misc_feature: Ceres ANNOT ID no. 6027646
  misc_feature: Encodes the peptide sequence at SEQ ID NO 3028
atggcgaccgccgcgagggacaggcgcctgccgccggcgctgcccctggccacgctcatcggccgcgagctccgcgcggggggctccgagcgcccggcgctgcgctatggccacgccggcttcgccaagcgcggcgaggattacttcctcgtcaagcccgactgcctccgcgtccccggggaccccgcatccgccttctccgtcttcgccgtgttcgatggccacaacggcgtgtcggcggcggtctacagcaaggagcatctgctcgagcacgtcatgagcgcgctgccgccggacatcggccgcgaagactggctgcaggcgctgccgcgcgcgctcgtcgccggctttgtcaaggccgacatcgattttcagcgcaagggggaagtgtctggaaccacggcgacactggtggtcatcgatgggttcacggtcacagtggcgtcggtgggcgactcgcgctgcatcctggacacgcagggcggcgagttgcagctgctgaccgtggaccaccgcctggaggagaatgcagaggagcgggagcgcgtcacggccagcggtggggaagtaggtcggctcaatctcttcggtgggcaggaggtcggtcctctccggtgctggcctggtggcttgtgcctttcaagatccattggggacatggatgttggggagttcattgtgcccattccacatgtcaagcaagtcaagctatcaaacaccggaggaaggctgataatagcatcagatggcatatgggatgcgttatccaatgaagcagctgcacaagcatgcagaggattgcctgcagaactggcagccaagcttgtcgttaagcaagctctgaaaacaagcgggctaaaggatgataccacctgtgtcgtagttgacatcatcccatccgatcatttgacatcaccgcaattgtctccaaagaaaaatcagaacaagttgaagtcactttttcgtagaaggtcgcatagttcagttggaaagcttggaggaaagtctgcctccattggttctgtggaggagttatttgaagaaggctctgcaatgttagaagaaaggttgggtaggaatttgtccttgaaagcagcttcaccaccttttcgctgtgcaatctgccaagtggaccaagagccattcgaagatttgatgacagataatggaggtggttactgctcttccccatacgctccatggggtggtccacatctctgtttggactgtcggaagaagaaagatgcaatggaaggtaagagatctagccgctctacagcatgcaggtga

SEQ ID NO: 3028 - protein, 429 aa, Sorghum bicolor
  misc_feature: Ceres ANNOT ID no. 6027646
  misc_feature (38)..(290): Pfam Id: PP2C Pfam Desc: Protein phosphatase 2C
  misc_feature (1)..(429): NCBI GI: 34394411 NCBI Desc: protein phosphatase 2c-like [oryza sativa (japonica cultivar-group)]
  misc_feature (1)..(426): NCBI GI: 92879648 NCBI Desc: protein phosphatase 2c-like [medicago truncatula]
  misc_feature (1)..(426): NCBI GI: 3249105 NCBI Desc: contains similarity to protein phosphatase 2c (abi1) gbx78886 from a. thaliana. [arabidopsis thaliana]
  misc_feature (1)..(428): NCBI GI: 124359155 NCBI Desc: protein phosphatase 2c-like [medicago truncatula]
  misc_feature (1)..(353): NCBI GI: 16930415 NCBI Desc: at1g09160/t12m4_13 [arabidopsis thaliana]
  misc_feature: The sequence is a functional homolog of SEQ ID NO. 363 in the 11/188,298 US application
  misc_feature: The sequence is a functional homolog of SEQ ID NO. 386 in the 11/188,298 US application
  misc_feature: The sequence is a functional homolog of SEQ ID NO. 406 in the 11/188,298 US application
  misc_feature: The sequence is a functional homolog of SEQ ID NO. 448 in the 11/188,298 US application
MATAARDRRLPPALPLATLIGRELRAGGSERPALRYGHAGFAKRGEDYFLVKPDCLRVPGDPASAFSVFAVFDGHNGVSAAVYSKEHLLEHVMSALPPDIGREDWLQALPRALVAGFVKADIDFQRKGEVSGTTATLVVIDGFTVTVASVGDSRCILDTQGGELQLLTVDHRLEENAEERERVTASGGEVGRLNLFGGQEVGPLRCWPGGLCLSRSIGDMDVGEFIVPIPHVKQVKLSNTGGRLIIASDGIWDALSNEAAAQACRGLPAELAAKLVVKQALKTSGLKDDTTCVVVDIIPSDHLTSPQLSPKKNQNKLKSLFRRRSHSSVGKLGGKSASIGSVEELFEEGSAMLEERLGRNLSLKAASPPFRCAICQVDQEPFEDLMTDNGGGYCSSPYAPWGGPHLCLDCRKKKDAMEGKRSSRSTACR

SEQ ID NO: 3029 - DNA, 1344 bp, Sorghum bicolor
  misc_feature: Ceres ANNOT ID no. 6027661
  misc_feature: Encodes the peptide sequence at SEQ ID NO 3030
atggggcagggcactccgggagggatgggcaagcagggcggcgccggcgaccgcaagccgggggacggcggcgataagaaggacaagaagttcgagccgccggccgcgccttcccgcgtcggccgcaagcagcgcaagcagaagggcgccgaggcggccgcgcgtctccccaacgtcgccccgctctccaagtgccgactccgcctcctcaagctcgagcgggtcaaggactacctcctcatggaggaggagttcgtcgccgcgcaggagcgcctccgtccccaggaggacaaggccgaggaggaccgatccaaggtcgacgacctccgcggcacccccatgagcgtcggatccctcgaagagatcatcgacgagagccacgccatcgtctcctcctccgtcggacccgagtactacgttggcatcctatccttcgtcgacaaggaccagctcgagccgggatgctcaatcctcatgcacaacaaggttctctctgtggttggtatattgcaagatgaagttgatcctatggtatctgtgatgaaagttgagaaagctcctctggaatcttatgctgacattggtggactagatgctcagattcaagaaattaaagaggcagttgagcttcccttgactcatcctgagctgtatgaagacattgggatcaggccccccaagggagtcatattatatggagaacctggaacaggaaaaactctactcgccaaggctgttgctaactcaacatctgcaactttcttgcgtgttgtcggtagtgagcttattcaaaagtaccttggggatggtcccaagctagtcagagaattgtttagggtggctgatgaactttctccctcaatagtctttattgatgagattgacgcagttggaacaaagaggtatgatgctcattcaggaggagagcgtgagatccaaagaactatgttggagctgctgaatcagctagatggttttgactcacgtggagatgttaaagttattctagcaacaaaccgcattgaaagtcttgatcctgctttgcttcggccaggccgtatagaccggaagattgaatttcctctcccagatattaaaactaggcgacgcatcttccagattcacacggcaaaaatgacattagctgacgatgtgaacttggaagagtttgttatgaccaaagacgagttttcgggcgctgatattaaggcgatctgcacggaggctggattgctcgccttaagagaacgtagaatgaaggtgacccatgcagatttcaagaaggcaaaggagaaggtgatgtacaagaagaaggaaggtgttccggatggtctctacatgtag

SEQ ID NO: 3030 - protein, 447 aa, Sorghum bicolor
  misc_feature: Ceres ANNOT ID no. 6027661
  misc_feature (228)..(415): Pfam Id: AAA Pfam Desc: ATPase family associated with various cellular activities(AAA)
  misc_feature (225)..(356): Pfam Id: AAA_2 Pfam Desc: ATPase family associated with various cellular activities(AAA)
  misc_feature (1)..(447): NCBI GI: 109940120 NCBI Desc: 26s protease regulatory subunit 4 homolog (tat-binding protein homolog 2)
  misc_feature (1)..(447): NCBI GI: 29837173 NCBI Desc: 26s proteasome regulatory subunit 4 homolog [oryza sativa (japonica cultivar-group)]
  misc_feature (1)..(447): NCBI GI: 556558 NCBI Desc: rice homologue of tat binding protein [oryza sativa (japonica cultivar-group)]
  misc_feature (1)..(447): NCBI GI: 87241031 NCBI Desc: aaa atpase; 26s proteasome subunit p45 [medicago truncatula]
  misc_feature (1)..(447): NCBI GI: 6652880 NCBI Desc: 26s proteasome aaa-atpase subunit rpt2a [arabidopsis thaliana]
  misc_feature: The sequence is a functional homolog of SEQ ID NO. 462 in the 11/188,298 US application
  misc_feature: The sequence is a functional homolog of SEQ ID NO. 471 in the 11/188,298 US application
MGQGTPGGMGKQGGAGDRKPGDGGDKKDKKFEPPAAPSRVGRKQRKQKGAEAAARLPNVAPLSKCRLRLLKLERVKDYLLMEEEFVAAQERLRPQEDKAEEDRSKVDDLRGTPMSVGSLEEIIDESHAIVSSSVGPEYYVGILSFVDKDQLEPGCSILMHNKVLSVVGILQDEVDPMVSVMKVEKAPLESYADIGGLDAQIQEIKEAVELPLTHPELYEDIGIRPPKGVILYGEPGTGKTLLAKAVANSTSATFLRVVGSELIQKYLGDGPKLVRELFRVADELSPSIVFIDEIDAVGTKRYDAHSGGEREIQRTMLELLNQLDGFDSRGDVKVILATNRIESLDPALLRPGRIDRKIEFPLPDIKTRRRIFQIHTAKMTLADDVNLEEFVMTKDEFSGADIKAICTEAGLLALRERRMKVTHADFKKAKEKVMYKKKEGVPDGLYM

SEQ ID NO: 3031 - DNA, 3162 bp, Sorghum bicolor
  misc_feature: Ceres ANNOT ID no. 6027668
  misc_feature: Encodes the peptide sequence at SEQ ID NO 3032
atgcttccatccaagaggtccgcgggcgccgacggcggcgagtccaagagggctaagctgggggaatcgccatcctccgccgccgccgccgtagggacggccagtaacggcacccggaatggggcggcaccggagatcgacgaggacctgcacagcaggcagctcgccgtgtacggcagggagacaatgcgccgcctcttcgccgccgatgtcctcgtctctggcctcaatggcctgggtgctgagattgcaaaaaatcttgctcttgctggagtcaaatctgtcaccatacatgatgtcaaaatggtggaaatgtgggacttgtctggcaatttcttcttatcagagcaagatgtcggaaagaacagggctgtagcctgtgtgtcaaagctgcaagagctgaataacgctgttctggtctctgctctaacagaggaattgacatcagagcacttttctaagttccaggctgttgttttcactgatataagtttggagaaggcttatgaatttgacgactattgtcacagccaccagcctccaatctcttttatcaaagctgaagtctgtggccttttcggcagtgtcttctgtgattttggacctgagtttactgtccttgatgttgatggtgaagatccacatactggtataattgcatccatcagcaatgacagtcctgcaatggtatcctgtgttgatgatgagaggcttgagtttcaggacggtgatcttgttgttttctctgaggtccaaggcatggcagaattgaatgatggaaaaccaaggaaggtaaaaaatgctaggccgttttcatttagcattgaggaggacacaagtagctatggtgtttatacaaaaggtggtatcgttgcacaagtgaaggaaccaaaggttctacgtttcaaggcactaagagatgcaatgagagatcctggcgatttccttctgagtgatttttcaaagtttgaacgatcacctgtgcttcatctagcctttcaagctctggataaatttaagaaggaacatgggcggtatcctaccgctggctgtgagcaggatgctcaaactttcctcaagtttgctgctgatattaatgaagcatctgttggtccgaagctggaaaacattgatgaaaagttgctctgtcattttgcaagtggttctcgagctgttttgaacccaatggctgcaatgtttggtggtattgttggtcaagaagttgtgaaggcatgttcagggaaattccatccgctttaccagttcttctactttgattctgttgaatctctccctacatatcagttggatccccaagacttgaagccttcaaatagccgctatgatgctcaggtctctgtttttggttccaagcttcagaagaagatgctagatgcaaatattttcattgtgggttctggcgctcttggttgtgagttcttgaagaaccttgccttaatgggtgtctcttgcagctccaagggaaagctaactataacagatgacgatgtcattgagaaaagcaatctgagtcgccagtttctgttccgtgactggaacattgggcaagcaaagtctactgtagctgctgcagccgccattgctatcaaccccagcctccaaattgatgctcttcagaaccgtgcctctccagataccgaaaatgtgttccatgacacattctgggatggactggatgttgttatcaatgcccttgataatgtgaatgctaggatgtatatggacatgaggtgcctgtacttccagaagccactactggagtcagggacattgggtgcaaagtgcaatacacaaatggtcattcctcaccttactgaaaattatggagcttctagagacccacccgagaagcaggcacccatgtgcacagtccattcttttccacacaacattgatcattgcttgacatgggcccgttcagagtttgagggtttgctagagaaaacaccaaatgaagtaaattcttttctgtctaatcctgctcaatatgctgctgccatgaggaaggcaggtgatgcccaagcaagggaattacttgaacgcgtctctgaatgtcttgacaaggagcgatgcaatacatttgaggattgtataacttgggcccgattgagatttgaggattatttctcaaaccgcgtgaagcagcttacattcacttttcctgaagatgctgctactagcacaggcactcctttctggtccgccccaaagcgctttccccgtcctctgcaattttcagccactgattcatctcacatcaacttcatcatggctgcttcaatactgagagcagagtcatttgggattgctatacctgactgggcaaagaatgcaagtaagctggctgatgcggtcgataaggttgcagttcctaaatttgagccaaagaaaggggtgaatattgtgacagatgagaaggctactaacctttctagtgcctcggttgatgatgttgctgttattaatgaccttttgaccaagttggaagaatatgccaagggcttgcctccaggattccaaatgaaacctatccaattcgagaaggatgatgacactaattttcacatggatttaatagctgggtttgcaaacatgcgcgcgaggaactacagcattcctgaggttgacaagttgaaggctaagttcatcgctggaaggatcatcccggccatcgcaacttcaacagccatggccacaggtctcgtgtgcctggagctatacaaggtcattgctggggagcaccccatcgaggactaccgcaacacatttgccaacctagctcttccgctgttctcaatggccgaaccagttccggcgaaggttatgaagcatcaagatctgagctggaccgtatgggaccgctggactatcaagggcaacctgactgtcgctgaactcctgcagtggttcagtgacaagggcctcagcgcttacagcatgtcctgcggcacttctcttctgtacaacagcatgttcgcgaggcacaaggataggctgcagaagaaggttgttgatgtcgccagggaggtggcaaaggtggaggttcctgaataccggaagcacatagatgtcgtggtggcatgtgaggatgatgacgggaatgacattgacattcctctcgtctcggtttacttccgctag

SEQ ID NO: 3032 - protein, 1053 aa, Sorghum bicolor
  misc_feature: Ceres ANNOT ID no. 6027668
  misc_feature (67)..(200): Pfam Id: ThiF Pfam Desc: ThiF family
  misc_feature (464)..(608): Pfam Id: ThiF Pfam Desc: ThiF family
  misc_feature (751)..(812): Pfam Id: UBACT Pfam Desc: Repeat in ubiquitin-activating (UBA) protein
  misc_feature (852)..(920): Pfam Id: UBACT Pfam Desc: Repeat in ubiquitin-activating (UBA) protein
  misc_feature (1)..(1053): NCBI GI: 401238 NCBI Desc: ubiquitin-activating enzyme e1 3
  misc_feature (41)..(1053): NCBI GI: 77548284 NCBI Desc: ubiquitin-activating enzyme e1 2 [oryza sativa (japonica cultivar-group)]
  misc_feature (1)..(1053): NCBI GI: 136632 NCBI Desc: ubiquitin-activating enzyme e1 1
  misc_feature (1)..(1053): NCBI GI: 100841 NCBI Desc: ubiquitin-protein ligase (ec 6.3.2.19) e1 - wheat
  misc_feature (1)..(1053): NCBI GI: 401237 NCBI Desc: ubiquitin-activating enzyme e1 2
MLPSKRSAGADGGESKRAKLGESPSSAAAAVGTASNGTRNGAAPEIDEDLHSRQLAVYGRETMRRLFAADVLVSGLNGLGAEIAKNLALAGVKSVTIHDVKMVEMWDLSGNFFLSEQDVGKNRAVACVSKLQELNNAVLVSALTEELTSEHFSKFQAVVFTDISLEKAYEFDDYCHSHQPPISFIKAEVCGLFGSVFCDFGPEFTVLDVDGEDPHTGIIASISNDSPAMVSCVDDERLEFQDGDLVVFSEVQGMAELNDGKPRKVKNARPFSFSIEEDTSSYGVYTKGGIVAQVKEPKVLRFKALRDAMRDPGDFLLSDFSKFERSPVLHLAFQALDKFKKEHGRYPTAGCEQDAQTFLKFAADINEASVGPKLENIDEKLLCHFASGSRAVLNPMAAMFGGIVGQEVVKACSGKFHPLYQFFYFDSVESLPTYQLDPQDLKPSNSRYDAQVSVFGSKLQKKMLDANIFIVGSGALGCEFLKNLALMGVSCSSKGKLTITDDDVIEKSNLSRQFLFRDWNIGQAKSTVAAAAAIAINPSLQIDALQNRASPDTENVFHDTFWDGLDVVINALDNVNARMYMDMRCLYFQKPLLESGTLGAKCNTQMVIPHLTENYGASRDPPEKQAPMCTVHSFPHNIDHCLTWARSEFEGLLEKTPNEVNSFLSNPAQYAAAMRKAGDAQARELLERVSECLDKERCNTFEDCITWARLRFEDYFSNRVKQLTFTFPEDAATSTGTPFWSAPKRFPRPLQFSATDSSHINFIMAASILRAESFGIAIPDWAKNASKLADAVDKVAVPKFEPKKGVNIVTDEKATNLSSASVDDVAVINDLLTKLEEYAKGLPPGFQMKPIQFEKDDDTNFHMDLIAGFANMRARNYSIPEVDKLKAKFIAGRIIPAIATSTAMATGLVCLELYKVIAGEHPIEDYRNTFANLALPLFSMAEPVPAKVMKHQDLSWTVWDRWTIKGNLTVAELLQWFSDKGLSAYSMSCGTSLLYNSMFARHKDRLQKKVVDVAREVAKVEVPEYRKHIDVVVACEDDDGNDIDIPLVSVYFR

SEQ ID NO: 3033 - DNA, 2877 bp, Sorghum bicolor
  misc_feature: Ceres ANNOT ID no. 6027676
  misc_feature: Encodes the peptide sequence at SEQ ID NO 3034
atggcgctctccgccagcgatgtgcccactatgtataccgtcctcgtcaattcgctcagcgccgacgaggcggcccggcgccccgcggaggcagctctgtcgcagtgcgagacccgcccgggcttctgctcctgcctcttgattgcactgcagctagctgtattaatctccaagattgcacgcttggattacccaaaggagtggccagaccttctctctgtattggcacaacagctgcagtccgctgatgttcttgcttcacatcgcatgtttatggtcctgtttcgaactctaaaggagctgtcaactaaacggcttgctgtggatcagaagaattatgcagagatcactggccacttgtttgagtatacctggaacctttggaagagtgatgtgcagactatattacagaatctttctatgctctcacagaggaatgatatagattccattttggagcaatccaatgaccttgctttgatttgcgaccggtggttgctctgcttaaagattgtccggcaactaattttttcaggttatgctagtgactcaagaactgctcaggaggtctggcaggttagggaagtttgtccaacagttttgactgccattagatcccttcttccatattacgactccttcaaagacaagcaagctaaactatgggactttgcaaaaagagcatgcactaagttgatgaaagtcctcgttactctacaaggcagacatccatattcttttgttcaccaaactgtgcttcctgctacagtggacttctgtttaaatatgattacaaatcctgaacagactggcacaacttttgaagaatttcttatacaaagcatggttttggttaaatcagtactggagtgcaaagaatacagaccaagtcccacaggacgtgttatcaatgaaaatgcacagcctttaagtctggagcaaaggaagagaaactttgcagcagtggctagtgacatgctgaaggccgttttgtctggtgatcgagtcgtgctcctatgcaacattttagtaaggagatacttcatttacacagcaaaggatttggaagagtggtcagagaatcctgagtccttccaccatgagcagaatttggttcagtggaccgagaaaaaacggccatgtgctgaagccctcttcattgttatcttcgagaagtaccgagagcttctagctccagttgttgtttctgttcttcgtgaagctatggttgtttcgccaccacaagaaacgggtgttactgctggaatgcttttaaaggatgctgcctatacagccgccgggcatgtttattatgaactttcgaactacctcagttttaatgaatggttccatggatctctatctattgaaatttcaaatcatcaccccaatatgcgtatcattcgtagaaaaattgcattgctgcttgggcaatggatttctgagatcaagggtgacactcggaaattggtctaccgtgctttggttggattgctgcaggataatgacatagccgtaaggctagcagcatgctcttctctgtgctatcttttccaagaatcttgcttttctgaagtagatttgtttgagtgtcttcctacatgttggacaatgagtttcaagttgatagaagacgtccaagaatttgattcaaaggtgcaagtgttgaacttcatttcagttcttcttgaacatgcgggagacaaggttattccatttgcaagtcagctatcacaattttttcagatgatatggaacgaatctgcgggtgaaagcttgctacagatacaattactaacagcacttagaacttttgtttcttcgcttggattccagtcacctctttcttaccacatgcttattcctatattgcaaagtggtatcaatatcaacagccctgatgctcttaatcttcttgaggacagtgttctgttgtgggaagcaaccctttcaaatgccccttccattgtacctcaacttctggatctattcccttacctcgtgggcatcatgaatagaagttttgactatctggaggtctcaatgaaaataattgacgattacataatttttggtggatcagaatttttgaaaagccatggtgcaaacctagctaacatcattgatactattgttggaaatgtcaatgacaaaggacttctcactgcacttcctattgttgatcttcttattcagatctttcctctggaagctccaccattgatatccagtgctcttcagaaacttaccttcatatcgttgagtcaagatgatgggcaaaacccgtctaggacaactgtccgggcatcctctggggcaattcttgctaggcttctggtgatgaatacaaactttttggcacaactattatcagagcctgcccttttggcaagcatccaacaagctgggatttctgtgaacaataatctgcttctttctttagttgatatgtggatagacaaggtagatgatgcaaatgctatacagcagaaggaatatgcaatggcgctttctataattttgacattacaggtacctcaggtcattgacaaacttgatgacatactgagtgtctgcactactgtcattataggaagccgtgaagtaaagatcgaggatgatactagtggcgatatcacaagctcttcatggataggcaacgatggttcaggttattccaatacttcaagcaaagagctgagaaagcgccaggtaaaggattcagatcctatcaaacaagcatcgctagagaatgtgttaagagagaacttaaaagcatgtgcagttttccatggggatgtagcattcaatgctgccatcagcaggatccatccatctgcgtttgctcagctgcagcaggccctgaatactgcataa

SEQ ID NO: 3034 - protein, 958 aa, Sorghum bicolor
  misc_feature: Ceres ANNOT ID no. 6027676
  misc_feature (48)..(633): NCBI GI: 108707612 NCBI Desc: importin-beta n-terminal domain containing protein [oryza sativa (japonica cultivar-group)]
  misc_feature (480)..(955): NCBI GI: 115452413 NCBI Desc: os03g0292900 [oryza sativa (japonica cultivar-group)]
  misc_feature (234)..(955): NCBI GI: 119571764 NCBI Desc: importin 11, isoform cra_a [homo sapiens]
  misc_feature (234)..(955): NCBI GI: 123995715 NCBI Desc: importin 11 [synthetic construct]
  misc_feature (234)..(955): NCBI GI: 119571766 NCBI Desc: importin 11, isoform cra_b [homo sapiens]
MALSASDVPTMYTVLVNSLSADEAARRPAEAALSQCETRPGFCSCLLIALQLAVLISKIARLDYPKEWPDLLSVLAQQLQSADVLASHRMFMVLFRTLKELSTKRLAVDQKNYAEITGHLFEYTWNLWKSDVQTILQNLSMLSQRNDIDSILEQSNDLALICDRWLLCLKIVRQLIFSGYASDSRTAQEVWQVREVCPTVLTAIRSLLPYYDSFKDKQAKLWDFAKRACTKLMKVLVTLQGRHPYSFVHQTVLPATVDFCLNMITNPEQTGTTFEEFLIQSMVLVKSVLECKEYRPSPTGRVINENAQPLSLEQRKRNFAAVASDMLKAVLSGDRVVLLCNILVRRYFIYTAKDLEEWSENPESFHHEQNLVQWTEKKRPCAEALFIVIFEKYRELLAPVVVSVLREAMVVSPPQETGVTAGMLLKDAAYTAAGHVYYELSNYLSFNEWFHGSLSIEISNHHPNMRIIRRKIALLLGQWISEIKGDTRKLVYRALVGLLQDNDIAVRLAACSSLCYLFQESCFSEVDLFECLPTCWTMSFKLIEDVQEFDSKVQVLNFISVLLEHAGDKVIPFASQLSQFFQMIWNESAGESLLQIQLLTALRTFVSSLGFQSPLSYHMLIPILQSGININSPDALNLLEDSVLLWEATLSNAPSIVPQLLDLFPYLVGIMNRSFDYLEVSMKIIDDYIIFGGSEFLKSHGANLANIIDTIVGNVNDKGLLTALPIVDLLIQIFPLEAPPLISSALQKLTFISLSQDDGQNPSRTTVRASSGAILARLLVMNTNFLAQLLSEPALLASIQQAGISVNNNLLLSLVDMWIDKVDDANAIQQKEYAMALSIILTLQVPQVIDKLDDILSVCTTVIIGSREVKIEDDTSGDITSSSWIGNDGSGYSNTSSKELRKRQVKDSDPIKQASLENVLRENLKACAVFHGDVAFNAAISRIHPSAFAQLQQALNTA

SEQ ID NO: 3035 - DNA, 2454 bp, Sorghum bicolor
  misc_feature: Ceres ANNOT ID no. 6027681
  misc_feature: Encodes the peptide sequence at SEQ ID NO 3036
atggagtccccctacgctctccacctcgccctcgccgcgctcgtcggcgcctccttcgccgctgcctccgcctactacatgcaccgcaagaccctcgaccagcttctccgcttcgcccgcgaccaacagcgccgccgcaaccgcctcctccccgacgccgacgaactcgagggcggcgaagacgacgaggactatcctccggcgcacagggaccacgatcgccgcaccctgcccatcccgccgggcctaccgccgctccacaccggccgagagggtggtaggccagtcatttctccaggttcgactaaaagagttggacctattgttagaccgactacacccaaatcctctgtccccactgtcagtgcatttgatagaattgaagattcagatgacgaggaggatcttgtcccagatgccaagaatgatactgcttacttggccccaaatggtgctgttggatcagatctcacagataaagcgagccaaaatggggaattaaaatcagcaccatcaacgcagatgattagatcccatagtgcaactggcagtctgcatgcaccccagcttaacccaatagcagctgatatacttcgaaaggaacctgaacatgaaaccttcagtaaaatcaacatcacagctgttgagactccttctcctgatgaaatcgaagcatacaaggttcttcagaaatgccttgagctgcgtgagaggtacatattcagagaagaagttgctccttgggaaaaggagatcataactgatcctagtaccccaaaacctaacccaaatccgttcaattatgaacatcaggctaaaactgatcaccattttgaaatggttgatggtgtcattcatgtgtatcccaataaacattctaaagaaagactctatccagttgccgatgcaactaccttctttactgatatgcactacatccttcgtgtgttggctgctggggatatccgaactgtgtgtcatcaccgtctaaatcttctagagcaaaaatttaatcttcatttgatggttaatacggatagagaactgcttgctcagaaagctgcacctcaccgggacttctacaacgttaggaaggttgatactcatgttcatcactcagcatgcatgaaccagaagcacctgttgagatttatcaagtctaagttgaggaaggaacctaatgaggttgtaatctttagagatgggacctacttgactcttaaggaggtttttgagagtttggacttgacagggtatgatctcaatgttgatctcttagatgtccatgctgataagagtacatttcatcgtttcgacaagttcaatctgaaatataatccatgtggtcaatctcgcctgagggagatctttttaaaacaggataatcttatccaaggtcgcttccttgctgagctgacaaaagaagtattttctgaccttgaagcaagtaaatatcagatggctgagtatcggatatctatttatgggaggaagaaaagtgaatgggaccaaatggcaagttggatagtgaacaatgaattatatagcgagaatgttgtttggttaattcagattcctcggatatacaatgtatacagggagatgggcacaatcaattcattccaaaacctccttgacaatatttttctccctctttatgaagtaactgttgacccagcttcacatcctcagctccatgttttcttagaacaggttgttgggttggatttggtggatgatgaaagcaaacctgaaagacgcccaacaaaacatatgccaacacctgagcaatggactaatgttttcaatccagcctatgcatattatgtgtactattgctatgccaatctgtatacactgaacaagcttcgtgagtccaagggcatgacaacaatcaaactgcgtccacactgtggggaggctggtgatatcgatcaccttgctgcagcatttcttacttcacataatattgctcatggggtgaacctaaagaaatcccctgtacttcagtatttgtactatcttgctcagattggtcttgcaatgtctcccttaagtaacaactcactgtttatcgactatcatcggaaccctttcccaacatttttcttgagaggtcttaacgtgtctctttcaactgacgaccctctacaaattcacctgacaaaggaacctttggttgaagaatacagtattgctgcttcactttggaagctgagctcatgtgacctgtgtgaaatcgctagaaattctgtctaccagtctggcttctctcacaggctcaagtctcactggattgggagaaactactacagaaggggtccggagggcaatgacatccaccagacaaatgttcctcacatcagggttgaatttcgacacactatctggaaagaagaaatggagctgatacattttggaaatgttaaactacccgaagaaattgacaggtga

SEQ ID NO: 3036 - protein, 817 aa, Sorghum bicolor
  misc_feature: Ceres ANNOT ID no. 6027681
  misc_feature (362)..(768): Pfam Id: A_deaminase Pfam Desc: Adenosine/AMP deaminase
  misc_feature (1)..(817): NCBI GI: 75242756 NCBI Desc: probable amp deaminase
  misc_feature (5)..(817): NCBI GI: 140053576 NCBI Desc: adenosine/amp deaminase active site [medicago truncatula]
  misc_feature (113)..(815): NCBI GI: 73536071 NCBI Desc: chain a, x-ray structure of adenosine 5'-monophosphate deaminase from arabidopsis thaliana in complex with coformycin 5'- phosphate
  misc_feature (421)..(817): NCBI GI: 115463339 NCBI Desc: os05g0349200 [oryza sativa (japonica cultivar-group)]
  misc_feature (189)..(804): NCBI GI: 60463062 NCBI Desc: amp deaminase [dictyostelium discoideum]
  misc_feature (34)..(815): SWISSPROT Homolog: EC 3.5.4.6 AMP deaminase
MESPYALHLALAALVGASFAAASAYYMHRKTLDQLLRFARDQQRRRNRLLPDADELEGGEDDEDYPPAHRDHDRRTLPIPPGLPPLHTGREGGRPVISPGSTKRVGPIVRPTTPKSSVPTVSAFDRIEDSDDEEDLVPDAKNDTAYLAPNGAVGSDLTDKASQNGELKSAPSTQMIRSHSATGSLHAPQLNPIAADILRKEPEHETFSKINITAVETPSPDEIEAYKVLQKCLELRERYIFREEVAPWEKEIITDPSTPKPNPNPFNYEHQAKTDHHFEMVDGVIHVYPNKHSKERLYPVADATTFFTDMHYILRVLAAGDIRTVCHHRLNLLEQKFNLHLMVNTDRELLAQKAAPHRDFYNVRKVDTHVHHSACMNQKHLLRFIKSKLRKEPNEVVIFRDGTYLTLKEVFESLDLTGYDLNVDLLDVHADKSTFHRFDKFNLKYNPCGQSRLREIFLKQDNLIQGRFLAELTKEVFSDLEASKYQMAEYRISIYGRKKSEWDQMASWIVNNELYSENVVWLIQIPRIYNVYREMGTINSFQNLLDNIFLPLYEVTVDPASHPQLHVFLEQVVGLDLVDDESKPERRPTKHMPTPEQWTNVFNPAYAYYVYYCYANLYTLNKLRESKGMTTIKLRPHCGEAGDIDHLAAAFLTSHNIAHGVNLKKSPVLQYLYYLAQIGLAMSPLSNNSLFIDYHRNPFPTFFLRGLNVSLSTDDPLQIHLTKEPLVEEYSIAASLWKLSSCDLCEIARNSVYQSGFSHRLKSHWIGRNYYRRGPEGNDIHQTNVPHIRVEFRHTIWKEEMELIHFGNVKLPEEIDR

SEQ ID NO: 3037 - DNA, 954 bp, Sorghum bicolor
  misc_feature: Ceres ANNOT ID no. 6027700
  misc_feature: Encodes the peptide sequence at SEQ ID NO 3038
atgacgggcaaggatgccgccgccggcggtggcggcggcaagggccgcctcttcacggtgggccttgtcacggcgtggtactcatccaacatcggggttctgctgctcaacaagtacctgctcagcaactacggcttcaagtaccccatcttcctcaccatgtgccacatgtccgcctgctccctcttctcctacgccgccatcgcctggctccgcatcgtccccatgcagctcccgcgctcccgcctccagctcgccaagatcgctgcgctcagcctcgtcttctgcgcctccgtcgtctcaggcaacatctccctccgctacctccccgtctccttcaaccaggctgtcggcgccaccacccccttcttcaccgctgtctttgcctacctcatgaccgtcaagcgcgagtcctttctcacctatctcgcgctcgtgcccgtcgtcaccggtgtcatcatcgccagcggcggagagcccagctttaatctgtttgggttcatcatgtgcgttggagcaactgctgcgagggcactcaagacggtcttgcaagggattcttatgtcttctgatggggagaagattaattccatgaacctgcttatgtacatggcaccaatcgctgttcttctcttggtccctgcaactatcttcatggaggataatgttgttgtcattacaatacaactggccaggaaggatatcaacataatttggtacctgctcttcaactcttccttggcctacttcgtgaatctgaccaatttcctggtgacaaagcatacgagtgcattaaccctacaggtcctgggcaatgcaaaaggagccgttgcagttgtgatctccatcttgatattcagaaacccagtgtctataactgggatgctgggctacacgctgactgtcataggggtgcttctttacagtgaagctaagaagcgaaccaagcaatga

SEQ ID NO: 3038 - protein, 317 aa, Sorghum bicolor
  misc_feature: Ceres ANNOT ID no. 6027700
  misc_feature (166)..(310): Pfam Id: TPT Pfam Desc: Triose-phosphate Transporter family
  misc_feature (16)..(316): Pfam Id: UAA Pfam Desc: UAA transporter family
  misc_feature (16)..(316): NCBI GI: 61651608 NCBI Desc: plastidic phosphate translocator-like protein2 [mesembryanthemum crystallinum]
  misc_feature (15)..(316): NCBI GI: 9759107 NCBI Desc: phosphate/phosphoenolpyruvate translocator protein-like [arabidopsis thaliana]
  misc_feature (15)..(316): NCBI GI: 52421287 NCBI Desc: at5g05820 [arabidopsis thaliana]
  misc_feature (6)..(316): NCBI GI: 115461805 NCBI Desc: os05g0121900 [oryza sativa (japonica cultivar-group)]
  misc_feature (14)..(314): NCBI GI: 21536504 NCBI Desc: phosphate/phosphoenolpyruvate translocator-like protein [arabidopsis thaliana]
  misc_feature: Useful for making plants with altered cell wall content and/or composition
  misc_feature: Functional homolog of the protein sequence encoded by LOCUS at1g12500
  misc_feature: Useful for making plants with altered cell wall content and/or composition
  misc_feature: Functional homolog of the protein sequence given in SEQ ID NO 13792
  misc_feature: The sequence is a functional homolog of SEQ ID NO. 360 in the 11/188,298 US application
  misc_feature: The sequence is a functional homolog of SEQ ID NO. 484 in the 11/188,298 US application
MTGKDAAAGGGGGKGRLFTVGLVTAWYSSNIGVLLLNKYLLSNYGFKYPIFLTMCHMSACSLFSYAAIAWLRIVPMQLPRSRLQLAKIAALSLVFCASVVSGNISLRYLPVSFNQAVGATTPFFTAVFAYLMTVKRESFLTYLALVPVVTGVIIASGGEPSFNLFGFIMCVGATAARALKTVLQGILMSSDGEKINSMNLLMYMAPIAVLLLVPATIFMEDNVVVITIQLARKDINIIWYLLFNSSLAYFVNLTNFLVTKHTSALTLQVLGNAKGAVAVVISILIFRNPVSITGMLGYTLTVIGVLLYSEAKKRTKQ

SEQ ID NO: 3039 - DNA, 2808 bp, Sorghum bicolor
  misc_feature: Ceres ANNOT ID no. 6028020
  misc_feature: Encodes the peptide sequence at SEQ ID NO 3040
atgacgatcccgagcgcggaggggttcctccaggcgtcgagctgcctcccttgcacggcggcggaggagcgggaggtcgttgacgcgctcaccagggaggccgagaagaatgtcaagcacggggatctccgctatctcgtctcgcagagctggtggatggagtggcaaggttatgtgggcatattcagtcatggagagaatggcaccgagcagtttcctcaggctatgaatagacctggagagattgataactcgaagcttgtttcggcagaaaggatcaatggtagtgaagagccagagcttcaaaggaccttgagagaaggggagcactatactttggtgccgcaagaagtttggcaaaggctatatgaatggtataaaggtggaccagaaatccctagaaaagttatttttgacaatccaattgacaagacttacatagtggatgtctaccctctctgtctaaaactaattgatggaagggacagttgtcaaaaagttttcagaataagtagaaaggccaaagttcatgagctttactcaatggtttgctcactcatgtcagtagagcagtccgagattgtcatctgggattattaccaaaggtcaaagggcaaaaagttgcttaatcaaaatgagacactagaagaagctcaacttactatggaccaggagatcctcttggagatgaagctgggcgagagcagttcaggtttcagtacaagatccacaaatgatgaattagcattaattccattagaaccctccacatcatcattttctattgctggagggcctacattttcaaagggtttttcatctgggattggttctagtttttcacaagataatagcttcagtcctttattaagggatagtgaagatggttacaatagtctcagcaatggaactaaagatggcactcatggattgagtggattacataacttgggtaatacatgcttcatgaatagtgccatacaatccttggttcatacacctccactggtacagtactttttggaggactatacttgtgaaataaacacagaaaatccactaggccttcagggtgaacttgcgatagcatttggagagctacttagaaaactctggtcatctggtcgaacttctgttgctccacgtgcatttaaatcaaaactttctcgttttgctccacagttcagtggatataatcagcatgattctcaggagctacttgcgttcttgttggatggtctgcatgaagatctgaaccgtgtaaaaaagaaaccatatattgaggcaaaggatgctgatggccgtccagatgatgaatttgctgaagaatgctggaattaccataaagctcgaaatgactccataattgtagataggtttcaaggtcaatacaagtccacattggtgtgcccagtttgtaacaaaatctcagttacctttgacccatttatgtatttgtcgctgccattaccgtcaacagttactcggatgattactgtaactgtattcagtggtactggagatgttcttccaatgccttacactgtgactgtacaaaaaaatggaaactgccgagatcttactaaagcccttgctgatgtttgctgcttaaaagattctgagacattgttgcttgcagaggtatatgagcgtcggatctaccgttacctaacaaatccaattgagggacttcatagtataaaagatgaagatatacttgttgcatataggctccctgttggttatgaaaaacttttgaggttggagatcctgcatcggagggcagacagatttcttgtggagcctcagtttaatatcaacaggaagctcattgggtgccccattgtgacttgtattccaaatggttctactggaaaatctgatatttatgcggctgtatctgctgttttggttccatttgtacgagcaaaagcacatagccctgatgtgtctgctgtcaagttaaatggcaatgggccaagcctggatggtattgtactgacggataatggcaccaccagtgaggagggtctctctatatcaagatcaagtgaggatgataatgcagctgtcgatgagcttttaccgttccagctttcattgactgatgaaaaaggaagtataagaaatgctatagacacggattctaatcgtggtttaggactagttattagggttttgatggattggtctgagaaagagcatgggatgtacaatattgattacatggatggacttcctgaagtcttcaagcctggttttatgtcaaagaagacccggcaagaagcagtcaatttattttcatgcttggatgcttttctgaaggaggaacccctagggcctgacgacatgtggtactgtcctgggtgcaaggaacacaggcaagctagcaagaaactggacttgtggaggttacctgagatattagtagttcatttgaaaaggttctcatacagccggtatatgaagaacaagcttgatacatttgtgaattttccaatccatgacctcaatatgagcaagtatgtgaagctgacatcaagaggtgaccagcaccccatgtatgaactctatgcagtaataaatcattacggtggtcttggtggtggacactattctgcatatgcaaagctagtagaagagaacaactggtatcattttgatgatagtcatgtttcctctgttaatgaggatgagatcaggacgtctgcagcatatgtgcttttctaccgacgagttggaggttcaagtacggtggcaaatggtggtgcagtcgacattgaaatggttgattcgatagagatgtag

SEQ ID NO: 3040 - protein, 935 aa, Sorghum bicolor
  misc_feature: Ceres ANNOT ID no. 6028020
  misc_feature (309)..(910): Pfam Id: UCH Pfam Desc: Ubiquitin carboxyl-terminal hydrolase
  misc_feature (1)..(913): NCBI GI: 42566404 NCBI Desc: ubiquitin carboxyl-terminal hydrolase family protein [arabidopsis thaliana]
  misc_feature (196)..(888): NCBI GI: 4115922 NCBI Desc: contains similarity to ubiquitin carboxyl-terminal hydrolase family 2 (pfam:pf00443, score=48.3, e=3.5e-13, n=2) and (pfam:pf00442, score=40.0 e=5.2e-08, n=1) [arabidopsis thaliana]
  misc_feature (19)..(712): NCBI GI: 42562472 NCBI Desc: ubiquitin carboxyl-terminal hydrolase family protein [arabidopsis thaliana]
  misc_feature (19)..(712): NCBI GI: 6910582 NCBI Desc: cds [arabidopsis thaliana]
  misc_feature (196)..(694): NCBI GI: 4115923 NCBI Desc: contains similarity to ubiquitin carboxyl-terminal hydrolase family 2 (pfam:pf00443, score=40.0, e=5.2e-08, n=1) and (pfam:pf00442, score=37.9 e=5.3e-10, n=1) [arabidopsis thaliana]
MTIPSAEGFLQASSCLPCTAAEEREVVDALTREAEKNVKHGDLRYLVSQSWWMEWQGYVGIFSHGENGTEQFPQAMNRPGEIDNSKLVSAERINGSEEPELQRTLREGEHYTLVPQEVWQRLYEWYKGGPEIPRKVIFDNPIDKTYIVDVYPLCLKLIDGRDSCQKVFRISRKAKVHELYSMVCSLMSVEQSEIVIWDYYQRSKGKKLLNQNETLEEAQLTMDQEILLEMKLGESSSGFSTRSTNDELALIPLEPSTSSFSIAGGPTFSKGFSSGIGSSFSQDNSFSPLLRDSEDGYNSLSNGTKDGTHGLSGLHNLGNTCFMNSAIQSLVHTPPLVQYFLEDYTCEINTENPLGLQGELAIAFGELLRKLWSSGRTSVAPRAFKSKLSRFAPQFSGYNQHDSQELLAFLLDGLHEDLNRVKKKPYIEAKDADGRPDDEFAEECWNYHKARNDSIIVDRFQGQYKSTLVCPVCNKISVTFDPFMYLSLPLPSTVTRMITVTVFSGTGDVLPMPYTVTVQKNGNCRDLTKALADVCCLKDSETLLLAEVYERRIYRYLTNPIEGLHSIKDEDILVAYRLPVGYEKLLRLEILHRRADRFLVEPQFNINRKLIGCPIVTCIPNGSTGKSDIYAAVSAVLVPFVRAKAHSPDVSAVKLNGNGPSLDGIVLTDNGTTSEEGLSISRSSEDDNAAVDELLPFQLSLTDEKGSIRNAIDTDSNRGLGLVIRVLMDWSEKEHGMYNIDYMDGLPEVFKPGFMSKKTRQEAVNLFSCLDAFLKEEPLGPDDMWYCPGCKEHRQASKKLDLWRLPEILVVHLKRFSYSRYMKNKLDTFVNFPIHDLNMSKYVKLTSRGDQHPMYELYAVINHYGGLGGGHYSAYAKLVEENNWYHFDDSHVSSVNEDEIRTSAAYVLFYRRVGGSSTVANGGAVDIEMVDSIEM

SEQ ID NO: 3041 - DNA, 1203 bp, Sorghum bicolor
  misc_feature: Ceres ANNOT ID no. 6028100
  misc_feature: Encodes the peptide sequence at SEQ ID NO 3042
atggcagccaacggcaagagcagcttggcgaacggcgcctcctccacccagggaaagcccatcaattgcaaagcggcggtggcgtgggcgcccggcgagccgctggtgatggaggaggtggaggtggcgccgccgggtcgcctggaggtccgcgtgagggtgctcttcacctccgtctgccacaccgatctcagtttcttgaaaggagagaacgagctgcagcgcaagttcccccgcatcctcggccatgaggcagccggagtggtggagagcgtgggggaaggggtgcaagacctggcccccggcgaccatgtggtccccatcttcaacggggagtgcggagcctgcgcgtactgcgagtcggacaagaccaacctgtgcgggacttaccgcgtcaacccattcaagagcaccatgtcctccgatggcggcacgaggttctccgtggtggaccgcaactctgggctgcggcagccggtgtaccacttcctcaacacctccaccttcgccgagtacaccgtgcttgacgcggcctgcgccgtcaagatcaaccccaaggccccgctccacaagatgtgcctcctcagctgcggcatctccacaggagtcggggctgcatggaacacggcaaacatttccgcgggcaacaccattgcaatattcggccttggggctgttggtctcgcggttgctgagggtgccaagctacgaggggcagctcggatcatcggtgttgacgtaaaccctgaaaagtttgccaaaggcaaagagatgggcgtcacggacttcgtcaactccaaggcctgtgacaaaccggtgcatgaggtgatcagggagatgactgacggagctggtgtcgactacagttttgagtgtaccggaatcaacgatgtgctgagagaggccttcctgtccacgcatgatggttggggcctgacggtggtgctggggatccacgcgacgcccaagatgatgccgctacacccgatggagctcttcgacggccgccggatcaccggctgcgtctttggtgacgtcaagggcaagtcccagctgccagccatcgtcgacaagtacgtcaacggggacctgaatataaactttgatgggttcataacacacaacatgcccttctcggacatcagcaaggccatccagttgctggaggaaggcaagtcccttaggtgcgtgctccatctctga

SEQ ID NO: 3042 - protein, 400 aa, Sorghum bicolor
  misc_feature: Ceres ANNOT ID no. 6028100
  misc_feature (47)..(183): Pfam Id: ADH_N Pfam Desc: Alcohol dehydrogenase GroES-like domain
  misc_feature (214)..(357): Pfam Id: ADH_zinc_N Pfam Desc: Zinc-binding dehydrogenase
  misc_feature (16)..(400): NCBI GI: 5042408 NCBI Desc: very similar to alcohol dehydrogenase [arabidopsis thaliana]
  misc_feature (37)..(400): NCBI GI: 145326652 NCBI Desc: oxidoreductase/ zinc ion binding [arabidopsis thaliana]
  misc_feature (14)..(400): NCBI GI: 48093455 NCBI Desc: adh-like udp-glucose dehydrogenase [nicotiana tabacum]
  misc_feature (14)..(398): NCBI GI: 297178 NCBI Desc: alcohol dehydrogenase [solanum tuberosum]
  misc_feature (14)..(398): NCBI GI: 113379 NCBI Desc: alcohol dehydrogenase 2
  misc_feature (14)..(398): SWISSPROT Homolog: EC 1.1.1.1 Alcohol dehydrogenase 2
  misc_feature: The sequence is a functional homolog of SEQ ID NO. 530 in the 11/188,298 US application
MAANGKSSLANGASSTQGKPINCKAAVAWAPGEPLVMEEVEVAPPGRLEVRVRVLFTSVCHTDLSFLKGENELQRKFPRILGHEAAGVVESVGEGVQDLAPGDHVVPIFNGECGACAYCESDKTNLCGTYRVNPFKSTMSSDGGTRFSVVDRNSGLRQPVYHFLNTSTFAEYTVLDAACAVKINPKAPLHKMCLLSCGISTGVGAAWNTANISAGNTIAIFGLGAVGLAVAEGAKLRGAARIIGVDVNPEKFAKGKEMGVTDFVNSKACDKPVHEVIREMTDGAGVDYSFECTGINDVLREAFLSTHDGWGLTVVLGIHATPKMMPLHPMELFDGRRITGCVFGDVKGKSQLPAIVDKYVNGDLNINFDGFITHNMPFSDISKAIQLLEEGKSLRCVLHL

SEQ ID NO: 3043 - DNA, 1608 bp, Sorghum bicolor
  misc_feature: Ceres ANNOT ID no. 6028218
  misc_feature: Encodes the peptide sequence at SEQ ID NO 3044
atggagtccgcgccgtcaacggcggcggtcatggagcgtgagcgcctcacggccgagctggacttggccgtggtggccgcggagcccagcagcttcgtcgtcaagatccggcgccggctgcccgatttcgcgcgcagcgtcaacctcaagtacgtccgccttggcctgcgctccggcggcatcccagccccctccacatgggtccccctcgcgctcgcgccgccgctcctcgccgcagcggtatactcgctcgtcggcgcggacaagctctactcgctcgacctgctcacctgcgtcgcgtggctcgccgcggcggtgctgctgctcacggtgtatttcctcaagcgcccgcggccggtgtacctcgtggacttcgcgtgctaccggcctgccgacgagcacgccatctccaaggagggcttcctcgacatgacggagagcacgggctggttcaacgcggaggcgctcgagttccagaccaagatcaccaggcgctccgggctgggagaccggacgtaccttccgccgggaatccaggcgcggccgccgcggctgtcgttgacggaggcgcgcgcggaggccgaggccgtcatgttcggctgcctggacgcgctgttcgcggccacgggcatcgacccgcgccgcgacgtgcgcgtgctcatcgtcaactgcagcctcttcaacccgacgccgtcgctggcgtccatggtggtgcaccgctacaagatgcgggaggacgtcaagtcgttcaaccttgctggcatggggtgcagcgcggggctcatcgccgtggacctcgccagggacatgctgcaggcgaaccccaggtgctacgccgtcgtggtgagcaccgagaacatcacgctcaactggtactttggcaacgaccgctccatgctgctgtccaactgcatcttccgcatgggcggcgccgccgcgctgctgtccaaccgtcgggccgacgcccggcgcgccaagtaccggctgctgcacacggtgcgcacccacaagggcgccgcggacgagtgctacagctgcgtgtaccagcgcgaggacggcgctggcagcgtcggcgtgtcgctggcgcgcgagctcatggccgtcgccggggacgcgctcaagacgaacatcaccaccctgggcccgctagtgctcccgctgtcggagcagctcaagttcctcaagtccctggtgctccgccgcgtcctccgctcccgcggcgtccgcccgtacatcccggacttccggcgcgcgttcgagcacttctgcgtgcacgccggcgggcgcgccgtgctggaggaggtgcagcgcagcctggggctcagggacgtggacatggagcccagcaggtgcaccctgcaccgcttcggcaacaccagcagcagctcgctctggtacgagctcgcgtacgccgaggccaagggccgcgtccgccgcggccaccgcgtgtggcagatcggcttcggctccgggttcaagtgcaacagcgccgtctggcgcgcgctccgtgacgtgccgcccgtgcacgccgacggcgccggcggtggcagcaactgcaacccgtgggtagacagcattcacaggtacccgccaaaagcgtacatctga

SEQ ID NO: 3044 - protein, 535 aa, Sorghum bicolor
  misc_feature: Ceres ANNOT ID no. 6028218
  misc_feature (112)..(402): Pfam Id: FAE1_CUT1_RppA Pfam Desc: FAE1/Type III polyketide synthase-like protein
  misc_feature (403)..(501): Pfam Id: ACP_syn_III_C Pfam Desc: 3-Oxoacyl-[acyl-carrier-protein (ACP)] synthase III C terminal
  misc_feature (359)..(503): Pfam Id: Chal_sti_synt_C Pfam Desc: Chalcone and stilbene synthases, C-terminal domain
  misc_feature (6)..(516): NCBI GI: 115481206 NCBI Desc: os10g0158100 [oryza sativa (japonica cultivar-group)]
  misc_feature (11)..(532): NCBI GI: 3551960 NCBI Desc: senescence-associated protein 15 [hemerocallis hybrid cultivar]
  misc_feature (11)..(530): NCBI GI: 87240844 NCBI Desc: chalcone and stilbene synthases, n-terminal [medicago truncatula]
  misc_feature (11)..(532): NCBI GI: 4091810 NCBI Desc: fatty acid elongase 3-ketoacyl-coa synthase 1 [arabidopsis thaliana]
  misc_feature (11)..(532): NCBI GI: 49355351 NCBI Desc: fatty acid elongase 3-ketoacyl-coa synthase [brassica napus]
  misc_feature (11)..(532): SWISSPROT Homolog: EC 2.3.1.119 3-ketoacyl-CoA synthase 1 (EC 2.3.1.-)
  misc_feature: The sequence is a functional homolog of SEQ ID NO 2 in US patent 7038112
MESAPSTAAVMERERLTAELDLAVVAAEPSSFVVKIRRRLPDFARSVNLKYVRLGLRSGGIPAPSTWVPLALAPPLLAAAVYSLVGADKLYSLDLLTCVAWLAAAVLLLTVYFLKRPRPVYLVDFACYRPADEHAISKEGFLDMTESTGWFNAEALEFQTKITRRSGLGDRTYLPPGIQARPPRLSLTEARAEAEAVMFGCLDALFAATGIDPRRDVRVLIVNCSLFNPTPSLASMVVHRYKMREDVKSFNLAGMGCSAGLIAVDLARDMLQANPRCYAVVVSTENITLNWYFGNDRSMLLSNCIFRMGGAAALLSNRRADARRAKYRLLHTVRTHKGAADECYSCVYQREDGAGSVGVSLARELMAVAGDALKTNITTLGPLVLPLSEQLKFLKSLVLRRVLRSRGVRPYIPDFRRAFEHFCVHAGGRAVLEEVQRSLGLRDVDMEPSRCTLHRFGNTSSSSLWYELAYAEAKGRVRRGHRVWQIGFGSGFKCNSAVWRALRDVPPVHADGAGGGSNCNPWVDSIHRYPPKAYI

SEQ ID NO: 3045 - DNA, 573 bp, Sorghum bicolor
  misc_feature: Ceres ANNOT ID no. 6028247
  misc_feature: Encodes the peptide sequence at SEQ ID NO 3046
atggcgcgtcccaagaacaaccagaaccccagggtgttcctggacctcagcattggcggcgagctggttggccgcgtcgtcatcgagctattcgccgacaaggtgcccaggacggcggagaacttccggcagctgtgcaccggcgagcgcggcttgggccggtggtctggcaagcggctgcactacaagggcgcgccgttccaccgcgtggtgcccgggttcatgtgccagggcggcgacatcacggcgggcaacggcacgggcggcgagtccgcgctcggcgacggcgggcggtacttcgccgacgaggcactcggcgccgtccggcactccggccccggggtggtgtccatggccaacgccgggcccaacaccaacgggtcccagttcttcatcaccttcgccgacgcgccgtggctggacgggcgccacgtcgcgttcggccgcgtcgagcaaggcatggcggcgctgcgcgccatcgagaaggccgggtccatgagcggcaggaccgtgaggccggtcgtcatcgccgactgcggccagctcaaggacgactacgccgccatgttctaa

SEQ ID NO: 3046 - protein, 190 aa, Sorghum bicolor
  misc_feature: Ceres ANNOT ID no. 6028247
  misc_feature (11)..(182): Pfam Id: Pro_isomerase Pfam Desc: Cyclophilin type peptidyl-prolyl cis-trans isomerase/CLD
  misc_feature (9)..(182): NCBI GI: 18076088 NCBI Desc: cyclophilin [ricinus communis]
  misc_feature (9)..(182): NCBI GI: 1220142 NCBI Desc: cyclophilin [catharanthus roseus]
  misc_feature (9)..(182): NCBI GI: 51235021 NCBI Desc: peptidyl-prolyl cis-trans isomerase [populus balsamifera subsp. trichocarpa]
  misc_feature (9)..(182): NCBI GI: 1563719 NCBI Desc: cyclophylin [digitalis lanata]
  misc_feature (10)..(182): NCBI GI: 1561575 NCBI Desc: cyclophilin [digitalis lanata]
  misc_feature (9)..(182): SWISSPROT Homolog: EC 5.2.1.8 Peptidyl-prolyl cis-trans isomerase
MARPKNNQNPRVFLDLSIGGELVGRVVIELFADKVPRTAENFRQLCTGERGLGRWSGKRLHYKGAPFHRVVPGFMCQGGDITAGNGTGGESALGDGGRYFADEALGAVRHSGPGVVSMANAGPNTNGSQFFITFADAPWLDGRHVAFGRVEQGMAALRAIEKAGSMSGRTVRPVVIADCGQLKDDYAAMF

SEQ ID NO: 3047 - DNA, 1554 bp, Sorghum bicolor
  misc_feature: Ceres ANNOT ID no. 6028348
  misc_feature: Encodes the peptide sequence at SEQ ID NO 3048
atggcaatgacactgtcgctatgctacctcctcctcctcgtcctcgccggtgacggcaggggcgaggtcgccgcgtttgagctggaggaggccaccatcgactcgatccatcgcgccttcgcgaccggggggcttacctcccgcggtctcgtcgagctctacctgcgccgcatcgcgtccctcgatcccactctccacgccatcatcgagatcgacccggacggcgcgctcgccgccgccgaccgcgccgacgccgctgcccggtctagctccggcgtgctcccgccgctgcacggcgtccctgtgctgctcaaggacaacatcgccgcggcaggcgacggtggggtgctgaacgctacggccgggtcgctcgccatggtcgggtcacgccccgcgcgcgacgccggcgtggtcgagcggctcaggcgcgccggcgcggtgctgctcggcaccgcgagcctcagcgagtggtgcaacttccgcggccccggcatacccgccggctggagcccccgcggcggccagggcaggaacccgtacgtgccgtcggcgacgacgtgctcctccagcagcggctcagcgattgcggcggcctcgaacatggcggcagtgacgattgggaccgaaacggatggctccatcatgtgcccttccagctacaactccgtcgtcgggatcaagcccaccgtgggtctcaccagccgggccggcgtcatcatcatttcacaaaggatggacacaattggccccatcactaggacagtttcagatgctgtgcatgtgttggaagcaattgttggttatgaccctcgagatgcagaggcaactcgcatgggttcacgatatataccagaaggtggatacaagcaatttttgaccatacacgggctacgagggaagaggttgggaattcttagaaaggatttcttccgttttccctctggttctgtccaagaacaggtcttcagtgatcattttagaactatgagtaaaatgggtgccatcttggtagacaaccttgagataccaagcatgaatgtcattaatgatgcaatgcaaagtggtgagcgtgctcttatgcttgctgaattcaagctatcactcaactcctacttatctgaactggccacttcacctgttagatcattatcagacataattgagtttaacaagaagcaccccattgaggaaaggatggctgaatttggacaagattaccttctacaatctgaagcaaccaatggcattggtccaactgaggagcatgctattttgaatctgaacaaactgtgcaaaagaggccttgagaaaataatgcaagataaccaattggatgcaattgtagccccaggtgcatctgctcacagcctgcttgccattggcggttatccggcaataactgttccggctgggtatgctgcaaatggcgtcccttttgccatctgcttcggagggttgaaaggatcggagccgaagcttattgagatatcatattcatttgagcaggcaacgagagtaaggaaacctccgtcaatgcagcattctgtcatttga

SEQ ID NO: 3048 - protein, 517 aa, Sorghum bicolor
  misc_feature: Ceres ANNOT ID no. 6028348
  misc_feature (49)..(494): Pfam Id: Amidase Pfam Desc: Amidase
  misc_feature (1)..(510): NCBI GI: 38346899 NCBI Desc: osjnbb0006l01.6 [oryza sativa (japonica cultivar-group)]
  misc_feature (13)..(510): NCBI GI: 116317815 NCBI Desc: osigba0140c02.3 [oryza sativa (indica cultivar-group)]
  misc_feature (10)..(513): NCBI GI: 115457176 NCBI Desc: os04g0184100 [oryza sativa (japonica cultivar-group)]
  misc_feature (26)..(513): NCBI GI: 38346902 NCBI Desc: osjnbb0006l01.9 [oryza sativa (japonica cultivar-group)]
  misc_feature (26)..(513): NCBI GI: 115457174 NCBI Desc: os04g0183500 [oryza sativa (japonica cultivar-group)]
MAMTLSLCYLLLLVLAGDGRGEVAAFELEEATIDSIHRAFATGGLTSRGLVELYLRRIASLDPTLHAIIEIDPDGALAAADRADAAARSSSGVLPPLHGVPVLLKDNIAAAGDGGVLNATAGSLAMVGSRPARDAGVVERLRRAGAVLLGTASLSEWCNFRGPGIPAGWSPRGGQGRNPYVPSATTCSSSSGSAIAAASNMAAVTIGTETDGSIMCPSSYNSVVGIKPTVGLTSRAGVIIISQRMDTIGPITRTVSDAVHVLEAIVGYDPRDAEATRMGSRYIPEGGYKQFLTIHGLRGKRLGILRKDFFRFPSGSVQEQVFSDHFRTMSKMGAILVDNLEIPSMNVINDAMQSGERALMLAEFKLSLNSYLSELATSPVRSLSDIIEFNKKHPIEERMAEFGQDYLLQSEATNGIGPTEEHAILNLNKLCKRGLEKIMQDNQLDAIVAPGASAHSLLAIGGYPAITVPAGYAANGVPFAICFGGLKGSEPKLIEISYSFEQATRVRKPPSMQHSVI

SEQ ID NO: 3049 - DNA, 1014 bp, Sorghum bicolor
  misc_feature: Ceres ANNOT ID no. 6028349
  misc_feature: Encodes the peptide sequence at SEQ ID NO 3050
atggcggccgagcccgagcccaggatcctagagctctccaacggcaagatcactgcgaggatctccaactggggcgccaccatcacctccctcctcgtccccgacgcccaagggagtatcgcggatgtggtgctcggattcgatgacctggacccgtacgtgaaaggcatgtcaccttattttggctgcatagttggccgagttgcaaataggatcaaggatggaaagtttagactcaacgaagttgagtattcattgcctgtcaacaatggacctaacagccttcatggtgggttgaggggatttgataaggttgtgtgggatgtcgtagaccacaaggatggtgaatgcccatcaataacttttcagtatcacagcaaggatggtgaagaaggctatccaggggatgtaaccattagggcaacatactcacttcctgaagctgctactctaagacttgacatggaagctacaccagaaaacaaagcaactcctataagcttggcgcagcacacctattggaaccttgcaggccatgcttccggtgacatcttaaatcattcaatacagatatgggggaagcacatcactccagttgatgaaaacacaattcccactggtgagataatgcccgtcaatggcacttcttttgatttcacaacagagcacaagattggagagcgcatcaatgatgttcctggagggtatgatcataactacatgctggactgtggcgatgagaagaatggcctgaagcatgcggccaagctgagagatccatcaagcttgcggaccctagagctctggactgatgcacctggcatgcagttctacaccgccaactatgtgaatgacatcagtggcaaagggggtgctgtctatgagaagcatgctggagtatgcttggaaacccaggggttccctaatgccatcaaccaacctaattttccctctgtagttgttcggcctggtgagaagtataagcacactatgctgtttgagttctcaaactga

SEQ ID NO: 3050 - protein, 337 aa, Sorghum bicolor
  misc_feature: Ceres ANNOT ID no. 6028349
  misc_feature (8)..(334): Pfam Id: Aldose_epim Pfam Desc: Aldose 1-epimerase
  misc_feature (1)..(336): NCBI GI: 78707805 NCBI Desc: aldose 1-epimerase [oryza sativa (japonica cultivar-group)]
  misc_feature (7)..(336): NCBI GI: 9294498 NCBI Desc: aldose 1-epimerase-like protein [arabidopsis thaliana]
  misc_feature (6)..(336): NCBI GI: 92890487 NCBI Desc: galactose mutarotase-like [medicago truncatula]
  misc_feature (56)..(336): NCBI GI: 115477940 NCBI Desc: os09g0108600 [oryza sativa (japonica cultivar-group)]
  misc_feature (9)..(336): NCBI GI: 92872798 NCBI Desc: galactose mutarotase-like [medicago truncatula]
MAAEPEPRILELSNGKITARISNWGATITSLLVPDAQGSIADVVLGFDDLDPYVKGMSPYFGCIVGRVANRIKDGKFRLNEVEYSLPVNNGPNSLHGGLRGFDKVVWDVVDHKDGECPSITFQYHSKDGEEGYPGDVTIRATYSLPEAATLRLDMEATPENKATPISLAQHTYWNLAGHASGDILNHSIQIWGKHITPVDENTIPTGEIMPVNGTSFDFTTEHKIGERINDVPGGYDHNYMLDCGDEKNGLKHAAKLRDPSSLRTLELWTDAPGMQFYTANYVNDISGKGGAVYEKHAGVCLETQGFPNAINQPNFPSVVVRPGEKYKHTMLFEFSN

SEQ ID NO: 3051 - DNA, 342 bp, Sorghum bicolor
  misc_feature: Ceres ANNOT ID no. 6028463
  misc_feature: Encodes the peptide sequence at SEQ ID NO 3052
atgtaccaccagctgagctcttgtagccgcggcctggccgcaacgctcctcctgctccttgccgccgccaccgccgccgctgccacacctgaagctccaacggcgggagcagcctgctacaacgacatcgtcgccctgcggagcacctgctaccgctacgtccaggacgagggtcccatggtgcagccatcgccgcattgctgtgccaccgtgagcggtatcgccaacgctacctgcgtctgcgactacttgagctccctcgacgacatcaacctggacaaggtgttctacgtcgccgggcagtgcgccgtctccatcccatggttctgcggagtttcctga

SEQ ID NO: 3052 - protein, 113 aa, Sorghum bicolor
  misc_feature: Ceres ANNOT ID no. 6028463
  misc_feature (11)..(111): NCBI GI: 79495992 NCBI Desc: lipid binding [arabidopsis thaliana]
  misc_feature (10)..(110): NCBI GI: 34394084 NCBI Desc: lipid transfer protein-like [oryza sativa (japonica cultivar-group)]
  misc_feature (9)..(102): NCBI GI: 42567284 NCBI Desc: protease inhibitor/seed storage/lipid transfer protein (ltp) family protein [arabidopsis thaliana]
  misc_feature (9)..(107): NCBI GI: 50509338 NCBI Desc: protease inhibitor-like protein [oryza sativa (japonica cultivar-group)]
  misc_feature (10)..(108): NCBI GI: 16555403 NCBI Desc: nonspecific lipid transfer protein [bromus inermis]
MYHQLSSCSRGLAATLLLLLAAATAAAATPEAPTAGAACYNDIVALRSTCYRYVQDEGPMVQPSPHCCATVSGIANATCVCDYLSSLDDINLDKVFYVAGQCAVSIPWFCGVS

SEQ ID NO: 3053 - DNA, 1584 bp, Sorghum bicolor
  misc_feature: Ceres ANNOT ID no. 6028520
  misc_feature: Encodes the peptide sequence at SEQ ID NO 3054
atggcaacgagatcgacccaccgccgtcctctgctgctcatcctcctgttcctcctcctcttcgccgccgtcaacggcagcgcccgccccagcaccagcccgataaagaacgtggtggtgctggcgctggagaaccggtcgttcgaccacatgctgggctggatgcgccgcctgctgggcctccccgtcgacgggctcaccggcgccgagtgcaacccaaactccaccaactccaccacctcctccatctgcgtgtccgccgacgccgacctcgtcgtccccgacgacccgggccactccttcgaggacgtcctggagcaggtcttcggcaacggcaacatctccgccgcgcagccctccatgtcgggcttcgtccgcagcgcgctctccgtcaacgcgctcctctcctccgccgtcatgcgcgccttccgcccctccctcctcccgaccttctccgcgctggcccccgccttcgccgtcttcgaccgctggttctcctccatcccgggccccacgcagcccaaccggctgttcctctactccgccacctcccgcggcgccgtcgcgcacgacaagctcgacctcctcctcggctacccgcagcgcaccatcttcgagtccctcgccgccgacggccacgacttcgccgtctacttcaagaccatccccaccgtgctcttctaccgccgcctccgcgcgctccgctacgccgcgcgcagcttccaccgctacgacgccgccttcaaggaccacgcccgccgcggggtcctcccggcgctctccgtcatcgagcccaggtacttcgacctcacggggacccccgccgacgacgaccacccggcgcacgacgtcgccaacggccagcgcctcgtcaaggacgtgtacgaggcgctccgggccagcccgcagtggaaccagacgctgctcatcgtcacctacgacgagcacggcggcttctacgaccacgtctccacgcccacagccggcgtgcccagccccgacggcatccggggcccgccgcccttcttcttcaagttcgaccgactcggcgtcagggtgcccaccatcatggtctcgccgtggatcaagaagggcaccgtcgtcggccgcgccgtcgggcctacggacacctccgagttcgagcactcctcgatcccggccaccatcaagaagatcttcaacctctcctccgatttcctcaccaagagagacgcgtgggccggtaccttcgagcacatcttcactgaactcgaccaaccaagaacagattgcccagagacattgccagaagtgccatttgtgagaccaacgccacccaaagaacacggctggctctcggatttccagcgggagctcgtcgagctcgcgagcttcctgaacggcgactacatgctgacgagccttgcgcaagagagccggaagaagaagatgacagtgaagcaggccgatgcgtacgtgcggcgagccatcacgagctttctgcaggcgagcaagcaggcggtgcggctgggcgcaaacgaatctgccattgtcaccatgaggtcgtctctgacaagtaagagcagcagctcatcaagcccttga

SEQ ID NO: 3054 - protein, 527 aa, Sorghum bicolor
  misc_feature: Ceres ANNOT ID no. 6028520
  misc_feature (35)..(396): Pfam Id: Phosphoesterase Pfam Desc: Phosphoesterase family
  misc_feature (13)..(520): NCBI GI: 24417137 NCBI Desc: phosphatidylglycerol specific phospholipase c [arabidopsis thaliana]
  misc_feature (8)..(524): NCBI GI: 58652062 NCBI Desc: at1g07230 [arabidopsis thaliana]
  misc_feature (35)..(527): NCBI GI: 115486109 NCBI Desc: os11g0593000 [oryza sativa (japonica cultivar-group)]
  misc_feature (110)..(525): NCBI GI: 115456329 NCBI Desc: os03g0826600 [oryza sativa (japonica cultivar-group)]
  misc_feature (115)..(432): NCBI GI: 89299898 NCBI Desc: phosphoesterase family protein [tetrahymena thermophila sb210]
MATRSTHRRPLLLILLFLLLFAAVNGSARPSTSPIKNVVVLALENRSFDHMLGWMRRLLGLPVDGLTGAECNPNSTNSTTSSICVSADADLVVPDDPGHSFEDVLEQVFGNGNISAAQPSMSGFVRSALSVNALLSSAVMRAFRPSLLPTFSALAPAFAVFDRWFSSIPGPTQPNRLFLYSATSRGAVAHDKLDLLLGYPQRTIFESLAADGHDFAVYFKTIPTVLFYRRLRALRYAARSFHRYDAAFKDHARRGVLPALSVIEPRYFDLTGTPADDDHPAHDVANGQRLVKDVYEALRASPQWNQTLLIVTYDEHGGFYDHVSTPTAGVPSPDGIRGPPPFFFKFDRLGVRVPTIMVSPWIKKGTVVGRAVGPTDTSEFEHSSIPATIKKIFNLSSDFLTKRDAWAGTFEHIFTELDQPRTDCPETLPEVPFVRPTPPKEHGWLSDFQRELVELASFLNGDYMLTSLAQESRKKKMTVKQADAYVRRAITSFLQASKQAVRLGANESAIVTMRSSLTSKSSSSSSP

SEQ ID NO: 3055 - DNA, 216 bp, Sorghum bicolor
  misc_feature: Ceres ANNOT ID no. 6028524
  misc_feature: Encodes the peptide sequence at SEQ ID NO 3056
atggcggactgggggcccgtggtggtggcggtggtgctgttcgtgctgctgtcgccgggcctgctgctgcagctgccggccaagggcggccgcttcgtggagttcggcaacttccagaccagcggcgcctccatcttcgtccacgccatcctcttcttcgcgctcgccgccatcttcctcatcgccatcggggtgcacatcaccacagacccttaa

SEQ ID NO: 3056 - protein, 71 aa, Sorghum bicolor
  misc_feature: Ceres ANNOT ID no. 6028524
  misc_feature (1)..(67): NCBI GI: 115485585 NCBI Desc: os11g0496500 [oryza sativa (japonica cultivar-group)]
  misc_feature (2)..(67): NCBI GI: 1532168 NCBI Desc: localized according to blastn similarity to est sequences; therefore, the coding span corresponds only to an area of similarity since the initation codon and stop codon could not
  misc_feature (2)..(67): NCBI GI: 1532168 (continued) be precisely determined [arabidopsis thaliana]
  misc_feature (3)..(67): NCBI GI: 1532167 NCBI Desc: localized according to blastn similarity to est sequences; therefore, the coding span corresponds only to an area of similarity since the initation codon and stop codon could not
  misc_feature (3)..(67): NCBI GI: 1532167 (continued) be precisely determined [arabidopsis thaliana]
  misc_feature (1)..(48): NCBI GI: 10178281 NCBI Desc: katanin p80 subunit-like protein [arabidopsis thaliana]
  misc_feature: Useful for making plants with altered cell wall content and/or composition
  misc_feature: Functional homolog of the protein sequence encoded by LOCUS at5g63500
MADWGPVVVAVVLFVLLSPGLLLQLPAKGGRFVEFGNFQTSGASIFVHAILFFALAAIFLIAIGVHITTDP

SEQ ID NO: 3057 - DNA, 1008 bp, Sorghum bicolor
  misc_feature: Ceres ANNOT ID no. 6028535
  misc_feature: Encodes the peptide sequence at SEQ ID NO 3058
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
atggcggcttcgccggcttgtgctccggtcctcgtctccggccccacgctccctccgcagcccgttcccttccgctgctaccgggcccaaaagccttcctccgcgtcgtccacctcctggcgcccgcgccgcaggcggttcgttctggttgcagctgcctccacccgcacctcccctgcggccgctcggggcctcgacgccgacgacttccgccacccgctcgacaagcagaacactctgctgctaagagcgattcctgggctcaacgacatcggcaaagctttgttaggacccgtctcggagcaagttatggtcctccagaacattggaacatcagttctcgtctccccaaaccagcttccagatctccaccaactgctggctgaggctgcaacgctcttgaacacggaagctcctgacttgtacataaggcagaatcctgttccaaatgcttacaccttagcaatcaatggcaaaaaaccattcattgtcgttcacacaagccttgtggagctgcttactccaaaggaattgcaggctgttttggctcatgagctgggtcacctcaagtgcgatcatggtgtatggctcactttcgccaatatactcacaatgggagcatacactgtccctggttttggcatggttgctggcttcctggaagagcagctatacaggtggctacgtgctgcagagctgacttgtgacagggcagctcttcttgtggtgcaagacccaaaggttgtcatctctgttctgatgaaattggccggaggatgcccatctcttgccgaccagttaaacgtggatgccttcttggagcaagctcgttcctacgacaaagctgcatcaaacccagttgggtggtacatccggaatgcacaaaccagagagctttcacaccctttgcctgtgatgcgagcccgagagatcgatgagtggtcaagaagccaggagtacaagaccacaatgcaaaaaatgcttcagctggggctaaatagggtatag

SEQ ID NO: 3058 - protein, 335 aa, Sorghum bicolor
  misc_feature: Ceres ANNOT ID no. 6028535
  misc_feature (127)..(321): Pfam Id: Peptidase_M48 Pfam Desc: Peptidase family M48
  misc_feature (2)..(333): NCBI GI: 57899210 NCBI Desc: peptidase m48-like [oryza sativa (japonica cultivar-group)]
  misc_feature (64)..(320): NCBI GI: 126659907 NCBI Desc: peptidase m48, ste24p [cyanothece sp. ccy0110]
  misc_feature (64)..(324): NCBI GI: 75907656 NCBI Desc: peptidase m48, ste24p [anabaena variabilis atcc 29413]
  misc_feature (53)..(325): NCBI GI: 86609607 NCBI Desc: peptidase, m48a family [cyanobacteria bacterium yellowstone b-prime]
  misc_feature (64)..(327): NCBI GI: 113475574 NCBI Desc: peptidase m48, ste24p [trichodesmium erythraeum ims101]
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
MAASPACAPVLVSGPTLPPQPVPFRCYRAQKPSSASSTSWRPRRRRFVLVAAASTRTSPAAARGLDADDFRHPLDKQNTLLLRAIPGLNDIGKALLGPVSEQVMVLQNIGTSVLVSPNQLPDLHQLLAEAATLLNTEAPDLYIRQNPVPNAYTLAINGKKPFIVVHTSLVELLTPKELQAVLAHELGHLKCDHGVWLTFANILTMGAYTVPGFGMVAGFLEEQLYRWLRAAELTCDRAALLVVQDPKVVISVLMKLAGGCPSLADQLNVDAFLEQARSYDKAASNPVGWYIRNAQTRELSHPLPVMRAREIDEWSRSQEYKTTMQKMLQLGLNRV

SEQ ID NO: 3059 - DNA, 1602 bp, Sorghum bicolor
  misc_feature: Ceres ANNOT ID no. 6028537
  misc_feature: Encodes the peptide sequence at SEQ ID NO 3060
  misc_feature: Up-regulated in shoot tissues in response to salicylic acid treatment
atggaggcggcggcggagatggcgctgcgcctccgggcggcggccaacgaccgcctggcgggctacgagccgctggccctcgtcgccgcgccgctcctcgcgctcctcgtcgcgcggaccctccacgccgccgccaacgccgtcgccgaccggggcctcgtcgccatcgccatcgccgccgtcaagttgctgccgggagtctccggctacatcgcggcggagaagaagaaggttgttgacaagatgcaatccggtggggccaagaacgatcggcgagctgacttgccaactattggccttggcgagcaagtgatagaagagcttgaaacactgaaagccaaagatgtagactggcagggaaaatgctctggcacagtatatattgctggaagtgagtctgagggccattttgaattgataaacaaggcggtatctatgttttcacacaccaatccgctccatcaagatgtattcaagagtgtggcaaacatggaagctgaagtagttgcaatgacagctgctttacttggcagcaaagaaaaatcatctggtggacaaatttgcggcaacatgacatcaggtggaactgaaagcatattattagcagtcaaaacaacacgtgactatatgcgatcaaagaaagggattacaaagcctgaaattataatggctgaatcagcacattctgcgtacgacaaagctgctgaatacttcaatattaaagtgcggcgtgtacctgtgaacaaagagtttcttgcagatgtgaaaggattcaaacgatgcataaatggaaacactataatgatgattggatctgcaccaggatttccacatggtttaattgatcctattgaggaacttggggaactggcttcacgctatgacatttgcttgcatattgatttatgccttggtggcttcgtactgccttttgctcgtaagcttgggtaccctattcctccttttgatttttctgtcaagggtgttacatcaatctcatcagatgttcataagtacggattagcaccaaaaggcacaagtattgttctgtacagaaatcatgaaattagaaagcatcaatttgttgctgttactgagtggaccggtgggctttatgtttctcccactatggctggaagcaggccaggtggattaattgcgggagcctgggctgctatgatgtctctcggactgaatggctacttggacaatacaaggtgtgtcatggaagtttcgaagaaaatacaaagagggattggagaaatcccagggttgtttgtgattgggaaaccagatatgaccattgtggcgtttggctcagatgttgtcgacatatttgaggtgaacgacataatgtcatcaaaaggttggcatctcaatgctctgcagagacctaacagtttgcacatctgtgtgacccttcaacacacgactatttacgaccaattcctgaaggatctgcaagattctgtggacactgtgaaagcaaacccaggccctattagcggcggaatggctcctatctacggcgccgcagggaagatgccagacagaggcacggtgagggagctgcttgtggagttcatggacagctcttgctga

SEQ ID NO: 3060 - protein, 533 aa, Sorghum bicolor
  misc_feature: Ceres ANNOT ID no. 6028537
  misc_feature (109)..(441): Pfam Id: Pyridoxal_deC Pfam Desc: Pyridoxal-dependent decarboxylase conserved domain
  misc_feature (1)..(533): NCBI GI: 62632703 NCBI Desc: sphingosine-1-phosphate lyase [oryza sativa (japonica cultivar-group)]
  misc_feature (1)..(533): NCBI GI: 110816414 NCBI Desc: sphingosine-1-phosphate lyase precursor (sp-lyase) (spl) (sphingosine-1-phosphate aldolase)
  misc_feature (1)..(533): NCBI GI: 115433964 NCBI Desc: os01g0100900 [oryza sativa (japonica cultivar-group)]
  misc_feature (95)..(530): NCBI GI: 115377564 NCBI Desc: sphingosine-1-phosphate lyase 1 [stigmatella aurantiaca dw4/3-1]
  misc_feature (45)..(531): NCBI GI: 118061560 NCBI Desc: pyridoxal-dependent decarboxylase [roseiflexus castenholzii dsm 13941]
  misc_feature (1)..(533): SWISSPROT Homolog: EC 4.1.2.27 Sphingosine-1-phosphate lyase precursor
  misc_feature: Up-regulated in shoot tissues in response to salicylic acid treatment
MEAAAEMALRLRAAANDRLAGYEPLALVAAPLLALLVARTLHAAANAVADRGLVAIAIAAVKLLPGVSGYIAAEKKKVVDKMQSGGAKNDRRADLPTIGLGEQVIEELETLKAKDVDWQGKCSGTVYIAGSESEGHFELINKAVSMFSHTNPLHQDVFKSVANMEAEVVAMTAALLGSKEKSSGGQICGNMTSGGTESILLAVKTTRDYMRSKKGITKPEIIMAESAHSAYDKAAEYFNIKVRRVPVNKEFLADVKGFKRCINGNTIMMIGSAPGFPHGLIDPIEELGELASRYDICLHIDLCLGGFVLPFARKLGYPIPPFDFSVKGVTSISSDVHKYGLAPKGTSIVLYRNHEIRKHQFVAVTEWTGGLYVSPTMAGSRPGGLIAGAWAAMMSLGLNGYLDNTRCVMEVSKKIQRGIGEIPGLFVIGKPDMTIVAFGSDVVDIFEVNDIMSSKGWHLNALQRPNSLHICVTLQHTTIYDQFLKDLQDSVDTVKANPGPISGGMAPIYGAAGKMPDRGTVRELLVEFMDSSC

SEQ ID NO: 3061 - DNA, 1209 bp, Sorghum bicolor
  misc_feature: Ceres ANNOT ID no. 6028554
  misc_feature: Encodes the peptide sequence at SEQ ID NO 3062
atgtcgtcgtggtcgtcgccctcagccgccgccgccgccaacacgggcgcccgattcggccccttcccttgccgagcgctgcggctcgcgccgtatccgtcgctcgcccggggagcccccgcctcgccgccgctcgtcctcaggtcccacccccacccgggcggccgtggccatggcctcctcgcgcgcaccggcggctcctctccctcctcgcggtgccgcgccgtcgccgccgaggtcgagggcctcaacatcgccgacaacgtcacccagctcatcggcaagacaccaatggtgtatctcaacaacgtcgtcaagggctcggtcgccaatgttgctgctaagctcgagattatggagccctgttgtagtgtcaaggacaggatagggtacagtatgataaatgatgctgaagagaggggcttgattactcctggaaagagtgttttggtggaagcaacaagtggaaatacaggcatcggtcttgcctttattgctgcatccaaaggatataagttgatattaacaatgccttcatcaatgagcatggagagaagagtcctactcagagcatttggtgccgaacttgtccttactgatgctgcaaaagggatgaaaggggccgtagataaggctacagagattttaaataagacacctaactcttacatgcttcaacagtttgataaccctgccaaccctaaggtacattatgagactaccggtccagagatctgggaggattcaaaggggaaggtagatatattcattggtggaattggaacaggggggacaatatctggtgctggccgtttcttaaaggagaaaaatcctggaattaaggttattggtattgagccttctgaaagtaacatactctccggtggaaaacctggtccacataagattcagggaattggcgcagggtttgttccaaggaacttggatagcgatattcttgatgaagtaattgagatatcaagtgatgaagctgttgagacagcaaaacagctggctgttcaggaaggattactggtgggaatctcctctggagcagctgccgccgctgccataaaggttgccaaaagaccagaaaatgctggaaagctgatagtggttgtgtttccgagctttggcgagaggtacctttcaactgtcctctatcagtccataagagaagaatgcgaaaacatgcagcctgagccatga

SEQ ID NO: 3062 - protein, 402 aa, Sorghum bicolor
  misc_feature: Ceres ANNOT ID no. 6028554
  misc_feature (89)..(377): Pfam Id: PALP Pfam Desc: Pyridoxal-phosphate dependent enzyme
  misc_feature (67)..(401): NCBI GI: 12644209 NCBI Desc: cysteine synthase, chloroplast precursor (o-acetylserine sulfhydrylase) (o-acetylserine (thiol)-lyase) (csase b) (cs-b) (oas-tl b)
  misc_feature (67)..(401): NCBI GI: 303902 NCBI Desc: cysteine synthase [spinacia oleracea]
  misc_feature (69)..(401): NCBI GI: 12081919 NCBI Desc: plastidic cysteine synthase 1 [solanum tuberosum]
  misc_feature (67)..(401): NCBI GI: 312944 NCBI Desc: cysteine synthase [spinacia oleracea]
  misc_feature (70)..(402): NCBI GI: 59799343 NCBI Desc: chloroplast cysteine synthase gcs2 [allium sativum]
  misc_feature (67)..(401): SWISSPROT Homolog: EC 2.5.1.47 Cysteine synthase, chloroplast/chromoplast precursor
MSSWSSPSAAAAANTGARFGPFPCRALRLAPYPSLARGAPASPPLVLRSHPHPGGRGHGLLARTGGSSPSSRCRAVAAEVEGLNIADNVTQLIGKTPMVYLNNVVKGSVANVAAKLEIMEPCCSVKDRIGYSMINDAEERGLITPGKSVLVEATSGNTGIGLAFIAASKGYKLILTMPSSMSMERRVLLRAFGAELVLTDAAKGMKGAVDKATEILNKTPNSYMLQQFDNPANPKVHYETTGPEIWEDSKGKVDIFIGGIGTGGTISGAGRFLKEKNPGIKVIGIEPSESNILSGGKPGPHKIQGIGAGFVPRNLDSDILDEVIEISSDEAVETAKQLAVQEGLLVGISSGAAAAAAIKVAKRPENAGKLIVVVFPSFGERYLSTVLYQSIREECENMQPEP

SEQ ID NO: 3063 - DNA, 234 bp, Sorghum bicolor
  misc_feature: Ceres ANNOT ID no. 6028573
  misc_feature: Encodes the peptide sequence at SEQ ID NO 3064
atggctacctccagattccacatgacctgcgctctcctcctacttggtgtcgtgctgctggggcagcaggggatagagggcgccgttgcctgcccccagtactgcctcgaagtggactacgtgacctgcccgtcgtccggctccgagaagctcccggcgaggtgcaactgctgcctggcgcccaaaggctgcacgctccatctctccgacgggacgcagcagacttgctcttag

SEQ ID NO: 3064 - protein, 77 aa, Sorghum bicolor
  misc_feature: Ceres ANNOT ID no. 6028573
  misc_feature (28)..(78): Pfam Id: Prot_inhib_II Pfam Desc: Potato type II proteinase inhibitor family
  misc_feature (14)..(77): NCBI GI: 37202046 NCBI Desc: at1g72060 [arabidopsis thaliana]
  misc_feature (1)..(72): NCBI GI: 1161572 NCBI Desc: proteinase inhibitor ii [lycopersicon esculentum]
  misc_feature (30)..(72): NCBI GI: 46396269 NCBI Desc: proteinase inhibitor psi-1.2
  misc_feature (1)..(72): NCBI GI: 76446068 NCBI Desc: trypsin proteinase inhibitor precursor [nicotiana corymbosa]
  misc_feature (12)..(72): NCBI GI: 3913937 NCBI Desc: proteinase inhibitor type ii tr8 precursor
MATSRFHMTCALLLLGVVLLGQQGIEGAVACPQYCLEVDYVTCPSSGSEKLPARCNCCLAPKGCTLHLSDGTQQTCS

SEQ ID NO: 3065 - DNA, 1578 bp, Sorghum bicolor
  misc_feature: Ceres ANNOT ID no. 6028592
  misc_feature: Encodes the peptide sequence at SEQ ID NO 3066
atggagagggtgctcaaggatgacgccgtccaggagaagggcgagcgcgccaggatggcatcgtttattggggccatggcaatcgcagatttgattaagaccacattgggaccaaaaggaatggacaagatcctgcaatcaactggcagagggcgtaatgttactgttacaaatgatggggctaccattctgaagtcacttcacattgacaatcctgctgcaaaggtccttgttgacatctcgaaagttcaagatgatgaagttggtgatgggacaacttctgtcgttgttctagctggagaacttttgaaggaggctgagaagttagttaacatgaaaattcatccaatgactatcattgcaggttacagaatggctctcgagtgtgccagagatactttgctacaaaagaccatggacaacaaagaaaatacagataagttcagaactgatctcatgaatattgctatgactactcttagttcaaaaattctttcccaagacaaggagtactttgctgaacttgcggttgatgctgtcttgaggcttaagggtagcaccaacttggaatctattcaaattctgaagaaacctggaggatctcttaaggattcctttttggacgaagggttcattcttgacaagaaaattggcattgggcagccaaagcgcattgagaatgccaaaattttggttgcaaacactgctatggacacagataaagttaagatatatggggcacgggttcgggtggattcgatgtctaaggttgcagatattgaagctgctgagaagcagaaaatgagagagaaagtccaaaagatcataggtcacggaatcaactgtttcgtcaacaggcagttaatctataacttccctgaggaactctttgctgacgctggcatacttgcaattgagcatgctgactttgagggaattgaacggctagctcttgttactggtggtgagatcgcatcaacttttgataacccagagtctgttaagcttggtcattgcaaggttattgaagagattatgattggtgaggacaggctaattcatttctctggggttgcgatggggcaggcttgcaccattgtcctaagaggggctagcgagcatgtacttgatgaggctgagaggtcattgcatgatgccttgtgtgtgctgtcccagacagtaaatgatactcgtgtcttgtttggaggcggatggcctgagatggtgatggccaaagaagtagatgaacttgcaaggaagacccctgggaagaaatctcatgctattgatgctttctcgcgtgctctgcaagccatcccaacaatcatagctgataatgctggtttggatagcgctgagttgatctctcagctccgagctgagcaccacaaagagaactgcactgctggaattgatgtcatcacaggctccgttggggatatgcaaaagctggggattcaagagtcgttcaaggtaaagcaggccatccttctgtctgcgacagaggctgctgagatgatcctcagggtcgatgagatcataacatgtgccccgcgcagaagagaggataggatgtga

SEQ ID NO: 3066 - protein, 525 aa, Sorghum bicolor
  misc_feature: Ceres ANNOT ID no. 6028592
  misc_feature (28)..(518): Pfam Id: Cpn60_TCP1 Pfam Desc: TCP-1/cpn60 chaperonin family
  misc_feature (4)..(525): NCBI GI: 92891163 NCBI Desc: protein kinase; groel-like chaperone, atpase [medicago truncatula]
  misc_feature (4)..(521): NCBI GI: 49522488 NCBI Desc: chaperonin containing tcp1, subunit 2 (beta) [xenopus tropicalis]
  misc_feature (4)..(521): NCBI GI: 27503862 NCBI Desc: cct2-prov protein [xenopus laevis]
  misc_feature (4)..(521): NCBI GI: 61368892 NCBI Desc: chaperonin containing tcp1 subunit 2 [synthetic construct]
  misc_feature (4)..(521): NCBI GI: 119617635 NCBI Desc: chaperonin containing tcp1, subunit 2 (beta), isoform cra_b [homo sapiens]
MERVLKDDAVQEKGERARMASFIGAMAIADLIKTTLGPKGMDKILQSTGRGRNVTVTNDGATILKSLHIDNPAAKVLVDISKVQDDEVGDGTTSVVVLAGELLKEAEKLVNMKIHPMTIIAGYRMALECARDTLLQKTMDNKENTDKFRTDLMNIAMTTLSSKILSQDKEYFAELAVDAVLRLKGSTNLESIQILKKPGGSLKDSFLDEGFILDKKIGIGQPKRIENAKILVANTAMDTDKVKIYGARVRVDSMSKVADIEAAEKQKMREKVQKIIGHGINCFVNRQLIYNFPEELFADAGILAIEHADFEGIERLALVTGGEIASTFDNPESVKLGHCKVIEEIMIGEDRLIHFSGVAMGQACTIVLRGASEHVLDEAERSLHDALCVLSQTVNDTRVLFGGGWPEMVMAKEVDELARKTPGKKSHAIDAFSRALQAIPTIIADNAGLDSAELISQLRAEHHKENCTAGIDVITGSVGDMQKLGIQESFKVKQAILLSATEAAEMILRVDEIITCAPRRREDRM

SEQ ID NO: 3067 - DNA, 957 bp, Sorghum bicolor
  misc_feature: Ceres ANNOT ID no. 6028603
  misc_feature: Encodes the peptide sequence at SEQ ID NO 3068
atggcggccgcctcgaggggcctgctcgcgcgcctccgcggcctctcactctctgccggcgggagcccgcgcctccccttcccgccttcccggctcttctccgcggaggccttcgtctcccattccgacgacgacgacgctgggggcgagggcggcggcgggggccggatcatcgaggcgcgggccggggtgatgggccccacatcgcggcgcaccggcgtgatcggcgtcaagtgcgggatgtcggcgatgtgggacaagtggggcgccaaggtgcccatcaccgtcctctgggtcgacgacaacgttgttacccaggtcaagaccgccgagaaggagggtttcttcgccctacagcttggcgcaggtcaaaagaaggaaaaacacctaacaaagcctgaagttggccactttagagcacagggagtgcctctgaagagaaagctaagggaatttcctgtcactgaggatgcgcttcttcctgttggcacaaccatcacagttcgccactttttgcctggacaatttgttgatgtcactggaatcacgaaggggaaaggttttgcgggtgtaatgaaaaaacatggtttcagtggggggcctgcatcacatggggcatctttgtcgcatcgcagtggtggctctactggtcaaagagatgctcctggaagggttttcaaaaacagaaaaatgcctggacgcatgggtggtgtgcaacgcacagtgaagaatgtatgggtttaccaaatagacccagccaggaacttactatatctgaagggccaggttcctggtcctcaaggtagctttgttttcgttaaggattctatatacaagaaacctgacacagctttgctcccatttcctacatatttcacgcaagaaggcgagcctgaagacttggagcccctgattgctgatcttggtgatgttgatccattcatggcagctgattaa

SEQ ID NO: 3068 - protein, 318 aa, Sorghum bicolor
  misc_feature: Ceres ANNOT ID no. 6028603
  misc_feature (78)..(274): Pfam Id: Ribosomal_L3 Pfam Desc: Ribosomal protein L3
  misc_feature (1)..(318): NCBI GI: 18401521 NCBI Desc: ribosomal protein l3 family protein [arabidopsis thaliana]
  misc_feature (56)..(318): NCBI GI: 140052871 NCBI Desc: translation factor [medicago truncatula]
  misc_feature (56)..(318): NCBI GI: 92877897 NCBI Desc: translation factor [medicago truncatula]
  misc_feature (68)..(313): NCBI GI: 146185729 NCBI Desc: ribosomal protein l3 containing protein [tetrahymena thermophila sb210]
  misc_feature (71)..(300): NCBI GI: 109893532 NCBI Desc: 50s ribosomal protein l3
MAAASRGLLARLRGLSLSAGGSPRLPFPPSRLFSAEAFVSHSDDDDAGGEGGGGGRIIEARAGVMGPTSRRTGVIGVKCGMSAMWDKWGAKVPITVLWVDDNVVTQVKTAEKEGFFALQLGAGQKKEKHLTKPEVGHFRAQGVPLKRKLREFPVTEDALLPVGTTITVRHFLPGQFVDVTGITKGKGFAGVMKKHGFSGGPASHGASLSHRSGGSTGQRDAPGRVFKNRKMPGRMGGVQRTVKNVWVYQIDPARNLLYLKGQVPGPQGSFVFVKDSIYKKPDTALLPFPTYFTQEGEPEDLEPLIADLGDVDPFMAAD

SEQ ID NO: 3069 - DNA, 1401 bp, Sorghum bicolor
  misc_feature: Ceres ANNOT ID no. 6028620
  misc_feature: Encodes the peptide sequence at SEQ ID NO 3070
atggcgagggaaccaagtcctgaaatagatgacgaacttttcaatgaagtttatgggaaagcatacagtggcccagttgcatcagctgcaaatagtgcgactcctaaagtaaatgctgagaagaggcccctgactcgtgataagtccgatgatgaagacgaggccccagatcctaatgctgttcctacggacttcactagccgagaggctaaggtctgggaggctaaagctaaggctactgaaaggaactggaagaagaggaaggaggaagaaatgatttgtaaaatatgtggagactcaggccattttactcagggttgtccctccacacttggggcaaataggagaaatgcagatttttttgaaagagttccagcaagagataagcaagtcagggatcttttcaatgataggataataagccagattgagagagatgtggggtgtaaaatcagaatggatgagaagttcctgtttgtcagtggaaaggataggttaatattagccaaaggtgtggatgctgtgcataaaattattcaagagggtaaaggcaaacatagtccaagcagtccgaaaccggatcgctctagatcgcctgtacgaaacactactgagtttcgacccagacactctgattctcatcgctcacatagccccagaaattatgattctcaacggtcccatagtccaagaaatgcatcacactctcaaagtaaaggataccataatgaaaggcatctagatggtcgcttacacaacaatatgcccaggttttcaaaaggctcttcacaagctcatgccaacttcggagcaaaaggtcgtccagcccaatcaaaatctccacgccatacctcttatcttgatgaatttcctagaacacatggcgagaataaccaatttgcttcacacgtgcccaatgactggggaattgagaggcatggagcagatggctcttcaagtcttaagtttgaaatgccatcccaccaacagaccttggaagagcttgagttggagtttaaaagggaagctacacaattagctagagctcgtgaccaagaggaggatgaagagaaccacaggcatcgagagtcgctgagagtgattagagaaaattacatggagagagtgattaccatgaggaatttgcattcaaggaagtgggaagaatttcttgaacaaacctttaaaaggcaacaagcacagccttcgtacacacaaactggctatccaggttttgagcagaggacgacacatatctcagctacacatcaaccaatggattcaaagagaacatatccatatgcttctgatagctattcagccccaaaggctcatgctgcatatggtgagtttcagcatgagaggcatgatgatcttgggaggacctatgggcgatattaa

SEQ ID NO: 3070 - protein, 466 aa, Sorghum bicolor
  misc_feature: Ceres ANNOT ID no. 6028620
  misc_feature (1)..(400): NCBI GI: 140045911 NCBI Desc: zinc finger, cchc-type [medicago truncatula]
  misc_feature: Useful for making plants with altered alkaloid content
  misc_feature: GREAT-hit functional homolog of the protein sequence given in SEQ ID NO 13325
MAREPSPEIDDELFNEVYGKAYSGPVASAANSATPKVNAEKRPLTRDKSDDEDEAPDPNAVPTDFTSREAKVWEAKAKATERNWKKRKEEEMICKICGDSGHFTQGCPSTLGANRRNADFFERVPARDKQVRDLFNDRIISQIERDVGCKIRMDEKFLFVSGKDRLILAKGVDAVHKIIQEGKGKHSPSSPKPDRSRSPVRNTTEFRPRHSDSHRSHSPRNYDSQRSHSPRNASHSQSKGYHNERHLDGRLHNNMPRFSKGSSQAHANFGAKGRPAQSKSPRHTSYLDEFPRTHGENNQFASHVPNDWGIERHGADGSSSLKFEMPSHQQTLEELELEFKREATQLARARDQEEDEENHRHRESLRVIRENYMERVITMRNLHSRKWEEFLEQTFKRQQAQPSYTQTGYPGFEQRTTHISATHQPMDSKRTYPYASDSYSAPKAHAAYGEFQHERHDDLGRTYGRY

SEQ ID NO: 3071 - DNA, 552 bp, Sorghum bicolor
  misc_feature: Ceres ANNOT ID no. 6028625
  misc_feature: Encodes the peptide sequence at SEQ ID NO 3072
atggccggagcccgcgtgctgctcatcgtcctcgcggctgccgtcgcgctcctggccgcacgcccggtggcggccaccgggggagttgccggtgtggaagaagtctgcaggagcacacctttcccggatctgtgcaccaggacggcggggaagcacgccgagaagtacaaggtcgtggacgcggtgacggtgctggagatgcaggtggacgcgttcaagaagcgcgtcaaggcggcgcggagggtcgcgaagcaggaggtgaagacggcggcgccgacgcccttggtgcggagggcgctgaacctctgcaagagctactacctggacgccggggacaacctcggcgcctgcaagcgcgccatcggcttcagggacgccgtcaccatccgcgccaccatgagcatggtggcacaggacatgcagaattgcgacgaggagttcaggaaggccggctccaccaaccccatggaggaccacaacaggtcgctcatcgagatgtccgagatctgccgcacgctctccaacatggtcccttacgaacatacccattga

SEQ ID NO: 3072 - protein, 183 aa, Sorghum bicolor
  misc_feature: Ceres ANNOT ID no. 6028625
  misc_feature (26)..(173): Pfam Id: PMEI Pfam Desc: Plant invertase/pectin methylesterase inhibitor
  misc_feature (31)..(179): NCBI GI: 92895946 NCBI Desc: pectinesterase inhibitor [medicago truncatula]
  misc_feature (7)..(173): NCBI GI: 3582002 NCBI Desc: tomato invertase inhibitor [lycopersicon esculentum]
MAGARVLLIVLAAAVALLAARPVAATGGVAGVEEVCRSTPFPDLCTRTAGKHAEKYKVVDAVTVLEMQVDAFKKRVKAARRVAKQEVKTAAPTPLVRRALNLCKSYYLDAGDNLGACKRAIGFRDAVTIRATMSMVAQDMQNCDEEFRKAGSTNPMEDHNRSLIEMSEICRTLSNMVPYEHTH

SEQ ID NO: 3073 - DNA, 507 bp, Sorghum bicolor
  misc_feature: Ceres ANNOT ID no. 6028628
  misc_feature: Encodes the peptide sequence at SEQ ID NO 3074
atggcaggagcccgcaccctgctcctcctcctcgtcgcggcgctctgcttagccaccgtgaacgcggcgacgctggcggagatctgcaaggggacggcgttcccggacatctgcaccagcacggtggggccggaggcggcgagcaacccggtgctggacccgatggcggtgctgcggatgcaggtggacgccttcaaccagcgcacggaggcggcgagggcgcacgtcaaggaggcggccatgacggcgtccccgaaggcgcggacggtgctggacctgtgcaacaacctgtacctggacgtggaggacaacctgggagcctgccgccgcgccatcggcttcaaggacgccgtcaccatccgcgccaccatgggcatggcggcgcaggacatgcagaactgcgacgagcagttcaggcagatcggcgagcccaaccccatggagcagttcgacgcgtcgctcgtcgagatgtccgagaactgccgctcgctctccaacatgatctga

SEQ ID NO: 3074 - protein, 168 aa, Sorghum bicolor
  misc_feature: Ceres ANNOT ID no. 6028628
  misc_feature (19)..(164): Pfam Id: PMEI Pfam Desc: Plant invertase/pectin methylesterase inhibitor
  misc_feature (28)..(168): NCBI GI: 22330888 NCBI Desc: invertase/pectin methylesterase inhibitor family protein [arabidopsis thaliana]
  misc_feature (19)..(168): NCBI GI: 92895946 NCBI Desc: pectinesterase inhibitor [medicago truncatula]
  misc_feature (22)..(168): NCBI GI: 71034461 NCBI Desc: pectin methylesterase inhibitor [brassica oleracea var. botrytis]
  misc_feature (25)..(168): NCBI GI: 15217788 NCBI Desc: invertase/pectin methylesterase inhibitor family protein [arabidopsis thaliana]
  misc_feature (1)..(168): NCBI GI: 4874271 NCBI Desc: t16b5.9 [arabidopsis thaliana]
MAGARTLLLLLVAALCLATVNAATLAEICKGTAFPDICTSTVGPEAASNPVLDPMAVLRMQVDAFNQRTEAARAHVKEAAMTASPKARTVLDLCNNLYLDVEDNLGACRRAIGFKDAVTIRATMGMAAQDMQNCDEQFRQIGEPNPMEQFDASLVEMSENCRSLSNMI

SEQ ID NO: 3075 - DNA, 1587 bp, Sorghum bicolor
  misc_feature: Ceres ANNOT ID no. 6028630
  misc_feature: Encodes the peptide sequence at SEQ ID NO 3076
atgtcgctgcgcccgagcgagcgggtcgaggtgcggcggaaccgctacaaggtggcggttgacgcggaggaggggcgccggcggcgcgaggacaatatggtggagatccgcaagaaccgccgcgaggagagcctgctcaagaggcgccgcgaggggctccaggcccagttccctgcccctccctccggggtcgagaagaagcttgaaagcctcccagctatggttagtggggtttactcggatgacaataaccttcagcttgatgccaccacacagttccgcaagttgctctctatagagaggagcccccccattgaagaagttataaaatctggtgtagttccaagatttgtgcagttcctcaccagagaggatttcccccagctgcagttcgaagcagcatgggctctcacaaatattgcttctggcacttcagaaaatacaaaggttgttattgatcatggggctgttcctatatttgtgaagcttcttgggtctgctagtgatgatgttcgtgagcaggctgtgtgggctctggggaatgttgctggtgactctccgaagtgccgcgaccttgttcttgccaatggtgcgttgatgcctctgctagcccagttgaacgagcatgctaagctctccatgttgaggaatgccacttggactttatctaacttctgcaggggaaagccacagccatcatttgatcagactaagcctgctctgccagcacttgcacgacttatccattccaacgatgaggaagttctcactgatgcatgctgggctctgtcatacttatctgatggcactaatgataagatccaagctgtgattgaagctggtgtttgcccccggcttgtggagctcctcctccatccatcaccatcagtgcttatacctgctctacgaactgttgggaacattgtcactggagatgatatgcaaactcagtgtatcattgatcatcaagctcttcctcgcctcctgaatctattgacacagaaccacaagaaaagcattaagaaagaggcatgctggacgatttcaaatattactgctggaaacaaagatcagatacaggctgtcataagtgctggcattatcgctcctttgttgcaactgctccaaacagcagagtttgatatcaagaaggaggctgcttgggccatctcaaatgctacctctggtggttcccatgagcaaatcaagtacttggtggcagagggctgcatcaagccattgtgcgaccttcttgtttgccctgatccaagaattgtaacagtttgtctggagggtcttgagaatattcttaaagtgggggagtatgacaagaacatgggtggtgcaacagctgatggcaatctctttgctcagatgattgatgaagcggaaggcctggaaaagattgagaacctacagagccacgatattaatgaaatctatgaaaaggctgtgaagcttcttgaggcatactggatggaggaggaagatgacacaatggctactgctgcggaagctggtcccactgtttttgacttcagccaaggtggcaaccctcctgctggtggtggtttgaacttcaactga

SEQ ID NO: 3076 - protein, 528 aa, Sorghum bicolor
  misc_feature: Ceres ANNOT ID no. 6028630
  misc_feature (398)..(438): Pfam Id: Arm Pfam Desc: Armadillo/beta-catenin-like repeat
  misc_feature (101)..(142): Pfam Id: Arm Pfam Desc: Armadillo/beta-catenin-like repeat
  misc_feature (186)..(227): Pfam Id: Arm Pfam Desc: Armadillo/beta-catenin-like repeat
  misc_feature (229)..(268): Pfam Id: Arm Pfam Desc: Armadillo/beta-catenin-like repeat
  misc_feature (144)..(184): Pfam Id: Arm Pfam Desc: Armadillo/beta-catenin-like repeat
  misc_feature (270)..(310): Pfam Id: Arm Pfam Desc: Armadillo/beta-catenin-like repeat
  misc_feature (312)..(353): Pfam Id: Arm Pfam Desc: Armadillo/beta-catenin-like repeat
  misc_feature (355)..(395): Pfam Id: Arm Pfam Desc: Armadillo/beta-catenin-like repeat
  misc_feature (4)..(92): Pfam Id: IBB Pfam Desc: Importin beta binding domain
  misc_feature (150)..(186): Pfam Id: HEAT Pfam Desc: HEAT repeat
  misc_feature (1)..(517): NCBI GI: 62900360 NCBI Desc: importin alpha-1a subunit
  misc_feature (1)..(517): NCBI GI: 33337497 NCBI Desc: importin [oryza sativa]
  misc_feature (1)..(523): NCBI GI: 119866037 NCBI Desc: impa2 [nicotiana benthamiana]
  misc_feature (1)..(523): NCBI GI: 13752562 NCBI Desc: importin alpha 2 [capsicum annuum]
  misc_feature (1)..(528): NCBI GI: 119866035 NCBI Desc: impa1 [nicotiana benthamiana]
  misc_feature: The sequence is a functional homolog of SEQ ID NO. 309 in the 11/188,298 US application
MSLRPSERVEVRRNRYKVAVDAEEGRRRREDNMVEIRKNRREESLLKRRREGLQAQFPAPPSGVEKKLESLPAMVSGVYSDDNNLQLDATTQFRKLLSIERSPPIEEVIKSGVVPRFVQFLTREDFPQLQFEAAWALTNIASGTSENTKVVIDHGAVPIFVKLLGSASDDVREQAVWALGNVAGDSPKCRDLVLANGALMPLLAQLNEHAKLSMLRNATWTLSNFCRGKPQPSFDQTKPALPALARLIHSNDEEVLTDACWALSYLSDGTNDKIQAVIEAGVCPRLVELLLHPSPSVLIPALRTVGNIVTGDDMQTQCIIDHQALPRLLNLLTQNHKKSIKKEACWTISNITAGNKDQIQAVISAGIIAPLLQLLQTAEFDIKKEAAWAISNATSGGSHEQIKYLVAEGCIKPLCDLLVCPDPRIVTVCLEGLENILKVGEYDKNMGGATADGNLFAQMIDEAEGLEKIENLQSHDINEIYEKAVKLLEAYWMEEEDDTMATAAEAGPTVFDFSQGGNPPAGGGLNFN

SEQ ID NO: 3077 - DNA, 3378 bp, Sorghum bicolor
  misc_feature: Ceres ANNOT ID no. 6028642
  misc_feature: Encodes the peptide sequence at SEQ ID NO 3078
  misc_feature: Up-regulated in shoot tissues in response to salicylic acid treatment
atgtcgtcgctcagccgcgagctcgtcttcctcatcctccagttcctcgacgaggagaagttcaaggagaccgtgcacaagcttgagcaagagtcaggcttcttcttcaacatgaagtacttcgaggagaaggtccatgctggggagtgggatgaggtggagaaatacttgtcaggtttcaccaaggtagatgacaataggtattcaatgaagatcttctttgagatcaggaagcagaagtatttggaagcacttgataggcatgatagggcaaaggctgtagatattcttgtcaaggatcttaaagtcttctcaacattcaatgaggagttatataaggagataacacagcttctcactcttgagaattttagggaaaatgaacagttgtctaagtatggggatactaaatcagctcgaagtattatgctggttgagctaaaaaaacttattgaagccaacccccttttcagggaaaaacttgtcttcccgactcttaaggcatcacggctccgaactctaattaaccaaagcttgaattggcagcatcagctttgtaagaatcctcgtccaaatccagatatcaagactttatttactgaccatacatgtactccacccaatggagctcgtgcgtcaccggtatctgtaccactggcagctgttccaaaggctggtgccgcatatccaccactcacagctcatactccattccaacctcctccacctggtccatctttagctggttggatggcaaatgcaactgcctcttcaactgttcagtctgctgttgtagcagcatcatcaatacctgttccacccaatcaagctgtctccatgttgaaacgcccaactataacagactatcaaagtgcagaatcagagcaactaatgaagcgcttgaggcctggtggacatggcgttgatgaggccacatatcctgctcccatccctcaacctgcatggtcagtggatgatcttccaaggacagttgcttgttcattttcacatggatctaatgtaactagcatggattttcacccaactcgccatacactgcttctagtgggatcttctaatggtgaatttacactttatgagatcggtttgcgtgaaccattgctatcaaagcccttcaaaattcgggatataaatgcatgctcaccacaatttcagaatgctgttgccaaagacccttccatatccattaatcgagttacctggagccctgatggagagttgattggagttgcattcacgaaacatttgattcatctacatgcatatcaaccaccaaatgagacacggcatgtcctagagattgaggctcattctggaggtgtaaatgatatagcattctcccgaccaaataagcaactttgtgtggtcacatgtggagatgataaactgataaaggtatgggatatgcatggacagaaattattcacatttgaagggcacgaggcgcctgtgtattctatatgtccgcatcacaaagagagtattcagttcatcttctcaacttcccttgacggaaaaattaaggcctggctttatgacaatgtgggatctagggtggactatgaagctcctggcaaatggtgtactactatgctatatagtgctgatgggactaggttgttctcatgtggaacgagcaaagagggagactcatatttggttgagtggaatgaaagtgaaggatctatcaagaggacttattctggattccgtaaaaggtcagctggtgttgctggtgtagtgcagtttgatacagctcagaatcacattttggctgctggtgaagataaccagattaaattttgggatgtcgataataataatatgctgatctgcacagacgctgaaggaggcctcccaactcttcctcgcttgaggttcaataaagaaggcaatcttcttgctgttactacagtggacaatggttttaagatacttgcaaatgctgatggactcagaactctacgcgcattagggagcaggcctcctttcgaagcatttaggccgcaatatgaagcttcttctatgaaggtctcaggtgctcctgttgttgctagcatctctcctaacataggccgaatagatcacttggacaggaactctcctgcaaagccatctcctatactgaatggtggggatacagcatcaagaagcatagatataaagccaagaatctcggaagaaaagcctgataaagcaaaaccttgggaactaatggaggttctaaatccgcagcaatgccgtgtagcaacaatgccagaaactcctgaccaggccagaaaggttgtccgacttctgtacacaaattctggtgttgggttgctagcactagggtctaacgccattcaaaggctatggaaatggagtcgaaacgaacaaaatccgagtggaaaagccacagccagtgttgtgccacaccattggcagccaaatagcggtcttgtcatgacaaatgatacagcagataccaatccagaggaggcagtcccgtgcattgcactctcaaagaatgattcctatgtgatgtctgcttgtggtgggaaggtttctttgtttaacatgatgacatttaaggtgatgacaacattcatgccacctccaccagcatcaacatttttagcatttcaccctcaagacaataacatcatagcaataggaatggaagattcaaccatccacatatacaatgtcagggtagatgaggtaaaaactagactcaaaggacatcaaaagaggataactggcttggcattctccaccaaccttggtgtacttgtttcttcaggcgccgatgcacagctttgtgtgtggaccaatgacacctgggaaaaaaagagaacagtttcgatacaaatgccagctggaaagactccttcaggagatacacgggtccagtttagttctgaccaaagtcacttgctagtagtacatgagactcaactagccatatatgatgcatcaaaaatggagaggatctatcagtggataccccaggacacattgtcagcttccatatcgcatgcatcatactcatgtaacagccagctagtttttgctgccttcactgatggcaacataggtgtttttgatgcggagaacttgagattaagatgtcgaatcgcaccatcggtgataaacagcaatccacctgttcaccctcttgtcgtcgctgcacatccccacgagccaaaccaatttgcggttgggctgtcagatgggtctgttaaagtgctggagccatcggagtccgaagggaaatggggaacacccgctccggcagacaatggcatccccaacggcaagatgccagcttcgtcggctactagtaaccctgctgcggaccaagtccaaagatag

SEQ ID NO: 3078 - protein, 1125 aa, Sorghum bicolor
  misc_feature: Ceres ANNOT ID no. 6028642
  misc_feature (435)..(475): Pfam Id: WD40 Pfam Desc: WD domain, G-beta repeat
  misc_feature (478)..(518): Pfam Id: WD40 Pfam Desc: WD domain, G-beta repeat
  misc_feature (907)..(945): Pfam Id: WD40 Pfam Desc: WD domain, G-beta repeat
  misc_feature (1)..(1125): NCBI GI: 87162556 NCBI Desc: lissencephaly type-1-like homology motif; ctlh, c-terminal to lish motif; nitrous oxide reductase, n-terminal; wd40-like; quinonprotein alcohol dehydrogenase-like [medicago
  misc_feature (1)..(1125): NCBI GI: 87162556 (continued) truncatula]
  misc_feature (1)..(1125): NCBI GI: 92879651 NCBI Desc: lissencephaly type-1-like homology motif; ctlh, c-terminal to lish motif [medicago truncatula]
  misc_feature (1)..(1125): NCBI GI: 22331124 NCBI Desc: wd-40 repeat family protein [arabidopsis thaliana]
  misc_feature (1)..(1125): NCBI GI: 92870734 NCBI Desc: lissencephaly type-1-like homology motif; ctlh, c-terminal to lish motif; wd40-like; quinonprotein alcohol dehydrogenase-like [medicago truncatula]
  misc_feature (1)..(1125): NCBI GI: 24461849 NCBI Desc: ctv.2 [poncirus trifoliata]
  misc_feature: Up-regulated in shoot tissues in response to salicylic acid treatment
  misc_feature: The sequence is a functional homolog of SEQ ID NO. 502 in the 11/188,298 US application
MSSLSRELVFLILQFLDEEKFKETVHKLEQESGFFFNMKYFEEKVHAGEWDEVEKYLSGFTKVDDNRYSMKIFFEIRKQKYLEALDRHDRAKAVDILVKDLKVFSTFNEELYKEITQLLTLENFRENEQLSKYGDTKSARSIMLVELKKLIEANPLFREKLVFPTLKASRLRTLINQSLNWQHQLCKNPRPNPDIKTLFTDHTCTPPNGARASPVSVPLAAVPKAGAAYPPLTAHTPFQPPPPGPSLAGWMANATASSTVQSAVVAASSIPVPPNQAVSMLKRPTITDYQSAESEQLMKRLRPGGHGVDEATYPAPIPQPAWSVDDLPRTVACSFSHGSNVTSMDFHPTRHTLLLVGSSNGEFTLYEIGLREPLLSKPFKIRDINACSPQFQNAVAKDPSISINRVTWSPDGELIGVAFTKHLIHLHAYQPPNETRHVLEIEAHSGGVNDIAFSRPNKQLCVVTCGDDKLIKVWDMHGQKLFTFEGHEAPVYSICPHHKESIQFIFSTSLDGKIKAWLYDNVGSRVDYEAPGKWCTTMLYSADGTRLFSCGTSKEGDSYLVEWNESEGSIKRTYSGFRKRSAGVAGVVQFDTAQNHILAAGEDNQIKFWDVDNNNMLICTDAEGGLPTLPRLRFNKEGNLLAVTTVDNGFKILANADGLRTLRALGSRPPFEAFRPQYEASSMKVSGAPVVASISPNIGRIDHLDRNSPAKPSPILNGGDTASRSIDIKPRISEEKPDKAKPWELMEVLNPQQCRVATMPETPDQARKVVRLLYTNSGVGLLALGSNAIQRLWKWSRNEQNPSGKATASVVPHHWQPNSGLVMTNDTADTNPEEAVPCIALSKNDSYVMSACGGKVSLFNMMTFKVMTTFMPPPPASTFLAFHPQDNNIIAIGMEDSTIHIYNVRVDEVKTRLKGHQKRITGLAFSTNLGVLVSSGADAQLCVWTNDTWEKKRTVSIQMPAGKTPSGDTRVQFSSDQSHLLVVHETQLAIYDASKMERIYQWIPQDTLSASISHASYSCNSQLVFAAFTDGNIGVFDAENLRLRCRIAPSVINSNPPVHPLVVAAHPHEPNQFAVGLSDGSVKVLEPSESEGKWGTPAPADNGIPNGKMPASSATSNPAADQVQR

SEQ ID NO: 3079 - DNA, 1530 bp, Sorghum bicolor
  misc_feature: Ceres ANNOT ID no. 6028652
  misc_feature: Encodes the peptide sequence at SEQ ID NO 3080
atgggcagcttgccactggacttgccaatgaagccactggaccctcacgccatcgccggcgactcgcaggcgattctagacttcctcgccgagtactaccgcgacgtggacaagttcccggtgcgggcggccgacatggagccaggccgcgtccgcaagctgctccccgaggccgcgccagagcacggcgagccgatggagcacatactggaggacgtgaggcgggacatcctgccggggctcacccactggcagagcccccggttcttcgccttcttcccgatgaacgccagctccgctgggctcgcgggggagatgctgtcggtcggcctcaacgtcgtgcccttcgtgtgggccgcgtcgccggccgccgcggagctcgagagcgtcgtcgtcgactggatggcgcggctgttcggcctgccgcgccggttcctcttctccggcggcggcgggggcgtcctgcaggggagcacgtgcgaggccgtggtgtgcacgctcgccgccgcgcgggacggcgcgctgggtaggctcgggcacgaggccatcgccaggctggtggtctacgcctccgaccagacgcacgccacgttccagaagggcgcccggctcgtcgggatcccaccgtcgaacttccgggtcatcaagacgtcggcggcttcagggtacggtctcaccgcggaagccgtccgcgccgccgtcgaccgcgacgtcggcctcgggctggtgccgctctacctctgcgccacggtgggcacgacggggctcggcgccgtcgaccccgttcgcgagatcggggaggaggcgcgccgccacggcatgtgggtgcaccttgacgcagcgtacgccggcagcgcggccatctgcccggagttccaggactacctcgacggcgcggagctcgccgactcggtgagcatgaacccgcacaagtggttccttaccaacatggactgctgctgcctgtgggtggcaagaccccgtgacctgatctcggcgctgtccaccgatccggagtacctcaagaacgtcggcgcggaagacggcggcgcaggaacgccggccgccgtagactacaaggactggcagatctccatgacgcgccggttccgtgccattaagctctgggtcatactgcggcggtacggtgcggctggcatgcgtgcgcacatccgtcggcacgtcgcagcagccaagtggttcgagcagagggtggcggccgacgagcgcttcgaggtggtggccccgaggaggttctccctggtatgcttccgcctcgcaccacggtccggccgggacgacgacgacgacgacacgaaccacgtgaaccgggacctcctcgcggcggtgaacgcgagcgggcgggctttcatgacgcacttcgtggtggacggcaagttcgtgatccggctagctgtgggcggcgcctcgacggagctgcagcacgtcatggaggtgtgggacctgctgcaggcaatagccgctgaggttctacacagacacagcactatccagcgtaacgagctctag

SEQ ID NO: 3080 - protein, 509 aa, Sorghum bicolor
  misc_feature: Ceres ANNOT ID no. 6028652
  misc_feature (48)..(427): Pfam Id: Pyridoxal_deC Pfam Desc: Pyridoxal-dependent decarboxylase conserved domain
  misc_feature (1)..(500): NCBI GI: 115481900 NCBI Desc: os10g0400500 [oryza sativa (japonica cultivar-group)]
  misc_feature (12)..(498): NCBI GI: 115607203 NCBI Desc: tyrosine decarboxylase [aristolochia contorta]
  misc_feature (4)..(509): NCBI GI: 1174828 NCBI Desc: tyrosine decarboxylase 2
  misc_feature (4)..(498): NCBI GI: 1174830 NCBI Desc: tyrosine decarboxylase 4
  misc_feature (12)..(498): NCBI GI: 12620328 NCBI Desc: tyrosine/dopa decarboxylase [thalictrum flavum subsp. glaucum]
  misc_feature (4)..(509): SWISSPROT Homolog: EC 4.1.1.25 Tyrosine decarboxylase 2
MGSLPLDLPMKPLDPHAIAGDSQAILDFLAEYYRDVDKFPVRAADMEPGRVRKLLPEAAPEHGEPMEHILEDVRRDILPGLTHWQSPRFFAFFPMNASSAGLAGEMLSVGLNVVPFVWAASPAAAELESVVVDWMARLFGLPRRFLFSGGGGGVLQGSTCEAVVCTLAAARDGALGRLGHEAIARLVVYASDQTHATFQKGARLVGIPPSNFRVIKTSAASGYGLTAEAVRAAVDRDVGLGLVPLYLCATVGTTGLGAVDPVREIGEEARRHGMWVHLDAAYAGSAAICPEFQDYLDGAELADSVSMNPHKWFLTNMDCCCLWVARPRDLISALSTDPEYLKNVGAEDGGAGTPAAVDYKDWQISMTRRFRAIKLWVILRRYGAAGMRAHIRRHVAAAKWFEQRVAADERFEVVAPRRFSLVCFRLAPRSGRDDDDDDTNHVNRDLLAAVNASGRAFMTHFVVDGKFVIRLAVGGASTELQHVMEVWDLLQAIAAEVLHRHSTIQRNEL

SEQ ID NO: 3081 - DNA, 978 bp, Sorghum bicolor
  misc_feature: Ceres ANNOT ID no. 6028661
  misc_feature: Encodes the peptide sequence at SEQ ID NO 3082
atggcggccacggtggagggggtgcggcaccggacggtggaggcgaacggagtgcgcctgcacgtggcggaggctgggcccgaggaggccggcgcccccgtggtgctgctcgttcacggcttcccggacctctggtacggctggcgccaccagatggccgccctggcggcgcgcggctaccgcgccgtggccccggacctccgcggctacggcgactccgactccccgcccgacgcgtccagctacaccaccttccatgtcgtcggggacctcgtcgcgctcatctccgacctcggccagccccgggtgttcgtggtggggcacgactggggcgccatcgtggcgtggcagctgtgtctgctccggccggacctggtgcgggcgctcgtgaacctcagcgtcgtgtaccacccgcggcggccggagatgagcccgctccagaccatcagggctgcctgcggcgaagaccactacatgtgccgcttccaggaacctggtgttgctgaagctgagtttgctctgtatgacaccaagtatgtgtttaagaagacattcggcatgcgcaagccagctcctcttgttctacctaaggacaagagcttctttgattcacttgattcagatggaacttgtcctccatggctatcagaggaagatatttcctactatgcagaaaaatttgcgaaaacaggctttactggaggacttaactactacagatgcatggacaggagctgggagctttctgcaccatggactggagctcagataaaagttccgtcaaaattcattgttggggacctagacattacatacaacgcccccggggtaccagactacattcacaagggtggcttcaaggcaagcgtgccaaatctagaggacgtggttattatggagggagtgagccacttcctcaaccaggagaagcctaatgaggtctctgatcacatctgcgagttctttagcaagttctga

SEQ ID NO: 3082 - protein, 325 aa, Sorghum bicolor
  misc_feature: Ceres ANNOT ID no. 6028661
  misc_feature (60)..(320): Pfam Id: Abhydrolase_1 Pfam Desc: alpha/beta hydrolase fold
  misc_feature (5)..(325): NCBI GI: 25044843 NCBI Desc: epoxide hydrolase [ananas comosus]
  misc_feature (5)..(325): NCBI GI: 46090793 NCBI Desc: soluble epoxide hydrolase [citrus jambhiri]
  misc_feature (5)..(325): NCBI GI: 124360004 NCBI Desc: epoxide hydrolase [medicago truncatula]
  misc_feature (5)..(325): NCBI GI: 124360005 NCBI Desc: epoxide hydrolase [medicago truncatula]
  misc_feature (5)..(325): NCBI GI: 92895845 NCBI Desc: epoxide hydrolase [medicago truncatula]
MAATVEGVRHRTVEANGVRLHVAEAGPEEAGAPVVLLVHGFPDLWYGWRHQMAALAARGYRAVAPDLRGYGDSDSPPDASSYTTFHVVGDLVALISDLGQPRVFVVGHDWGAIVAWQLCLLRPDLVRALVNLSVVYHPRRPEMSPLQTIRAACGEDHYMCRFQEPGVAEAEFALYDTKYVFKKTFGMRKPAPLVLPKDKSFFDSLDSDGTCPPWLSEEDISYYAEKFAKTGFTGGLNYYRCMDRSWELSAPWTGAQIKVPSKFIVGDLDITYNAPGVPDYIHKGGFKASVPNLEDVVIMEGVSHFLNQEKPNEVSDHICEFFSKF

SEQ ID NO: 3083 - DNA, 984 bp, Sorghum bicolor
  misc_feature: Ceres ANNOT ID no. 6028662
  misc_feature: Encodes the peptide sequence at SEQ ID NO 3084
atggtggaggcagctgctgagcagctggtgtgcgtgaccggagctggaggcttcattgggtcatggctggtcaaggagctgctccaacgcggctacgctgtcaggggcaccgccagggaccctgaggactcgaagaattcccatctgcgggcactggatggagctcaagaacggctatctctgtaccatgctgatgtgctggactacatgtcacttcgtcgtgccttcagcttatgtgatggtgtcttccatgttgcctccccgatatccaatgatcctgaccttgtgccggttgctattgagggaacaaagaacgttatgaacgctgcagcagacatgggggtgcaacgtgtggtgttcacctcatcttatggggctgtccacatgaaccctaacaggaaccctgatcggactgtggacgagagttgttggagtgatcttgacttctgcaagcaaacacagaattggtattgctacgcgaagacggttgctgagaagactgcaatggaagaggcatcaaagagagggatacaactactaatagttgtcccatcagtgacaataggcagaatgctacaaccaacattaaacttaactttatctgcagttgccacctacatgaacggcacaaagaaggcatactcgaacgcagttggagcatatgtcgatgtgcgggatgttgcccttgcccatattttcgtgtatgaagatttgagcacacatgggcggtacctctgcataggtgacatgctacatcaatcggaatttcttcaaatgatgagagagctcttcccacagtacccgatcaccaccaaatgcaaggatgaaaacaagccaatgatcaagccttacaagttctccacacaaaggctcgttgctttgggtatgaagttcactcctttgaaagagagtttatacaacacagtggtcagcctacaggagaatggtcatatcccattactgctacataagtcatccctgtga

SEQ ID NO: 3084 - protein, 327 aa, Sorghum bicolor
  misc_feature: Ceres ANNOT ID no. 6028662
  misc_feature (10)..(248): Pfam Id: Epimerase Pfam Desc: NAD dependent epimerase/dehydratase family
  misc_feature (11)..(275): Pfam Id: 3Beta_HSD Pfam Desc: 3-beta hydroxysteroid dehydrogenase/isomerase family
  misc_feature (12)..(227): Pfam Id: NAD_binding_4 Pfam Desc: Male sterility protein
  misc_feature (7)..(327): NCBI GI: 115436018 NCBI Desc: os01g0283600 [oryza sativa (japonica cultivar-group)]
  misc_feature (7)..(321): NCBI GI: 18307514 NCBI Desc: cinnamoyl coa reductase [oryza sativa]
  misc_feature (7)..(321): NCBI GI: 115449475 NCBI Desc: os02g0811400 [oryza sativa (japonica cultivar-group)]
  misc_feature (1)..(319): NCBI GI: 115478234 NCBI Desc: os09g0262000 [oryza sativa (japonica cultivar-group)]
  misc_feature (7)..(322): NCBI GI: 115449483 NCBI Desc: os02g0812000 [oryza sativa (japonica cultivar-group)]
  misc_feature: Useful for making plants with altered cell wall content and/or composition
  misc_feature: Functional homolog of the protein sequence encoded by LOCUS at1g15950
  misc_feature: Functional homolog of the protein sequence encoded by LOCUS at1g80820
  misc_feature: Useful for making plants with altered carbohydrate content
  misc_feature: Functional homolog of the protein sequence given in SEQ ID NO 13817
  misc_feature: Useful for making plants with altered cell wall content and/or composition
  misc_feature: Useful for making plants with altered lignin content
  misc_feature: Functional homolog of the protein sequence given in SEQ ID NO 13818
MVEAAAEQLVCVTGAGGFIGSWLVKELLQRGYAVRGTARDPEDSKNSHLRALDGAQERLSLYHADVLDYMSLRRAFSLCDGVFHVASPISNDPDLVPVAIEGTKNVMNAAADMGVQRVVFTSSYGAVHMNPNRNPDRTVDESCWSDLDFCKQTQNWYCYAKTVAEKTAMEEASKRGIQLLIVVPSVTIGRMLQPTLNLTLSAVATYMNGTKKAYSNAVGAYVDVRDVALAHIFVYEDLSTHGRYLCIGDMLHQSEFLQMMRELFPQYPITTKCKDENKPMIKPYKFSTQRLVALGMKFTPLKESLYNTVVSLQENGHIPLLLHKSSL

SEQ ID NO: 3085 - DNA, 306 bp, Sorghum bicolor
  misc_feature: Ceres ANNOT ID no. 6028664
  misc_feature: Encodes the peptide sequence at SEQ ID NO 3086
atggctctcgtcgctctctcctccgcgcgcgccgtgctcgcgtcgctggcacccagggcagccagcatcaggggctacgcggcgtcggcggcgtccggggccatgaggcgcgcggcggccgcggcggagggcgcggctggtgcgggcgaggccagggaggccggcgggcgcgccgctgccagctccgagatctcgtgggtgcccgaccccgtcacgggccactaccgccccgccaactgggccgccgccgtcgaccccgccgacctccgcgccgcgcacctcgcccgctcctacgcccgggcctga

SEQ ID NO: 3086 - protein, 101 aa, Sorghum bicolor
  misc_feature: Ceres ANNOT ID no. 6028664
  misc_feature (1)..(95): Pfam Id: LEA_3 Pfam Desc: Late embryogenesis abundant protein
  misc_feature (5)..(101): NCBI GI: 108792642 NCBI Desc: zinc inducible protein -like [oryza sativa (japonica cultivar-group)]
  misc_feature (1)..(101): NCBI GI: 1129142 NCBI Desc: orf1 [hordeum vulgare]
  misc_feature (1)..(81): NCBI GI: 1184112 NCBI Desc: zn-induced protein
  misc_feature (5)..(85): NCBI GI: 2570503 NCBI Desc: zinc inducible protein [oryza sativa]
  misc_feature (5)..(81): NCBI GI: 19347607 NCBI Desc: ramy1 [oryza sativa]
MALVALSSARAVLASLAPRAASIRGYAASAASGAMRRAAAAAEGAAGAGEAREAGGRAAASSEISWVPDPVTGHYRPANWAAAVDPADLRAAHLARSYARA

SEQ ID NO: 3087 - DNA, 468 bp, Sorghum bicolor
  misc_feature: Ceres ANNOT ID no. 6028672
  misc_feature: Encodes the peptide sequence at SEQ ID NO 3088
atggcgccgcgcctgcagctccgcgccgccgccgtcctcgcgctgctgatggccgtcgtctccgtggccgcgctctcggcggcgccggcgtcggcggccggagtggccgtcggcgacctggccgtggcccatctggccggcgccgtggtgatccggcgcggcgggcggacgtgccgcggcacggtgggcgagtgcatggagtacttgggcgcggacgccgagggcgaggccgacgtcgcgggcatggccaccggcggcagcaagcgccgggtgctgcagggcggctccggctacatcggctacgacgcgctgcgcagggacaacgtgccctgctcgcagcgcggcgcgtcctactacaactgccagcccggcgccgaggccaacccctactcccgcggctgcagcgccatcacccagtgcagggtagaaaagatcaattcaaatggctcagcgaccgggattagctag

SEQ ID NO: 3088 - protein, 155 aa, Sorghum bicolor
  misc_feature: Ceres ANNOT ID no. 6028672
  misc_feature (76)..(142): Pfam Id: RALF Pfam Desc: Rapid ALkalinization Factor (RALF)
  misc_feature (40)..(141): NCBI GI: 42374767 NCBI Desc: rapid alkalinization factor preproprotein [nicotiana attenuata]
  misc_feature (30)..(141): NCBI GI: 15623891 NCBI Desc: p0506e04.27 [oryza sativa (japonica cultivar-group)]
  misc_feature (40)..(141): NCBI GI: 16566316 NCBI Desc: ralf precursor [nicotiana tabacum]
  misc_feature (4)..(141): NCBI GI: 115447833 NCBI Desc: os02g0670500 [oryza sativa (japonica cultivar-group)]
  misc_feature (44)..(141): NCBI GI: 28628203 NCBI Desc: rapid alkalinization factor 1 precursor [populus balsamifera subsp. trichocarpa x populus deltoides]
  misc_feature: The plant is abnormally small.
  misc_feature: Useful for making plants with modulated biomass
  misc_feature: Functional homolog of the protein sequence given in SEQ ID NO 13255
MAPRLQLRAAAVLALLMAVVSVAALSAAPASAAGVAVGDLAVAHLAGAVVIRRGGRTCRGTVGECMEYLGADAEGEADVAGMATGGSKRRVLQGGSGYIGYDALRRDNVPCSQRGASYYNCQPGAEANPYSRGCSAITQCRVEKINSNGSATGIS

SEQ ID NO: 3089 - DNA, 324 bp, Sorghum bicolor
  misc_feature: Ceres ANNOT ID no. 6028674
  misc_feature: Encodes the peptide sequence at SEQ ID NO 3090
atgtctggcgtttgggtgttcaagaacggcgtggtccggctggtggagaacggcgcggcggctggcggcgaggcggtgcggcggcggaaggcgctggtgcacacgccgagcgggcaggtggtgcggtcgtacgcggagctggagtcggagctgcgggcgctggggtgggagcgctactacgaggacccggcgctgtaccagttccacaagcgcggctccctcgacctcatctccctccccgccgacttcaacaggttctcctccgtccacatgtacgacatcgtcatcaagaaccgcgactccttcagggtcgtcgacgtctga

SEQ ID NO: 3090 - protein, 107 aa, Sorghum bicolor
  misc_feature: Ceres ANNOT ID no. 6028674
  misc_feature (1)..(106): NCBI GI: 2370459 NCBI Desc: fpf1 protein [sinapis alba]
  misc_feature (1)..(107): NCBI GI: 32141027 NCBI Desc: gravity and root development protein [oryza sativa (japonica cultivar-group)]
  misc_feature (1)..(107): NCBI GI: 40949983 NCBI Desc: flowering promoting factor-like 1 [nicotiana tabacum]
  misc_feature (1)..(106): NCBI GI: 115457536 NCBI Desc: os04g0282400 [oryza sativa (japonica cultivar-group)]
  misc_feature (43)..(103): NCBI GI: 115452981 NCBI Desc: os03g0346200 [oryza sativa (japonica cultivar-group)]
  misc_feature: Useful for making plants with modulated flowering time
  misc_feature: GREAT-hit functional homolog of the protein sequence given in SEQ ID NO 13392
  misc_feature: Useful for making plants with modulated flowering time
  misc_feature: Functional homolog of the protein sequence given in SEQ ID NO 13392
MSGVWVFKNGVVRLVENGAAAGGEAVRRRKALVHTPSGQVVRSYAELESELRALGWERYYEDPALYQFHKRGSLDLISLPADFNRFSSVHMYDIVIKNRDSFRVVDV

SEQ ID NO: 3091 - DNA, 1350 bp, Sorghum bicolor
  misc_feature: Ceres ANNOT ID no. 6028676
  misc_feature: Encodes the peptide sequence at SEQ ID NO 3092
atggagccgtacgcggcggcgaagggcggtggggccgacgccggcaccggcctggaagagtcgatgcggaggctggggctcggcgacgacggggaaccgggggaggagaagcttccggagcggccgggcgaggcggactgcgcctactacctccgcacgggcgcctgcggctacggggagcgctgccgctacaaccacccccgcgatcggccgcctccggttaatggagttggaaagaccgcaggtatggtggagtacccagagcgtcctggacagccactctgtgagtactatgcaaagaatggcacctgtaaatttggttccaattgcaagtttgatcatcccagggaaggtggttttgtacctgtcacattaaacagcagtggattccctctacgtctgggtgaaaaggaatgttcctattacatgaaaactggacattgcaagtttggatctacatgtaaattccatcacccagaagttggttttctttcggagacacctggcatgtacccaccagttcaaccatcacctatttcctcctcacatccatatccgcatcttgccaattggcaaatggggaggcctcctgttgtgccagggtcatttttaccaggctcgtatccaccaatgatgcttccacctacagttatgccaatgcagggatggaacccttatgtttcacctatgaaccaagttacaccagctgggggacagcaagctgttccagcaggggcatcttatggtttgtcacaccagggccctacctctgccatgacttatggcagtcattatgcacaattgtattcttcatctgggacttcaagcagcaacatacaagaatatgcctttccagagcggcctgggcagcctgaatgtgaacattacatgaagaccggaacctgtaaatatggagcagtttgcaaatatcatcatcctcaatacttcagtggaccaaagtctaactacatgctgagccctctgggtcttcccctgcgtcctggttctcagccatgtgcttactatgcacaccatgggttttgcaagtttgggccgacatgcaagtttgatcatccgatgggtactccaaactatagtatttcagcatcatcacttgccgatgtgccagtcgctccatatcctcacagtttccctgttactcctatgcctccatatctgccatcttctgatctgcgtccacaatacactctagtcaaggattcctctgctaatccacctccagcgcctggaactacatatggacctgttgggtctatgtcaaaggtttatgctccccacacgcttatccgatccccagcttctgcagctgctggcatgcaagcgtcgtaa

SEQ ID NO: 3092 - protein, 449 aa, Sorghum bicolor
  misc_feature: Ceres ANNOT ID no. 6028676
  misc_feature (42)..(68): Pfam Id: zf-CCCH Pfam Desc: Zinc finger C-x8-C-x5-C-x3-H type (and similar)
  misc_feature (90)..(116): Pfam Id: zf-CCCH Pfam Desc: Zinc finger C-x8-C-x5-C-x3-H type (and similar)
  misc_feature (134)..(160): Pfam Id: zf-CCCH Pfam Desc: Zinc finger C-x8-C-x5-C-x3-H type (and similar)
  misc_feature (288)..(314): Pfam Id: zf-CCCH Pfam Desc: Zinc finger C-x8-C-x5-C-x3-H type (and similar)
  misc_feature (334)..(360): Pfam Id: zf-CCCH Pfam Desc: Zinc finger C-x8-C-x5-C-x3-H type (and similar)
  misc_feature (1)..(446): NCBI GI: 62901483 NCBI Desc: zinc finger ccch type domain containing protein zfn-like 3
  misc_feature (1)..(428): NCBI GI: 115435748 NCBI Desc: os01g0257400 [oryza sativa (japonica cultivar-group)]
  misc_feature (5)..(449): NCBI GI: 62901411 NCBI Desc: zinc finger ccch type domain containing protein zfn-like 1
  misc_feature (12)..(383): NCBI GI: 30690809 NCBI Desc: zinc finger (ccch-type) family protein [arabidopsis thaliana]
  misc_feature (16)..(412): NCBI GI: 38603838 NCBI Desc: at5g18550 [arabidopsis thaliana]
MEPYAAAKGGGADAGTGLEESMRRLGLGDDGEPGEEKLPERPGEADCAYYLRTGACGYGERCRYNHPRDRPPPVNGVGKTAGMVEYPERPGQPLCEYYAKNGTCKFGSNCKFDHPREGGFVPVTLNSSGFPLRLGEKECSYYMKTGHCKFGSTCKFHHPEVGFLSETPGMYPPVQPSPISSSHPYPHLANWQMGRPPVVPGSFLPGSYPPMMLPPTVMPMQGWNPYVSPMNQVTPAGGQQAVPAGASYGLSHQGPTSAMTYGSHYAQLYSSSGTSSSNIQEYAFPERPGQPECEHYMKTGTCKYGAVCKYHHPQYFSGPKSNYMLSPLGLPLRPGSQPCAYYAHHGFCKFGPTCKFDHPMGTPNYSISASSLADVPVAPYPHSFPVTPMPPYLPSSDLRPQYTLVKDSSANPPPAPGTTYGPVGSMSKVYAPHTLIRSPASAAAGMQAS

SEQ ID NO: 3093 - DNA, 1524 bp, Sorghum bicolor
  misc_feature: Ceres ANNOT ID no. 6028683
  misc_feature: Encodes the peptide sequence at SEQ ID NO 3094
atggagatcgacgaggcggtgcgcgggtgcagcgaccgccgcctgcgcaccaagtacggcaacgccgtctacgtcgtccagcgcgccttcgcgctctacccgtttgaggaaattgccttcagctttaatggtgggaaggattcaactgtgctcctgcatttgattcgagctggttactacctttacaagaaggactctggtgatatagcccaaatgaatgctgttaaaaactgtccactgcgtaccatctattttgaaagcccttgtgcttttcctgaaatcaactcattcacttatgagactgtctcaacttatgggttaccactggaaactatccattcggatttcaagtctggtctagaaggccttctgaaggagaagcccaccaaagcaattttcattggcacaagaattggtgatccaaatgcggttggtcaagaacagttctctcctagttcacctggctggcctccttttatgagggtgaatccgatcttggattggtcatacagggatgtttggtcttttctattaacatgtaaggtcaaatactgcagcctttatgatcaagggtatacttccattgggagcatacatgatactgttccaaatgcacttcttagtgattcatcaacggagaaaagttttagaccagcatacatgctaacagatggaaggcttgaaagagctggtcgaacaaaaaaaactaatcctaaagtagaaatgaattctgttgcaagcaatggcatgaacattactgagggaggacaaatggtctcacgtgcggcatcaatcattgtagttggtgatgaaattttgtttggtacaactgaggataacttaggagcggccttgtgcaagaagcttcatgcaattggctggcgggtttctcatgtagcagttgttcgcaatgagattgattctgttgctgaagaagttgagcgatgtaaatctgttgatgacatggtgtttatttttggtggacttgggcccctacattcagatgtttctttggctggtgtcgcaaaagcatttggagttcgtctggctcctgatgaagagtttgaggattatcttagtcaactcatgggaaacaattacaccggtgatcgaaatgagatggcgcagttgccagaaggtatcactgaattactgcatcacaaaacgctaccattaccattgatcaaatgcagaaatgtcattgctcttggtgcaaccaatatggttgaactagacaccgagtgggattgtcttctagatactcaggagagtggtttaatgccaacaaaaccttttgtgtcaaagcatctcagcactacagtttcagatgttcaaattgctccggtccttgcaaaactgtgcttagagttttctgatgtttacatagggtgtcatcggatatcaagagctgggcctttggttgtgaatcttactggaaaggataaccagagggtagatgcggctgccgagaagctgacaagcagctttgaaggacaattttcccaagttgacagttgcaaataa

SEQ ID NO: 3094 - protein, 507 aa, Sorghum bicolor
  misc_feature: Ceres ANNOT ID no. 6028683
  misc_feature (37)..(203): Pfam Id: PAPS_reduct Pfam Desc: Phosphoadenosine phosphosulfate reductase family
  misc_feature (264)..(397): Pfam Id: MoCF_biosynth Pfam Desc: Probable molybdopterin binding domain
  misc_feature (144)..(507): NCBI GI: 115435764 NCBI Desc: os01g0259600 [oryza sativa (japonica cultivar-group)]
  misc_feature (15)..(244): NCBI GI: 3668151 NCBI Desc: spcc1235.04c [schizosaccharomyces pombe]
  misc_feature (11)..(233): NCBI GI: 41872403 NCBI Desc: fad synthetase isoform 2 [homo sapiens]
  misc_feature (11)..(233): NCBI GI: 123980152 NCBI Desc: fad1 flavin adenine dinucleotide synthetase homolog (s. cerevisiae) [synthetic construct]
  misc_feature (11)..(233): NCBI GI: 123994953 NCBI Desc: fad1 flavin adenine dinucleotide synthetase homolog (s. cerevisiae) [synthetic construct]
MEIDEAVRGCSDRRLRTKYGNAVYVVQRAFALYPFEEIAFSFNGGKDSTVLLHLIRAGYYLYKKDSGDIAQMNAVKNCPLRTIYFESPCAFPEINSFTYETVSTYGLPLETIHSDFKSGLEGLLKEKPTKAIFIGTRIGDPNAVGQEQFSPSSPGWPPFMRVNPILDWSYRDVWSFLLTCKVKYCSLYDQGYTSIGSIHDTVPNALLSDSSTEKSFRPAYMLTDGRLERAGRTKKTNPKVEMNSVASNGMNITEGGQMVSRAASIIVVGDEILFGTTEDNLGAALCKKLHAIGWRVSHVAVVRNEIDSVAEEVERCKSVDDMVFIFGGLGPLHSDVSLAGVAKAFGVRLAPDEEFEDYLSQLMGNNYTGDRNEMAQLPEGITELLHHKTLPLPLIKCRNVIALGATNMVELDTEWDCLLDTQESGLMPTKPFVSKHLSTTVSDVQIAPVLAKLCLEFSDVYIGCHRISRAGPLVVNLTGKDNQRVDAAAEKLTSSFEGQFSQVDSCK

SEQ ID NO: 3095 - DNA, 1305 bp, Sorghum bicolor
  misc_feature: Ceres ANNOT ID no. 6028710
  misc_feature: Encodes the peptide sequence at SEQ ID NO 3096
atgggagctaattgctgcgttgctgcaaaggagaggacacagccatgcatcactccaatagaagtatcagcgtacaggaatgtgaggcactcgccatcatggagctttcgatgggacaatcgcacacatatagaagacataatggatatccctactctgttctccaaccatagtagtggaagcattcggcctgatacaaagagtggttcaattgccccaactgaaggattttctaatggaaatagccgtggaactagcccttccaatgtgtttcacggagcaaagtggcacaaatctgataaaaaaacagaagcaccgaaggttacaaaggttgatcctcgagctgaccgcaccacagcaagtaactgttctcctgaggcaaagctttccaggaaatcactggacatgtcaagtgttgcttcagatttgaagacatcagtatctgttccttcaacgccacccttagtatccagagcagatccatcatcctccagggggcattctcaacctacagattcagattcgacgaagaaagcacggcgatcaccagggtatcaattatacagacaggtttcggacagtaaaattccatctctcagatctctcaatgagataagctctcctgaaggaaggccttcctcttccatgttatcagtctgcagcaatgacttatcagcagcaggatcctatggtgagtcatcagatggctggtcaatgcgcacattttctgaaatggtcgcaacatcccaaagagagaggtggtcacttgacagtgagctcttgggatccatttctagtaaaatgacaagatcaagtgcttcgaattctactacacttccccctgaccaagaggtgtgcaagctgtgtttaaagatgttaaaagagagatcgacatggaacgctcaggagctggctgttgttgctgttttgttgtgtggacatgtgtaccatgctgactgtctggacagcataactacagaagctgacaaatatgatcctccctgccctgtatgtacccatggtgagaaatgtacagtgaagctatttggaaagctcgaatcaaagattaagaacaagataccaaaaaatgttgcagttgatatgaatccagatgggaacggtaataagcaccagaagaaaggtagaagagagcccaggttaggtacaagttcaagcatgaaggtcccatttagtcgtccatttttgaggagacatttctccattggatctcgaccacctcggtcagtctcagaaactgattcgacaagaaagaagggattctgggcaagacactggagagagtag

SEQ ID NO: 3096 - protein, 434 aa, Sorghum bicolor
  misc_feature: Ceres ANNOT ID no. 6028710
  misc_feature (286)..(338): Pfam Id: zf-C3HC4 Pfam Desc: Zinc finger, C3HC4 type (RING finger)
  misc_feature (1)..(434): NCBI GI: 56783986 NCBI Desc: c3h2c3 ring-finger protein -like [oryza sativa (japonica cultivar-group)]
  misc_feature (1)..(367): NCBI GI: 92870334 NCBI Desc: zinc finger, ring-type [medicago truncatula]
  misc_feature (1)..(434): NCBI GI: 140071230 NCBI Desc: zinc finger, ring-type [medicago truncatula]
  misc_feature (213)..(384): NCBI GI: 73329342 NCBI Desc: at1g19680 [arabidopsis thaliana]
  misc_feature (213)..(384): NCBI GI: 73329338 NCBI Desc: at1g19680 [arabidopsis thaliana]
MGANCCVAAKERTQPCITPIEVSAYRNVRHSPSWSFRWDNRTHIEDIMDIPTLFSNHSSGSIRPDTKSGSIAPTEGFSNGNSRGTSPSNVFHGAKWHKSDKKTEAPKVTKVDPRADRTTASNCSPEAKLSRKSLDMSSVASDLKTSVSVPSTPPLVSRADPSSSRGHSQPTDSDSTKKARRSPGYQLYRQVSDSKIPSLRSLNEISSPEGRPSSSMLSVCSNDLSAAGSYGESSDGWSMRTFSEMVATSQRERWSLDSELLGSISSKMTRSSASNSTTLPPDQEVCKLCLKMLKERSTWNAQELAVVAVLLCGHVYHADCLDSITTEADKYDPPCPVCTHGEKCTVKLFGKLESKIKNKIPKNVAVDMNPDGNGNKHQKKGRREPRLGTSSSMKVPFSRPFLRRHFSIGSRPPRSVSETDSTRKKGFWARHWRE

SEQ ID NO: 3097 - DNA, 1557 bp, Sorghum bicolor
  misc_feature: Ceres ANNOT ID no. 6028711
  misc_feature: Encodes the peptide sequence at SEQ ID NO 3098
atggaagtactgcgtgatatgcacctgccaccaggatttggattccatccttcggatcctgaacttatttctcactatctgaagaggaaaatacttggccagaaaattgaatatgatcttataccagaggtggatatatacaagcatgaaccatgggatttacctgcaaagtgcaatcttccaatcaaggacaacaagtggcatttctttgcctctcgtgacaggaagtaccctactggctctaggtcaaacagggcaacactcgctggttactggaaatcaactgggaaggaccgagccataaagctgaacaagcgaactctaggaacaaagaagactctagtttttcatgaaggccggcctccctctggcagacgcactgagtggattatgcatgagtactacatagacgagaatgaatgtaaagtcagccctgatatgaaggatgcctttgtcctctgccgtgttactaaaagaagtgactgggcattagataatgataatgaggtgggcaacaggaactctcatctggaacaactagatgatgctgctacatcagttgtcagcactgtaaagccagaagatgctgctgcctcagtcatctgcccagaagaatcgaatcatgctgctacaccagttggcagtgctgaactatgtaatgatgttgctcaggcagctatcactcctgattcaagatctccaaatggtggcattgaactggaaacatggctggaagaactgttggatccttcaccttcatttaaccttgtagctgatactggttctgctggcgtgtctctgactgaacaatgtgctgaatcatcgaatttgcagaatcctggtttcatggctccaaatattggaccaggccatgctagccctatccaggatggaacagatgccacagactacctattcactgatgatcttcctgaggatctttacagtatgttgtatcctggtactgaccagttcaatgataatatattcttggaacaagttggccaggaaggtattgcttttcctaccaaccaggcatactacatgatgggaacagatgcttatgctcttccaaacaactttgagaatggaactccgaatgttgaattgcagttagaccaggaaaatgaccagatgaatctgccaaatggaaatgttgacactggaattgcaatacgaagtcgcagagcaacagcatctcctgctaacatttcactagcatatggcaatattaaaatgcaggttggaattaagaggatggtcacaagtaattccgaatctatcaaccagactatgaagtttacacataacagtggtcgtcgtcttgatctcaggactgatgttgaacaccagaagaaaaatacaaacaatgtcatttctgccaagcaatctgatgcagccaagactgaaggccacagcaatcaaggttatctcaagggcttcaaaagatgttcatcagctgggttcaagtcatacatatttgttgccttttttgtggttggagttgctgctgcagctgcagcgctgcattatcaccgctctggtgccaacctataa

SEQ ID NO: 3098 - protein, 518 aa, Sorghum bicolor
  misc_feature: Ceres ANNOT ID no. 6028711
  misc_feature (9)..(137): Pfam Id: NAM Pfam Desc: No apical meristem (NAM) protein
  misc_feature (1)..(326): NCBI GI: 6730946 NCBI Desc: osnac8 protein [oryza sativa]
  misc_feature (9)..(159): NCBI GI: 15237939 NCBI Desc: no apical meristem (nam) family protein [arabidopsis thaliana]
  misc_feature (9)..(159): NCBI GI: 145651780 NCBI Desc: at3g03200 [arabidopsis thaliana]
  misc_feature (9)..(481): NCBI GI: 140067655 NCBI Desc: no apical meristem (nam) protein [medicago truncatula]
  misc_feature (9)..(318): NCBI GI: 6227016 NCBI Desc: contains similarity to gbaf123310 nac domain protein nam gene from arabidopsis thaliana
  misc_feature: The sequence is a functional homolog of SEQ ID NO 612 in the 11/435,388US patent application
  misc_feature: Useful for making plants with modulated growth and phenotype characteristics
  misc_feature: The sequence is a functional homolog of SEQ ID NO 612 in the 20060272060 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: Useful for biocontainment applications
  misc_feature: Functional homolog of the protein sequence given in SEQ ID NO 13623
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 344 in the 10/666,642 US patent application
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MEVLRDMHLPPGFGFHPSDPELISHYLKRKILGQKIEYDLIPEVDIYKHEPWDLPAKCNLPIKDNKWHFFASRDRKYPTGSRSNRATLAGYWKSTGKDRAIKLNKRTLGTKKTLVFHEGRPPSGRRTEWIMHEYYIDENECKVSPDMKDAFVLCRVTKRSDWALDNDNEVGNRNSHLEQLDDAATSVVSTVKPEDAAASVICPEESNHAATPVGSAELCNDVAQAAITPDSRSPNGGIELETWLEELLDPSPSFNLVADTGSAGVSLTEQCAESSNLQNPGFMAPNIGPGHASPIQDGTDATDYLFTDDLPEDLYSMLYPGTDQFNDNIFLEQVGQEGIAFPTNQAYYMMGTDAYALPNNFENGTPNVELQLDQENDQMNLPNGNVDTGIAIRSRRATASPANISLAYGNIKMQVGIKRMVTSNSESINQTMKFTHNSGRRLDLRTDVEHQKKNTNNVISAKQSDAAKTEGHSNQGYLKGFKRCSSAGFKSYIFVAFFVVGVAAAAAALHYHRSGANL

SEQ ID NO: 3099 - DNA, 1041 bp, Sorghum bicolor
  misc_feature: Ceres ANNOT ID no. 6028719
  misc_feature: Encodes the peptide sequence at SEQ ID NO 3100
atgctctcctcctcctccaccaccgctcactcggccacctcgcccctccccggccccgcctccacaaaccctaacccccgctcccgcctcctccgcctccacgccgcatcgcgcgtgccgtccgcggccttaaacgcgcgcgggcgcccgccgatgtgttcggtcagcgcttcgtccgccgctggggcgggcggctggggagcggcggcagtgggggagttggcgacggaacggctggttgaggtggcgcagcgggcggcagacgcggccggggaggtgctcaggaagtacttccgccagcgggttgagatcatcgacaaggaggacaacagtcctgttacgattgcagatagagaagcagaagaagcaatggtgtcagttatactgaagagcttccctactcatttccaacatttacttgaatcatgcagttttggtgaggagaatggttggagatgtgcagagagttctgcagattatgtttgggttttggacccaatagatggaacgaaaagtttcataactggcaagcctctttttggtacacttatagcacttctgcacaatgggaagccggttattggtgtcattgaccaaccaatcttgcgagaaagatggattggggtggatgggaaacaaacaactttgaacggacaagaaatatccgttcgctcttgtaatttacttgcacaagcttacttatatacaacaagcccacatctctttgaaggagatgctgaagatgcatttattcgtgtaaggaataaggtgaaagtcccactttatggctgtgattgttatgcttatgctcttctggcttctggttttgtggatattgttgttgaatccggtttgaagccatatgatttcctctccctggtacctgtcattgaaggagctggagggtcaataactgattggagaggggacaatctccattggcctgttactgcagaatcacggcccacaagtttcaacgtggtagcagctggggatgcccgtgtccacaaacaggcccttgatacgctgcagtggtgctag

SEQ ID NO: 3100 - protein, 346 aa, Sorghum bicolor
  misc_feature: Ceres ANNOT ID no. 6028719
  misc_feature (75)..(344): Pfam Id: Inositol_P Pfam Desc: Inositol monophosphatase family
  misc_feature (15)..(345): NCBI GI: 38603848 NCBI Desc: at4g39120 [arabidopsis thaliana]
  misc_feature (15)..(345): NCBI GI: 51971457 NCBI Desc: inositol monophosphatase - like protein [arabidopsis thaliana]
  misc_feature (77)..(344): NCBI GI: 144899266 NCBI Desc: inositol monophosphatase [magnetospirillum gryphiswaldense msr-1]
  misc_feature (80)..(343): NCBI GI: 23015473 NCBI Desc: cog0483: archaeal fructose-1,6-bisphosphatase and related enzymes of inositol monophosphatase family [magnetospirillum magnetotacticum ms-1]
  misc_feature (80)..(343): NCBI GI: 82948109 NCBI Desc: archaeal fructose-1,6-bisphosphatase and related enzyme of inositol monophosphatase family [magnetospirillum magneticum amb-1]
MLSSSSTTAHSATSPLPGPASTNPNPRSRLLRLHAASRVPSAALNARGRPPMCSVSASSAAGAGGWGAAAVGELATERLVEVAQRAADAAGEVLRKYFRQRVEIIDKEDNSPVTIADREAEEAMVSVILKSFPTHFQHLLESCSFGEENGWRCAESSADYVWVLDPIDGTKSFITGKPLFGTLIALLHNGKPVIGVIDQPILRERWIGVDGKQTTLNGQEISVRSCNLLAQAYLYTTSPHLFEGDAEDAFIRVRNKVKVPLYGCDCYAYALLASGFVDIVVESGLKPYDFLSLVPVIEGAGGSITDWRGDNLHWPVTAESRPTSFNVVAAGDARVHKQALDTLQWC

SEQ ID NO: 3101 - DNA, 1422 bp, Sorghum bicolor
  misc_feature: Ceres ANNOT ID no. 6028728
  misc_feature: Encodes the peptide sequence at SEQ ID NO 3102
atggcgaagcccccgtcgtccgcggcggcggccgccgccggaggccgcggcccggttcacaaccggacccggctcctcctcgtcctcctcgtggccgtcgccgcctccgcatccacagcggggttcctcctccgcggtgccctgcgagacccctgcgacggccgtggagaccccgccgccctcaacaccgccgtcgccgcggggagtcccctcgggttcatgaggtccaaactcgtgctcctcgtctcccacgagctctccctttcgggtggcccacttttactgatggaattggcatttcttctgaggcatgttggttcggaagtggtgtggataacaaaccagagatcagaagaaacaaatgatgtcacatatagcttggagcataggatgttgagccatggagtgcaggttttaccagctaggggacaggaggcagttgatattgctctaaaagctgatctggttatcttaaacactgctgttgctggcaagtggcttgatcctgttctgaaagatcatgttcctaaagtccttccgaagattttgtggtggatccatgaaatgcgagggcattactttaaggttgaatatgtcaaacatcttccctttgttgctggagccatgattgattctcatacaacggctgaatattggaagagcaggactagcgaccgcctaaaaatacagatgccacaaacttatgttgttcacctggggaatagtaaagaactaatggaagttgctgaagataatgtcgcaagaagagtcctacgggaacatattcgtgaatcccttggagtacggagtgaagatctcctgtttgcaataataaacagtgtatcacgagggaagggacaagacttatttcttcaagcattttatcagggtttgcagctcatccaacaccagaaactaaaagtgcctacaatgcatgctatagttgtgggaagtgatatgaatgctcagaccaaatttgagactcagttacgtgactttgtggtgaagaatgcgattcatgaccgtgtccattttgtgaacaagacattggcagtggcaccttatttggcagcaattgatgtgcttgttcagaattcccaggcccgtggagaatgcttcggaaggataacaattgaagcaatggcattcaagttgccagtattgggcacggctgctggagggaccacggaaatcgtcctggacggctcgactggccttctgcatcctgctgggaaggagggcgtgacgcctcttgcaaagaacattgtgagactcgcaagccatgccgagcaaagggtctccatgggggaaaagggctatgacagggtgaaggaaatgttcatggagcaccacatggctgagaggatcgcggcggtgttgaaggaagttctgcagaaatcacaggaacgctctaggtcttga

SEQ ID NO: 3102 - protein, 473 aa, Sorghum bicolor
  misc_feature: Ceres ANNOT ID no. 6028728
  misc_feature (259)..(442): Pfam Id: Glycos_transf_1 Pfam Desc: Glycosyl transferases group 1
  misc_feature (175)..(404): NCBI GI: 72536771 NCBI Desc: at1g19710 [arabidopsis thaliana]
  misc_feature (175)..(404): NCBI GI: 72536773 NCBI Desc: at1g19710-like protein [arabidopsis lyrata]
  misc_feature (175)..(404): NCBI GI: 72536751 NCBI Desc: at1g19710 [arabidopsis thaliana]
  misc_feature (259)..(463): NCBI GI: 124006976 NCBI Desc: glycosyl transferase, group 1 family protein [microscilla marina atcc 23134]
  misc_feature (246)..(463): NCBI GI: 118038167 NCBI Desc: glycosyl transferase, group 1 [burkholderia phytofirmans psjn]
MAKPPSSAAAAAAGGRGPVHNRTRLLLVLLVAVAASASTAGFLLRGALRDPCDGRGDPAALNTAVAAGSPLGFMRSKLVLLVSHELSLSGGPLLLMELAFLLRHVGSEVVWITNQRSEETNDVTYSLEHRMLSHGVQVLPARGQEAVDIALKADLVILNTAVAGKWLDPVLKDHVPKVLPKILWWIHEMRGHYFKVEYVKHLPFVAGAMIDSHTTAEYWKSRTSDRLKIQMPQTYVVHLGNSKELMEVAEDNVARRVLREHIRESLGVRSEDLLFAIINSVSRGKGQDLFLQAFYQGLQLIQHQKLKVPTMHAIVVGSDMNAQTKFETQLRDFVVKNAIHDRVHFVNKTLAVAPYLAAIDVLVQNSQARGECFGRITIEAMAFKLPVLGTAAGGTTEIVLDGSTGLLHPAGKEGVTPLAKNIVRLASHAEQRVSMGEKGYDRVKEMFMEHHMAERIAAVLKEVLQKSQERSRS

SEQ ID NO: 3103 - DNA, 1044 bp, Sorghum bicolor
  misc_feature: Ceres ANNOT ID no. 6028732
  misc_feature: Encodes the peptide sequence at SEQ ID NO 3104
atggcttcaatcaatatagttcttggtgcaattttcattgcttccttctacttatctggctcccttgccttccctcctggtcacgatgagggagcccatccaattggaaatggtccaatctcaggtctttctacagattactacaagttcacatgcccacaagccgatgagattgtggtgcccatactaaagaaggctattgcaaaggaaccacgcatagctgcttcccttctcaggctcctgtttcatgactgctttgttcagggatgtgatgcatcagttcttttggatgacgctgaggaagttgtaagtgagaaaaaagctattcccaataagaattctattaggggatttgaggttatagacgagatcaaagctgcacttgaggaagcatgtccgaatacagtgtcttgtgctgacactatcgccctagcagccagaggttcaacagtactgagtggtggaccatattgggaacttccattaggaaggagggactcaaagacagcaaacatgaagctagcaaacaagaaccttcctccaccaaatgcaacactacatcgtcttatcaagttcttccaaaggcaaggactggacaaggtggaccttgttgcattatcaggaagccacaccattggaaaggccagatgtgtgagtttcaaacaacgactctacaatcagcatagagataacagaccagacaacacactagaaaaaagtttctatcacacattggcatcggcgtgcccacacactggtggtgatgacaacataaggtccctagattttgtcagcccttcgcaatttgacaacagctattataagctgatattggagggaaaagggctccttaattcagatgaagttttgtggacaggaaaagaccccgaaatagcaggtctagtaaaaagttatgcagaaaacgagcaactattctttgaacattatgtgaattcaataatcaaaatggggaacataaatcccctcatgggttacaatggagaaatccgcaagaactgccatagggttaatcaggatatctag

SEQ ID NO: 3104 - protein, 347 aa, Sorghum bicolor
  misc_feature: Ceres ANNOT ID no. 6028732
  misc_feature (59)..(308): Pfam Id: peroxidase Pfam Desc: Peroxidase
  misc_feature (42)..(344): NCBI GI: 14031051 NCBI Desc: peroxidase [nicotiana tabacum]
  misc_feature (32)..(340): NCBI GI: 993004 NCBI Desc: prx [mercurialis annua]
  misc_feature (43)..(344): NCBI GI: 37783275 NCBI Desc: anionic peroxidase swpb1 [ipomoea batatas]
  misc_feature (10)..(344): NCBI GI: 37783277 NCBI Desc: anionic peroxidase swpb2 [ipomoea batatas]
  misc_feature (43)..(344): NCBI GI: 7453855 NCBI Desc: peroxidase prx15 precursor [spinacia oleracea]
  misc_feature (1)..(344): SWISSPROT Homolog: EC 1.11.1.7 Peroxidase 9 precursor
  misc_feature: Useful for making plants with altered cell wall content and/or composition
  misc_feature: GREAT-hit functional homolog of the protein sequence encoded by LOCUS at1g44970
  misc_feature: Useful for making plants with altered cell wall content and/or composition
  misc_feature: Functional homolog of the protein sequence given in SEQ ID NO 13814
  misc_feature: Useful for making plants with altered carbohydrate content
  misc_feature: Functional homolog of the protein sequence given in SEQ ID NO 13815
  misc_feature: Useful for making plants with modulated oxidative stress sensitivity
  misc_feature: Functional homolog of the protein sequence given in SEQ ID NO 13607
  misc_feature: Useful for making plants with modulated light quality response
  misc_feature: Functional homolog of the protein sequence given in SEQ ID NO 13816
MASINIVLGAIFIASFYLSGSLAFPPGHDEGAHPIGNGPISGLSTDYYKFTCPQADEIVVPILKKAIAKEPRIAASLLRLLFHDCFVQGCDASVLLDDAEEVVSEKKAIPNKNSIRGFEVIDEIKAALEEACPNTVSCADTIALAARGSTVLSGGPYWELPLGRRDSKTANMKLANKNLPPPNATLHRLIKFFQRQGLDKVDLVALSGSHTIGKARCVSFKQRLYNQHRDNRPDNTLEKSFYHTLASACPHTGGDDNIRSLDFVSPSQFDNSYYKLILEGKGLLNSDEVLWTGKDPEIAGLVKSYAENEQLFFEHYVNSIIKMGNINPLMGYNGEIRKNCHRVNQDI

SEQ ID NO: 3105 - DNA, 1005 bp, Sorghum bicolor
  misc_feature: Ceres ANNOT ID no. 6028741
  misc_feature: Encodes the peptide sequence at SEQ ID NO 3106
atgacaacttccatgggttctctcgtcttgctctgccttgtttctaccctcctctttcccagtgccgtccttggccacccatggggtggcttgttcccacagttctatgaccattcgtgccccaaggcgaaggagattgtgcagtccattgtggcacaggctgtggccaaggagaccaggatggcagcatccttggtcagattgcatttccatgactgctttgtcaagggctgcgatgcttcagtgctgttggacaacagcagcagcatagttagtgagaaagggtccaatccgaacaggaactccctcagggggtttgaggtggtcgaccagattaaggctgctctcgaggctgcctgcccaggcactgtctcctgtgcagacattcttgccctcgcggctcgtgattccacttccctggttggtggcccatactgggatgtgccacttggccggagggactcgctcggcgcaagcatccagggctccaacaatgacatcccagcccccaataacacactccccactatcatcaccaagttcaagcgccagggcctcaatgttgttgatgttgttgccctctcaggtggtcacaccataggtatgtctcggtgcactagcttccggcagaggctgtacaaccagacaggcaatggcatggctgacagcacgctggatgtatcttacgccgcgcagctgaggcaggggtgcccccgctctggtggtgacaacaacctcttccccttggacttcgtcaccccagccaagtttgacaatttttactacaagaacctcctggccggcaagggccttctaagctctgatgaggttctgttaaccaagagcgctgagacagcggccctcgtgaaggcatatgctgctgatgtcaatctcttcttccagcactttgcacagtctatggtgaatatgggcaacatctcgccactgacagggtcacaaggtgagatcaggaagaactgcaggaggctcaacaacagccactga

SEQ ID NO: 3106 - protein, 334 aa, Sorghum bicolor
  misc_feature: Ceres ANNOT ID no. 6028741
  misc_feature (47)..(295): Pfam Id: peroxidase Pfam Desc: Peroxidase
  misc_feature (1)..(333): NCBI GI: 25044849 NCBI Desc: peroxidase [ananas comosus]
  misc_feature (7)..(331): NCBI GI: 92876748 NCBI Desc: haem peroxidase, plant/fungal/bacterial [medicago truncatula]
  misc_feature (1)..(334): NCBI GI: 115437360 NCBI Desc: os01g0543100 [oryza sativa (japonica cultivar-group)]
  misc_feature (10)..(332): NCBI GI: 110007375 NCBI Desc: peroxidase [dimocarpus longan]
  misc_feature (8)..(331): NCBI GI: 7453855 NCBI Desc: peroxidase prx15 precursor [spinacia oleracea]
  misc_feature (9)..(334): SWISSPROT Homolog: EC 1.11.1.7 Peroxidase 72 precursor
  misc_feature: Useful for making plants with altered cell wall content and/or composition
  misc_feature: Useful for making plants with modulated light quality response
  misc_feature: Functional homolog of the protein sequence encoded by LOCUS at2g18140
  misc_feature: Functional homolog of the protein sequence encoded by LOCUS at2g18150
  misc_feature: Functional homolog of the protein sequence encoded by LOCUS at2g35380
  misc_feature: Functional homolog of the protein sequence encoded by LOCUS at5g66390
  misc_feature: Useful for making plants with altered carbohydrate content
  misc_feature: Functional homolog of the protein sequence given in SEQ ID NO 13815
  misc_feature: Useful for making plants with altered cell wall content and/or composition
  misc_feature: Functional homolog of the protein sequence given in SEQ ID NO 13819
  misc_feature: Useful for making plants with modulated nitrogen use efficiency
  misc_feature: Functional homolog of the protein sequence given in SEQ ID NO 13820
  misc_feature: Useful for making plants with modulated oxidative stress sensitivity
  misc_feature: Functional homolog of the protein sequence given in SEQ ID NO 13607
  misc_feature: Useful for making plants with modulated light quality response
  misc_feature: Functional homolog of the protein sequence given in SEQ ID NO 13816
MTTSMGSLVLLCLVSTLLFPSAVLGHPWGGLFPQFYDHSCPKAKEIVQSIVAQAVAKETRMAASLVRLHFHDCFVKGCDASVLLDNSSSIVSEKGSNPNRNSLRGFEVVDQIKAALEAACPGTVSCADILALAARDSTSLVGGPYWDVPLGRRDSLGASIQGSNNDIPAPNNTLPTIITKFKRQGLNVVDVVALSGGHTIGMSRCTSFRQRLYNQTGNGMADSTLDVSYAAQLRQGCPRSGGDNNLFPLDFVTPAKFDNFYYKNLLAGKGLLSSDEVLLTKSAETAALVKAYAADVNLFFQHFAQSMVNMGNISPLTGSQGEIRKNCRRLNNSH

SEQ ID NO: 3107 - DNA, 1683 bp, Sorghum bicolor
  misc_feature: Ceres ANNOT ID no. 6028747
  misc_feature: Encodes the peptide sequence at SEQ ID NO 3108
atgtcggatcagaaggatcctgggatcaagctcttcggccgggtgatcccgttggagccggaacccgcgccgggaaccacggaagcggaggacccgccgcccagccacgaccagccgccggacgagctgcagccacgggcgccggagttagcggcggcggcggatgaggatcaacacaatgagaaagaagagaaacctgctagtgaaatggttaacatgccacaagagaaggataaagaaatcaaggttgacacgccacaagtggagaaggataatgaaatgaaggtcgatgcgccacaaaaggaacatgatgatgaaatgaaaattgatgcacagcaagagaaaaaagatgaacagatggaagtcaatggatcaccaatgcatgaaaatatagaaccagccaatttacctccctcagagcataagaaagaagacgaggacctgatgaacagtactgaagataaagcagcatcagatccaaagggggagaatgagaagacatcaaatgaggaatcaggccaggacaaggcacttaagaagccagataagattctaccttgtcctcggtgcaacagcatggatacaaagttctgctattacaacaattacaatgttaatcaaccaagacacttctgtaagaattgccagcggtactggactgcagggggcactatgaggaatgtacctgttggtgctgggcggcgcaaaagtaagaattcatcattgcactaccgtcagttactgatggcccctgattgtatgctggggtctagagtggacatatcaaagtcagtgctccctgaagctcttgtatctccacctgccccgatacagccaaccagtagaaatgaaacagttctaaaatttgggcctgaggtgccactttgtgaatcaatggtgtcagcattgaacattgatgagcagaatgtaaacaactctggatcagcaccaagaggtgaaaatagggaagataaccctggacctggcacatcatacaatggtgtgcctgaaaacatggttcacgtcgataagaacggagcaccagttcattgtaacggagttgccccagtgccacaatattaccttggtacccctttcatgtacccttggaatgtaggatggaacaatgtccctgtgatggcgccaggtaaaagtatgcccgaatctgctcctgcttctgcttcagagagctgcagtactagttcagctctatggatgaactctcccatgattccagcctcaagatttcctagtccagcatttccatacccacttgtgccacctgcgctttggggttgtttgtctggatggccagtgacaacttggaacataccatggatcagagctaatggttgcgtgtcaccgtcgtcatcaagcaacagcagctgctcgggcaatgggtctcctactctgggtaaacattccagggactctaatccaatgaaagaggagaagagagagaaatcactgtgggttcccaagacactccggatcgatgatcctgatgaagctgcaaagagctcaatatgggccacccttggcatcaaacccggagaccctggcactttcaagcctttccagtccaaggtcgagagcaagggacagagatcagacgctgctcaggttttgcaggcgaatccagcagcattatcacgctcgcaaacgttccaggagagctcttga

SEQ ID NO: 3108 - protein, 560 aa, Sorghum bicolor
  misc_feature: Ceres ANNOT ID no. 6028747
  misc_feature (180)..(242): Pfam Id: zf-Dof Pfam Desc: Dof domain, zinc finger
  misc_feature (138)..(560): NCBI GI: 56783710 NCBI Desc: ascorbate oxidase promoter-binding protein aobp -like [oryza sativa (japonica cultivar-group)]
  misc_feature (102)..(409): NCBI GI: 92871382 NCBI Desc: zinc finger, dof-type [medicago truncatula]
  misc_feature (86)..(405): NCBI GI: 92871449 NCBI Desc: zinc finger, dof-type [medicago truncatula]
  misc_feature (134)..(436): NCBI GI: 92894858 NCBI Desc: zinc finger, dof-type [medicago truncatula]
  misc_feature (103)..(560): NCBI GI: 63034231 NCBI Desc: dof domain zinc finger dna-binding protein [picea abies]
  misc_feature: The sequence is a functional homolog of SEQ ID NO 10 in the 10/225,066US patent application
  misc_feature: The sequence is a functional homolog of SEQ ID NO 1008 in the 10/225,066US patent application
  misc_feature: The sequence is a functional homolog of SEQ ID NO 112 in the 10/666,642US patent application
  misc_feature: The sequence is a functional homolog of SEQ ID NO 1129 in the 10/374,780US patent application
  misc_feature: The sequence is a functional homolog of SEQ ID NO 1130 in the 10/374,780US patent application
  misc_feature: The sequence is a functional homolog of SEQ ID NO 1131 in the 10/374,780US patent application
  misc_feature: The sequence is a functional homolog of SEQ ID NO 1132 in the 10/374,780US patent application
  misc_feature: The sequence is a functional homolog of SEQ ID NO 1133 in the 10/374,780US patent application
  misc_feature: The sequence is a functional homolog of SEQ ID NO 132 in the 10/412,699US patent application
  misc_feature: The sequence is a functional homolog of SEQ ID NO 1328 in the 10/412,699US patent application
  misc_feature: The sequence is a functional homolog of SEQ ID NO 1329 in the 10/412,699US patent application
  misc_feature: The sequence is a functional homolog of SEQ ID NO 1330 in the 10/412,699US patent application
  misc_feature: The sequence is a functional homolog of SEQ ID NO 1331 in the 10/412,699US patent application
  misc_feature: The sequence is a functional homolog of SEQ ID NO 136 in the 11/375,241US patent application
  misc_feature: The sequence is a functional homolog of SEQ ID NO 1873 in the 11/479,226US patent application
  misc_feature: The sequence is a functional homolog of SEQ ID NO 1968 in the 10/374,780US patent application
  misc_feature: The sequence is a functional homolog of SEQ ID NO 1970 in the 11/479,226US patent application
  misc_feature: The sequence is a functional homolog of SEQ ID NO 2352 in the 10/374,780US patent application
  misc_feature: The sequence is a functional homolog of SEQ ID NO 304 in the 10/374,780US patent application
  misc_feature: The sequence is a functional homolog of SEQ ID NO 309 in the 11/479,226US patent application
  misc_feature: The sequence is a functional homolog of SEQ ID NO 364 in the 10/374,780US patent application
  misc_feature: The sequence is a functional homolog of SEQ ID NO 582 in the 11/435,388US patent application
  misc_feature: The sequence is a functional homolog of SEQ ID NO 724 in the 10/225,066US patent application
  misc_feature: The sequence is a functional homolog of SEQ ID NO 838 in the 10/225,066US patent application
  misc_feature: Useful for making plants with modulated growth and phenotype characteristics
  misc_feature: The sequence is a functional homolog of SEQ ID NO 132 in the 20040045049 US patent application
  misc_feature: The sequence is a functional homolog of SEQ ID NO 1328 in the 20040045049 US patent application
  misc_feature: The sequence is a functional homolog of SEQ ID NO 1329 in the 20040045049 US patent application
  misc_feature: The sequence is a functional homolog of SEQ ID NO 1330 in the 20040045049 US patent application
  misc_feature: The sequence is a functional homolog of SEQ ID NO 1331 in the 20040045049 US patent application
  misc_feature: The sequence is a functional homolog of SEQ ID NO 10 in the 20050160493 US patent application
  misc_feature: The sequence is a functional homolog of SEQ ID NO 1008 in the 20050160493 US patent application
  misc_feature: The sequence is a functional homolog of SEQ ID NO 724 in the 20050160493 US patent application
  misc_feature: The sequence is a functional homolog of SEQ ID NO 1133 in the 20060162006 US patent application
  misc_feature: The sequence is a functional homolog of SEQ ID NO. 486 in the 11/188,298 US application
  misc_feature: The sequence is a functional homolog of SEQ ID NO. 489 in the 11/188,298 US application
  misc_feature: The sequence is a functional homolog of SEQ ID NO. 379 in the 11/188,298 US application
MSDQKDPGIKLFGRVIPLEPEPAPGTTEAEDPPPSHDQPPDELQPRAPELAAAADEDQHNEKEEKPASEMVNMPQEKDKEIKVDTPQVEKDNEMKVDAPQKEHDDEMKIDAQQEKKDEQMEVNGSPMHENIEPANLPPSEHKKEDEDLMNSTEDKAASDPKGENEKTSNEESGQDKALKKPDKILPCPRCNSMDTKFCYYNNYNVNQPRHFCKNCQRYWTAGGTMRNVPVGAGRRKSKNSSLHYRQLLMAPDCMLGSRVDISKSVLPEALVSPPAPIQPTSRNETVLKFGPEVPLCESMVSALNIDEQNVNNSGSAPRGENREDNPGPGTSYNGVPENMVHVDKNGAPVHCNGVAPVPQYYLGTPFMYPWNVGWNNVPVMAPGKSMPESAPASASESCSTSSALWMNSPMIPASRFPSPAFPYPLVPPALWGCLSGWPVTTWNIPWIRANGCVSPSSSSNSSCSGNGSPTLGKHSRDSNPMKEEKREKSLWVPKTLRIDDPDEAAKSSIWATLGIKPGDPGTFKPFQSKVESKGQRSDAAQVLQANPAALSRSQTFQESS

SEQ ID NO: 3109 - DNA, 951 bp, Sorghum bicolor
  misc_feature: Ceres ANNOT ID no. 6028754
  misc_feature: Encodes the peptide sequence at SEQ ID NO 3110
atgtcctttctattcaagtctagcaatggtggtaccactgaaaaaaccatgcccctggaagaacagcaagaaaaaataaatgaactacgcaaggtgcttggtgaccactcatcaccagccattcaagacttcctttcagatgcctcattagcgagatttcttcgagcaaggaactggaatgtgcagaaagctagtaaaatgatgaaagcagctgtgaagtggcggcttgcattcaaacctgaaaacatctgttgggatgatatttcagaggaagcagagaccggaaagatatatagggcagactataaggacaaacatggcagaactgttcttgtattgaggcctggtttagagaacactacctcagcaacaggacagatcaaatatctagtctactctctggagaaagcaattatgaacctgacggaagatcaagagaagatggtatggctgacagatttccagtcctggacattgggaagcacaccactgaaggtgacccgtgagactgtcaatgtcttgcaagactgttatcctgagaggttggggcttgcaatcctttacaaccctcctaggatatttgaatcattctggaagatagtgaagccgttcctggaccaagagacccgcaagaaggtgaagtttgtgtactccaacgacaaggagagccagaagataatggcagaagtctttgacatggaggagctcgactcggcatttgggggaaagaacccagcgacatttgagtacaacagctacgcagagcgaatgcaggaggacgacaagaagatgggatcgttgcacagttcaaccaatagcttgcttgaatcagctgagaaggaggctaatggcgcagactcggacgcctcaagtgaggcctccttctacagtggaactgactctccgaaacatgaggacggtgaacacagcatcgcaaagaagagcggctga

SEQ ID NO: 3110 - protein, 316 aa, Sorghum bicolor
  misc_feature: Ceres ANNOT ID no. 6028754
  misc_feature (98)..(267): Pfam Id: CRAL_TRIO Pfam Desc: CRAL/TRIO domain
  misc_feature (14)..(83): Pfam Id: CRAL_TRIO_N Pfam Desc: CRAL/TRIO, N-terminus
  misc_feature (6)..(307): NCBI GI: 30687745 NCBI Desc: sec14 cytosolic factor family protein / phosphoglyceride transfer family protein [arabidopsis thaliana]
  misc_feature (5)..(315): NCBI GI: 92893041 NCBI Desc: cellular retinaldehyde-binding/triple function, n-terminal [medicago truncatula]
  misc_feature (4)..(263): NCBI GI: 83283975 NCBI Desc: transporter-like protein [solanum tuberosum]
  misc_feature (22)..(263): NCBI GI: 92868927 NCBI Desc: cellular retinaldehyde-binding/triple function, n-terminal [medicago truncatula]
  misc_feature (88)..(286): NCBI GI: 79321295 NCBI Desc: transporter [arabidopsis thaliana]
MSFLFKSSNGGTTEKTMPLEEQQEKINELRKVLGDHSSPAIQDFLSDASLARFLRARNWNVQKASKMMKAAVKWRLAFKPENICWDDISEEAETGKIYRADYKDKHGRTVLVLRPGLENTTSATGQIKYLVYSLEKAIMNLTEDQEKMVWLTDFQSWTLGSTPLKVTRETVNVLQDCYPERLGLAILYNPPRIFESFWKIVKPFLDQETRKKVKFVYSNDKESQKIMAEVFDMEELDSAFGGKNPATFEYNSYAERMQEDDKKMGSLHSSTNSLLESAEKEANGADSDASSEASFYSGTDSPKHEDGEHSIAKKSG

SEQ ID NO: 3111 - DNA, 2400 bp, Sorghum bicolor
  misc_feature: Ceres ANNOT ID no. 6028773
  misc_feature: Encodes the peptide sequence at SEQ ID NO 3112
atgggcaccaccatcctgaccctccccgcaccggagggcaacggcactggcggcggcggcggcgacgacctgcagctgcaggtggcgtcgcctaagcctccccctcccggcgcgaaggcggatcccccggcgacggtggccactcacacgcgcaccatcggcatcatccaccctccgcccgacatccgcgtcatcatcgagaagacggctaccttcgtcgccaagaacgggcccgagttcgagcgccgcatcatctcccacaaccagggcaacgccaaattcaacttcctccagccctcggatccctaccacgcctactaccagcaccgcgtctccgagataggcgctgcgccgcccggcgcggacggcctcttgggcgccgagactgacggggatcccgccgaagcgccagcgtcggcctctgccgacggcggcgccgccgtcgcacctgcagatggcgccgccgcggacgcgaaggccgaccactccgcgcccttccgcgtggcgccgccgcccaaggtgctggtgccacccaaggcggagctgtacacggtgcggctgcccgagggtatcacgggggaggagctggacatcatcaagctgaccgcccagtttgtggcgcggaatggaaagaacttcctgacgagcctggcgcagcgcgagagcaacaacatgcagttccacttcatccggcccacgcacagcatgttccccttctttacggccctcacagatgcctactccagggtgctgaggccagcagagggggtgcctgcgctgctaaaagagctgagggagggggcaaaggacctgactacagtgttggagagatgcctgaaccggttggagtgggataggtcgcaggagcaggcaaggcagcaggcagaggatgaggttgagcaggaacggatgcagatgtcaatgattgactggcatgattttgttgttgtggagaccattgaatttgcggatgatgagtatgaggggcttcccgtgccacttacattggaggagttgaagcgccagaagaggatggagaacttgggagaggaggaagcgatggatttggctgaacctgctaaggaggttgagatggaaatggatgaagaggagatgcaacttgtcgaggaaggaatgcgggcagcacagcttgaggagaatgatggaggagcgcaagttaacgtggctggtgatgacgacgcgcctatgaggattgtcaagaactataagaggcctgaggagaggattcctgcggagagagacccaaccaaatttgttgtctcgccgataactggggagctcattcccatcagcgagatggaggaacacatgcgcatctcactcattgaccctaagtacaaggaacagaaagagaggatgttggccaagatcaaggagactacacttgcacctgatgatgaaatttcacggaacattgttggccttgctcgcactcgccctgatatttttgggaccactgaggaggaggtgtctaacgccgtcaaggcagaaattgagaagaaaaaggatgagcagccaaagcaggttatttgggatggtcattctggtagcattggtcgcactgctactcatgcattatctcagcctcagggtggcgaggaacagtttgatgcttcaaatgttcctggtccagctccacttgtccgacctggcatgccattgccccgacctcctcagccacttcctcttgttaatgttcctcgttttatcgctccaccagcaccatactctcttcaacccccaggtcctcatatgcctggagttccacagatgatgcctcacatgcatctgcctccacagcagatacctgggcagccgccgatggttaggatgccaggtcaaatggttcatatgccgaccaacattccaccgcctcctggccaaactcagtttatgcctggtccaccacgcacgtttgctatgcccccatcatcgcacatgccgcccatggtcaatcccattggaattcctcagcctccagcaccgcctctgcctccgcagcctcctgctgaagagcaaccgcctccacctgatgaaccggaacctaagaggccgagaacagatgatgcttctcttatcccagtggaacagttccttgctcagcatccgggtcctgctagcatctctgtatctgtacccaaccttgacgaagggaacttgagaggccaagttttgcagatccctgttcaatcactgtcagacacagttggtagtctgaaggagcagatagctggagagttgcagctccctgctaataagcagaagctgagtgtgaggactagtttcctcaaagacaaccttactcttgcttactacaatgtgggtcctggagtggtgatcaatctaacactgagagagcgtggtgggagaaagaaatga

SEQ ID NO: 3112 - protein, 799 aa, Sorghum bicolor
  misc_feature: Ceres ANNOT ID no. 6028773
  misc_feature (66)..(110): Pfam Id: Surp Pfam Desc: Surp module
  misc_feature (199)..(243): Pfam Id: Surp Pfam Desc: Surp module
  misc_feature (725)..(794): Pfam Id: ubiquitin Pfam Desc: Ubiquitin family
  misc_feature (132)..(799): NCBI GI: 7527720 NCBI Desc: t5e21.13 [arabidopsis thaliana]
  misc_feature (156)..(762): NCBI GI: 15223844 NCBI Desc: swap (suppressor-of-white-apricot)/surp domain-containing protein [arabidopsis thaliana]
  misc_feature (139)..(689): NCBI GI: 140054189 NCBI Desc: swap/surp; ubiquitin [medicago truncatula]
  misc_feature (405)..(799): NCBI GI: 24647566 NCBI Desc: cg16941-pa [drosophila melanogaster]
  misc_feature (173)..(696): NCBI GI: 68566085 NCBI Desc: splicing factor 3 subunit 1 (sf3a120)
MGTTILTLPAPEGNGTGGGGGDDLQLQVASPKPPPPGAKADPPATVATHTRTIGIIHPPPDIRVIIEKTATFVAKNGPEFERRIISHNQGNAKFNFLQPSDPYHAYYQHRVSEIGAAPPGADGLLGAETDGDPAEAPASASADGGAAVAPADGAAADAKADHSAPFRVAPPPKVLVPPKAELYTVRLPEGITGEELDIIKLTAQFVARNGKNFLTSLAQRESNNMQFHFIRPTHSMFPFFTALTDAYSRVLRPAEGVPALLKELREGAKDLTTVLERCLNRLEWDRSQEQARQQAEDEVEQERMQMSMIDWHDFVVVETIEFADDEYEGLPVPLTLEELKRQKRMENLGEEEAMDLAEPAKEVEMEMDEEEMQLVEEGMRAAQLEENDGGAQVNVAGDDDAPMRIVKNYKRPEERIPAERDPTKFVVSPITGELIPISEMEEHMRISLIDPKYKEQKERMLAKIKETTLAPDDEISRNIVGLARTRPDIFGTTEEEVSNAVKAEIEKKKDEQPKQVIWDGHSGSIGRTATHALSQPQGGEEQFDASNVPGPAPLVRPGMPLPRPPQPLPLVNVPRFIAPPAPYSLQPPGPHMPGVPQMMPHMHLPPQQIPGQPPMVRMPGQMVHMPTNIPPPPGQTQFMPGPPRTFAMPPSSHMPPMVNPIGIPQPPAPPLPPQPPAEEQPPPPDEPEPKRPRTDDASLIPVEQFLAQHPGPASISVSVPNLDEGNLRGQVLQIPVQSLSDTVGSLKEQIAGELQLPANKQKLSVRTSFLKDNLTLAYYNVGPGVVINLTLRERGGRKK

SEQ ID NO: 3113 - DNA, 498 bp, Sorghum bicolor
  misc_feature: Ceres ANNOT ID no. 6028780
  misc_feature: Encodes the peptide sequence at SEQ ID NO 3114
atggcttcctgcaacaagcagctctcctccgtgttgcttgctgtcctcctggcgctcgtcgccggcgggggcgcggtggtggacgctgaacacctgcacttgtacatgcacgacgtgacgggcggtccgtccccgacggcggtgcgggtggtgaacgccccgcgcggctacttcggcaacatgttcgtcatcgacgacgcgctgacggagggcgcctcgtcgtcgaccaccagcagggtggtggggcgcgcgcaggggtactacatgtgcgcgtcggtggccaacctggagctgctggtcaccatgaacgtggttctcacgtcgggcccgtacgccgggagctccgtcaccgtggtgggccgcgacgacatcaacgcgcccgtgcgggagctctcggtggtcggcggcaccggccagttcaggatggcgcgtggctacgtgctctggaagacggtcacgcccgagattatcgacctcgaaatcttcgtcaacccatga

SEQ ID NO: 3114 - protein, 165 aa, Sorghum bicolor
  misc_feature: Ceres ANNOT ID no. 6028780
  misc_feature (7)..(163): Pfam Id: Dirigent Pfam Desc: Dirigent-like protein
  misc_feature (1)..(165): NCBI GI: 77552297 NCBI Desc: dirigent-like protein [oryza sativa (japonica cultivar-group)]
  misc_feature (13)..(156): NCBI GI: 115486441 NCBI Desc: os11g0644700 [oryza sativa (japonica cultivar-group)]
  misc_feature (10)..(155): NCBI GI: 34394264 NCBI Desc: disease resistance response protein-like protein [oryza sativa (japonica cultivar-group)]
  misc_feature (8)..(162): NCBI GI: 28812108 NCBI Desc: disease resistance response protein-like protein [oryza sativa (japonica cultivar-group)]
  misc_feature (10)..(151): NCBI GI: 115484459 NCBI Desc: os11g0179700 [oryza sativa (japonica cultivar-group)]
MASCNKQLSSVLLAVLLALVAGGGAVVDAEHLHLYMHDVTGGPSPTAVRVVNAPRGYFGNMFVIDDALTEGASSSTTSRVVGRAQGYYMCASVANLELLVTMNVVLTSGPYAGSSVTVVGRDDINAPVRELSVVGGTGQFRMARGYVLWKTVTPEIIDLEIFVNP

SEQ ID NO: 3115 - DNA, 1827 bp, Sorghum bicolor
  misc_feature: Ceres ANNOT ID no. 6028785
  misc_feature: Encodes the peptide sequence at SEQ ID NO 3116
atggcgcactgtgttggcgacagtgatggtagtgacaacttcgaatgggatagtgacggcgatggggaggaggcagcgagcttcaacgctgctggtgccagttcatcagcaatggcatcaacgaacgctgatgctccaggcccatctacacgggttgctaatggcaatgggaaggctgggccatctgcctctttggttcataagtatatggacatgggtttcccagaagagattgttctgaaggccatgaaggacaatggggataatggagcagattcattagttgagcttcttcttacttaccaggaactaggcaatgacctcaaagtggataatggctttgcttctggttgtgtcccccaaaatgttgacgatagtgatgatgatgacattctagaaaactgggatgatgaggatgctggtggtagaagcaccggggttgctaactcggttgatgattctggagatgaggatttcttacatgagatgtcacagacggacgagaaagtttattccttagttaaaatggggtttcctgaagacgaggctgcactggctgttactagatgcgggcaggatgcatctatttcggttctggtggattcaatatatgcttcacagactgcaggagatgtttactgtggcaatttgtctgactatgaggataattcctacggagggagaaacaaaggaaggttcatggatgcgaacaaaaaaaggagaaagagatatgaaggtcaagcacacggaagtagaggcccattggatggtagctctgatgaacccatgcctctcccacatccaatggttggatttagtttgccacaccagtgcacaaggccagtggacagatcactgccttcacaagctatgggtccaccatacttctactatgagaacgttgctcttgctccaaaaggtgtttggactaccatatcaagattcttgtatgatattcagccagagtttgtggactcgaagtacttctgtgctgctgccaggaaaagaggttatatacacaatctgccacttgagaacaggtcacctctcctccccatacctccaaagaaaatatcagaagcatttcctcataccaagaggtggtggccatcatgggacccaagacgacagttcaattgcctccagacttgtgtgtctagtgcaaaactgttagagaggattcgtgtagctcttacaaacagttcagatccacctcctccaagagttcagaagtttgtgttggaggagtgtaggaaatggaatctcgcttgggttggcttaaacaaggttgctcctctagagcctgatgagatggagtttctactcggttttccgaaggatcacaccagaggtatcagcaggagagagaggtaccgatctctaggaaattcatttcaagttgatactgttgcttaccatctctcggtcctcaaggatatgtacccacaaggcatgaatgtactgtctttattctctggtattggaggagcagaggtggctctccacaggcttggtatacgcatgaaaacagttatttcagtagagaagtctgaggtcaataggacgattctgaagagttggtgggatcagacgcagactggtcttttaattgagatttgtgatgtgcagacattgacatctgagaggatcgaggcatatgttagaagaattggtggctttgatcttgtgattggtggaagtccctgtaacaatcttactgggagcaaccgttaccacagagatggtttggagggcgagcattcttcgttattctaccactatgttaggatcttagactctgtcaagtccatcatggagcgtttgtag

SEQ ID NO: 3116 - protein, 608 aa, Sorghum bicolor
  misc_feature: Ceres ANNOT ID no. 6028785
  misc_feature (9)..(607): NCBI GI: 29467228 NCBI Desc: dna methyltransferase [nicotiana tabacum]
  misc_feature (34)..(607): NCBI GI: 92874580 NCBI Desc: ubiquitin-associated [medicago truncatula]
  misc_feature (102)..(607): NCBI GI: 140056280 NCBI Desc: uba-like [medicago truncatula]
  misc_feature (258)..(551): NCBI GI: 42766606 NCBI Desc: at5g15380 [arabidopsis thaliana]
  misc_feature (293)..(603): NCBI GI: 22135461 NCBI Desc: dna methyltransferase dmt106 [zea mays]
MAHCVGDSDGSDNFEWDSDGDGEEAASFNAAGASSSAMASTNADAPGPSTRVANGNGKAGPSASLVHKYMDMGFPEEIVLKAMKDNGDNGADSLVELLLTYQELGNDLKVDNGFASGCVPQNVDDSDDDDILENWDDEDAGGRSTGVANSVDDSGDEDFLHEMSQTDEKVYSLVKMGFPEDEAALAVTRCGQDASISVLVDSIYASQTAGDVYCGNLSDYEDNSYGGRNKGRFMDANKKRRKRYEGQAHGSRGPLDGSSDEPMPLPHPMVGFSLPHQCTRPVDRSLPSQAMGPPYFYYENVALAPKGVWTTISRFLYDIQPEFVDSKYFCAAARKRGYIHNLPLENRSPLLPIPPKKISEAFPHTKRWWPSWDPRRQFNCLQTCVSSAKLLERIRVALTNSSDPPPPRVQKFVLEECRKWNLAWVGLNKVAPLEPDEMEFLLGFPKDHTRGISRRERYRSLGNSFQVDTVAYHLSVLKDMYPQGMNVLSLFSGIGGAEVALHRLGIRMKTVISVEKSEVNRTILKSWWDQTQTGLLIEICDVQTLTSERIEAYVRRIGGFDLVIGGSPCNNLTGSNRYHRDGLEGEHSSLFYHYVRILDSVKSIMERL

SEQ ID NO: 3117 - DNA, 888 bp, Sorghum bicolor
  misc_feature: Ceres ANNOT ID no. 6028788
  misc_feature: Encodes the peptide sequence at SEQ ID NO 3118
atgggcaagaatggcacccagtacgcagtgctggacgccttcacggcggagccgttcaggggcaaccccgccgcggtgtgcctcctccaggacgccgccaaggccgctgacgagcggtggatgcagtccgtcgccgccgagttcaacctctccgagaccgccttcctcctccgggactcctccgcgtctggcgccgccccgcggttccagctccgatggttcacccccgccgctgaggtggagctctgcggccacgcgacgctggcctccgcccacttcctcttcacatccgtcctcgcggagcacgagacgctcatcgagttctcgaccaagtcggggattcttaccgccaaaagggttcctgcgccggagagcacgggcgtgtcaggcgaggggaaactgttcattgagctggatttccccatgattgaccttgttgattgccatccttccgagctgccgtccatccccaagaccctgaacggagcctccattgtcagcgttcacaaggcaacgacggccggtgacctcattgtggagctttcatcaggaaaagaggttgctgatatcattcctaacattcatgaaatcaaaatatgttcaggcagaggaattattgttacagggccagcgcctgctggatctggttatgacttcttcagtcgtttcttctgcccaaaatttgggatacctgaggaccccgtttgcggcagtgcacattgtgtcttggcaccttattggggtgggaagctggggaaacacaaattgacggcatttcaagcatctccacggagtggaatactatacctggagttagaagctgcaggcaggagagtgcgaattcagggagaagctgttactgtgatgactggtaccctcctagcgtag

SEQ ID NO: 3118 - protein, 295 aa, Sorghum bicolor
  misc_feature: Ceres ANNOT ID no. 6028788
  misc_feature (5)..(291): Pfam Id: PhzC-PhzF Pfam Desc: Phenazine biosynthesis-like protein
  misc_feature (1)..(294): NCBI GI: 92867002 NCBI Desc: phenazine biosynthesis phzc/phzf protein [medicago truncatula]
  misc_feature (1)..(294): NCBI GI: 79461947 NCBI Desc: catalytic [arabidopsis thaliana]
  misc_feature (11)..(294): NCBI GI: 92867000 NCBI Desc: phenazine biosynthesis phzc/phzf protein [medicago truncatula]
  misc_feature (3)..(294): NCBI GI: 51972140 NCBI Desc: at4g02850 [arabidopsis thaliana]
  misc_feature (1)..(232): NCBI GI: 92867001 NCBI Desc: phenazine biosynthesis phzc/phzf protein [medicago truncatula]
MGKNGTQYAVLDAFTAEPFRGNPAAVCLLQDAAKAADERWMQSVAAEFNLSETAFLLRDSSASGAAPRFQLRWFTPAAEVELCGHATLASAHFLFTSVLAEHETLIEFSTKSGILTAKRVPAPESTGVSGEGKLFIELDFPMIDLVDCHPSELPSIPKTLNGASIVSVHKATTAGDLIVELSSGKEVADIIPNIHEIKICSGRGIIVTGPAPAGSGYDFFSRFFCPKFGIPEDPVCGSAHCVLAPYWGGKLGKHKLTAFQASPRSGILYLELEAAGRRVRIQGEAVTVMTGTLLA

SEQ ID NO: 3119 - DNA, 1227 bp, Sorghum bicolor
  misc_feature: Ceres ANNOT ID no. 6028792
  misc_feature: Encodes the peptide sequence at SEQ ID NO 3120
atgggttttttcggtagaacacctcctgcaagctgcccagcaacccggcactgcgcagaatgggcccgaatctacttgaagtattgcttgtgcagccagaaggaaggtgctgccctggcacttgggctaatcagtgtcataagctggggcctcgccgaggtgccacagataataacaaattacagacagaagtcaacagaaggactctctgtcgccttccttatgacctggattgttggggatttgtttaaccttgttggctgcttcctcgaacctgctactctgccaactcagttctacatggctttgctatataccatgacaacactgattcttactggacagacgctatactatagccacatctaccatcgtcttaaagcaaaaaaatccagggcagctagcaagccacaaaagcatcaccgtggggatgcttcattacgtgaaaagcttttgggcgccaaggacggtgcggcatccagaaacaacaatgagtcagatgctacagtccttattccaagctcacctattcctgttaatatgaaatttgtcgaccaatgccatggaagcagccccagtaccgactattactacatgtcagcaagatccttgtccagtagtccagtgccaactgctggtacatggttgggcagtaatcgtcaatcatcaaggactcccccacaaacgaatgatcaaaggggatctttagttggtgagatcgctccagcacattctgcaccatctactgtaacaaaaaatgccctctcagtggcaccatggatgggtcttctattgggtatgtgtctcttgcacattttagttggaaacacacatagggaaatgccaagtggaactgtcataccagttggaagaaggcttttactgtttgtggatgatcatggaaattcatctctcagccatggtagtggaagtgaaattggaagctttcttggttgggctatggcaataatttatatgggtgggcggcttccccagattttgttaaatgggctgaatccattaatgtttgcctttgctttagtgggaaattcaacatacgtaggaagtatacttgtaaatagcatggactggtcgaaacttagaccaaatctcccgtggcttgtagacgctggaggatgtgttttgctggattctttttttctttatttccattatcggaagcaaagggagccttcggatgagcatgacgatgcagataaagcttaa

SEQ ID NO: 3120 - protein, 408 aa, Sorghum bicolor
  misc_feature: Ceres ANNOT ID no. 6028792
  misc_feature (36)..(100): Pfam Id: PQ-loop Pfam Desc: PQ loop repeat
  misc_feature (310)..(369): Pfam Id: PQ-loop Pfam Desc: PQ loop repeat
  misc_feature (102)..(404): NCBI GI: 140062013 NCBI Desc: cystinosin/ers1p repeat [medicago truncatula]
  misc_feature (9)..(168): NCBI GI: 140063820 NCBI Desc: cystinosin/ers1p repeat [medicago truncatula]
  misc_feature (9)..(168): NCBI GI: 92868494 NCBI Desc: cystinosin/ers1p repeat [medicago truncatula]
  misc_feature (95)..(387): NCBI GI: 124359535 NCBI Desc: cystinosin/ers1p repeat [medicago truncatula]
  misc_feature (9)..(168): NCBI GI: 140050311 NCBI Desc: cystinosin/ers1p repeat [medicago truncatula]
MGFFGRTPPASCPATRHCAEWARIYLKYCLCSQKEGAALALGLISVISWGLAEVPQIITNYRQKSTEGLSVAFLMTWIVGDLFNLVGCFLEPATLPTQFYMALLYTMTTLILTGQTLYYSHIYHRLKAKKSRAASKPQKHHRGDASLREKLLGAKDGAASRNNNESDATVLIPSSPIPVNMKFVDQCHGSSPSTDYYYMSARSLSSSPVPTAGTWLGSNRQSSRTPPQTNDQRGSLVGEIAPAHSAPSTVTKNALSVAPWMGLLLGMCLLHILVGNTHREMPSGTVIPVGRRLLLFVDDHGNSSLSHGSGSEIGSFLGWAMAIIYMGGRLPQILLNGLNPLMFAFALVGNSTYVGSILVNSMDWSKLRPNLPWLVDAGGCVLLDSFFLYFHYRKQREPSDEHDDADKA

SEQ ID NO: 3121 - DNA, 1476 bp, Sorghum bicolor
  misc_feature: Ceres ANNOT ID no. 6028813
  misc_feature: Encodes the peptide sequence at SEQ ID NO 3122
atgggcggcggcaacggcgatggaaccaccccgctgggggagccgctgctggcgaagaaggggagggcgtaccggccgaggtgccccggatgccgggtggaccgcctgaacgcggagcgggagggggtgttccctctcaaggacctcttcctcatctggctcgtcaccatcacctgcaccttgccgatccagtctctgtttcccttcttgtattttatgataagggatctgcatattgctaaacaaacacaagacattggattttacgctggttttgttggcgcttcatatatgtttgggagagcactctcctcaacaatatggggaatcgtggctgataagtatggaaggaaaccagttatcgtactgacccttgttgcaatagttatcttcaatactctctttggactaagcttaaactattggatggcattaatcacacgatgcctgcttggggtcatgtgtggttatctcgggccaattaaggcttatgctacagaagttgtccgaaaagaatacaaccatctagctttagcagttgtttcttcctcacgaggcattggtctcattattggaccagctattggtggttaccttgcacagcctgcagataaatatccaagcatattctctcagacatccatatttgggaggtttccatattttcttccctgcctgtgtatatcgatccttgcagttattgctctaattgcctgcatctggtttccggaaactttgcataaacacaatgaggataccgttgataattcagttgaaactgtagaagaatctcttgctggtacagacactgaagaaaatggaggtggtggatgtctaacattgtttaaaaactggccgttgatgtcatctattactttatattgtatcttctctcttcaggatgtggcttatgcagagacgttctctctttgggctgtcagtgacagatcatatggtggattaagctttactaccacagatgtgggcaatgtccttgcaatgtcaggtctcttcctttttctgtatcaaatgttgatttatccattgcttgcaaaagcggtggaccacatcacattagttcgtgcagtggcgatattgactctaccacttcttgctagctatccattctttccttcattgaaagggttcgtgcttatgttggtagtaaattgtgcatcttttctgaagaatactttctcggtaactaccattaccgtgttcaacattttgatgaatgaagctgtgactcaggatgtaagagctgcagccaatggcatagctgtaacactaatgtccatctcaaaagctgttgctccagctgttgcaggaattatattttcatgggcccagaggcgtcaaacagcttcgtttcttccaggcgaccacttggtgttcttcatactgaacatcttcacactcaccggtctcatcttcaccttcagaccgttttttgttcgaggcagcgcgaagcactga

SEQ ID NO: 3122 - protein, 491 aa, Sorghum bicolor
  misc_feature: Ceres ANNOT ID no. 6028813
  misc_feature (52)..(439): Pfam Id: MFS_1 Pfam Desc: Major Facilitator Superfamily
  misc_feature (15)..(483): NCBI GI: 77548534 NCBI Desc: major facilitator superfamily protein [oryza sativa (japonica cultivar-group)]
  misc_feature (29)..(483): NCBI GI: 115487198 NCBI Desc: os12g0133100 [oryza sativa (japonica cultivar-group)]
  misc_feature (4)..(484): NCBI GI: 56783672 NCBI Desc: major facilitator superfamily antiporter [oryza sativa (japonica cultivar-group)]
  misc_feature (28)..(483): NCBI GI: 42565446 NCBI Desc: transporter-related [arabidopsis thaliana]
  misc_feature (28)..(483): NCBI GI: 77548523 NCBI Desc: major facilitator superfamily [oryza sativa (japonica cultivar-group)]
  misc_feature: Useful for making plants with modulated flowering time
  misc_feature: Functional homolog of the protein sequence given in SEQ ID NO 12969
MGGGNGDGTTPLGEPLLAKKGRAYRPRCPGCRVDRLNAEREGVFPLKDLFLIWLVTITCTLPIQSLFPFLYFMIRDLHIAKQTQDIGFYAGFVGASYMFGRALSSTIWGIVADKYGRKPVIVLTLVAIVIFNTLFGLSLNYWMALITRCLLGVMCGYLGPIKAYATEVVRKEYNHLALAVVSSSRGIGLIIGPAIGGYLAQPADKYPSIFSQTSIFGRFPYFLPCLCISILAVIALIACIWFPETLHKHNEDTVDNSVETVEESLAGTDTEENGGGGCLTLFKNWPLMSSITLYCIFSLQDVAYAETFSLWAVSDRSYGGLSFTTTDVGNVLAMSGLFLFLYQMLIYPLLAKAVDHITLVRAVAILTLPLLASYPFFPSLKGFVLMLVVNCASFLKNTFSVTTITVFNILMNEAVTQDVRAAANGIAVTLMSISKAVAPAVAGIIFSWAQRRQTASFLPGDHLVFFILNIFTLTGLIFTFRPFFVRGSAKH

SEQ ID NO: 3123 - DNA, 2190 bp, Sorghum bicolor
  misc_feature: Ceres ANNOT ID no. 6028816
  misc_feature: Encodes the peptide sequence at SEQ ID NO 3124
atggcgctactcctccgcccgacttctcctccctctccccacctccgcgcgctcctccgccgcctcctctccactggcgccggacccttcccctcacgcatgctcccctcgccccgctccaccgccgccgtccctcggctcctcttcgggccaagggttgtggcggcggcggcggcggccccgcggcggaatggggtcccggtgcgtgcgttcatggcctcaacgacggcgtctgaagcgatgcatgagaagcgggtggccgccgagtacactgctgccaatgtccaggtcctagaagcattagatggagttcgcacaaggcctggtatgtacattgggagcacaggaccacgtggattgcatcatctggtttatgaaatcttggataatgctgtggatgaaggtcaagcgggtcacgcttcaaagattgatgtagttcttcatgatgacaattctgttagtgtaacagacaatggacgtgggattcctacggatatgcacccccagacgaagaaatcttgtgtggagactgtcttaacgttaatgcatgctggtggcaaatttggaggttcaaagagtggttacagtgtctctggagggcttcatggtgttggtttatcagttgttaatgctttatcagaggcacttgaagttactgtttggcgtgatgggaacaaatacagacaaagctattcaaggggaaagccaacaacgccgctaagtagtatcacacttactggtgaaacaagtcctcgtcaaggaacaagcattagattttggcctgataaagatatatttaccaccaccattgattttgacttcaatacaatctccagtcgcattcgggagcttgcctttctaaatcctgagcttacaataaccttgacaaaggaagaagggcacacagttcaacataatgaatactgttatgctggtggccttgttgaatatgttaaatggttgaatactgacaagaaacccctgcatgacccgattgcgttcagaaaggagttggatggtataacagtggatgtctcccttcaatggtcctctgattcgtactctgatacagtgctaggatatgcaaacagtatccggactattgatggtggtactcatattgatggcctgaaggcttcattgacaagaaccattaataactttgcgaagaagtcaaagactattaaggataaggatattaccttgagtggggagcatgtaagagaagggatgacatgcgtcatttcagtgaaggtccctagtccagagtttgaggggcaaacaaagacaaggttgggaaatccagaagtacggagaatagtcgaacaggctgttcaagaaaacttaacagagtacttagagcttcatccagatgttctggattcaatcctatcaaagtcccttaatgctctcaaggcttcgttggcagccaagcgggctagggaactagttaggtcaaagagtgtgttgaaatcttcttcaatccctgggaaattagctgattgtgcatcaactaatcctgaagaatctgaaatcttcattgtcgaaggtgattctgcgggtggtagtgcaaagcaaggacgagatagaagatttcaggctattttgcccctaagaggtaaaattctcaacattgaaagaagggatgaagcagccatgtacaaaaatgaagagatccaaaaccttattcttgcgcttggattaggagtgaagggtgaggattttaagaaggaggctctccggtatcataagatagttatacttactgatgctgatgttgatggcgcacatatccggactctcctccttactttcttcttcagatatcaaagagcattatttgatgaaggttgcatctacgttggtgtacctcctctttataaggttgagcgtggaaaacaagcacattactgctatgatgatgctgatcttaaagagatagttaacaccttccctccaaatgcgtcatatcatatccagaggtttaaaggtttgggtgagatgatgcctgtacaactgtgggaaacaacaatggatcctgagaggcggctgttgaagcagcttaaggttgaagatgctgctgaggccaatgttgtgttctcgtcacttatgggtagccgggttgaatataggaagcaactgatccaggaagctgctagcacgatcagcatggatcaacttgacatttga

SEQ ID NO: 3124 - protein, 729 aa, Sorghum bicolor
  misc_feature: Ceres ANNOT ID no. 6028816
  misc_feature (313)..(483): Pfam Id: DNA_gyraseB Pfam Desc: DNA gyrase B
  misc_feature (650)..(716): Pfam Id: DNA_gyraseB_C Pfam Desc: DNA gyrase B subunit, carboxyl terminus
  misc_feature (115)..(264): Pfam Id: HATPase_c Pfam Desc: Histidine kinase-, DNA gyrase B-, and HSP90-like ATPase
  misc_feature (510)..(615): Pfam Id: Toprim Pfam Desc: Toprim domain
  misc_feature (1)..(729): NCBI GI: 75285839 NCBI Desc: dna gyrase subunit b, chloroplast/mitochondrial precursor
  misc_feature (4)..(729): NCBI GI: 38017095 NCBI Desc: dna gyrase b subunit [nicotiana benthamiana]
  misc_feature (245)..(729): NCBI GI: 9955568 NCBI Desc: dna gyrase subunit b-like protein [arabidopsis thaliana]
  misc_feature (346)..(729): NCBI GI: 92896012 NCBI Desc: dna topoisomerase ii [medicago truncatula]
  misc_feature (86)..(729): NCBI GI: 81301300 NCBI Desc: dna gyrase, b subunit [synechococcus elongatus pcc 7942]
  misc_feature (1)..(729): SWISSPROT Homolog: EC 5.99.1.3 DNA gyrase subunit B, chloroplast/mitochondrial precursor
MALLLRPTSPPSPHLRALLRRLLSTGAGPFPSRMLPSPRSTAAVPRLLFGPRVVAAAAAAPRRNGVPVRAFMASTTASEAMHEKRVAAEYTAANVQVLEALDGVRTRPGMYIGSTGPRGLHHLVYEILDNAVDEGQAGHASKIDVVLHDDNSVSVTDNGRGIPTDMHPQTKKSCVETVLTLMHAGGKFGGSKSGYSVSGGLHGVGLSVVNALSEALEVTVWRDGNKYRQSYSRGKPTTPLSSITLTGETSPRQGTSIRFWPDKDIFTTTIDFDFNTISSRIRELAFLNPELTITLTKEEGHTVQHNEYCYAGGLVEYVKWLNTDKKPLHDPIAFRKELDGITVDVSLQWSSDSYSDTVLGYANSIRTIDGGTHIDGLKASLTRTINNFAKKSKTIKDKDITLSGEHVREGMTCVISVKVPSPEFEGQTKTRLGNPEVRRIVEQAVQENLTEYLELHPDVLDSILSKSLNALKASLAAKRARELVRSKSVLKSSSIPGKLADCASTNPEESEIFIVEGDSAGGSAKQGRDRRFQAILPLRGKILNIERRDEAAMYKNEEIQNLILALGLGVKGEDFKKEALRYHKIVILTDADVDGAHIRTLLLTFFFRYQRALFDEGCIYVGVPPLYKVERGKQAHYCYDDADLKEIVNTFPPNASYHIQRFKGLGEMMPVQLWETTMDPERRLLKQLKVEDAAEANVVFSSLMGSRVEYRKQLIQEAASTISMDQLDI

SEQ ID NO: 3125 - DNA, 1518 bp, Sorghum bicolor
  misc_feature: Ceres ANNOT ID no. 6028821
  misc_feature: Encodes the peptide sequence at SEQ ID NO 3126
atggctcacggaaggcgaaaagacgacgaggaggattgcacttgcacggcggccctgctgctgcgcggcgacgacgccgaggcatggaaggaggaagagtggcaccaccaccaccaccaccaccacgcgtcctccagcgatctatggaggtggatgaggagggtacgcgaggagtcgaggaagctgtgggaggtcgtggggcccgccatcttcacacgcgccgccatctacagcctcaacgtcgtcatgcaggcagtcgccggccacctcggcgacctcgagctggcatccgtctccttcgcctgcactgtcctgaccggcttcaactatggcctcatgcttggcatggcgagcgcgctggagacgttgtgtggccaggcgtacggcgccaagaagtaccacatgatgggagtgtacatgcagcgctcgtggatcgtcctcttcgtgtgcgccctgctgctgacgcccatgtacttcttcaccgaggacctgctcctggtgacggggcagccgccgaagctgtcggcgatggcggggcgggtctccatgtggttcatccctctgcacttctcccaggccttcctcttcccgctgcagttgttcctacagtgccagcggaagaacctggccaacgccactgccgccgccgccgcgctcggcatccacctctttgtcagctggctcttcgtagccaggctcaagctcgggctcgtcggcgtcgcgctcacgctcagcgtctcgtggtggacgatcaccgctatgcttttcgtctatgtcacgtgtggcggctgcccagagacctggcacggcttcacggcggaggcgttcgccggactgggggagttcatcaagctgtccgctgcctccggtgtcatgctttgcttggagaactggtactataggatactgatcttgctgaccgggaacctcaagaacgcggcagttgcggtggatgccctctccatctgcatgaatatcaatggatgggagatgacgattccactggcattttttgccggcaccggggtgcgggtggccaacgagctcggtgctggaaatggcattggcgccaggtttgcggccattgtatcatccacgacctcactggtgatcgggctcttcttctgggtgctgatcatgggcctccacagcaagatcgctctcatcttcaccaccagtgctgtcgtgctggatgccgtcgataagctctcgctcttgctggccttcaccatactcctcaacagcgtacagcctgtcttgtcaggtgtggctgttgggtcaggatggcagtcgacggtggcgtacatcaacatcggctgctattacatcatcggcatacccatgggcgtcctcctcggatggctcttcaaccttggcgtgctggggatctgggcaggcatgatcggcggaaccgcagtgcagacgctcatcctggccatcataaccgttcgctgcgactgggaaaaacaggctattatcgcgagcacgcgcatggacaagttatcgcaggtccggtga

SEQ ID NO: 3126 - protein, 505 aa, Sorghum bicolor
  misc_feature: Ceres ANNOT ID no. 6028821
  misc_feature (68)..(228): Pfam Id: MatE Pfam Desc: MatE
  misc_feature (288)..(451): Pfam Id: MatE Pfam Desc: MatE
  misc_feature (116)..(505): NCBI GI: 115451229 NCBI Desc: os03g0188100 [oryza sativa (japonica cultivar-group)]
  misc_feature (58)..(329): NCBI GI: 72384467 NCBI Desc: 52o08_38 [brassica rapa subsp. pekinensis]
  misc_feature (58)..(329): NCBI GI: 72255624 NCBI Desc: 117m18_23 [brassica rapa]
  misc_feature (53)..(500): NCBI GI: 91806846 NCBI Desc: ripening-responsive protein [arabidopsis thaliana]
  misc_feature (54)..(474): NCBI GI: 12231296 NCBI Desc: ripening regulated protein ddtfr18 [lycopersicon esculentum]
MAHGRRKDDEEDCTCTAALLLRGDDAEAWKEEEWHHHHHHHHASSSDLWRWMRRVREESRKLWEVVGPAIFTRAAIYSLNVVMQAVAGHLGDLELASVSFACTVLTGFNYGLMLGMASALETLCGQAYGAKKYHMMGVYMQRSWIVLFVCALLLTPMYFFTEDLLLVTGQPPKLSAMAGRVSMWFIPLHFSQAFLFPLQLFLQCQRKNLANATAAAAALGIHLFVSWLFVARLKLGLVGVALTLSVSWWTITAMLFVYVTCGGCPETWHGFTAEAFAGLGEFIKLSAASGVMLCLENWYYRILILLTGNLKNAAVAVDALSICMNINGWEMTIPLAFFAGTGVRVANELGAGNGIGARFAAIVSSTTSLVIGLFFWVLIMGLHSKIALIFTTSAVVLDAVDKLSLLLAFTILLNSVQPVLSGVAVGSGWQSTVAYINIGCYYIIGIPMGVLLGWLFNLGVLGIWAGMIGGTAVQTLILAIITVRCDWEKQAIIASTRMDKLSQVR

SEQ ID NO: 3127 - DNA, 879 bp, Sorghum bicolor
  misc_feature: Ceres ANNOT ID no. 6028823
  misc_feature: Encodes the peptide sequence at SEQ ID NO 3128
atgcagggcggcgtctccggattccagaacgcgccggtgacgcgggcggtcgtcctcgcgagcggcctcctgtccgtcgtcttcagcgcgcagcgccgcgcccgcgcccttggcatctcataccaggacactataacgaatttccgtttatggaagatattcccatctgtatttgcttttcagtcaacaccggagttaatgtttggactgtaccttctgtattacttccgtgtgtttgagaggcagataggctctaacaaatactcggttttttgtctgttcactatcacagcatcatcactcctcgagatcctgtcattggttatcctgaaagatacaaactacatcagtacgcttgcatcagggccttatggtctaatatttgcctcttttgttccattctttcttgacattccggtcacatcacggttccgtatttttggcctgaatttcagtgacaaatcattcatttacttagctggtcttcagcttcttttatcttcttggaagcgctcccttattcctggtatatttggtctggttgctggttctctctatcgtctaaatgtgctcggcatccgcaagatgaagcttccacaggttatttcatcattttttgcaagatactttgccccttccccaggaagcacacctcgcccctccaggagtcttgttggaaacacaccgtcccaaacaggacgtgctgttcagaatcagccatcaactggatttgcacctatcgtggaacctccggagtcctccgttgctatgctggtctcgatgggctttgatgacaataacgcaaggcaggcactggtgagggcaagaaatgacatcaacgtggcaacgaacatcctactggaagcacaatctcattga

SEQ ID NO: 3128 - protein, 292 aa, Sorghum bicolor
  misc_feature: Ceres ANNOT ID no. 6028823
  misc_feature (250)..(286): Pfam Id: UBA Pfam Desc: UBA/TS-N domain
  misc_feature (42)..(197): NCBI GI: 115440573 NCBI Desc: os01g0806000 [oryza sativa (japonica cultivar-group)]
  misc_feature (4)..(226): NCBI GI: 119629416 NCBI Desc: phosphoglycerate dehydrogenase like 1, isoform cra_b [homo sapiens]
  misc_feature (72)..(226): NCBI GI: 39645857 NCBI Desc: phgdhl1 protein [homo sapiens]
  misc_feature (117)..(226): NCBI GI: 111307736 NCBI Desc: phgdhl1 protein [homo sapiens]
  misc_feature (127)..(226): NCBI GI: 119629418 NCBI Desc: phosphoglycerate dehydrogenase like 1, isoform cra_d [homo sapiens]
MQGGVSGFQNAPVTRAVVLASGLLSVVFSAQRRARALGISYQDTITNFRLWKIFPSVFAFQSTPELMFGLYLLYYFRVFERQIGSNKYSVFCLFTITASSLLEILSLVILKDTNYISTLASGPYGLIFASFVPFFLDIPVTSRFRIFGLNFSDKSFIYLAGLQLLLSSWKRSLIPGIFGLVAGSLYRLNVLGIRKMKLPQVISSFFARYFAPSPGSTPRPSRSLVGNTPSQTGRAVQNQPSTGFAPIVEPPESSVAMLVSMGFDDNNARQALVRARNDINVATNILLEAQSH

SEQ ID NO: 3129 - DNA, 1317 bp, Sorghum bicolor
  misc_feature: Ceres ANNOT ID no. 6028825
  misc_feature: Encodes the peptide sequence at SEQ ID NO 3130
atgctggcggcgtccaccaaggtcggctctaggctggcctctccgcacgcctcctcgtccgccagtgctgctgctgctgtggcgacggcgctggcgagctcccccgtgctgggctctgggtctggggtgctctcaggcgccgggttcggcgagacggggagtcatcacgcggcggacgcgccgccgccttgcagttcctcgggcgattcaagggaatattgtcagtggaagagactggtgaatcaaaggcagtcaacgctacaaggaggcaaagtgactgctgcattgggcgatcatgtttctggcgcacgctgttcctcgtggagtcaacatattaacagatacttttcatcttcttctcatcaagggaggatatgggccgggagcaaggttctacatgacctgccacagtatgtaaaaattgtggaagtagggccacgggatggtttacagaatgaaaaggacattgtaccaacacctgtaaaggttgagcttatacgaagattggccacatccggattacctgtggtggaggcaacaagttttgtatctccaaaatgggtacctcagttagctgatgcgaaggatgttatggaagcagttcggattattgagggtgtgcgtcttcctgtattgaccccaaaccttaagggatttgaggcagctattgcagcaggggcaaaagaaatcgcaatatttgcatcagcttctgaaggattttccaagtcaaacataaactgcaccatcaaagagagcattgcccgttataatgatgttgctcttgctgcaaaagagaaagaaattcctgtccgagggtatgtgtcttgtgtggttggatgcccagtagatggaccagtaccaccttcaaacgtagcttatgtagcgaaagaactttatgacatgggctgctatgaagtttcacttggtgataccattggagtcggtactccaggtaccgtggctccaatgcttgaggcagccatgtccgtcgttcccgtggagaagcttgctgtccacttccacgacacctacggccagtccctctcaaatattctcatctctctccagatgggagtcaacgttgtggactcctctgtcgctggcctcggtggctgcccgtacgcaaagggtgcgtcagggaacgtggcgacggaggatgtagtgtacatgctcaaagggctgggcatcaagacgggcgtcgacctgggcaaggtgatggccgccggcgagtttatctgcaagcacctgggacgccagtctgggtccaaggcagcgaccgctctgagcaaagttactgcaaacgcctcgaaactctga

SEQ ID NO: 3130 - protein, 438 aa, Sorghum bicolor
  misc_feature: Ceres ANNOT ID no. 6028825
  misc_feature (147)..(418): Pfam Id: HMGL-like Pfam Desc: HMGL-like
  misc_feature (13)..(438): NCBI GI: 115435876 NCBI Desc: os01g0269000 [oryza sativa (japonica cultivar-group)]
  misc_feature (112)..(438): NCBI GI: 124360527 NCBI Desc: pyruvate carboxyltransferase [medicago truncatula]
  misc_feature (137)..(431): NCBI GI: 19526275 NCBI Desc: hydroxymethylglutaryl-coa lyase [takifugu rubripes]
  misc_feature (135)..(431): NCBI GI: 41055014 NCBI Desc: similar to 3-hydroxymethyl-3-methylglutaryl-coenzyme a lyase (hydroxymethylglutaricaciduria) [danio rerio]
  misc_feature (127)..(431): NCBI GI: 13242293 NCBI Desc: 3-hydroxy-3-methylglutaryl coa lyase [rattus norvegicus]
  misc_feature (127)..(431): SWISSPROT Homolog: EC 4.1.3.4 Hydroxymethylglutaryl-CoA lyase, mitochondrial precursor
MLAASTKVGSRLASPHASSSASAAAAVATALASSPVLGSGSGVLSGAGFGETGSHHAADAPPPCSSSGDSREYCQWKRLVNQRQSTLQGGKVTAALGDHVSGARCSSWSQHINRYFSSSSHQGRIWAGSKVLHDLPQYVKIVEVGPRDGLQNEKDIVPTPVKVELIRRLATSGLPVVEATSFVSPKWVPQLADAKDVMEAVRIIEGVRLPVLTPNLKGFEAAIAAGAKEIAIFASASEGFSKSNINCTIKESIARYNDVALAAKEKEIPVRGYVSCVVGCPVDGPVPPSNVAYVAKELYDMGCYEVSLGDTIGVGTPGTVAPMLEAAMSVVPVEKLAVHFHDTYGQSLSNILISLQMGVNVVDSSVAGLGGCPYAKGASGNVATEDVVYMLKGLGIKTGVDLGKVMAAGEFICKHLGRQSGSKAATALSKVTANASKL

SEQ ID NO: 3131 - DNA, 618 bp, Sorghum bicolor
  misc_feature: Ceres ANNOT ID no. 6028850
  misc_feature: Encodes the peptide sequence at SEQ ID NO 3132
atggccgctgccaacagctcccgcgcgcttcttctccccgtgctgaccctcgccggcgtcgtcttcttccttctcgctcccgctgccgccgccgacgccgccgatgcagccgcgccgcagggcctggagttccacgtcggcggcccgcgcgggtggcgcgtccctgacgccaacaccagctacggctggtgggccatgaacaaccgcttccgcgtcggcgaccacctctacttcaagtacgccaacgactcggtgctcctggtggaccgcaccgccttcgacgcctgcaacaccacggagccgctcgcgaccttcgccgacggcgccaccaggttcgtcctcgaccgcccgggcttcttctgcttcatcagcggcgagccgggccactgcgaggaaggacaaaggctcatcgtgcgcgtcatggtgcacccggccatcgtcgcgacgccaggcccggcatccgcaccagcgacgtcggcgcagccgggccacggcggcggcggcggccaggcgcatccgcccggggcttcctccggcgcagacacagcggttgccgctgctgccggcgtcgccgtcgcggcggcactggctgtcttcgtcagtctcgtctcgtcttga

SEQ ID NO: 3132 - protein, 205 aa, Sorghum bicolor
  misc_feature: Ceres ANNOT ID no. 6028850
  misc_feature (52)..(134): Pfam Id: Cu_bind_like Pfam Desc: Plastocyanin-like domain
  misc_feature (42)..(157): NCBI GI: 22775562 NCBI Desc: phosphoprotein ntepb1 [nicotiana tabacum]
  misc_feature (21)..(159): NCBI GI: 27529822 NCBI Desc: ntepc-like protein [nicotiana tabacum]
  misc_feature (43)..(164): NCBI GI: 15222012 NCBI Desc: plastocyanin-like domain-containing protein [arabidopsis thaliana]
  misc_feature (42)..(162): NCBI GI: 22775564 NCBI Desc: phosphoprotein ntepb2 [nicotiana tabacum]
  misc_feature (42)..(146): NCBI GI: 22775566 NCBI Desc: phosphoprotein ntepb3 [nicotiana tabacum]
MAAANSSRALLLPVLTLAGVVFFLLAPAAAADAADAAAPQGLEFHVGGPRGWRVPDANTSYGWWAMNNRFRVGDHLYFKYANDSVLLVDRTAFDACNTTEPLATFADGATRFVLDRPGFFCFISGEPGHCEEGQRLIVRVMVHPAIVATPGPASAPATSAQPGHGGGGGQAHPPGASSGADTAVAAAAGVAVAAALAVFVSLVSS

SEQ ID NO: 3133 - DNA, 1143 bp, Sorghum bicolor
  misc_feature: Ceres ANNOT ID no. 6028854
  misc_feature: Encodes the peptide sequence at SEQ ID NO 3134
atgaacgcggcggcggcggcggcgcggaaggccgcgggcggcggcatggcgcgcgcgccggcgctggtgctagcgctggtggcggcgggggcgttcctgatctcctacaacttcttcgccatgctgtttcgcggcggcggcggcggaataggcggcgcggcggcgtcctcggggacgagggaccctgtggtggccatgccggcgtggatgcgcgaggcggcggacaccgaggcgcggcggcggccgttccatgtggcgctcacggccacggacgcgccctacagccggtggcagtgccgagtcatgtacttctggtacaagcggatgcaggcgcggccgggcggggaggccatgggcggcttcacgcgcgtgctgcactcgggaaagcccgacgggctcatggacgagatccccaccttcgtcgtcgacccgctgcccgctggcaaggaccatggatacgtggtcttgaatagaccgtgggcatttgtgcagtggcttcagaaagcaaagattgaagaagagtatatactaatggcagaaccagatcatatatttgtgaaacctttaccaaatttggcccatgacgatgatccagcagcatttcccttcttttacattacaccatcagaacatgaacaaattatccggaaatactatgccaaagaaagaggtcctgtcacagatattgatcctattggaaattctcctgtaatcattaagaagacacttcttgagaagattgcccccacatggatgaatgtgtcaattcaaatgaaagaggatgaagagacagataaaatttttggatgggtgctggaaatgtatgcatacgctgttgctagcgcattgcatggggttcagcatatccttcgtaaagatttcatgatccagccaccctttgatacaaagctcgggaatacatttataatccacttcacttatggatgtgactattcactaaagggtgaactgacctatgggaaagttggtgaatggcgatttgacaaaagatcattcccagatgggccaccaccaagaaattttacattgccccctcctggagtcccagaaagtgtggttactctagtaaaaatggtcaatgaagctagtgcaaacctacctcggtgggatgatggaatataa

SEQ ID NO: 3134 - protein, 380 aa, Sorghum bicolor
  misc_feature: Ceres ANNOT ID no. 6028854
  misc_feature (7)..(378): NCBI GI: 115463637 NCBI Desc: os05g0386000 [oryza sativa (japonica cultivar-group)]
  misc_feature (83)..(377): NCBI GI: 115466750 NCBI Desc: os06g0180000 [oryza sativa (japonica cultivar-group)]
  misc_feature (304)..(359): NCBI GI: 115457362 NCBI Desc: os04g0226400 [oryza sativa (japonica cultivar-group)]
  misc_feature: Useful for making plants with modulated drought sensitivity
  misc_feature: GREAT-hit functional homolog of the protein sequence given in SEQ ID NO 13235
  misc_feature: Useful for making plants with modulated drought sensitivity
  misc_feature: Functional homolog of the protein sequence given in SEQ ID NO 13235
MNAAAAAARKAAGGGMARAPALVLALVAAGAFLISYNFFAMLFRGGGGGIGGAAASSGTRDPVVAMPAWMREAADTEARRRPFHVALTATDAPYSRWQCRVMYFWYKRMQARPGGEAMGGFTRVLHSGKPDGLMDEIPTFVVDPLPAGKDHGYVVLNRPWAFVQWLQKAKIEEEYILMAEPDHIFVKPLPNLAHDDDPAAFPFFYITPSEHEQIIRKYYAKERGPVTDIDPIGNSPVIIKKTLLEKIAPTWMNVSIQMKEDEETDKIFGWVLEMYAYAVASALHGVQHILRKDFMIQPPFDTKLGNTFIIHFTYGCDYSLKGELTYGKVGEWRFDKRSFPDGPPPRNFTLPPPGVPESVVTLVKMVNEASANLPRWDDGI

SEQ ID NO: 3135 - DNA, 1368 bp, Sorghum bicolor
  misc_feature: Ceres ANNOT ID no. 6028856
  misc_feature: Encodes the peptide sequence at SEQ ID NO 3136
atggcctcccctgacgcggaacagccggcgccgacggagcccgagcggtggcgtgacctcgacatgctcctctcccgccccgggaacctcgtggaggcctccttcgatcccagccccggcctgcgagacctactggggagcctcgtggaggttttggttgtgggcgcgggcgggctcggctgcgagctcctcaaggacctggccctctccggcttcaagaagctgcacgtcatcgatatggacaccatcgacgtatccaacctcaatcgccagttcctcttcagagttcaagatgtcgggaagtccaaggctgaagtagcagcgaagagggttatggagcgagttaatggggtgaacattgtccctcatttttgcaggattgaagataaagaaatagagttttatagtcagttccacataattgtcctcggtctggattcaattgaagctcgaagctatatcaattctgtggcttgtggtttcttagagtatgactcaaacgacaatccactcgaagagacagtcaaacctatggtagatggtggaactgagggcttcaagggacatgctagagtcattatacctggaaaaacaccttgctttgaatgcaacatatggctttttcctccacaggttaagttccctttatgtaccctcgccgagacaccaagaactgcagctcactgcattgagtatgctcacttgatcaaatgggatgaggttcatcctggaaaaccttttgatgctgatgatgcagagcatatgcagtggatttattcagaggctttaaagagagcagagcttttcggtatttctggtgttacatattctttaacacagggtgttgtcaaaaatataatcccagccattgcatcaacaaatgcaattatatcagctgcttgtgcattggaagccttcaagcttatttctgggtgcagcaaaagtgtgtcaaactatctcacgtacaatggtctggaaggaactcacattaaagtaactgagtttatcagagacaaagattgccttgtatgtgggcctggtacccttattgagctggatacaacatctactctttcagatttcatcaagatgcttgaagagcaccccacgttgcggatgtcaaaagccagcgtgacccacgaaggtaacaacctgtacatgcagtcaccggaggtgctggagcagatgacacggccaaacctgagcgttcccatgtttgagctcctcaaagaggtcccatacaccactgtccatgccacgggcatggcagagaacaacgggaagaaagtgtcctcattgaggaagctccgtgtggccttcaagggcatcgaagaagcctccaagatggatacgaccgtgagctcatga

SEQ ID NO: 3136 - protein, 455 aa, Sorghum bicolor
  misc_feature: Ceres ANNOT ID no. 6028856
  misc_feature (47)..(193): Pfam Id: ThiF Pfam Desc: ThiF family
  misc_feature (246)..(312): Pfam Id: UBACT Pfam Desc: Repeat in ubiquitin-activating (UBA) protein
  misc_feature (350)..(441): Pfam Id: E2_bind Pfam Desc: E2 binding domain
  misc_feature (279)..(348): Pfam Id: MoeZ_MoeB Pfam Desc: MoeZ/MoeB domain
  misc_feature (1)..(451): NCBI GI: 140067587 NCBI Desc: ubiquitin-activating enzyme, e1 [medicago truncatula]
  misc_feature (1)..(417): NCBI GI: 125810729 NCBI Desc: ga12220-pa [drosophila pseudoobscura]
  misc_feature (16)..(408): NCBI GI: 48103956 NCBI Desc: similar to ensangp00000009925 [apis mellifera]
  misc_feature (13)..(408): NCBI GI: 20129973 NCBI Desc: cg13343-pa [drosophila melanogaster]
  misc_feature (16)..(408): NCBI GI: 18605783 NCBI Desc: ubiquitin-activating enzyme e1c, isoform 1 [homo sapiens]
MASPDAEQPAPTEPERWRDLDMLLSRPGNLVEASFDPSPGLRDLLGSLVEVLVVGAGGLGCELLKDLALSGFKKLHVIDMDTIDVSNLNRQFLFRVQDVGKSKAEVAAKRVMERVNGVNIVPHFCRIEDKEIEFYSQFHIIVLGLDSIEARSYINSVACGFLEYDSNDNPLEETVKPMVDGGTEGFKGHARVIIPGKTPCFECNIWLFPPQVKFPLCTLAETPRTAAHCIEYAHLIKWDEVHPGKPFDADDAEHMQWIYSEALKRAELFGISGVTYSLTQGVVKNIIPAIASTNAIISAACALEAFKLISGCSKSVSNYLTYNGLEGTHIKVTEFIRDKDCLVCGPGTLIELDTTSTLSDFIKMLEEHPTLRMSKASVTHEGNNLYMQSPEVLEQMTRPNLSVPMFELLKEVPYTTVHATGMAENNGKKVSSLRKLRVAFKGIEEASKMDTTVSS

SEQ ID NO: 3137 - DNA, 804 bp, Sorghum bicolor
  misc_feature: Ceres ANNOT ID no. 6028889
  misc_feature: Encodes the peptide sequence at SEQ ID NO 3138
atggatcacttgaaccctgctctgccaccaacacgggctttggttccattccaagagggaaacaagcatgtcttcattgtagaggaggcttatgatgagcatgtggaggatcatggcaccagtaatggccatgatggtagctctaatcaggggaatcgcatcatgaggaggggtcactggtgtccttctgaggatgacaaactaaaagatttggttgcacgatatggccccaagaattggcgccgcatcgctgagaagcttgaaggaagatcaggaaagagttgcaggctacggtggatcaaccaactagacccacaacttaaccgagatgcattctccaaggaggaagaggagcaactcctagcggcgcgccatgcatatggaaccaagtggtcccttatcgctcgcctctttcctggccgcactgataacgctatcaaaaaccactggcatgtcatgatggcacgtaagtcccgtgcaatccaagacattaagatctcatcctcatcttgcccctcatcatcgacacaagggtcgccacacttcatgccaatcatcaatatctaccacaactatgacaacaatatgcacccagaactcaatgtcccagttgaggcggcagcaagccacatttaccatgccaatgaattcaacaattcctcatccaccaacacaacacacctctccataggaggaggctctgacatggcccctcatggcaggacacccactgcaaccaccgacaagggtgctgacaagttcagcccaccattctttgatttccttggtgttggcaatgcatga

SEQ ID NO: 3138 - protein, 267 aa, Sorghum bicolor
  misc_feature: Ceres ANNOT ID no. 6028889
  misc_feature (57)..(103): Pfam Id: Myb_DNA-binding Pfam Desc: Myb-like DNA-binding domain
  misc_feature (109)..(154): Pfam Id: Myb_DNA-binding Pfam Desc: Myb-like DNA-binding domain
  misc_feature (36)..(159): NCBI GI: 140052980 NCBI Desc: homeodomain-related [medicago truncatula]
  misc_feature (40)..(159): NCBI GI: 77549246 NCBI Desc: myb-like protein [oryza sativa (japonica cultivar-group)]
  misc_feature (40)..(159): NCBI GI: 6979341 NCBI Desc: myb-like protein [oryza sativa]
  misc_feature (40)..(197): NCBI GI: 9295726 NCBI Desc: t24p13.16 [arabidopsis thaliana]
  misc_feature (21)..(162): NCBI GI: 51970696 NCBI Desc: myb56 r2r3-myb factor family member [arabidopsis thaliana]
  misc_feature: The sequence is a functional homolog of SEQ ID NO 1664 in the 11/479,226 US patent application
  misc_feature: The sequence is a functional homolog of SEQ ID NO 2578 in the 10/374,780 US patent application
  misc_feature: The sequence is a functional homolog of SEQ ID NO 62 in the 10/225,066 US patent application
  misc_feature: The sequence is a functional homolog of SEQ ID NO 114 in the 10/412,699 US patent application
  misc_feature: The sequence is a functional homolog of SEQ ID NO 275 in the 11/479,226 US patent application
  misc_feature: The sequence is a functional homolog of SEQ ID NO 84 in the 10/286,264 US patent application
  misc_feature: The sequence is a functional homolog of SEQ ID NO. 395 in the 11/188,298 US application
MDHLNPALPPTRALVPFQEGNKHVFIVEEAYDEHVEDHGTSNGHDGSSNQGNRIMRRGHWCPSEDDKLKDLVARYGPKNWRRIAEKLEGRSGKSCRLRWINQLDPQLNRDAFSKEEEEQLLAARHAYGTKWSLIARLFPGRTDNAIKNHWHVMMARKSRAIQDIKISSSSCPSSSTQGSPHFMPIINIYHNYDNNMHPELNVPVEAAASHIYHANEFNNSSSTNTTHLSIGGGSDMAPHGRTPTATTDKGADKFSPPFFDFLGVGNA

SEQ ID NO: 3139 - DNA, 1989 bp, Sorghum bicolor
  misc_feature: Ceres ANNOT ID no. 6028894
  misc_feature: Encodes the peptide sequence at SEQ ID NO 3140
atgtgctttcatatgtggccagttattgattatgtcatggcaactgttgctggctgtaggacagtaggaactacaatggatcaacatgattccatggctgactcaccaaggaggcttcataatcttctgcgagacaaggtccagttggtgaaaaggaaggactcaaatcgctatgagattgtccgcttccgtgatccattgtcttttgagaaaggcttctttgttgtgatccgtgcctgccagcttttggcgcagcacaatggcgggataatatttgttggtgttgctggcccctctggtgctgggaagacggtgtttactgagaaggtggtcaatttcatgcccgatgttgctgttatatcaatggacaactataatgacgcaactcgcatagttgatggcaattttgatgatccacgtctaacagactatgacacactgctggaaaatattcatggtctgaaggaaggacgatcagttcaagttccaatatatgatttcaagtcgagctgccggattggttatagaacagttgatgtccctagctcccgaattgttatcattgaaggtatttatgcactgagtgagaagttacggcctgtgatggacttgcgtgtttctgtcactggtggtgttcattttgacctagtgaagagggttttaagggatatacaacgagctggccaggagcctgaagaaataattcatcagatctctgaaacagtttatccaatgtacaaggctttcatcgaaccagatttggagactgcacatattaaaatcgtcaacaagttcaacccattctcagggttccaaaatcctatgtacattctaaagtcaccaagatctctattacctgagaaaatcaagtccgtacttggtgatgatcatatggaaagcaacgaagaaacttatgatatatatctacttccacctggtgaagacccagaagcatgccaatcttatttgagaatgcggaatagggaaggaaaatataatctaatgtttgaggaatgggtgaccgacaattcatttatcatatcaccaaggatcacttttgaagttggtgtacgtcttcttggtggtttgatggcattgggatatactatagcagctatactgaagagaagcagtcgtgttttttctgatggcaaggcaactgttaaaattgattggctggaacaactcaaccgacactatatacaagtgcaaggaagagatcggctttatgttaaatttgtagcggatcagttaggtttggatggttcttatataccgcgcacatatattgaacaaattcagctggagaaattgattaatgatgttatggcattaccagaagatttgaagacaaagctcagcattgatgatgagctggtctcaagtccaaaggaagccttttcccgtgtttctgctgatcggagaaacaaacttatgaaaagtggcctatctcaatcatattcaacgcatagagacaaacgtgttgtgaaattgagtcaactgacagagaggaggtttggtggagggcaagcccttgaacctcctgctattgaccagggtggtatcatccagctttctgaacagatatcaacattgaatgaaaggatggatgaatttacctctcgagttgaagaactcaattcaaaattttcagtgaagaaacatttgcccagtcagcagaacttagctcttccaaatgatgcttgtagtggttccacacctacaaatctctttgtctctcagttaggcaatggtactttgatacctcattcttcatcgtcaaaccaactttcaaaggattccccaatgatagaagaggttatgaacatatcaagaggtcagcgccaggtcatacatcagctcgacaatctgaccaacctgcttcatgagcatttggtcttaacacgccaagcaaattcatgcccacttatttgcctgactgttgccagtattgggtacttcatgtttaaaggtctcaaccggagctga

SEQ ID NO: 3140 - protein, 662 aa, Sorghum bicolor
  misc_feature: Ceres ANNOT ID no. 6028894
  misc_feature (273)..(435): Pfam Id: CYTH Pfam Desc: CYTH domain
  misc_feature (92)..(266): Pfam Id: PRK Pfam Desc: Phosphoribulokinase / Uridine kinase family
  misc_feature (26)..(662): NCBI GI: 41053166 NCBI Desc: uridine kinase-like protein [oryza sativa (japonica cultivar-group)]
  misc_feature (46)..(446): NCBI GI: 60467744 NCBI Desc: uridine kinase [dictyostelium discoideum]
  misc_feature (58)..(438): NCBI GI: 11245940 NCBI Desc: uridine kinase-like protein [dictyostelium discoideum]
  misc_feature (68)..(473): NCBI GI: 39546268 NCBI Desc: osjnba0079f16.16 [oryza sativa (japonica cultivar-group)]
  misc_feature (99)..(473): NCBI GI: 115457524 NCBI Desc: os04g0280200 [oryza sativa (japonica cultivar-group)]
  misc_feature: The sequence is a functional homolog of SEQ ID NO. 532 in the 11/188,298 US application
MCFHMWPVIDYVMATVAGCRTVGTTMDQHDSMADSPRRLHNLLRDKVQLVKRKDSNRYEIVRFRDPLSFEKGFFVVIRACQLLAQHNGGIIFVGVAGPSGAGKTVFTEKVVNFMPDVAVISMDNYNDATRIVDGNFDDPRLTDYDTLLENIHGLKEGRSVQVPIYDFKSSCRIGYRTVDVPSSRIVIIEGIYALSEKLRPVMDLRVSVTGGVHFDLVKRVLRDIQRAGQEPEEIIHQISETVYPMYKAFIEPDLETAHIKIVNKFNPFSGFQNPMYILKSPRSLLPEKIKSVLGDDHMESNEETYDIYLLPPGEDPEACQSYLRMRNREGKYNLMFEEWVTDNSFIISPRITFEVGVRLLGGLMALGYTIAAILKRSSRVFSDGKATVKIDWLEQLNRHYIQVQGRDRLYVKFVADQLGLDGSYIPRTYIEQIQLEKLINDVMALPEDLKTKLSIDDELVSSPKEAFSRVSADRRNKLMKSGLSQSYSTHRDKRVVKLSQLTERRFGGGQALEPPAIDQGGIIQLSEQISTLNERMDEFTSRVEELNSKFSVKKHLPSQQNLALPNDACSGSTPTNLFVSQLGNGTLIPHSSSSNQLSKDSPMIEEVMNISRGQRQVIHQLDNLTNLLHEHLVLTRQANSCPLICLTVASIGYFMFKGLNRS

SEQ ID NO: 3141 - DNA, 894 bp, Sorghum bicolor
  misc_feature: Ceres ANNOT ID no. 6028917
  misc_feature: Encodes the peptide sequence at SEQ ID NO 3142
atggcggcggccgcaccaacccacgcacccgtgtgctcctcctcagcgtgccgcgcgggaatctgctctagcgggacacccttccccagttttcgctctgcggaggcttcggcccctgggtggcggcgcagggagccgtacccggcagtctccgtggtgccgggctccgcgccaggagctgtggccgtcgacaccgaggttgacacattactagacagtgtgaagtgggacagcaaagggttggctgttgctattgcacaaaatgtggatactggagccattcttatgcagggttttgctaataaagaagcccttgcaaagactatatcaacaaggaaagctacattctttagccgctcaaggtcatccttgtggacaaaaggggagacatcaatgaacttcattaatgtgcatgacattttcctggactgcgaccatgattctataatataccttggaaagccagatggacctacctgccatacaggagcagaaacgtgttattatacttcagtttatgatgctctacaaagttcaaagcctaatgaaggcaggcaggttatgacaaccctatactcacttgaagatacaattagtagacgacaggaggagatagttactgaaggaggtggcaagccatcatggacgaaaaaactactgcttgataaccagctactttgctcaaaaatacgtgaagaagctggtgaactaattcaaacgctgctcgagaacgaggaccaatctcgtgcagcttcggagatggctgatctgctgtaccatgctatggtgctgctcagagtcaaggatgtaaagatggaagaagtccttgagatcctgaggaagaggttttcgcagtctggtatcgaggagaaggcgagtcgcaataaatcttag

SEQ ID NO: 3142 - protein, 297 aa, Sorghum bicolor
  misc_feature: Ceres ANNOT ID no. 6028917
  misc_feature (96)..(170): Pfam Id: PRA-CH Pfam Desc: Phosphoribosyl-AMP cyclohydrolase
  misc_feature (191)..(284): Pfam Id: PRA-PH Pfam Desc: Phosphoribosyl-ATP pyrophosphohydrolase
  misc_feature (221)..(283): Pfam Id: MazG Pfam Desc: MazG nucleotide pyrophosphohydrolase domain
  misc_feature (98)..(276): NCBI GI: 50313439 NCBI Desc: phosphoribosyl-atp pyrophosphohydrolase/phosphoribosyl-amp cyclohydrolase [alyssum lesbiacum]
  misc_feature (81)..(168): NCBI GI: 88857352 NCBI Desc: bifunctional: phosphoribosyl-amp cyclohydrolase (n-terminal); phosphoribosyl-atp pyrophosphatase (c-terminal) [pseudoalteromonas tunicata d2]
  misc_feature (71)..(285): NCBI GI: 89210594 NCBI Desc: phosphoribosyl-amp cyclohydrolase:phosphoribosyl-atp pyrophosphohydrolase [halothermothrix orenii h 168]
  misc_feature (80)..(282): NCBI GI: 146300620 NCBI Desc: phosphoribosyl-amp cyclohydrolase [flavobacterium johnsoniae uw101]
  misc_feature (64)..(296): NCBI GI: 124515199 NCBI Desc: phosphoribosyl-amp cyclohydrolase [leptospirillum sp. group ii uba]
  misc_feature: The plant is abnormally small.
  misc_feature: Useful for making plants with modulated biomass
  misc_feature: GREAT-hit functional homolog of the protein sequence given in SEQ ID NO 13030
  misc_feature: Useful for making plants with modulated biomass
  misc_feature: Functional homolog of the protein sequence given in SEQ ID NO 13030
MAAAAPTHAPVCSSSACRAGICSSGTPFPSFRSAEASAPGWRRREPYPAVSVVPGSAPGAVAVDTEVDTLLDSVKWDSKGLAVAIAQNVDTGAILMQGFANKEALAKTISTRKATFFSRSRSSLWTKGETSMNFINVHDIFLDCDHDSIIYLGKPDGPTCHTGAETCYYTSVYDALQSSKPNEGRQVMTTLYSLEDTISRRQEEIVTEGGGKPSWTKKLLLDNQLLCSKIREEAGELIQTLLENEDQSRAASEMADLLYHAMVLLRVKDVKMEEVLEILRKRFSQSGIEEKASRNKS

SEQ ID NO: 3143 - DNA, 1080 bp, Sorghum bicolor
  misc_feature: Ceres ANNOT ID no. 6028918
  misc_feature: Encodes the peptide sequence at SEQ ID NO 3144
atggcggagcaggcgagcgccggaaggtactggtgccacatgtgcgccgcggtcgtgagccccgcggagggcgaggcggagatgaagtgcccgctctgccacagcggcttcctcgaggagatggagaccgcccgtggcgcggccgtggccgcggtcgcgaccgacgacggtgacggtgacggcacggtggctcaagtgtattccggcggcgccgaccgcccgagctccatctgggcgcacgccatcctcagcacggtcgacagctccgtccgccgccgccgcaaccggcggcagcaggaggccgccggcgacgtctacgactggaacgaccccgagttctcgctgcgccggcggcgcgtcaccgcgttcctgcggctcctgcacgagctccgtgaccgccagctgcagcgcctggaggctgctgccggcgtcgccctcgaaggcgaccagctcacccctttcggccggagcctcttcatcggcgcagctggcggtggcggcggcagcgagcatggcgtggcgctgggcgactacttcctcggccctagcctcgacgcactggtgcagcagcttgccgagaacgacgcggggcggcaggggacgccgccggccaagaaggaggccgtggaggcaatgccgatcgtggaaatccccagtggcaacgatgacgacacggccagctgcccagtctgcctggaggactacgccgccggcgagcgcgcccgcgagatgccctgcaggcacaggttccacgccaattgcatcgtgccgtggctcgagatgcacagctcctgccctgtctgccggttccagctgccggccaccgatgacaagagctcatgcagcagtggcaacggcggtggttttgtcagtgtcgatgcagatcgtgaaggcaatgacgacggcggtggtgatggtactggtagggcaacctctcctccaggcaatgccgagccagctgaagccgaagagagcggcaggcggttgccgccatccttgcagtggctcaacagcctgttctcgccgtcggcgcagtcctccggtagcggcagcagcagttcgcatcattgggagaattga

SEQ ID NO: 3144 - protein, 359 aa, Sorghum bicolor
  misc_feature: Ceres ANNOT ID no. 6028918
  misc_feature (228)..(268): Pfam Id: zf-C3HC4 Pfam Desc: Zinc finger, C3HC4 type (RING finger)
  misc_feature (3)..(356): NCBI GI: 92888063 NCBI Desc: zinc finger, ring-type; ringv [medicago truncatula]
  misc_feature (174)..(325): NCBI GI: 38454178 NCBI Desc: at3g13430 [arabidopsis thaliana]
  misc_feature (176)..(318): NCBI GI: 23308365 NCBI Desc: at3g19950/mpn9_19 [arabidopsis thaliana]
  misc_feature (175)..(313): NCBI GI: 92868562 NCBI Desc: zinc finger, ring-type; ringv [medicago truncatula]
  misc_feature (176)..(331): NCBI GI: 46806079 NCBI Desc: zinc finger -like [oryza sativa (japonica cultivar-group)]
  misc_feature: The sequence is a functional homolog of SEQ ID NO 1201 in the 10/374,780US patent application
  misc_feature: Useful for making plants with modulated growth and phenotype characteristics
  misc_feature: The sequence is a functional homolog of SEQ ID NO 1201 in the 20060162006 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
MAEQASAGRYWCHMCAAVVSPAEGEAEMKCPLCHSGFLEEMETARGAAVAAVATDDGDGDGTVAQVYSGGADRPSSIWAHAILSTVDSSVRRRRNRRQQEAAGDVYDWNDPEFSLRRRRVTAFLRLLHELRDRQLQRLEAAAGVALEGDQLTPFGRSLFIGAAGGGGGSEHGVALGDYFLGPSLDALVQQLAENDAGRQGTPPAKKEAVEAMPIVEIPSGNDDDTASCPVCLEDYAAGERAREMPCRHRFHANCIVPWLEMHSSCPVCRFQLPATDDKSSCSSGNGGGFVSVDADREGNDDGGGDGTGRATSPPGNAEPAEAEESGRRLPPSLQWLNSLFSPSAQSSGSGSSSSHHWEN

SEQ ID NO: 3145 - DNA, 1539 bp, Sorghum bicolor
  misc_feature: Ceres ANNOT ID no. 6028926
  misc_feature: Encodes the peptide sequence at SEQ ID NO 3146
atggccgcgcccggaggaggcctggaccaggaccgaggccggggccggggacaggacgccgccattaagctcttcggccgcagcatcccggtgctccactcctccgtcgtcgcagcggccgcatccgaggttagcaccaagttagcaaatgatgtaagaagcaatgatggcatgtcatgccttccaaacatgcctttgattgtcaaagcaagtcccttcccttccaagaacaatatgaagaatggtttacaagctattagcagtcagcatgggaaaatggaagctgattccaagtctgaggaagttaagaatagtttacaagctatcatcagtcagcctgggaaaacagacgattccaagtctgaggaaactaagactgaatctggtggatctggccaagagaaggtactcaagaagccagataagattctgccttgccctcgctgccatagtatggaaacaaaattttgctacttcaacaattacaatgtgaaccagcccaggcatttctgccggaactgcaagaggtactggactgccggggggactatgaggaatgtccctataggttctggtagacgcagaaataaggatccatctcatcaccatcatgtcaccaagccgtgtgatcatatcgtaactgctaatggagatgtttctgatgcaactcagcgccagtctcttgcagtcaagccatctgtccttcaaggttcaggaaaacaaaatgaaacagcgtgcaagtctgtatctccagtccttaatattaaagagcagaataatgccgaccttatttccttggtctctggtgacaataaggaagagaaatcatgtgcatcctctgtggtatctggctcctcggaaaactggatgccagaaaatacagttaaaaaggaggaggatagtacttcagcgtacggtaatggtgtgaaagaacctgatcccaacacgcagtctcaccatgctggacccatttcggtgttctccggaaatcctgctgcagtcatggtgactaatcagtcctcagcagatggtattcatgggccgggaaatggtacggtcagtcctctttcactaccaccaccacccatggtaccaaccccgggaatttgtgcacctgctgttccattccctctcgtgccagccttcgtgagctgcattcctggttggccaagtgcagtatggggtgcagcatggcctggaagtagtggccctacattactatctcttcccccaaacagtttagctttttcaggaagcaactctagggtgttaggaaagcatacaagggtagctaatttgcaggaagaacagaaggcagaaaaaaagttttgggtccctaaagctctccgaattgacaacccagaagaggcagcaaagagttcaatctgggcctctcttggtatcaagcctgatgagagaatcatattcaagtctttccagtccaaggatctgaaaaatagtgagactaagacgccagaatccctgcaggccaatccagcagcgttttcccgctctcagacatttcaggagaggacctga

SEQ ID NO: 3146 - protein, 512 aa, Sorghum bicolor
  misc_feature: Ceres ANNOT ID no. 6028926
  misc_feature (139)..(201): Pfam Id: zf-Dof Pfam Desc: Dof domain, zinc finger
  misc_feature (16)..(512): NCBI GI: 56783710 NCBI Desc: ascorbate oxidase promoter-binding protein aobp -like [oryza sativa (japonica cultivar-group)]
  misc_feature (19)..(259): NCBI GI: 53749192 NCBI Desc: at5g39660 [arabidopsis thaliana]
  misc_feature (19)..(259): NCBI GI: 15983797 NCBI Desc: at5g39660/mij24_130 [arabidopsis thaliana]
  misc_feature (18)..(332): NCBI GI: 92871449 NCBI Desc: zinc finger, dof-type [medicago truncatula]
  misc_feature (62)..(510): NCBI GI: 63034231 NCBI Desc: dof domain zinc finger dna-binding protein [picea abies]
  misc_feature: The sequence is a functional homolog of SEQ ID NO 112 in the 10/666,642US patent application
  misc_feature: The sequence is a functional homolog of SEQ ID NO 1122 in the 10/374,780US patent application
  misc_feature: The sequence is a functional homolog of SEQ ID NO 1129 in the 10/374,780US patent application
  misc_feature: The sequence is a functional homolog of SEQ ID NO 1130 in the 10/374,780US patent application
  misc_feature: The sequence is a functional homolog of SEQ ID NO 1131 in the 10/374,780US patent application
  misc_feature: The sequence is a functional homolog of SEQ ID NO 1132 in the 10/374,780US patent application
  misc_feature: The sequence is a functional homolog of SEQ ID NO 1133 in the 10/374,780US patent application
  misc_feature: The sequence is a functional homolog of SEQ ID NO 1145 in the 10/666,642US patent application
  misc_feature: The sequence is a functional homolog of SEQ ID NO 132 in the 10/412,699US patent application
  misc_feature: The sequence is a functional homolog of SEQ ID NO 1322 in the 10/412,699US patent application
  misc_feature: The sequence is a functional homolog of SEQ ID NO 1328 in the 10/412,699US patent application
  misc_feature: The sequence is a functional homolog of SEQ ID NO 1329 in the 10/412,699US patent application
  misc_feature: The sequence is a functional homolog of SEQ ID NO 1330 in the 10/412,699US patent application
  misc_feature: The sequence is a functional homolog of SEQ ID NO 1331 in the 10/412,699US patent application
  misc_feature: The sequence is a functional homolog of SEQ ID NO 1968 in the 10/374,780US patent application
  misc_feature: The sequence is a functional homolog of SEQ ID NO 2352 in the 10/374,780US patent application
  misc_feature: The sequence is a functional homolog of SEQ ID NO 309 in the 11/479,226US patent application
  misc_feature: The sequence is a functional homolog of SEQ ID NO 582 in the 11/435,388US patent application
  misc_feature: The sequence is a functional homolog of SEQ ID NO 724 in the 10/225,066US patent application
  misc_feature: Useful for making plants with modulated growth and phenotype characteristics
  misc_feature: The sequence is a functional homolog of SEQ ID NO 132 in the 20040045049 US patent application
  misc_feature: The sequence is a functional homolog of SEQ ID NO 132 in the 20040045049 US patent application
  misc_feature: The sequence is a functional homolog of SEQ ID NO 1322 in the 20040045049 US patent application
  misc_feature: The sequence is a functional homolog of SEQ ID NO 1328 in the 20040045049 US patent application
  misc_feature: The sequence is a functional homolog of SEQ ID NO 1329 in the 20040045049 US patent application
  misc_feature: The sequence is a functional homolog of SEQ ID NO 1330 in the 20040045049 US patent application
  misc_feature: The sequence is a functional homolog of SEQ ID NO 1331 in the 20040045049 US patent application
  misc_feature: The sequence is a functional homolog of SEQ ID NO 724 in the 20050160493 US patent application
  misc_feature: The sequence is a functional homolog of SEQ ID NO 1133 in the 20060162006 US patent application
  misc_feature: Useful for biocontainment applications
  misc_feature: Useful for making plants with modulated biomass
  misc_feature: Useful for making plants with modulated flowering time
  misc_feature: Useful for making plants with modulated light quality response
  misc_feature: Functional homolog of the protein sequence given in SEQ ID NO 13821
  misc_feature: The sequence is a functional homolog of SEQ ID NO. 489 in the 11/188,298 US application
  misc_feature: The sequence is a functional homolog of SEQ ID NO. 379 in the 11/188,298 US application
  misc_feature: The sequence is a functional homolog of SEQ ID NO. 486 in the 11/188,298 US application
MAAPGGGLDQDRGRGRGQDAAIKLFGRSIPVLHSSVVAAAASEVSTKLANDVRSNDGMSCLPNMPLIVKASPFPSKNNMKNGLQAISSQHGKMEADSKSEEVKNSLQAIISQPGKTDDSKSEETKTESGGSGQEKVLKKPDKILPCPRCHSMETKFCYFNNYNVNQPRHFCRNCKRYWTAGGTMRNVPIGSGRRRNKDPSHHHHVTKPCDHIVTANGDVSDATQRQSLAVKPSVLQGSGKQNETACKSVSPVLNIKEQNNADLISLVSGDNKEEKSCASSVVSGSSENWMPENTVKKEEDSTSAYGNGVKEPDPNTQSHHAGPISVFSGNPAAVMVTNQSSADGIHGPGNGTVSPLSLPPPPMVPTPGICAPAVPFPLVPAFVSCIPGWPSAVWGAAWPGSSGPTLLSLPPNSLAFSGSNSRVLGKHTRVANLQEEQKAEKKFWVPKALRIDNPEEAAKSSIWASLGIKPDERIIFKSFQSKDLKNSETKTPESLQANPAAFSRSQTFQERT

SEQ ID NO: 3147 - DNA, 1425 bp, Sorghum bicolor
  misc_feature: Ceres ANNOT ID no. 6028931
  misc_feature: Encodes the peptide sequence at SEQ ID NO 3148
atggccggcggcgaggacggctcggcggcggcgtcgtcgttgctgccgccggagcggaggcacgagggttgccccgggtgccgccttgaagaggccaacaagacgagcaccggcgtcccctacctcaacttcttcttcatctggatcgtctgtctcactaacactctgccggtccagtcgttgttcccctatctatacttcatgatcagggacttaaaagtcgcacagcaagagcaagacatcggcttctatgctggattcgttggagcaagttatttccttgccagaacctgtagctctgtcccttggggcatgtttgctgacaaaattgcgttcaacacactctttggtcttagcacaacttattggatggcaattgtgactcgggggttgcttgggatgctttgtggtatccttggaccaattaaggcctatgctatagaagtctgcaggaaagagcaccaagctctagggatctcaattgttacaacatcagacgcaatagcacttgttgttggaccagctattggaggatttctttcacagccagcagaaaagtacccaaatgttttctccaaagagtccatatttgggaggtttccatacttccttccatcctttgtcatatcgatactagcaatgggatcatgtattgcatgcatttggcttccggaaacactacactttcacattgatgaaaaagtagaagctaccgatgaagtggaggcacaagttggtgactcgaccatacaagttggaaaagctaaacaatctagtgacagatctacaaagaacctcctaaagaactggcaactgatgtcagcaataatcctctattgtatcttttgcctccatgatgtagcttatgctgaggcagtgagcaacagaaaattccatggcttgggtttgacatcccaagaagttggtactgtgctagcagtctcaggttgtggacttttgatatatcaactttttgtttacccattcattgtcaagtatcttggaccaataaggccattgcgacctacagtggtattgtctatacttctccttacaacatatcccttcatggtcaacctacaagggctggagctcaaagtactaatcaacatagcctcgcttatgaagaatgtattctatgctacaatcaatattgcgtgcaacattctacaaaacacagcagtgacacaagaacaaagaggtgttgcaaatggcatctcgatgactctaatgtcattgttcaaaggtgtagctccggcggcggcaggaattttgttttcatgggcccagaagcacatgaatggtgggctattcttaccaggtgaccagatcatgtttctgacgataaacatggtttccatacttgggctaattctgacgttcaagccatttttctccatgtcaaatgcgttgaggcgttcctag

SEQ ID NO: 3148 - protein, 474 aa, Sorghum bicolor
  misc_feature: Ceres ANNOT ID no. 6028931
  misc_feature (47)..(419): Pfam Id: MFS_1 Pfam Desc: Major Facilitator Superfamily
  misc_feature (2)..(467): NCBI GI: 56783672 NCBI Desc: major facilitator superfamily antiporter [oryza sativa (japonica cultivar-group)]
  misc_feature (21)..(467): NCBI GI: 77548534 NCBI Desc: major facilitator superfamily protein [oryza sativa (japonica cultivar-group)]
  misc_feature (25)..(467): NCBI GI: 115487198 NCBI Desc: os12g0133100 [oryza sativa (japonica cultivar-group)]
  misc_feature (21)..(469): NCBI GI: 77548523 NCBI Desc: major facilitator superfamily [oryza sativa (japonica cultivar-group)]
  misc_feature (16)..(467): NCBI GI: 23452823 NCBI Desc: major facilitator superfamily antiporter [oryza sativa (japonica cultivar-group)]
  misc_feature: Useful for making plants with modulated flowering time
  misc_feature: Functional homolog of the protein sequence given in SEQ ID NO 12969
MAGGEDGSAAASSLLPPERRHEGCPGCRLEEANKTSTGVPYLNFFFIWIVCLTNTLPVQSLFPYLYFMIRDLKVAQQEQDIGFYAGFVGASYFLARTCSSVPWGMFADKIAFNTLFGLSTTYWMAIVTRGLLGMLCGILGPIKAYAIEVCRKEHQALGISIVTTSDAIALVVGPAIGGFLSQPAEKYPNVFSKESIFGRFPYFLPSFVISILAMGSCIACIWLPETLHFHIDEKVEATDEVEAQVGDSTIQVGKAKQSSDRSTKNLLKNWQLMSAIILYCIFCLHDVAYAEAVSNRKFHGLGLTSQEVGTVLAVSGCGLLIYQLFVYPFIVKYLGPIRPLRPTVVLSILLLTTYPFMVNLQGLELKVLINIASLMKNVFYATINIACNILQNTAVTQEQRGVANGISMTLMSLFKGVAPAAAGILFSWAQKHMNGGLFLPGDQIMFLTINMVSILGLILTFKPFFSMSNALRRS

SEQ ID NO: 3149 - DNA, 1470 bp, Sorghum bicolor
  misc_feature: Ceres ANNOT ID no. 6028940
  misc_feature: Encodes the peptide sequence at SEQ ID NO 3150
atggccggcggagaggacgacgacggttcagcggcggcgccgctgctggggtcgaagaggaggcacgaggggtgccccggttgccggctggacgaggccaataagaccaacgccggcgtcccctacctcaacttcttctatatttggatcgtctgccttacttccactctgccgatccagtcattgttcccttatctatacttcatgatcagggatttgaaaattgcaaagcaagagcaagatatcgggttctatgctggatttgttggggcaacatattttgtcgccagaactttcagttctgtgccatgggggatatttgctgacaagtacggaaggaagccttgcattgtaatcagcatcctctcagtgattgtgttcaacacactctttggccttagcactagttattggatggcaattgtaactagggggttacttgggttgctctgtggtatactgggaccaatcaaggcctatgctacagaagtttgtaggaaagagcaccaagctctaggaatctctctcgttacgtcatcccgtgcaatagctcttgttattggcccagccattggagggtttcttgcacaacctgcagaaaagtacccaaatatttttcccaaagagtccatatttgggaggtttccatatttcctcccatgctttgtcatatcgatactagcaacaggatcatgtattgcatgcatttggcttccggaaacactgcactttcataatgatcaaaaggtcaaagctattgacgaattggaggcagaagttggtgactccaacttagaaggtggaaaagttaaagaatctagcgacacatctacaaagaacctactaaagaattggcaattgatgtcagcagtaattatctattgtatcttttgtctccatgacacagcctatcttgagacattttcactctgggcagtgagtagcaaaaaatttcgaggcctgagtttgacgtcccaggatgttggcattgtgctagctgtctcaggtttgggtgttctggtataccaacttgttctttatccttttattgccaagtcttttggaccaatcaggccattacgtcctgctgcggtcttgtctgtacttcttctcacaacatatcccttcatggccaacttagatgggatggagctgaaaacattaatcaacatagcttcactgttgaagaacatattctctgctacaattactactgcatgcaacattctgcaaaacaatgcagtgacacaagaacaaaggggtgttgcaaatggcatctctgtgactctaatgtcattgttcaaaggtgtagctccagcagcagcagggattttgttttcgtgggctcagaagcacacaactggattgttcttaccaggtgatcagatcctattcctcattataaacatggtggcaataattggactgattttgacattcaagccatttttctccatgtcaatgcgctga

SEQ ID NO: 3150 - protein, 489 aa, Sorghum bicolor
  misc_feature: Ceres ANNOT ID no. 6028940
  misc_feature (48)..(439): Pfam Id: MFS_1 Pfam Desc: Major Facilitator Superfamily
  misc_feature (47)..(487): Pfam Id: Sugar_tr Pfam Desc: Sugar (and other) transporter
  misc_feature (2)..(489): NCBI GI: 56783672 NCBI Desc: major facilitator superfamily antiporter [oryza sativa (japonica cultivar-group)]
  misc_feature (6)..(486): NCBI GI: 77548534 NCBI Desc: major facilitator superfamily protein [oryza sativa (japonica cultivar-group)]
  misc_feature (22)..(486): NCBI GI: 77548523 NCBI Desc: major facilitator superfamily [oryza sativa (japonica cultivar-group)]
  misc_feature (26)..(486): NCBI GI: 115487198 NCBI Desc: os12g0133100 [oryza sativa (japonica cultivar-group)]
  misc_feature (18)..(486): NCBI GI: 23452823 NCBI Desc: major facilitator superfamily antiporter [oryza sativa (japonica cultivar-group)]
  misc_feature: Useful for making plants with modulated flowering time
  misc_feature: Functional homolog of the protein sequence given in SEQ ID NO 12969
MAGGEDDDGSAAAPLLGSKRRHEGCPGCRLDEANKTNAGVPYLNFFYIWIVCLTSTLPIQSLFPYLYFMIRDLKIAKQEQDIGFYAGFVGATYFVARTFSSVPWGIFADKYGRKPCIVISILSVIVFNTLFGLSTSYWMAIVTRGLLGLLCGILGPIKAYATEVCRKEHQALGISLVTSSRAIALVIGPAIGGFLAQPAEKYPNIFPKESIFGRFPYFLPCFVISILATGSCIACIWLPETLHFHNDQKVKAIDELEAEVGDSNLEGGKVKESSDTSTKNLLKNWQLMSAVIIYCIFCLHDTAYLETFSLWAVSSKKFRGLSLTSQDVGIVLAVSGLGVLVYQLVLYPFIAKSFGPIRPLRPAAVLSVLLLTTYPFMANLDGMELKTLINIASLLKNIFSATITTACNILQNNAVTQEQRGVANGISVTLMSLFKGVAPAAAGILFSWAQKHTTGLFLPGDQILFLIINMVAIIGLILTFKPFFSMSMR

SEQ ID NO: 3151 - DNA, 1542 bp, Sorghum bicolor
  misc_feature: Ceres ANNOT ID no. 6028960
  misc_feature: Encodes the peptide sequence at SEQ ID NO 3152
atggagtctcgcaatggcgaagttcaagagttgcctcctccacctccacctccacctcctcctcctcctgtaaataccatccatgagcctcttgctgccgaggaaacaaagaagaactaccatgaaggatgccctgggtgccggctggatgaggtgaacaagatcagcaccggcatcccctacctcaatttcttcttcatctggattatctgcctcactactgccgctctgcccattcaatcaatgtacccttatctatacttcctgatcagggatttgaaaattgcaaagcaagagcaagacatagggttctatgctggatttgttgggggaacttatttccttactagaaccattagttctgtgccatggggtatatttgctgacaagtacggaaggaagccatgcatcgtgatgagcatcatctcagtgattgtgttcaacacactctttggcattagcaagagttattggatggcaattgtaactagggggttgcttgggttgctctctggtataataggaccagtcaaggcctatgctacagaagtttgtaggaaagaacatcaagctctaggaatgtctcttgttacatcatcagtagcggcaggtcttgttgttggaccagctattggaggctttcttgcacagcctgcagaaaagtacccacgtattttctccaaagagtctatatttggaaggtttccatacttcctcccatgcttggtcatatcaattctagcagcagtatcatgtatcgcatgcatttggcttccggaaacgctgcactttcacaagaatgagaaagtagacgctgttgatgaagtggaagcacaagttggtcactcaaacgtagaaggtggaaaagctaaagaatctggtggcacatctacaaagaatatactaaagaactggcaattgatgtcatcaataatcctctattgtatattttgtcttcgtgacacagcttatcttgagatattttcactctgggcagtgagcagtagaaaattccaaggcctgagtttgacatcccaggatgttggtcttgtgctagtcatttcaggtttgggtgttctggtatatcaacttgttggttatcccttaattgccaggtattttggaccaatcagaccattacgacctgctgcggtcttgtctatacttgtcctggcaacatatcccttcatagccaaactacaagggctagaactcaaaatactaatcaacatagcttcacttttggggaacacattttctgctacaattattactgcatgcaacattctgcaaaacactgcagtgacacaagaacagagaggtgttgcaaatggcatctctgtgactctaatgtcattgctcaaaagtgtagctccagtagcgggaggaattatgttttcatgggctcagaagcacatgactgggctgttattaccgggtgaccagatcttattcctgatgataaacatggtggcaataatcggactaattttgacgttcaagccatttttctctatgtcagatgcattgagacgtttataa

SEQ ID NO: 3152 - protein, 513 aa, Sorghum bicolor
  misc_feature: Ceres ANNOT ID no. 6028960
  misc_feature (68)..(459): Pfam Id: MFS_1 Pfam Desc: Major Facilitator Superfamily
  misc_feature (70)..(510): Pfam Id: Sugar_tr Pfam Desc: Sugar (and other) transporter
  misc_feature (44)..(508): NCBI GI: 56783672 NCBI Desc: major facilitator superfamily antiporter [oryza sativa (japonica cultivar-group)]
  misc_feature (37)..(506): NCBI GI: 77548534 NCBI Desc: major facilitator superfamily protein [oryza sativa (japonica cultivar-group)]
  misc_feature (45)..(508): NCBI GI: 115487198 NCBI Desc: os12g0133100 [oryza sativa (japonica cultivar-group)]
  misc_feature (40)..(506): NCBI GI: 77548523 NCBI Desc: major facilitator superfamily [oryza sativa (japonica cultivar-group)]
  misc_feature (31)..(506): NCBI GI: 23452823 NCBI Desc: major facilitator superfamily antiporter [oryza sativa (japonica cultivar-group)]
  misc_feature: Useful for making plants with modulated flowering time
  misc_feature: Functional homolog of the protein sequence given in SEQ ID NO 12969
MESRNGEVQELPPPPPPPPPPPPVNTIHEPLAAEETKKNYHEGCPGCRLDEVNKISTGIPYLNFFFIWIICLTTAALPIQSMYPYLYFLIRDLKIAKQEQDIGFYAGFVGGTYFLTRTISSVPWGIFADKYGRKPCIVMSIISVIVFNTLFGISKSYWMAIVTRGLLGLLSGIIGPVKAYATEVCRKEHQALGMSLVTSSVAAGLVVGPAIGGFLAQPAEKYPRIFSKESIFGRFPYFLPCLVISILAAVSCIACIWLPETLHFHKNEKVDAVDEVEAQVGHSNVEGGKAKESGGTSTKNILKNWQLMSSIILYCIFCLRDTAYLEIFSLWAVSSRKFQGLSLTSQDVGLVLVISGLGVLVYQLVGYPLIARYFGPIRPLRPAAVLSILVLATYPFIAKLQGLELKILINIASLLGNTFSATIITACNILQNTAVTQEQRGVANGISVTLMSLLKSVAPVAGGIMFSWAQKHMTGLLLPGDQILFLMINMVAIIGLILTFKPFFSMSDALRRL

SEQ ID NO: 3153 - DNA, 1539 bp, Sorghum bicolor
  misc_feature: Ceres ANNOT ID no. 6028974
  misc_feature: Encodes the peptide sequence at SEQ ID NO 3154
atgctcctccacctgcttccgctctcctgccccgcgccgccgttccgcctgcgcggcggctcgccgcgggtccgggccgggggcagggccaggacgcgggcgctgcggggggcggacgtggagccggagacacctccgcgaaggcgccgcggccgcgatgacgaccacgatccgcacgcggccgggagcggtggagacaccggggcgctgctggcgtcggtcaggaggcttctgctctccgaggcgccgacggcggcggcggcggcggaggaggaggaggaggagcagggacagttccccaagcgttgggccatcgtcttcctctgcttctctgcattcctgctctgcaacatggaccgcgtaaatatgagcattgctattctgcctatgtccgcagagtatggttggaacccacagactgttggtctcatccagtcatctttcttctggggctacctcctaactcagatagctggaggaatatgggcagatactgttggaggaaagactgtccttggttttggtgtggtttggtggtccatagctacggctcttactcctgttgcagcaaagcttggcttgccatttcttcttgttgtgcgggctttcatgggaatcggtgagggggttgccatgcctgcaatgaacaatattctttcgaaatgggttcctgtatcagagaggagcagatcattggctcttgtgtatagtggaatgtaccttgggtcagttacaggacttgcattttcccccttgctgatacataagttcggatggccatcagtcttctattcattcgggtccctaggggctgtttgggtcacgacatgggcaaccaaggcatatagttccccacttgaagatcctggaatcagcgctgcagaaaagaagcttattgctagtcagagcacagcaggcgagcctgttaaaacaattccatggagattgatattatcaaaaccgcctgtttgggcacttatagtttctcatttctgccataactggggaactttcattttgctcacatggatgcccacatactacaaccaggttctgaaattcaacctcatggaatcgggccttgtctgtgttcttccctggttcacgatggcagtttctgcaaatgttggtggttggattgcagacacacttgtcagtagaggagtatctgtgacaactgttcggaagatcatgcaatcaatcggattcttggggccagcattttttctaactcaactaagccatgtcgactcgcctgccatggcagttttatgcatggcttgtagccagggaactgatgcattctcgcagtctggtctgtactcaaaccatcaagatataggccctcgatatgcaggtgtattgcttggtctttccaacacggctggggtcttagctggtgtatttggcacagcagcaacaggatacatcttgcagcatggttcttgggataacgtattcgagttatcagtggtgctttacctggtagggactttggtatggaatgtattctcaactggcgagaagattcttgattga

SEQ ID NO: 3154 - protein, 512 aa, Sorghum bicolor
  misc_feature: Ceres ANNOT ID no. 6028974
  misc_feature (108)..(471): Pfam Id: MFS_1 Pfam Desc: Major Facilitator Superfamily
  misc_feature (98)..(512): NCBI GI: 117622266 NCBI Desc: na+/pi transporter [thellungiella halophila]
  misc_feature (98)..(512): NCBI GI: 144923552 NCBI Desc: major facilitator superfamily mfs_1 [medicago truncatula]
  misc_feature (98)..(512): NCBI GI: 144923920 NCBI Desc: major facilitator superfamily mfs_1 [medicago truncatula]
  misc_feature (207)..(350): NCBI GI: 7267124 NCBI Desc: at4g00370 [arabidopsis thaliana]
  misc_feature (102)..(512): NCBI GI: 145351974 NCBI Desc: mfs family transporter: sugar [ostreococcus lucimarinus cce9901]
  misc_feature: The sequence is a functional homolog of SEQ ID NO. 296 in the 11/188,298 US application
MLLHLLPLSCPAPPFRLRGGSPRVRAGGRARTRALRGADVEPETPPRRRRGRDDDHDPHAAGSGGDTGALLASVRRLLLSEAPTAAAAAEEEEEEQGQFPKRWAIVFLCFSAFLLCNMDRVNMSIAILPMSAEYGWNPQTVGLIQSSFFWGYLLTQIAGGIWADTVGGKTVLGFGVVWWSIATALTPVAAKLGLPFLLVVRAFMGIGEGVAMPAMNNILSKWVPVSERSRSLALVYSGMYLGSVTGLAFSPLLIHKFGWPSVFYSFGSLGAVWVTTWATKAYSSPLEDPGISAAEKKLIASQSTAGEPVKTIPWRLILSKPPVWALIVSHFCHNWGTFILLTWMPTYYNQVLKFNLMESGLVCVLPWFTMAVSANVGGWIADTLVSRGVSVTTVRKIMQSIGFLGPAFFLTQLSHVDSPAMAVLCMACSQGTDAFSQSGLYSNHQDIGPRYAGVLLGLSNTAGVLAGVFGTAATGYILQHGSWDNVFELSVVLYLVGTLVWNVFSTGEKILD

SEQ ID NO: 3155 - DNA, 1248 bp, Sorghum bicolor
  misc_feature: Ceres ANNOT ID no. 6028975
  misc_feature: Encodes the peptide sequence at SEQ ID NO 3156
atgcaagttaataatgaggcaccactagtgtgcctcaagccaaatatttctcagtataactctccagagcagagaggtggagttgaagggtttcctgagaataatgaaaaaaggaatgatattgttgctgcggaaaaaatctgggaggcgtctcctattccaaatcaaggcctcagcaggcccttctaccgacaagaattttatgcctggccatatattcattcagattatcaaatggtgcgtcagccactaccttatggttttgacaaccaattttatcagataaatagggaccatggtttccctattgaaaacagagttcagtatcttccattcaagatgctccctcaaggtcacccccatgatgcacagcttcaggaatttcagtatttcgtggttattgactttgaagcaacctgtgacaaggtgaacaatccatttccacaagaaatcattgagtttccatctgtcttggttaacagtgcaactggaaaactcgaagaatgcttccaaacatatgttcggccgacgtatcatcaatttttgaccgatttttgcaaggagcttactggcatacaacagattcaggtggacagaggtgtgcctctaggtgaagccttactcatgcatgacaagtggctagaggacaagggcatcaagaacacaaactttgctattgtgacctggtctaactgggactgccgtacaatgctggagtcagaatgccgatttaagagaatcaggaagcccccttattttaacaggtggatcaacttgaaggtacctttccaggaagtgtatggggatgtccgctgcaacctgaaggaggcagtacagttggctggccttacatgggaggggcgtgctcactgtgggctcgatgatgcccgaaatactgctcgcctcctggcacttatgatgcaccggggtttcaagttttctatcaccaactcacttgtgtggcaacctgctccacagtcaaccacttgccaattatcccctgaccgctctccagatccagttcaacagcagcagaaaccaaaggagatgctgggatctcctgtgcaggttaacccatatgccacctccgcagggaaggacagagcgatgtactgttactgtggtgtgctgagcaggtggagcgttgtgcgcaagccaggacctatgcagggacggtacttctttggatgcggaaactggaccgccacgaggcgggcgatctgcccatactttgcatgggcctcgtga

SEQ ID NO: 3156 - protein, 415 aa, Sorghum bicolor
  misc_feature: Ceres ANNOT ID no. 6028975
  misc_feature (131)..(303): Pfam Id: Exonuc_X-T Pfam Desc: Exonuclease
  misc_feature (370)..(416): Pfam Id: zf-GRF Pfam Desc: GRF zinc finger
  misc_feature (193)..(415): NCBI GI: 140038720 NCBI Desc: polynucleotidyl transferase, ribonuclease h fold [medicago truncatula]
  misc_feature (149)..(319): NCBI GI: 119587241 NCBI Desc: similar to riken cdna 4933424n09 gene, isoform cra_b [homo sapiens]
  misc_feature (1)..(196): NCBI GI: 140038725 NCBI Desc: polynucleotidyl transferase, ribonuclease h fold [medicago truncatula]
  misc_feature (125)..(319): NCBI GI: 24657535 NCBI Desc: cg6393-pd, isoform d [drosophila melanogaster]
  misc_feature (125)..(319): NCBI GI: 28573607 NCBI Desc: cg6393-pa, isoform a [drosophila melanogaster]
MQVNNEAPLVCLKPNISQYNSPEQRGGVEGFPENNEKRNDIVAAEKIWEASPIPNQGLSRPFYRQEFYAWPYIHSDYQMVRQPLPYGFDNQFYQINRDHGFPIENRVQYLPFKMLPQGHPHDAQLQEFQYFVVIDFEATCDKVNNPFPQEIIEFPSVLVNSATGKLEECFQTYVRPTYHQFLTDFCKELTGIQQIQVDRGVPLGEALLMHDKWLEDKGIKNTNFAIVTWSNWDCRTMLESECRFKRIRKPPYFNRWINLKVPFQEVYGDVRCNLKEAVQLAGLTWEGRAHCGLDDARNTARLLALMMHRGFKFSITNSLVWQPAPQSTTCQLSPDRSPDPVQQQQKPKEMLGSPVQVNPYATSAGKDRAMYCYCGVLSRWSVVRKPGPMQGRYFFGCGNWTATRRAICPYFAWAS

SEQ ID NO: 3157 - DNA, 774 bp, Sorghum bicolor
  misc_feature: Ceres ANNOT ID no. 6028978
  misc_feature: Encodes the peptide sequence at SEQ ID NO 3158
atggcgtcccgcgtcaagtttgagaactcgtgcgaggtgggcgtcttcgcgaggctcaccaacgcctactgcctcgtccccgccggcgccgcctcccagggcttctacagtgtgctcgagggcgagctcgccggcgccgtccccgtggtcaggacctccgtcgccggcaccaggatcgtcgggaggctctgcgtcggcaacaagagagggctgctgcttccccataccgccaccgaccaagagatccagcacctgaggaacagcctgcccgatgaagtggtggtcaagtgcgtggacgagcgcctttccgccctgggaaactgcattgcctgcaacgaccatgtcgctctcacacaccctgacctcgacaaggaaactgaagaagtcatctcagacgttctcggtgtagaggtgttcaggcaaacgattgcagggaacatcctggttgggagctactgcaccttcaccaacaaaggaggactggttcacccgcagacgtcggtagaggacctggacgagctgtcgacgctgctgcaggtgcccatggtcgccggcaccgtcaacaggggcagcgaggtcgtctccgccggcatggccgtcaatgactggacggccttctgcggctccgacaccacggcgaccgaggtgtcggtggtcgagagcgtcttcaggctcagggacccccgcgcaggggcgctgggctcggttcaggatttctttacgagtggagctgggcttttgccggagccaagacaaaaaacaaggctctgctga

SEQ ID NO: 3158 - protein, 257 aa, Sorghum bicolor
  misc_feature: Ceres ANNOT ID no. 6028978
  misc_feature (3)..(205): Pfam Id: eIF-6 Pfam Desc: eIF-6 family
  misc_feature (1)..(238): NCBI GI: 6381991 NCBI Desc: b4 integrin interactor homolog [mus musculus]
  misc_feature (1)..(256): NCBI GI: 119596626 NCBI Desc: integrin beta 4 binding protein, isoform cra_b [homo sapiens]
  misc_feature (1)..(238): NCBI GI: 61365887 NCBI Desc: integrin beta 4 binding protein [synthetic construct]
  misc_feature (1)..(238): NCBI GI: 31563378 NCBI Desc: integrin beta 4 binding protein isoform a [homo sapiens]
  misc_feature (1)..(238): NCBI GI: 123984345 NCBI Desc: integrin beta 4 binding protein [synthetic construct]
MASRVKFENSCEVGVFARLTNAYCLVPAGAASQGFYSVLEGELAGAVPVVRTSVAGTRIVGRLCVGNKRGLLLPHTATDQEIQHLRNSLPDEVVVKCVDERLSALGNCIACNDHVALTHPDLDKETEEVISDVLGVEVFRQTIAGNILVGSYCTFTNKGGLVHPQTSVEDLDELSTLLQVPMVAGTVNRGSEVVSAGMAVNDWTAFCGSDTTATEVSVVESVFRLRDPRAGALGSVQDFFTSGAGLLPEPRQKTRLC

SEQ ID NO: 3159 - DNA, 1227 bp, Sorghum bicolor
  misc_feature: Ceres ANNOT ID no. 6028983
  misc_feature: Encodes the peptide sequence at SEQ ID NO 3160
atgcttgccctgctcgccgccttcgccgtcgcctgcctgctcttcgtgtccaggccatgcgcgcgtgacatgagactgttcctcgcctccctgtgccagcagctcctgctctccctcctcggactcctggcaggcctccgcctgctgggcggcgtcgcggccgcgtcccacgcggccaacacagagaccatgccgctcatgccgtccttcaagaggaagcgggccgcggtcacggtggagaatgcggaggaggcggccggcgccgccgctggcggcgagccgtcggtgctcgacctgccggagctggccatcgattgcattctcgagaggctgcagccggcggagctgcggagcatggccgccgtctgccgctccatgcgcgagcgctgccgcagcgaccacctctgggagcgccacatgaccagcaagtggggccgtgtcctgggccgcgccgccagggacgaatggaggacgcacgtggcgtccgccagcgagtccggcgcggtctcgggcggcggcggcggcggcaagcgccggaggtggctcgcggcgctctcctgcgtttgcccggtggtgtcctggatgcggcccaggcccgacggtggcaagtcgtccgcccccgtgctggatgattccatcatgtcgtggtacctgtccatggagagcggcaagttctggttcccggctcaggtctacaaccgcgagcatgggcatgttgggttcatgatgtcttgctatgatgcagagctcagttatgattttcacactgacacattccgtgcaaggtatccgccacacggtcgacgaactgtggtcttggaggatggtgtccattgggacaggatcagggcaccacctgttgacactcttgcgcatgatctccacacctctgactgcctacatgaactccggcctggtgatcatattgagattcagtggagaaggaacaaagaattcccatatggctggtggtatggggttgttgggcacttggagtcatgtgatggaaatgaacacttttgtcggtgtcatcttagtgataccgtcgtgctggagttcaatcagtacacgccaggctcaagatggaggcaagcgttggtaaatcggaaggaacacagggaagagggcaatgagggcgacgggttctacggcggtgtcaggaagctccgcagcaaggatgacatctccaagtggaggcagctgtggccaacagacatcctggagtag

SEQ ID NO: 3160 - protein, 408 aa, Sorghum bicolor
  misc_feature: Ceres ANNOT ID no. 6028983
  misc_feature (94)..(141): Pfam Id: F-box Pfam Desc: F-box domain
  misc_feature (92)..(408): NCBI GI: 46402474 NCBI Desc: at2g26850 [arabidopsis thaliana]
  misc_feature (95)..(408): NCBI GI: 87241181 NCBI Desc: cyclin-like f-box [medicago truncatula]
  misc_feature (50)..(407): NCBI GI: 55296278 NCBI Desc: f-box family protein-like [oryza sativa (japonica cultivar-group)]
  misc_feature (95)..(408): NCBI GI: 46931342 NCBI Desc: at2g41170 [arabidopsis thaliana]
  misc_feature (95)..(401): NCBI GI: 87241189 NCBI Desc: cyclin-like f-box [medicago truncatula]
MLALLAAFAVACLLFVSRPCARDMRLFLASLCQQLLLSLLGLLAGLRLLGGVAAASHAANTETMPLMPSFKRKRAAVTVENAEEAAGAAAGGEPSVLDLPELAIDCILERLQPAELRSMAAVCRSMRERCRSDHLWERHMTSKWGRVLGRAARDEWRTHVASASESGAVSGGGGGGKRRRWLAALSCVCPVVSWMRPRPDGGKSSAPVLDDSIMSWYLSMESGKFWFPAQVYNREHGHVGFMMSCYDAELSYDFHTDTFRARYPPHGRRTVVLEDGVHWDRIRAPPVDTLAHDLHTSDCLHELRPGDHIEIQWRRNKEFPYGWWYGVVGHLESCDGNEHFCRCHLSDTVVLEFNQYTPGSRWRQALVNRKEHREEGNEGDGFYGGVRKLRSKDDISKWRQLWPTDILE

SEQ ID NO: 3161 - DNA, 969 bp, Sorghum bicolor
  misc_feature: Ceres ANNOT ID no. 6029033
  misc_feature: Encodes the peptide sequence at SEQ ID NO 3162
atggccacagcggccggcaagccgctggtgtgcgtgaccggagctggaggcttcattgggtcgtcgctcgtcaaagagctgctccagcgtggctaccgcgtgaggggcaccgcaaggaacccagaccgcaagaatgcccatctgcatgcactggacggagccaaagaacgcctctctctgtgccgtgctgatgtgttggactacaagtcgctcgttgcggcatttaggctttgtgagggcgtcttccatgtcgcttgcccggaactcatggctgctgctattgagggaacgaagaatgccatcaacgctgctgcagatatgggagtgcaacgcgtggtgtacacttcatcctatggtgctgtccatatgaacccaaaaaggagtcctgatgaggttgtggatgagagttgctggagcgatcttgaattctgcctaaagacaaagaacttttactgcttcgcgaagacggttgctgagaaaacagccatggaggaggcatccaagagagggatacacctggtggtggtcgtgccggcgttcacgctaggtgaaacgctgcagccggggctgcacctggcgatgtacatgctcattgtctcctacgtgaagggcaccaggaagacgtacccgaacgctgtctccgggtttgtcgatgtgcaggatgttgcgcgtgcccatgtgttggtgtatgaaacccctactgcacatggacgctacctctgcattggcgaagtggtgcaccagtcggagtttattcaaatgatgatagagctcttcccacagtatcagatcaccgctaagtgtaaggatgaaaatgcaccaaaggtcaaaccgtacaagttctctacaaaaaggctacaggatctgggcatgaagttcactcctctaaaaaaaagtttacacaagacagtgatatgcctacaagaacaaggtcatatcccaaagctcccccacaaatcggccttgtga

SEQ ID NO: 3162 - protein, 322 aa, Sorghum bicolor
  misc_feature: Ceres ANNOT ID no. 6029033
  misc_feature (10)..(243): Pfam Id: Epimerase Pfam Desc: NAD dependent epimerase/dehydratase family
  misc_feature (12)..(226): Pfam Id: NAD_binding_4 Pfam Desc: Male sterility protein
  misc_feature (11)..(261): Pfam Id: 3Beta_HSD Pfam Desc: 3-beta hydroxysteroid dehydrogenase/isomerase family
  misc_feature (10)..(216): Pfam Id: NmrA Pfam Desc: NmrA-like family
  misc_feature (1)..(322): NCBI GI: 115436018 NCBI Desc: os01g0283600 [oryza sativa (japonica cultivar-group)]
  misc_feature (7)..(314): NCBI GI: 18307514 NCBI Desc: cinnamoyl coa reductase [oryza sativa]
  misc_feature (7)..(314): NCBI GI: 115449475 NCBI Desc: os02g0811400 [oryza sativa (japonica cultivar-group)]
  misc_feature (9)..(314): NCBI GI: 115449483 NCBI Desc: os02g0812000 [oryza sativa (japonica cultivar-group)]
  misc_feature (14)..(320): NCBI GI: 115478234 NCBI Desc: os09g0262000 [oryza sativa (japonica cultivar-group)]
  misc_feature: Useful for making plants with altered cell wall content and/or composition
  misc_feature: Functional homolog of the protein sequence encoded by LOCUS at1g15950
  misc_feature: Functional homolog of the protein sequence encoded by LOCUS at1g80820
  misc_feature: Useful for making plants with altered carbohydrate content
  misc_feature: Functional homolog of the protein sequence given in SEQ ID NO 13817
  misc_feature: Useful for making plants with altered cell wall content and/or composition
  misc_feature: Useful for making plants with altered lignin content
  misc_feature: Functional homolog of the protein sequence given in SEQ ID NO 13818
MATAAGKPLVCVTGAGGFIGSSLVKELLQRGYRVRGTARNPDRKNAHLHALDGAKERLSLCRADVLDYKSLVAAFRLCEGVFHVACPELMAAAIEGTKNAINAAADMGVQRVVYTSSYGAVHMNPKRSPDEVVDESCWSDLEFCLKTKNFYCFAKTVAEKTAMEEASKRGIHLVVVVPAFTLGETLQPGLHLAMYMLIVSYVKGTRKTYPNAVSGFVDVQDVARAHVLVYETPTAHGRYLCIGEVVHQSEFIQMMIELFPQYQITAKCKDENAPKVKPYKFSTKRLQDLGMKFTPLKKSLHKTVICLQEQGHIPKLPHKSAL

SEQ ID NO: 3163 - DNA, 729 bp, Sorghum bicolor
  misc_feature: Ceres ANNOT ID no. 6029047
  misc_feature: Encodes the peptide sequence at SEQ ID NO 3164
atggcgtccatgccggccgtgtccgccacctccgtcctcgcgccggcaccggcgtcgccccgctcccaactctgctactcaacggaaacgagacgcggcgcgctctccctccgccccgcccgcgctatccccgcgctgaggctcgtcggccaccgcgacgcccgtggcgccgtcgtcgtccgcgccgctgcggcagagggagccgtggatctgcaggccaaagtgacgaccaagtgcttcttcgacgtggaggtcggcggggagcccgcgggccgcatcgtcatcgggttgttcggagaggtcgtacctaagaccgtcgacaacttccgtgcactctgcactggtgagaaagggtacggctacaagggctgctcattccaccggatcatcaaggactttatgattcaaggcggggacttccaggaaaacaatggtactggtgggagaagtatttatggtgaaagctttgatgatgaaaattttacgttgaagcatgttggccctggtgtgctaagcatggcaaatgctggccctaacacaaatggaagtcaatttttcatttgcactgtgaagacaccgtggttggacaaccgtcacgtcgtgtttggacatgtcttggaggggatggacgtggtgaagcagcttgaatctcaagaaaccagcaggtccgatactcccaagcagccctgtcgaatcgttaactgtggcgagttacccctggacagctga

SEQ ID NO: 3164 - protein, 242 aa, Sorghum bicolor
  misc_feature: Ceres ANNOT ID no. 6029047
  misc_feature (78)..(238): Pfam Id: Pro_isomerase Pfam Desc: Cyclophilin type peptidyl-prolyl cis-trans isomerase/CLD
  misc_feature (67)..(241): NCBI GI: 115436026 NCBI Desc: os01g0284700 [oryza sativa (japonica cultivar-group)]
  misc_feature (62)..(241): NCBI GI: 140049884 NCBI Desc: peptidyl-prolyl cis-trans isomerase, cyclophilin type [medicago truncatula]
  misc_feature (11)..(242): NCBI GI: 21555831 NCBI Desc: peptidylprolyl isomerase roc4 [arabidopsis thaliana]
  misc_feature (11)..(242): NCBI GI: 20259872 NCBI Desc: peptidylprolyl isomerase roc4 [arabidopsis thaliana]
  misc_feature (11)..(242): NCBI GI: 11762200 NCBI Desc: at3g62030 [arabidopsis thaliana]
  misc_feature (11)..(242): SWISSPROT Homolog: EC 5.2.1.8 Peptidyl-prolyl cis-trans isomerase CYP20-3, chloroplast precursor
MASMPAVSATSVLAPAPASPRSQLCYSTETRRGALSLRPARAIPALRLVGHRDARGAVVVRAAAAEGAVDLQAKVTTKCFFDVEVGGEPAGRIVIGLFGEVVPKTVDNFRALCTGEKGYGYKGCSFHRIIKDFMIQGGDFQENNGTGGRSIYGESFDDENFTLKHVGPGVLSMANAGPNTNGSQFFICTVKTPWLDNRHVVFGHVLEGMDVVKQLESQETSRSDTPKQPCRIVNCGELPLDS

SEQ ID NO: 3165 - DNA, 1239 bp, Sorghum bicolor
  misc_feature: Ceres ANNOT ID no. 6029057
  misc_feature: Encodes the peptide sequence at SEQ ID NO 3166
atggcttccggcgagggggccggggagggatgggaggcggcggtgcgggcggaggtgggcgccgttgcctggtgggaagacccggacagcgccgacctccgcgccaggttcaaggctttcacggggcagcgcagcgactggccgcagcccacggtcctcttctggaaggaccttctcctccgtgtcgctcggagactccgcgtctgctccgcccctgcccacctcgtgacgagcgcttggttcgcgcgccccggggggctcacgccgctctgcttgccgcaagttctggaagagatgcgtgcggatggggacatactgctgaaatccgagctgatcgatccatcctcagggagcctgcaccagctggtcaggagggtgagcctgatgaccatcggctccaggaggacggtttcgcaggaggacatcctcgtgttcaaattgttggttgaggaacgggctgctgatattgctaggcaattgggcgactctcattggacatcgacatgtgttgttacgattagcaaattcaatagcttctttgttgaccgggaggatgctcatgtcgcattgtgttttttgacgcaatctgggaaagctaggtacctttcaggcaggaaacaagaacctattgagggtgtcaagtttgcactcactgcttcacaagttcctgctgtatccaaacttgaccacgacaccttgcacttagtatggacagaagagaagttgcaaggacagcttgatgtttcaaggagaagggcattggcatccttcaaatccggagataaacaggctgcttatcgttatgtgaggcagtctaaattattctcacaaagccggagcagatgcacacagttgttggaaaggattgaagaagtcatcagtctaattgctagtgctgaatcaaataagaaggtctatgaggcaatacaaattggtatcttggcaatgaaggacaacaatgtcagcatagatgaggttagcatccacatgaaggaggttgatgagcttgttgctgcacaaagagaagttgaagctgcccttgaatcagtacctctccagtcgttagatggtgaaggagatattgaggaagagttcaacaagcttgaagcagaattgcaggatgacattccacatattcatgttcaagaaccaatggcaccttccaacaaggaatcacctgatgaagtggttgaatcattgagccataacatgtcaagaattagactggagcccatctaa

SEQ ID NO: 3166 - protein, 412 aa, Sorghum bicolor
  misc_feature: Ceres ANNOT ID no. 6029057
  misc_feature (223)..(391): Pfam Id: Snf7 Pfam Desc: Snf7
  misc_feature (25)..(409): NCBI GI: 140049900 NCBI Desc: snf7 [medicago truncatula]
  misc_feature (25)..(401): NCBI GI: 145332925 NCBI Desc: snf7 family protein [arabidopsis thaliana]
  misc_feature (25)..(403): NCBI GI: 73917785 NCBI Desc: protein chmp7
  misc_feature (25)..(403): NCBI GI: 80476947 NCBI Desc: mgc68906 protein [xenopus laevis]
  misc_feature (25)..(394): NCBI GI: 94732918 NCBI Desc: novel protein (zgc:73300) [danio rerio]
MASGEGAGEGWEAAVRAEVGAVAWWEDPDSADLRARFKAFTGQRSDWPQPTVLFWKDLLLRVARRLRVCSAPAHLVTSAWFARPGGLTPLCLPQVLEEMRADGDILLKSELIDPSSGSLHQLVRRVSLMTIGSRRTVSQEDILVFKLLVEERAADIARQLGDSHWTSTCVVTISKFNSFFVDREDAHVALCFLTQSGKARYLSGRKQEPIEGVKFALTASQVPAVSKLDHDTLHLVWTEEKLQGQLDVSRRRALASFKSGDKQAAYRYVRQSKLFSQSRSRCTQLLERIEEVISLIASAESNKKVYEAIQIGILAMKDNNVSIDEVSIHMKEVDELVAAQREVEAALESVPLQSLDGEGDIEEEFNKLEAELQDDIPHIHVQEPMAPSNKESPDEVVESLSHNMSRIRLEPI

SEQ ID NO: 3167 - DNA, 1611 bp, Sorghum bicolor
  misc_feature: Ceres ANNOT ID no. 6029070
  misc_feature: Encodes the peptide sequence at SEQ ID NO 3168
  misc_feature: Down-regulated in shoot tissues in response to salicylic acid treatment
atggtcgccgccgccgccatggccaccgctgcatcggcggccgcgccgctactcaacgggacccgaaggcctgcgaggctccgccgtcgcggactccgcgtgcgctgcgccgctgtggcgggcggcgcggccgaggcaccggcctccaccggcgcgcggctgtccgcggactgcgtcgtggtgggcggcgggatcagtggcctctgcaccgcgcaggcgctggccacgcggcacggcgtcggggaggtgcttgtcacggaggcccgcgcccgacccggcggcaacatcaccaccgtcgagcgccccgaggaagggtacctctgggaggagggtcccaacagcttccagccatccgaccccgttctctccatggccgtggacagcgggctgaaggatgacctggtttttggggatcccaacgcgccgcggttcgtgctgtgggaggggaagctgaggcccgtgccatccaagcccgccgacctcccgttcttcgatctcatgagcatccctggcaagctcagggccggtctcggcgcgcttggcatccgcccgcctcctccaggccgcgaggagtcagtggaggagtttgtgcgccgcaacctcggtgctgaggtctttgagcgcctaattgagcctttctgctcaggtgtctatgctggtgatccttccaagctcagtatgaaggctgcatttgggaaggtgtggcggttagaagaagctggaggtagtattattggtggaaccatcaagacgattcaggagagaggcaagaatccaaaaccaccgagggatccccgccttccgaagccaaaagggcagacagttgcatctttcaggaagggtcttgccatgcttccaaatgccatcacatccagcttgggtagtaaagtcaaactatcatggaaactcacgagcattacaaaatcagatggcaaggggtatgttttggagtatgaaacaccagaaggggttgttttggtgcaggctaaaagtgttatcatgaccattccatcatatgttgctagcgacattttgcgtccactttcaggtgatgctgcagatgctctatcaagattctattatccaccagttgctgctgtaacggtttcgtatccaaaggaagcaattagaaaagaatgcttaattgatggggaactccagggttttggccagttgcatccacgtagtcaaggagttgagacattaggaacaatatacagctcatcactctttccaaatcgtgctcctgctggtagggtgttacttctaaactacataggaggtgctacaaacacaggaattgtttccaagactgaaagtgagctggtagaagcagttgaccgtgacctccgaaaaatgcttataaattctacagcagtggaccctttagtccttggtgtccgagtttggccacaagccatacctcagttcctggtaggacatcttgatcttctggaggtcgcaaaatctgccctggaccaaggtggctatgatgggctgttcctaggagggaactatgttgcaggagttgccctgggcagatgcattgagggcgcatatgagagtgccgcacaaatatatgacttcttgaccaagtatgcctacaagtga

SEQ ID NO: 3168 - protein, 536 aa, Sorghum bicolor
  misc_feature: Ceres ANNOT ID no. 6029070
  misc_feature (65)..(527): Pfam Id: Amino_oxidase Pfam Desc: Flavin containing amine oxidoreductase
  misc_feature (1)..(536): NCBI GI: 6715441 NCBI Desc: protoporphyrinogen ix oxidase [zea mays]
  misc_feature (3)..(536): NCBI GI: 13434996 NCBI Desc: protoporphyrinogen oxidase i [oryza sativa (japonica cultivar-group)]
  misc_feature (32)..(536): NCBI GI: 7268212 NCBI Desc: protoporphyrinogen oxidase [arabidopsis thaliana]
  misc_feature (31)..(536): NCBI GI: 4105186 NCBI Desc: protoporphyrinogen oxidase px-1 [nicotiana tabacum]
  misc_feature (32)..(536): NCBI GI: 3859604 NCBI Desc: arabidopsis thaliana protoporphyrinogen oxidase precursor (ppo) (sw:p55826)
  misc_feature (32)..(536): SWISSPROT Homolog: EC 1.3.3.4 Protoporphyrinogen oxidase, chloroplast precursor
  misc_feature: Down-regulated in shoot tissues in response to salicylic acid treatment
MVAAAAMATAASAAAPLLNGTRRPARLRRRGLRVRCAAVAGGAAEAPASTGARLSADCVVVGGGISGLCTAQALATRHGVGEVLVTEARARPGGNITTVERPEEGYLWEEGPNSFQPSDPVLSMAVDSGLKDDLVFGDPNAPRFVLWEGKLRPVPSKPADLPFFDLMSIPGKLRAGLGALGIRPPPPGREESVEEFVRRNLGAEVFERLIEPFCSGVYAGDPSKLSMKAAFGKVWRLEEAGGSIIGGTIKTIQERGKNPKPPRDPRLPKPKGQTVASFRKGLAMLPNAITSSLGSKVKLSWKLTSITKSDGKGYVLEYETPEGVVLVQAKSVIMTIPSYVASDILRPLSGDAADALSRFYYPPVAAVTVSYPKEAIRKECLIDGELQGFGQLHPRSQGVETLGTIYSSSLFPNRAPAGRVLLLNYIGGATNTGIVSKTESELVEAVDRDLRKMLINSTAVDPLVLGVRVWPQAIPQFLVGHLDLLEVAKSALDQGGYDGLFLGGNYVAGVALGRCIEGAYESAAQIYDFLTKYAYK

SEQ ID NO: 3169 - DNA, 582 bp, Sorghum bicolor
  misc_feature: Ceres ANNOT ID no. 6029073
  misc_feature: Encodes the peptide sequence at SEQ ID NO 3170
atggcggagtgcaaggacagcagcggccggtctccgtcgtcgtccatggatagcagcacgcacccggtgctctccaccacgtcgtcgggctgccggccggcggcgaggagggacgacctcagcaccgacctccagctagggctcagcctgtcgccggcgtcctcgtccctcctggtagcggagagcaagaggagcatcccttctacgccaaggaaccaagtactcccggattggcccccgatcaaaccgttccttagaagcgccttgacagcctcggcacgccgacggagcacattgttcgtgaaggtgtacatggaaggcgttccaatcggtcggaagctggacttgctcttgctggatgggtacgacagcctcctagccaaactccgccacatgttcaaggcctctatcacttatgctgatgttatggagtaccatcaaagagctcctcacgagaaggctgcacatgttctcacctatgaagaccaggatggagactggatgatggttggggatgtaccgtgggagctcttccttggaagtgtaaggaaactgaggattgcaagaacagataaatgctag

SEQ ID NO: 3170 - protein, 193 aa, Sorghum bicolor
  misc_feature: Ceres ANNOT ID no. 6029073
  misc_feature (4)..(190): Pfam Id: AUX_IAA Pfam Desc: AUX/IAA family
  misc_feature (1)..(193): NCBI GI: 88911339 NCBI Desc: auxin-responsive protein iaa4 (indoleacetic acid-induced protein 4)
  misc_feature (90)..(193): NCBI GI: 115436040 NCBI Desc: os01g0286900 [oryza sativa (japonica cultivar-group)]
  misc_feature (11)..(191): NCBI GI: 20269055 NCBI Desc: aux/iaa protein [populus tremula x populus tremuloides]
  misc_feature (3)..(191): NCBI GI: 88911341 NCBI Desc: auxin-responsive protein iaa8 (indoleacetic acid-induced protein 8)
  misc_feature (11)..(191): NCBI GI: 20269053 NCBI Desc: aux/iaa protein [populus tremula x populus tremuloides]
  misc_feature: The plant produces a reduced number of seeds.
  misc_feature: The sequence is a functional homolog of SEQ ID NO 1149 in the 10/412,699US patent application
  misc_feature: The sequence is a functional homolog of SEQ ID NO 118 in the 10/286,264US patent application
  misc_feature: The sequence is a functional homolog of SEQ ID NO 126 in the 10/225,066US patent application
  misc_feature: The sequence is a functional homolog of SEQ ID NO 1812 in the 11/479,226US patent application
  misc_feature: The sequence is a functional homolog of SEQ ID NO 276 in the 10/374,780US patent application
  misc_feature: The sequence is a functional homolog of SEQ ID NO 574 in the 10/666,642US patent application
  misc_feature: The sequence is a functional homolog of SEQ ID NO 736 in the 10/374,780US patent application
  misc_feature: The sequence is a functional homolog of SEQ ID NO 737 in the 10/374,780US patent application
  misc_feature: The sequence is a functional homolog of SEQ ID NO 738 in the 10/374,780US patent application
  misc_feature: The sequence is a functional homolog of SEQ ID NO 739 in the 10/374,780US patent application
  misc_feature: The sequence is a functional homolog of SEQ ID NO 742 in the 10/374,780US patent application
  misc_feature: The sequence is a functional homolog of SEQ ID NO 892 in the 10/412,699US patent application
  misc_feature: The sequence is a functional homolog of SEQ ID NO 982 in the 11/435,388US patent application
  misc_feature: Useful for biocontainment applications
  misc_feature: Useful for making plants with altered alkaloid content
  misc_feature: Useful for making plants with modulated growth and phenotype characteristics
  misc_feature: Useful for making plants with modulated low light sensitivity
  misc_feature: Functional homolog of the protein sequence given in SEQ ID NO 13291
  misc_feature: The sequence is a functional homolog of SEQ ID NO 118 in the 20030093837 US patent application
  misc_feature: The sequence is a functional homolog of SEQ ID NO 1149 in the 20040045049 US patent application
  misc_feature: The sequence is a functional homolog of SEQ ID NO 736 in the 20060162006 US patent application
  misc_feature: The sequence is a functional homolog of SEQ ID NO 737 in the 20060162006 US patent application
  misc_feature: The sequence is a functional homolog of SEQ ID NO 738 in the 20060162006 US patent application
  misc_feature: The sequence is a functional homolog of SEQ ID NO 739 in the 20060162006 US patent application
  misc_feature: The sequence is a functional homolog of SEQ ID NO 982 in the 20060272060 US patent application
MAECKDSSGRSPSSSMDSSTHPVLSTTSSGCRPAARRDDLSTDLQLGLSLSPASSSLLVAESKRSIPSTPRNQVLPDWPPIKPFLRSALTASARRRSTLFVKVYMEGVPIGRKLDLLLLDGYDSLLAKLRHMFKASITYADVMEYHQRAPHEKAAHVLTYEDQDGDWMMVGDVPWELFLGSVRKLRIARTDKC

SEQ ID NO: 3171 - DNA, 729 bp, Sorghum bicolor
  misc_feature: Ceres ANNOT ID no. 6029078
  misc_feature: Encodes the peptide sequence at SEQ ID NO 3172
atggttcgcaagaaggtgaatctccaatggatcaccaaagcctccaagcgtcgtgcgacgtttaggaggcgccgcgatagcattaagaagaaggtcgatgagctagccacactctgcggcaccaaggtgggtgtcgtgttgtacagcgaggatcaggctaagccattggcttggcctaatgactcagaggccaaagatatcttcaaaaaattcatcgacatgccagatcttggcaaaagattcaagaagatgcagaaccaggaggaacttcttagcacccgcatccccaagctccaacaccagataagtaggttggaacgtgagaactacacacatgagatctcattccttctctatgagagcattgatggacgccgccccggtctcatcaacaccactgagaaggaacgcaccagccttggcgagatggtagaagagaagattaagaaaatcaaagaacgtatacgacaacttcaaggagtagcactagaggcccatctaccactacagctacggtcatcgccaaaccagccactagcaccctgcacatttaatgagatggcggtagtgggacgcgtgccaccccaacaacaacaggattgggttgctagcctcaccaccaatggaggcgagcttggcaccattgtctccggtgccttcgctagtagcagtggtggggttgacatgatgcacccttacaatatggattatttctcaaggttcccatag

SEQ ID NO: 3172 - protein, 242 aa, Sorghum bicolor
  misc_feature: Ceres ANNOT ID no. 6029078
  misc_feature (9)..(60): Pfam Id: SRF-TF Pfam Desc: SRF-type transcription factor (DNA-binding and dimerisationdomain)
  misc_feature (1)..(177): NCBI GI: 116309208 NCBI Desc: osigba0139j17.10 [oryza sativa (indica cultivar-group)]
  misc_feature (1)..(177): NCBI GI: 116309207 NCBI Desc: osigba0139j17.9 [oryza sativa (indica cultivar-group)]
  misc_feature (21)..(152): NCBI GI: 108709427 NCBI Desc: srf-type transcription factor family protein [oryza sativa (japonica cultivar-group)]
  misc_feature (2)..(179): NCBI GI: 32402454 NCBI Desc: mads-box protein agl38 [arabidopsis thaliana]
  misc_feature (1)..(159): NCBI GI: 32402456 NCBI Desc: mads-box protein agl35 [arabidopsis thaliana]
  misc_feature: The sequence is a functional homolog of SEQ ID NO 130 in the 11/375,241US patent application
  misc_feature: The sequence is a functional homolog of SEQ ID NO 1781 in the 11/479,226US patent application
  misc_feature: The sequence is a functional homolog of SEQ ID NO 270 in the 10/374,780US patent application
  misc_feature: The sequence is a functional homolog of SEQ ID NO 2892 in the 10/374,780US patent application
  misc_feature: The sequence is a functional homolog of SEQ ID NO 4 in the 10/225,066US patent application
  misc_feature: The sequence is a functional homolog of SEQ ID NO 48 in the 10/225,066US patent application
  misc_feature: The sequence is a functional homolog of SEQ ID NO 488 in the 10/225,066US patent application
  misc_feature: Useful for making plants with modulated growth and phenotype characteristics
  misc_feature: The sequence is a functional homolog of SEQ ID NO 4 in the 20050160493 US patent application
  misc_feature: The sequence is a functional homolog of SEQ ID NO 48 in the 20050160493 US patent application
  misc_feature: The sequence is a functional homolog of SEQ ID NO 488 in the 20050160493 US patent application
MVRKKVNLQWITKASKRRATFRRRRDSIKKKVDELATLCGTKVGVVLYSEDQAKPLAWPNDSEAKDIFKKFIDMPDLGKRFKKMQNQEELLSTRIPKLQHQISRLERENYTHEISFLLYESIDGRRPGLINTTEKERTSLGEMVEEKIKKIKERIRQLQGVALEAHLPLQLRSSPNQPLAPCTFNEMAVVGRVPPQQQQDWVASLTTNGGELGTIVSGAFASSSGGVDMMHPYNMDYFSRFP

SEQ ID NO: 3173 - DNA, 1077 bp, Sorghum bicolor
  misc_feature: Ceres ANNOT ID no. 6029100
  misc_feature: Encodes the peptide sequence at SEQ ID NO 3174
  misc_feature: Up-regulated in root tissues in response to salicylic acid treatment
atggaccttccggtggtggatctcgcgccgtatcttcgggccgccgccggcgacgcggccccggcgggtgaggaggagctgcgcacgctgtgcgccacggtgagcgctagcctgcgggatacaggggcgttgctggtgatggacccgcgctgctccgcggcggacaacgaccgcttcctcgacgtcgtcgagagctacttcgcccgatccgccgacgcaaagcgcctccaggaacggccccacctccactaccaggttggtgtcacacccgaaggggtcgaggttcctcgcagtttggtcgacaagaacatgcaggagaagatcaggagcatgccagaggagtttcagccagccacgcctaaagggccggacccgaaatggcggtacatgtggagagtgggtcctcgccctgcaaatactcgctttaaggagctaaactcagaacctgttatccctgagggattacctgagtggaaagagacgatggattcctggggttctaaaatgatttctgcaattgaggttgttgctgagatggctgcaattggctttggcctgtccaaggacgcatttacttctttgatgaaggagggaccacatctcctagcaccaactggaagtgacttgcagcgtcatggttctgagggcactgtttttgctggattccactacgatcttaattttttgacaatacatggccggagtagattcccaggcctaaacatctggttaaggaatggtaaaaagatggaagtgaaagtccctgttggttgccttctaattcagtctggaaaacagctggaatggcttactggtggcgattgtttggctggaatgcatgaggtagtggtgtctaagagaacgctagatgccatagcactagcgaaagagcaaaatagaagtttgtggagggtttcatcaacattgttcgcgcacattgcttcggatgcaattcttaagccgctcggccactttgctgaagcacctgatgctcattcctatccacctatatgcgctggggattatgtcgagcaggagctttcagtcattaacctgaaaggaaaggatggagtatag

SEQ ID NO: 3174 - protein, 358 aa, Sorghum bicolor
  misc_feature: Ceres ANNOT ID no. 6029100
  misc_feature (143)..(352): NCBI GI: 56179780 NCBI Desc: 2og-fe(ii) oxygenase superfamily protein [idiomarina loihiensis l2tr]
  misc_feature (32)..(352): NCBI GI: 33862407 NCBI Desc: iron/ascorbate oxidoreductase [prochlorococcus marinus str. mit 9313]
  misc_feature (115)..(352): NCBI GI: 16124455 NCBI Desc: oxidoreductase iron/ascorbate family [caulobacter crescentus cb15]
  misc_feature (125)..(352): NCBI GI: 124021884 NCBI Desc: iron/ascorbate oxidoreductase [prochlorococcus marinus str. mit 9303]
  misc_feature (137)..(352): NCBI GI: 84702671 NCBI Desc: oxidoreductase [parvularcula bermudensis htcc2503]
  misc_feature: Up-regulated in root tissues in response to salicylic acid treatment
  misc_feature: The sequence is a functional homolog of SEQ ID NO. 513 in the 11/188,298 US application
MDLPVVDLAPYLRAAAGDAAPAGEEELRTLCATVSASLRDTGALLVMDPRCSAADNDRFLDVVESYFARSADAKRLQERPHLHYQVGVTPEGVEVPRSLVDKNMQEKIRSMPEEFQPATPKGPDPKWRYMWRVGPRPANTRFKELNSEPVIPEGLPEWKETMDSWGSKMISAIEVVAEMAAIGFGLSKDAFTSLMKEGPHLLAPTGSDLQRHGSEGTVFAGFHYDLNFLTIHGRSRFPGLNIWLRNGKKMEVKVPVGCLLIQSGKQLEWLTGGDCLAGMHEVVVSKRTLDAIALAKEQNRSLWRVSSTLFAHIASDAILKPLGHFAEAPDAHSYPPICAGDYVEQELSVINLKGKDGV

SEQ ID NO: 3175 - DNA, 1749 bp, Sorghum bicolor
  misc_feature: Ceres ANNOT ID no. 6029108
  misc_feature: Encodes the peptide sequence at SEQ ID NO 3176
atggagacgaggccggagcgccaccgccacgaccacgtccacgagcagcaagcccaggagggggaggaggacgacgcagcagcagcagtcatggaacacggcgctgctctctcgctgcaacgcggagccaccttgtttgggcgccggcgtcagcacgatgaggaggccgaccgccgccgccggggcgagatccgggaggtggacttcttctcgagggactccggagcccggggccaggacgacggcggcgggcgcggggtgcccggaggcggacgcgacgacgtcaacatcgggctagacctgctgaccaccgccaccgctgccacgacaagcgccgccggcgaggaaatgatggcggtcaagaatcaaaagatagaggcgtcagctgtggaagtggagctcaggcgggtggtggaggagaaccggcggctgcgtggcatgcttgaggagctcaaccggagctatggcgcgctgtaccaacagcttctccaggtcacgcagcaccgacagcatcctgctgatctcatgatcaacagatcatcactggctcatacccacctgacgaccaccgcggcctcgcacaacacgtcgtccactcggcagctgttggaggcgcgcgcgtcctctactgctatggcgcagccgcatgccgtcgccgctggaggggacgacgaggctagcgacggagccgaggaggcgtcgccttcgctgagcaatggaggaaacaacaacgacgacgccgatggcaagaggaaaacctcgccggataggacagcaccaccgagagagaatggcggcgagcaggcgtcgtcggagctgcccggccggaaggcaagggtgtccgtgcgcgcgcgatctgaggcaccaatgattagtgatgggtgtcaatggaggaagtacgggcagaagatggccaaaggtaacccatgcccgagggcatactaccggtgcacaatggctgtggcatgccccgtcaggaagcaggtgcaacggtgcgccgaggacaagacaattctggtcacgacttacgagggacaccacaaccacccgctgccgccggcggccaccaccatggcgaacaccacgtccgccgcggcggccatgctgctctccggcccggccaccagccgcgacggcgctgccgcggcgctcctcggccacccggcgctgttccaccactccagcagcatcccctacgcgtccaccatggccacgctctctgcctccgcgccgttccccaccatcaccctcgacctcacccaggcgcccggcggcgttgccgggagcggcggcggcggcctgctgcctcacgggctcgggctccatcgcccacccggcgggatccaccctgtgacggcggtcccggcgatgccgttcccggtgccatcgccgctggcttcgatgttccttccacagcgagcgcccacggggccgccgatgcccaccgggctgcaggtcgcgcggcagcagcagtcggtgatgatggagacggtgacagcagccatcgcggccgaccccaacttcaccacggcgcttgcggcggccatctcgtcggtcatggcaggcggagcagcgcaccaggctcagcctactccacgtgggagtaatatcatcggcatcgccgccggggatcaggccaacggcagtgcgggtgctgctgccattgcaggtccgacggcagccggagcacatgcagcgtctgccgggtcacctcgtttcgcgacgcagtcctgcaccacgtcaacttga

SEQ ID NO: 3176 - protein, 582 aa, Sorghum bicolor
  misc_feature: Ceres ANNOT ID no. 6029108
  misc_feature (291)..(351): Pfam Id: WRKY Pfam Desc: WRKY DNA -binding domain
  misc_feature (108)..(581): NCBI GI: 115436052 NCBI Desc: os01g0289600 [oryza sativa (japonica cultivar-group)]
  misc_feature (49)..(559): NCBI GI: 46394264 NCBI Desc: tpa: wrky transcription factor 5 [oryza sativa (japonica cultivar-group)]
  misc_feature (121)..(423): NCBI GI: 124359759 NCBI Desc: dna-binding wrky [medicago truncatula]
  misc_feature (60)..(522): NCBI GI: 126013406 NCBI Desc: wrky protein [solanum tuberosum]
  misc_feature (121)..(423): NCBI GI: 124360508 NCBI Desc: dna-binding wrky [medicago truncatula]
  misc_feature: The sequence is a functional homolog of SEQ ID NO 1200 in the 10/374,780US patent application
  misc_feature: The sequence is a functional homolog of SEQ ID NO 1372 in the 10/666,642US patent application
  misc_feature: The sequence is a functional homolog of SEQ ID NO 1395 in the 10/412,699US patent application
  misc_feature: The sequence is a functional homolog of SEQ ID NO 1593 in the 10/374,780US patent application
  misc_feature: The sequence is a functional homolog of SEQ ID NO 1594 in the 10/374,780US patent application
  misc_feature: The sequence is a functional homolog of SEQ ID NO 16 in the 10/412,699US patent application
  misc_feature: The sequence is a functional homolog of SEQ ID NO 1639 in the 10/412,699US patent application
  misc_feature: The sequence is a functional homolog of SEQ ID NO 1640 in the 10/412,699US patent application
  misc_feature: The sequence is a functional homolog of SEQ ID NO 204 in the 10/714,887US patent application
  misc_feature: The sequence is a functional homolog of SEQ ID NO 204 in the 11/435,388US patent application
  misc_feature: The sequence is a functional homolog of SEQ ID NO 22 in the 10/374,780US patent application
  misc_feature: The sequence is a functional homolog of SEQ ID NO 231 in the 11/479,226US patent application
  misc_feature: The sequence is a functional homolog of SEQ ID NO 258 in the 10/714,887US patent application
  misc_feature: The sequence is a functional homolog of SEQ ID NO 258 in the 11/435,388US patent application
  misc_feature: The sequence is a functional homolog of SEQ ID NO 272 in the 10/374,780US patent application
  misc_feature: The sequence is a functional homolog of SEQ ID NO 300 in the 10/225,066US patent application
  misc_feature: The sequence is a functional homolog of SEQ ID NO 858 in the 10/225,066US patent application
  misc_feature: The sequence is a functional homolog of SEQ ID NO 88 in the 10/412,699US patent application
  misc_feature: The sequence is a functional homolog of SEQ ID NO 882 in the 10/412,699US patent application
  misc_feature: The sequence is a functional homolog of SEQ ID NO 885 in the 10/666,642US patent application
  misc_feature: The sequence is a functional homolog of SEQ ID NO 886 in the 10/666,642US patent application
  misc_feature: The sequence is a functional homolog of SEQ ID NO 887 in the 10/666,642US patent application
  misc_feature: The sequence is a functional homolog of SEQ ID NO 94 in the 10/412,699US patent application
  misc_feature: Useful for making plants with modulated growth and phenotype characteristics
  misc_feature: The sequence is a functional homolog of SEQ ID NO 1395 in the 20040045049 US patent application
  misc_feature: The sequence is a functional homolog of SEQ ID NO 16 in the 20040045049 US patent application
  misc_feature: The sequence is a functional homolog of SEQ ID NO 1639 in the 20040045049 US patent application
  misc_feature: The sequence is a functional homolog of SEQ ID NO 1640 in the 20040045049 US patent application
  misc_feature: The sequence is a functional homolog of SEQ ID NO 88 in the 20040045049 US patent application
  misc_feature: The sequence is a functional homolog of SEQ ID NO 882 in the 20040045049 US patent application
  misc_feature: The sequence is a functional homolog of SEQ ID NO 94 in the 20040045049 US patent application
  misc_feature: The sequence is a functional homolog of SEQ ID NO 204 in the 20060015972 US patent application
  misc_feature: The sequence is a functional homolog of SEQ ID NO 885 in the 20070033671 US patent application
  misc_feature: The sequence is a functional homolog of SEQ ID NO 886 in the 20070033671 US patent application
  misc_feature: The sequence is a functional homolog of SEQ ID NO 887 in the 20070033671 US patent application
METRPERHRHDHVHEQQAQEGEEDDAAAAVMEHGAALSLQRGATLFGRRRQHDEEADRRRRGEIREVDFFSRDSGARGQDDGGGRGVPGGGRDDVNIGLDLLTTATAATTSAAGEEMMAVKNQKIEASAVEVELRRVVEENRRLRGMLEELNRSYGALYQQLLQVTQHRQHPADLMINRSSLAHTHLTTTAASHNTSSTRQLLEARASSTAMAQPHAVAAGGDDEASDGAEEASPSLSNGGNNNDDADGKRKTSPDRTAPPRENGGEQASSELPGRKARVSVRARSEAPMISDGCQWRKYGQKMAKGNPCPRAYYRCTMAVACPVRKQVQRCAEDKTILVTTYEGHHNHPLPPAATTMANTTSAAAAMLLSGPATSRDGAAAALLGHPALFHHSSSIPYASTMATLSASAPFPTITLDLTQAPGGVAGSGGGGLLPHGLGLHRPPGGIHPVTAVPAMPFPVPSPLASMFLPQRAPTGPPMPTGLQVARQQQSVMMETVTAAIAADPNFTTALAAAISSVMAGGAAHQAQPTPRGSNIIGIAAGDQANGSAGAAAIAGPTAAGAHAASAGSPRFATQSCTTST

SEQ ID NO: 3177 - DNA, 3843 bp, Sorghum bicolor
  misc_feature: Ceres ANNOT ID no. 6029126
  misc_feature: Encodes the peptide sequence at SEQ ID NO 3178
atgccggagtcctggagacccgccgaggcgaatgcctcctcgcagccggcggcggcaggcacgtccggaccctcggctccgagcccgggcaatggcgccaaggggggatcccccggcgctgcggaggcggcggcgacggcgacggcgactcgggtgccgttccacaagctgttcgcgttcgcggactccaccgacgtcgcgctcatgctactgggcgcgctcggggccgtggccaacggcgccgcgatgcccttcatgaccgtgctcttcggcaacctcatcgacgcctttggcggcgcgctcagcatccacgacgtcgtcaaccgggtgtccatggtctctctcgagttcatctacctcgccatcgcctccgccgtcgcctccttcgtccaggtgacctgctggatgatcaccggcgagcgtcaggcggcgcggatacggaacctgtacctcaagacaatcctgaggcaggagatcgccttcttcgacaagtacaccagcaccggcgaggtcgtgggcaggatgtccggcgacacggtgctgatccaggatgccatgggcgagaaggtcggcaagttcatccagctggtggtgactttcctcggcggcttcatcgtcgccttcgcgcagggctggctgctcaccctggtcatgatggcgaccatcccgccgctcgtcatggcgggcgctgtcatgtccaacgtcgtgaccaagatggcgtccctgggccaggcggcctacgcggagtcgtcggtggtggtggagcagaccatcggttccatcaggacggttgcgtctttcaccggtgagaaacgggcggtggagaagtacaacaagtccttgaagaacgcgtacaagtccggcgtccgagagggcctcgccactgggcttggtatgggcacggtcatggtgctcctcttctgcggctactcgctggggatttggtatggcgctaagctgatcctggagaaggggtacaccggagccaaggtcatgaacgtgatctttgcagtcctcactggttcactggctctaggccaggcgtctccaagcatgaaagcatttgcaggtgggcaggccgctgcatacaaaatgtttgagacgatcaatagaacaccagaaatcgacgcgtacagcaccacaggaaggaagctggaggacattcgaggggatattgagtttagagatgtctatttctcttatccaacaaggcccgatgagcaaatattcaagggtttctccctcaccatacctagtggcatgacaatcgcattggtaggccagagcgggagtggtaaatccacggtcatcagcctaatcgaacggttttacgaccctcagcttggcgatgttctgatagatggtgtgaatctcaaggagttccagttaaggtggatcagaagtaaaatcggccttgtcagccaggagccagtcctttttgctgccagcataaaggagaacatagcttatggcaaagacaacgcgacggatctggaaattagagctgctgctgagcttgccaacgctgccaaattcatagataaaatgcctcagggttttgatacttcggttggtgagcatgggacacagctttctggtgggcagaagcaaagaattgccattgcaagggctattctgaaagatccacgaatcctactattggatgaagctaccagcgcactggatgccgagtctgaaaggattgtgcaggaagctcttgacagggtcatgacaaataggacaacagtcatagttgcacaccgtctgagcactgttcgaaatgctgacaccattgctgttattcatcaaggaacactagttgaaaaaggtccacacaatgagcttctaagagatccagaaggagcttatagccaactgataaggctacaggaagcaaaccagcagaacaatcggaagggtgatgccaatgctcgtccaggcaaacaaacgtcaataaataagtcagctagcaggaggtcatcccgtgataacagtagccaccattcattctcggtaccatttggtatgcctcttgggattgatattcaggatggttcatctaacaaactgtgtgacgagataccacaggaagtgcctctcagccggcttgcatctcttaacaagccagagatcccagtccttatactaggttccattgcctcagtcatcagtggagttatcttcccaatctttgcgatactcctgtcaaatgtgataaaagcattctatgagcctccacatcttctaaggagggattcacagttctgggcttccatgttcttggtgtttggtgcagtgtacttcttgtcactccctgtcagttcgtaccttttctccatagctgggtgcaggttgattagaaggatccgactgatgacatttgaaaaggtggtaaatatggagatcgaatggtttgatcacccagaaaactcaagtggagcaattggtgcaaggctgtcagcagatgcagcaaaagttagaggacttgtgggagacgcgcttcaattggttgtgcaaaactcttcaacattagtcgctggtttggtaattgcatttgtatcaaactgggagctatccctcatcatcttagctttaataccactcattggcctcaatggatggatccagatgaagtttattcagggtttcagtgcagatgcaaagatgatgtatgaagaggcaagccaggtggctaatgatgcagtaagcagcataagaacagtggcctcattctcagctgaagagaaggtcatggatttgtacaagaagaaatgtgaaggtcccctaagaacaggaatcaggacagggattataagtggaatcggttttggagtttcctttttcttgctatttggggtatatgcagctagcttttatgctggtgctcggcttgttgaggacaggaagacaacctttcctaaagttttcagggtttttcttgctcttgcaatggcggcaattggagtgtcgcaatcaagtacgcttacatcggattcttccaaagcaaaatcagctgcatcttctatatttgcaattgtagaccgaaaatcaaggatagacccaagtgaggatgcaggggtgactgttgagacactacgaggaaatatcgaattccagcacgttagcttcaggtatccaaccaggccagatgttcagattttccgggacctttgcttgacaattcatgctggaaagactgttgcgcttgttggagagagtggtagtggcaaatcaacagcaatttcgttgcttcagaggttctatgacccagatgtaggcaatatactactagatggcgtggacatacagaagttccagcttaggtggttaaggcaacaaatgggcctggttagtcaagaaccagctttatttaatgacacaataagggctaacattgcctatggaaaagatggacaagcaacagaatctgagatcatatctgctgcagaattggcaaatgctcacaaatttatcagttcggcgctccaggggtatgacacaatggttggagagcgtggagctcagttgtcaggagggcagaagcagcgtgtggcgattgcccgtgcaattgtgaaggaccctaggatcctgcttctggacgaagcgactagtgcactggatgctgaatccgagcggatcgtccaggacgcactggacagggtaatggtgaaccggacaacagtgatcgtcgctcaccgtctgtcaacaatacaaaatgcagatttgatcgcagtcgtgaggaatggggttatcatcgagaagggaaagcacgatgccttgatcaacatcaaggatggcgcgtatgcgtccctcgtcgcccttcactcggcagcctcttcgtag

SEQ ID NO: 3178 - protein, 1280 aa, Sorghum bicolor
  misc_feature: Ceres ANNOT ID no. 6029126
  misc_feature (420)..(604): Pfam Id: ABC_tran Pfam Desc: ABC transporter
  misc_feature (1064)..(1249): Pfam Id: ABC_tran Pfam Desc: ABC transporter
  misc_feature (69)..(348): Pfam Id: ABC_membrane Pfam Desc: ABC transporter transmembrane region
  misc_feature (714)..(989): Pfam Id: ABC_membrane Pfam Desc: ABC transporter transmembrane region
  misc_feature (13)..(1280): NCBI GI: 27368865 NCBI Desc: mdr-like abc transporter [oryza sativa (japonica cultivar-group)]
  misc_feature (52)..(1280): NCBI GI: 92894394 NCBI Desc: cyclic peptide transporter [medicago truncatula]
  misc_feature (9)..(1279): NCBI GI: 14715462 NCBI Desc: cjmdr1 [coptis japonica]
  misc_feature (52)..(1280): NCBI GI: 2739309 NCBI Desc: p-glycoprotein-like protein [arabidopsis thaliana]
  misc_feature (48)..(1279): NCBI GI: 92896736 NCBI Desc: cyclic peptide transporter [medicago truncatula]
MPESWRPAEANASSQPAAAGTSGPSAPSPGNGAKGGSPGAAEAAATATATRVPFHKLFAFADSTDVALMLLGALGAVANGAAMPFMTVLFGNLIDAFGGALSIHDVVNRVSMVSLEFIYLAIASAVASFVQVTCWMITGERQAARIRNLYLKTILRQEIAFFDKYTSTGEVVGRMSGDTVLIQDAMGEKVGKFIQLVVTFLGGFIVAFAQGWLLTLVMMATIPPLVMAGAVMSNVVTKMASLGQAAYAESSVVVEQTIGSIRTVASFTGEKRAVEKYNKSLKNAYKSGVREGLATGLGMGTVMVLLFCGYSLGIWYGAKLILEKGYTGAKVMNVIFAVLTGSLALGQASPSMKAFAGGQAAAYKMFETINRTPEIDAYSTTGRKLEDIRGDIEFRDVYFSYPTRPDEQIFKGFSLTIPSGMTIALVGQSGSGKSTVISLIERFYDPQLGDVLIDGVNLKEFQLRWIRSKIGLVSQEPVLFAASIKENIAYGKDNATDLEIRAAAELANAAKFIDKMPQGFDTSVGEHGTQLSGGQKQRIAIARAILKDPRILLLDEATSALDAESERIVQEALDRVMTNRTTVIVAHRLSTVRNADTIAVIHQGTLVEKGPHNELLRDPEGAYSQLIRLQEANQQNNRKGDANARPGKQTSINKSASRRSSRDNSSHHSFSVPFGMPLGIDIQDGSSNKLCDEIPQEVPLSRLASLNKPEIPVLILGSIASVISGVIFPIFAILLSNVIKAFYEPPHLLRRDSQFWASMFLVFGAVYFLSLPVSSYLFSIAGCRLIRRIRLMTFEKVVNMEIEWFDHPENSSGAIGARLSADAAKVRGLVGDALQLVVQNSSTLVAGLVIAFVSNWELSLIILALIPLIGLNGWIQMKFIQGFSADAKMMYEEASQVANDAVSSIRTVASFSAEEKVMDLYKKKCEGPLRTGIRTGIISGIGFGVSFFLLFGVYAASFYAGARLVEDRKTTFPKVFRVFLALAMAAIGVSQSSTLTSDSSKAKSAASSIFAIVDRKSRIDPSEDAGVTVETLRGNIEFQHVSFRYPTRPDVQIFRDLCLTIHAGKTVALVGESGSGKSTAISLLQRFYDPDVGNILLDGVDIQKFQLRWLRQQMGLVSQEPALFNDTIRANIAYGKDGQATESEIISAAELANAHKFISSALQGYDTMVGERGAQLSGGQKQRVAIARAIVKDPRILLLDEATSALDAESERIVQDALDRVMVNRTTVIVAHRLSTIQNADLIAVVRNGVIIEKGKHDALINIKDGAYASLVALHSAASS

SEQ ID NO: 3179 - DNA, 2601 bp, Sorghum bicolor
  misc_feature: Ceres ANNOT ID no. 6029142
  misc_feature: Encodes the peptide sequence at SEQ ID NO 3180
atgaccggtgggaacaagaacaagagcctcaactgggatttgaacgactggaggtgggacgccaacctgttcctggccacaccggcggccgccgccgcgccgtccgagtgcagcatcagggagctgagccgagctcagggggagatcgatttcggcgtcgtcgttgacaagaggcggcgcctgtcgccagaggaggacggcagcgccggctgcagcaattctgcggtagcagatggagacaacaatcacgtggtgtctgttcagagagcgcggagcagtgaggaggaggaggaggagaggcccaggaaaggtgccagttcgagcaccactccgtcttgccaggttgacggctgccacgccgatctcagcggtgccagggactaccataagaggcacaaggtgtgtgaagcgcataccaggacgactgtggtctgcatcaagaatgtagagcatcggttctgtcagcagtgcagcaggtttcaccttcttcaagaatttgatgaagggaagaagagctgccgctcacgtctagcaaaacataatggaaggagaaggaaagttcaaccacaagctgctgtgaatgggaattccatgaatgaaaatcaatccctaagtagcgccttattccttctgttaaaacaactttccgggctagagtctggtagctcttctgagcaaatcaatcatcctaattctttggttaacattttgaagaaccttactgctattgctagcacacagtcatatcaagatattctaaagaatgcaaattcaaattcaataccgtcaaatgctgctaataatgctgcaaatggttctatcatgcatgagcaaactatacggtcaactcctatcgggagggaatcattagcagaagagcctccagtgaaaaggcgagtacaggattttgatttgaatgatgcttgcattgaagaagctgagagccgaacagataaaattgtgttcaagctctttggaaaagagccgaaagattttcctgtagatctacgggaacagatccaaaactggttgtcacattatccaactgatatggaaagctatattaggcctggctgtgttattctaactatttaccttcgcctccctaattggatgtgggatgagcttgatgatgatccagcttcttggatagaaaagcttattagcttatccaatgatggattttggagaaaaggatggttgtatgctagggtacaggactgcctaacactgagttgcaatggtagtcttatgtttgcatctccctggcaaccggtaattggtgacaagcatcagagactgtgtgtaactcctattgcagttgcttgttcttcatctgtaaaattctccgtgcaaggtttcaatatagttcagccaaccacaaaattactttgtgtgtttggtgaaaactatttaattcaagaagagacacaaatgctacttgaagattcaactatgcagcaaggccctcaatgcctaaccttctcatgttcctttccttgtacaagtggaagaggattcatagaggttgaagattatgatcaaagcagcctttctgttccctttgttgtcaccgacaatgatgtatgttctgaaattcggacgttggagcatggattgaatttaatttcatttgatgaaaccccggaaagaatagatgatcttatggcttatcgcagtcggtcgttacattttttgcatgaaatcggctggctccttcaaaggagccacgtgcgagctacatctgagcagccacagtattgtccagaccgtttccctgttgcaagatttaaatggctgttatcctttgcaattgatcatgaatggtgtgctgttgtaaggaagcttctgaacaccatgttccagggtgatattgatctagatgtgccatcaccagttgaatttgccttgggagaaaatctgttgcttactgctgtcaaaaaatgctcaaagcctttagttgaatgtctattaagatacacaacaacaaattatgctccagtgggcagtggagacggtgctccagttcagttcttgttcactcctgcgatgactggactgtcaaatattacacctcttcatattgcagccacaatcagtgatgctactggtgttttagatgctttaactgatgatcctcagcagttgggaatcaaagcgtggaagaatgctcgtgatgccactggcttcactcctgaggaatatgctcgacagagaggccacgtatcctatattcaaatggtacaggacaaaattgacagaaggatgagcagagatcatgtcttggttaccatccccaccacaattgatgctgtcggaaagcatgctagcggattgaagtctgccgatcaaatcacatttggtgtggagaaacaactaaacatcaacgaaacatcgagctgcagacaatgtgtccagcaggttcagcagtttgcattccaaccccgtacaaataggtttttgtctaataggcctgcgatgctttccttggtcgccattgctgccgtctgtgtctgtgtaggattgctcatgaagagcccgccacaagttgcttgtatgaggcctttcctctgggacaatgtacgttggggccccaattga

SEQ ID NO: 3180 - protein, 866 aa, Sorghum bicolor
  misc_feature: Ceres ANNOT ID no. 6029142
  misc_feature (112)..(190): Pfam Id: SBP Pfam Desc: SBP domain
  misc_feature (312)..(864): NCBI GI: 92894378 NCBI Desc: sbp [medicago truncatula]
  misc_feature (312)..(864): NCBI GI: 140055592 NCBI Desc: ankyrin [medicago truncatula]
  misc_feature (312)..(864): NCBI GI: 92870364 NCBI Desc: sbp [medicago truncatula]
  misc_feature (212)..(660): NCBI GI: 5931653 NCBI Desc: squamosa promoter binding protein-like 1 [arabidopsis thaliana]
  misc_feature (312)..(763): NCBI GI: 115477262 NCBI Desc: os08g0513700 [oryza sativa (japonica cultivar-group)]
  misc_feature: Useful for making plants with altered terpenoid content
  misc_feature: Useful for making plants with modulated flowering time
  misc_feature: Functional homolog of the protein sequence given in SEQ ID NO 13706
  misc_feature: The sequence is a functional homolog of SEQ ID NO 1120 in the 10/225,066 US patent application
  misc_feature: The sequence is a functional homolog of SEQ ID NO 1912 in the 10/412,699 US patent application
  misc_feature: The sequence is a functional homolog of SEQ ID NO 432 in the 10/374,780 US patent application
  misc_feature: The sequence is a functional homolog of SEQ ID NO 958 in the 10/412,699 US patent application
  misc_feature: The sequence is a functional homolog of SEQ ID NO. 452 in the 11/188,298 US application
MTGGNKNKSLNWDLNDWRWDANLFLATPAAAAAPSECSIRELSRAQGEIDFGVVVDKRRRLSPEEDGSAGCSNSAVADGDNNHVVSVQRARSSEEEEEERPRKGASSSTTPSCQVDGCHADLSGARDYHKRHKVCEAHTRTTVVCIKNVEHRFCQQCSRFHLLQEFDEGKKSCRSRLAKHNGRRRKVQPQAAVNGNSMNENQSLSSALFLLLKQLSGLESGSSSEQINHPNSLVNILKNLTAIASTQSYQDILKNANSNSIPSNAANNAANGSIMHEQTIRSTPIGRESLAEEPPVKRRVQDFDLNDACIEEAESRTDKIVFKLFGKEPKDFPVDLREQIQNWLSHYPTDMESYIRPGCVILTIYLRLPNWMWDELDDDPASWIEKLISLSNDGFWRKGWLYARVQDCLTLSCNGSLMFASPWQPVIGDKHQRLCVTPIAVACSSSVKFSVQGFNIVQPTTKLLCVFGENYLIQEETQMLLEDSTMQQGPQCLTFSCSFPCTSGRGFIEVEDYDQSSLSVPFVVTDNDVCSEIRTLEHGLNLISFDETPERIDDLMAYRSRSLHFLHEIGWLLQRSHVRATSEQPQYCPDRFPVARFKWLLSFAIDHEWCAVVRKLLNTMFQGDIDLDVPSPVEFALGENLLLTAVKKCSKPLVECLLRYTTTNYAPVGSGDGAPVQFLFTPAMTGLSNITPLHIAATISDATGVLDALTDDPQQLGIKAWKNARDATGFTPEEYARQRGHVSYIQMVQDKIDRRMSRDHVLVTIPTTIDAVGKHASGLKSADQITFGVEKQLNINETSSCRQCVQQVQQFAFQPRTNRFLSNRPAMLSLVAIAAVCVCVGLLMKSPPQVACMRPFLWDNVRWGPN

SEQ ID NO: 3181 - DNA, 1140 bp, Sorghum bicolor
  misc_feature: Ceres ANNOT ID no. 6029144
  misc_feature: Encodes the peptide sequence at SEQ ID NO 3182
atgtatcacccgcagtgcgagctcctgatggcgcacgaagcccaggacctggacgccgccggccagccgcatcacctcgccgtctccggcgtcgcgggcagcatcccggcagagctgagcttccacctgctccactccctcgacgccacggcggcggtcaacaattctgtcacgccgcagtccaccatcgactacttcctcggcgtcggcggcgctgaccctcaccagccggcggcgctgcagtacgagccgctgccgccccccggcgggcaccaccagcacaccatgaacatgctgcgcgactactgcagcaacggcggcggcggcggccactaccccaccgccgagccgtacctccgcgggacgaggacaggcgccctcgtgttcggggccaccgacgacgacgagtcggctgctgcatacatgcccggcgggccctttgttgagacctccccgccgccacgggccaccggcggccggaagcggggtagggcgctgggcggtggtttccatgctgggctggccaacggcgtcgagaagaaggagaagcagcgccggcagcggctcaccgagaagtacaccgccctcatgcacctcatacccaacgttacaaagcctgatagggcgacggtgatctcggacgcgattgagtacatccaggagctggggaggacggtggaggagctgacgctgctggtggagaagaagcggcgccggagggagctgcagggggacgtggtggacgcggcgccgacggctgtggtggttgcggccgcggccaccggtggtgaggcggagagctcggagggcgaggtggcaccgccgccgccgccgccggcggccgtgcagcggcagccgatccggagcacgtacatccagcggcggagcaaggacacgtccgtggacgtgcggatcgtggaggaagacgtgaacatcaagctcaccaagcgccgccgcgatgggtgcctcgcggccgcgtcgcgcgcgctggacgacctccgccttgacctcgtccacctctccggcggcaagatcggtgactgccacatctacatgttcaacactaagattcacaagggttcttcagtgtttgcgagtgcagtggccagtagactgatggaagtggtggatgagtactag

SEQ ID NO: 3182 - protein, 379 aa, Sorghum bicolor
  misc_feature: Ceres ANNOT ID no. 6029144
  misc_feature (176)..(223): Pfam Id: HLH Pfam Desc: Helix-loop-helix DNA-binding domain
  misc_feature (161)..(377): NCBI GI: 38345766 NCBI Desc: osjnba0083n12.3 [oryza sativa (japonica cultivar-group)]
  misc_feature (106)..(376): NCBI GI: 29466635 NCBI Desc: transcription factor [oryza sativa]
  misc_feature (106)..(376): NCBI GI: 115457612 NCBI Desc: os04g0301500 [oryza sativa (japonica cultivar-group)]
  misc_feature (106)..(376): NCBI GI: 116308947 NCBI Desc: h0215e01.1 [oryza sativa (indica cultivar-group)]
  misc_feature (145)..(357): NCBI GI: 1420924 NCBI Desc: in1 [zea mays]
MYHPQCELLMAHEAQDLDAAGQPHHLAVSGVAGSIPAELSFHLLHSLDATAAVNNSVTPQSTIDYFLGVGGADPHQPAALQYEPLPPPGGHHQHTMNMLRDYCSNGGGGGHYPTAEPYLRGTRTGALVFGATDDDESAAAYMPGGPFVETSPPPRATGGRKRGRALGGGFHAGLANGVEKKEKQRRQRLTEKYTALMHLIPNVTKPDRATVISDAIEYIQELGRTVEELTLLVEKKRRRRELQGDVVDAAPTAVVVAAAATGGEAESSEGEVAPPPPPPAAVQRQPIRSTYIQRRSKDTSVDVRIVEEDVNIKLTKRRRDGCLAAASRALDDLRLDLVHLSGGKIGDCHIYMFNTKIHKGSSVFASAVASRLMEVVDEY

SEQ ID NO: 3183 - DNA, 1149 bp, Sorghum bicolor
  misc_feature: Ceres ANNOT ID no. 6029160
  misc_feature: Encodes the peptide sequence at SEQ ID NO 3184
atggcgccgcggccggcggcggcggcggcggcggcggcgctgatggacgagctcgtggaggagatccttctccgcattccaccggacgaccccgcgcgcctcctccacgcggcgctcgtctgcaagcgctggcgccgcatcgtctccgaccccagattccgcagccggttctgtgagttccatcgcacgcccccgatgctcggcttcatccgcaatcacgagcgagggtcgtccttcgtgtccacctcctccttccgcgcgccccctgccgatcgcgtcaacagccgcgcgatcgacgcgcgccatggccgcgtcctccttcagagccggggcccttcggatcacaatccctgggaggattccttccatgtctgggtcccgatcacgggcgaacggaggaagctgcccgtgcttctgccggggcccatctacccttggtcctggaatgccgccgtgctctgcgccgcagccaccgaaggctgtgaacacctcgattgccaccgcggacccttcctggtcgtctttgtaggcaacggcgacgttgtggaaacgcccgtgatgtgtgcccatgtctactcatcggagtctgattcgtggagccagcagatctctgctcctcacatctatgatgatctcggattgaatccaagtgcctttgcagagaattcgctctactttaggtgtatgcatagtgtcctcaagtatgatttggccacacaggaactatctttgattctcctgccagaagaaagcttcttttggggatgtgctctgctcatggctaccgagggcggtgaacttggacttgcctacatatttacaagtagattgtacctgtggtcgaggaaggctggccctaacaatggtgctggatgggcaaggaaagtcattaagcttacagcattgcttcctgctcacgacgactcacttgttccgatgggtcttactggctttgcacatggccttgatgttttttttttgaggacaagtgtggggattttcacttttgatctgaagtccatccgtttcatcacaaaggtgtgcgaagaaagtttctgcgatgcaagtttcccctacatgagcttctgcactccagcattgggagcagcctctgccgagggatcaagaacaggcacctcaaatgcctga

SEQ ID NO: 3184 - protein, 382 aa, Sorghum bicolor
  misc_feature: Ceres ANNOT ID no. 6029160
  misc_feature (9)..(59): Pfam Id: F-box Pfam Desc: F-box domain
  misc_feature (10)..(365): NCBI GI: 115470391 NCBI Desc: os07g0122900 [oryza sativa (japonica cultivar-group)]
  misc_feature (14)..(367): NCBI GI: 115437584 NCBI Desc: os01g0557400 [oryza sativa (japonica cultivar-group)]
  misc_feature (27)..(365): NCBI GI: 115481210 NCBI Desc: os10g0158700 [oryza sativa (japonica cultivar-group)]
  misc_feature (5)..(226): NCBI GI: 115481344 NCBI Desc: os10g0188000 [oryza sativa (japonica cultivar-group)]
  misc_feature (17)..(376): NCBI GI: 115475786 NCBI Desc: os08g0299900 [oryza sativa (japonica cultivar-group)]
MAPRPAAAAAAAALMDELVEEILLRIPPDDPARLLHAALVCKRWRRIVSDPRFRSRFCEFHRTPPMLGFIRNHERGSSFVSTSSFRAPPADRVNSRAIDARHGRVLLQSRGPSDHNPWEDSFHVWVPITGERRKLPVLLPGPIYPWSWNAAVLCAAATEGCEHLDCHRGPFLVVFVGNGDVVETPVMCAHVYSSESDSWSQQISAPHIYDDLGLNPSAFAENSLYFRCMHSVLKYDLATQELSLILLPEESFFWGCALLMATEGGELGLAYIFTSRLYLWSRKAGPNNGAGWARKVIKLTALLPAHDDSLVPMGLTGFAHGLDVFFLRTSVGIFTFDLKSIRFITKVCEESFCDASFPYMSFCTPALGAASAEGSRTGTSNA

SEQ ID NO: 3185 - DNA, 1410 bp, Sorghum bicolor
  misc_feature: Ceres ANNOT ID no. 6029165
  misc_feature: Encodes the peptide sequence at SEQ ID NO 3186
atggcggccactcttctcccgaccttatcgccgcccgtctcgcgcgccgccgccgctttcctcctccgacgagccccactgaagccctcccgttatctgcacccaccccccactctccgccgcttactctcctcctcctcctgtccagcaacccctccccttggactacgccccgtctctaccatgccgtccaccgccgccgctcgagccgttccggcccgccgcgacctcctcatgctaggcatcgagaccagctgcgacgacactgcggctgctgtggtgagaggtgacggcgagatccttagccaagtggtatcttcccaagcggatttgcttgcaaggtatggtggtgtcgctcctaagatggccgaggaagcacatgcccttgtgattgaccaggttgttcaaaaggcccttgacgatgcagaattgtcagaaagtgatctttctgcagtcgctgtgaccattggaccgggacttagtctatgccttagagttggtgttcataaagctagacaggtagcaaaagcatttgggttgcctattgttggagttcatcatatggaagcacatgcattagtttccaggctagtgaataaggaccttgagttcccatttctggctcttctaatttcaggaggacacaatcttcttgttcttgctcgtggccttgggcaatacattcaactggggactagtatagatgatgcgattggtgaggcatatgacaaatcagctagatggttgggccttgatatgcggaaaggtggtggtcctgctcttgaagagcttgctctggaaggtgatccaaatgctgttaagttcaaagttccaatgcggcaacacaaagattgcaatttttcttatgctggcctgaagactcaagttcgattggcaattgaatctaagaacttatgtacagaggatgttcccatttcgtccgcatcggaggaagacagacaattaagggcgaacattgctgcctcttttcagcgagttgctgtgttacatttggaagaaagatgccagcgagcagttgaatgggcattgaagatggaaccttccatcaaatactttgttgtttcaggaggtgtcgcatcaaacaagtatgttaggactcgcttgaatcaagttgctgagaataatggcctacaacttgtatctcctcctccaagcctttgtactgacaatggcgtcatgattgcttggactgggattgagcacttcgctgtggggagatttgaggatccacctgctgctaatgagcctgatgacaagcagtatgagctgcggccaagatggcctcttggtgaggaatattcagaaggaagaagtgttgcacgatcattgaagaccgctcgagtccatccatcactaacttctatgatacaaggctctcttcaaaagtag

SEQ ID NO: 3186 - protein, 469 aa, Sorghum bicolor
  misc_feature: Ceres ANNOT ID no. 6029165
  misc_feature (99)..(403): Pfam Id: Peptidase_M22 Pfam Desc: Glycoprotease family
  misc_feature (166)..(469): NCBI GI: 124360173 NCBI Desc: peptidase m22, glycoprotease [medicago truncatula]
  misc_feature (62)..(165): NCBI GI: 115436088 NCBI Desc: os01g0295900 [oryza sativa (japonica cultivar-group)]
  misc_feature (230)..(459): NCBI GI: 47026853 NCBI Desc: o-sialoglycoprotein endopeptidase [hyacinthus orientalis]
  misc_feature (276)..(467): NCBI GI: 115488584 NCBI Desc: os12g0485000 [oryza sativa (japonica cultivar-group)]
  misc_feature (78)..(313): NCBI GI: 85710452 NCBI Desc: metal-dependent protease [erythrobacter sp. nap1]
MAATLLPTLSPPVSRAAAAFLLRRAPLKPSRYLHPPPTLRRLLSSSSCPATPPLGLRPVSTMPSTAAARAVPARRDLLMLGIETSCDDTAAAVVRGDGEILSQVVSSQADLLARYGGVAPKMAEEAHALVIDQVVQKALDDAELSESDLSAVAVTIGPGLSLCLRVGVHKARQVAKAFGLPIVGVHHMEAHALVSRLVNKDLEFPFLALLISGGHNLLVLARGLGQYIQLGTSIDDAIGEAYDKSARWLGLDMRKGGGPALEELALEGDPNAVKFKVPMRQHKDCNFSYAGLKTQVRLAIESKNLCTEDVPISSASEEDRQLRANIAASFQRVAVLHLEERCQRAVEWALKMEPSIKYFVVSGGVASNKYVRTRLNQVAENNGLQLVSPPPSLCTDNGVMIAWTGIEHFAVGRFEDPPAANEPDDKQYELRPRWPLGEEYSEGRSVARSLKTARVHPSLTSMIQGSLQK

SEQ ID NO: 3187 - DNA, 2478 bp, Sorghum bicolor
  misc_feature: Ceres ANNOT ID no. 6029239
  misc_feature: Encodes the peptide sequence at SEQ ID NO 3188
atggcatcggcatcctccatcttggtcgctctcttgtgcgccattgccgccgccgccgtctcttcctctgcggccgccgctgctggttccggcggcgcaggcggtggtctcggccccatcagcaccaatggcaggaactacaccaaggtgtgcgaccccgtacggttcgcggcgctgggcctggacatgtcgcgcttccggtactgcgacgcgtcgctgccgtacgccgagcgggtgcgcgacctcgtgggccgcctgtcgctggaggagaaggtgcgcaacctcggggaccaggcggagggcgccccccgcgtggggctgccgccgtacaagtggtggggggaggcgctccacggcgtctccgacgtcggccccggcggcacgtggttcggcgacgtggtgcccggcgccaccagcttccctctcgtcatcaacagcgccgccgcgttcaacgagtcgctgtggcgcgccatcggcggcgtggtgtccacggagatcagggccatgtacaaccttggccacgccgagctcacctactggagccccaacatcaacgtggtgcgcgacccgcggtgggggcgcgccagcgagacacccggcgaggaccccttcgtcgtcggccgctacgccgtcaacttcgtccgcgggatgcaggacgtcgttatcgccgccggagcggcggcgacggcggacccgttctcgcggcccatcaaggtgtccagctgctgcaagcacttcgccgcctacgacgtggacgcgtggttcaaggccgaccgcctcacgttcgacgcgcaggtggaggagcgcgacatggtcgagaccttcgagcgccccttcgagatgtgcatccgggacggcgacgccagctgcgtcatgtgctcctacaaccgcatcaacggcatcccggcctgcgccgacgcgcggctgctgtcggagaccgtccggagccagtggcagctccacgggtacatcgtctccgactgcgactcggtccgcgtcatggtccgcgacgccaagtggctcaactacaccggcgtcgaggccaccgccgcggccatgaaggccgggctcgacctcgactgcggcatgttctgggagggcgcccgggacttcttcaccacctacggcgtcgacgccgtccgccagggcaagatcaaggaggccgacgtcgacaacgcgctcggcaacgtctacaccaccctgatgcgcctcggcttcttcgacgggatgccggagttcgagtccctcggcgccgacgacgtctgcactcgggaccacaaggagctggctgccgacgccgccaggcaggggatggtcctcctcaagaacgatgcccgtcgcctcccattggaccccagcaagattaattcagtgtcgttggttggcctgttggagcacatcaatgccacggatgtcatgcttggagactacagaggcaagccatgcagaattgtgacgccatacgacgctatcagacaagtggtgaatgccacgtacgtgcacgcctgcgacagtggggcgtgtagcacggcggaagggatgggcagagcatccaggacggccaagatcgccgacgcgaccatcgtgatcgccggcctgaacatgagcgtggagagggagagcaacgacagggaggatctcctgctgccgtggaaccagagcagctggatcaacgccgtcgccgaggcctctaccacgccgatcgtcctggtgatcatgtcggccggcggcgtggacgtctccttcgcgcagaacaacaccaagatcggcgccattgtctgggccgggtacccgggcgaggaaggcggcacggccatcgccgatgttctcttcggaaaatacaatccaggaggacggctgccgctgacatggttcaagaacgagtacgtgaaccagatccccatgacgtccatggcgctgcgtcccgacgccgcgcacggctaccccggccggacctacaagttctacggcggccccgccgtgctctacccgttcggccacggcctcagctacaccagcttcacctacgcgtccggcaccaccggcgccacggtcaccatcccgatcggcgcctgggagcattgcaagatgctcacctacaagtcgggtaaggcgccgtcgccgtcgccggcgtgcccggcgctcaacgtcgctagccataggtgcgacgaggtggtgagcttcagcctcagggtggcgaacacgggcggcgtcggcggcgaccacgtggtgccggtgtacaccgcgccgcctcccgaggtgggcgacgcgccgcggaagcagctggtggagttccggagggtgttcgtccccgcgggcgccgccgtcgacgtgcccttcgccctcaacgtgtgcaagacgttcgcgatcgtcgaggagacggcgtacaccgtcgtgccgtcgggcgtcagcacggtcatcgtcggagatgacgcgctggcgctgtcgttcgcggtcacgatcaacctggcagtgtag

SEQ ID NO: 3188 - protein, 825 aa, Sorghum bicolor
  misc_feature: Ceres ANNOT ID no. 6029239
  misc_feature (438)..(673): Pfam Id: Glyco_hydro_3_C Pfam Desc: Glycosyl hydrolase family 3 C terminal domain
  misc_feature (99)..(362): Pfam Id: Glyco_hydro_3 Pfam Desc: Glycosyl hydrolase family 3 N terminal domain
  misc_feature (298)..(823): NCBI GI: 115436096 NCBI Desc: os01g0296700 [oryza sativa (japonica cultivar-group)]
  misc_feature (162)..(823): NCBI GI: 115486595 NCBI Desc: os11g0673200 [oryza sativa (japonica cultivar-group)]
  misc_feature (53)..(810): NCBI GI: 18025340 NCBI Desc: alpha-l-arabinofuranosidase/beta-d-xylosidase isoenzyme ara-i [hordeum vulgare]
  misc_feature (68)..(817): NCBI GI: 18025342 NCBI Desc: beta-d-xylosidase [hordeum vulgare]
  misc_feature (64)..(812): NCBI GI: 15230897 NCBI Desc: glycosyl hydrolase family 3 protein [arabidopsis thaliana]
  misc_feature: The sequence is a functional homolog of SEQ ID NO. 525 in the 11/188,298 US application
MASASSILVALLCAIAAAAVSSSAAAAAGSGGAGGGLGPISTNGRNYTKVCDPVRFAALGLDMSRFRYCDASLPYAERVRDLVGRLSLEEKVRNLGDQAEGAPRVGLPPYKWWGEALHGVSDVGPGGTWFGDVVPGATSFPLVINSAAAFNESLWRAIGGVVSTEIRAMYNLGHAELTYWSPNINVVRDPRWGRASETPGEDPFVVGRYAVNFVRGMQDVVIAAGAAATADPFSRPIKVSSCCKHFAAYDVDAWFKADRLTFDAQVEERDMVETFERPFEMCIRDGDASCVMCSYNRINGIPACADARLLSETVRSQWQLHGYIVSDCDSVRVMVRDAKWLNYTGVEATAAAMKAGLDLDCGMFWEGARDFFTTYGVDAVRQGKIKEADVDNALGNVYTTLMRLGFFDGMPEFESLGADDVCTRDHKELAADAARQGMVLLKNDARRLPLDPSKINSVSLVGLLEHINATDVMLGDYRGKPCRIVTPYDAIRQVVNATYVHACDSGACSTAEGMGRASRTAKIADATIVIAGLNMSVERESNDREDLLLPWNQSSWINAVAEASTTPIVLVIMSAGGVDVSFAQNNTKIGAIVWAGYPGEEGGTAIADVLFGKYNPGGRLPLTWFKNEYVNQIPMTSMALRPDAAHGYPGRTYKFYGGPAVLYPFGHGLSYTSFTYASGTTGATVTIPIGAWEHCKMLTYKSGKAPSPSPACPALNVASHRCDEVVSFSLRVANTGGVGGDHVVPVYTAPPPEVGDAPRKQLVEFRRVFVPAGAAVDVPFALNVCKTFAIVEETAYTVVPSGVSTVIVGDDALALSFAVTINLAV

SEQ ID NO: 3189 - DNA, 624 bp, Sorghum bicolor
  misc_feature: Ceres ANNOT ID no. 6029257
  misc_feature: Encodes the peptide sequence at SEQ ID NO 3190
atgtttggtggtcgttccaacagctccgccaccactcgcctcaccgtccacttcggctccgccatgatcgacaccaccgtgacccgcgacgcggcggtcgccgacgactgggtccgcaccgtgcgcgcggcgaacccgcgtggcgcccgtctcatcgtcggcctggactgcgagtggaagcccaactaccgcagctggacgacctccaaggtggccatcctccagctctgcgccggcacccgctgcctcgtcctccagctcctctacgtcgaccgcgtcccggcgtccgtcaggagcttcctcgccgaccccgacgtgctgttcgtcggcatcggcgtcggcgaggacgtggcgaagctggacgccgactacgggctcacgtgcgcggcgcacgttgacttggaaagccgctgcaacgactacctgggccgctacactggagtggggaggaggctggggctcaagggctacgcagaggaggtgctggggctgttcatggagaagccacgcggtgtcaccatgagcaactgggagaagcatgacctcgaggaggcacagatccggtatgcatgcatcgatgcgtacgtgtcttacaagctcggagagaaggtcttggcctactga

SEQ ID NO: 3190 - protein, 207 aa, Sorghum bicolor
  misc_feature: Ceres ANNOT ID no. 6029257
  misc_feature (25)..(206): Pfam Id: 3_5_exonuc Pfam Desc: 3'-5' exonuclease
  misc_feature (15)..(191): NCBI GI: 115436114 NCBI Desc: os01g0299700 [oryza sativa (japonica cultivar-group)]
  misc_feature (18)..(204): NCBI GI: 38344132 NCBI Desc: osjnbb0072n21.11 [oryza sativa (japonica cultivar-group)]
  misc_feature (18)..(204): NCBI GI: 116309147 NCBI Desc: osigba0101a01.4 [oryza sativa (indica cultivar-group)]
  misc_feature (15)..(201): NCBI GI: 115439803 NCBI Desc: os01g0737600 [oryza sativa (japonica cultivar-group)]
  misc_feature (15)..(204): NCBI GI: 115439805 NCBI Desc: os01g0737700 [oryza sativa (japonica cultivar-group)]
MFGGRSNSSATTRLTVHFGSAMIDTTVTRDAAVADDWVRTVRAANPRGARLIVGLDCEWKPNYRSWTTSKVAILQLCAGTRCLVLQLLYVDRVPASVRSFLADPDVLFVGIGVGEDVAKLDADYGLTCAAHVDLESRCNDYLGRYTGVGRRLGLKGYAEEVLGLFMEKPRGVTMSNWEKHDLEEAQIRYACIDAYVSYKLGEKVLAY

SEQ ID NO: 3191 - DNA, 1827 bp, Sorghum bicolor
  misc_feature: Ceres ANNOT ID no. 6029274
  misc_feature: Encodes the peptide sequence at SEQ ID NO 3192
  misc_feature: Down-regulated in shoot tissues in response to salicylic acid treatment
atggcgaccggccaacttttttcgaaaactacccaagcattattctacaactacaagcaacttcccatccaacggatgcttgattttgacttcctctgcgggagagaaacaccttctgttgctggaataatcaaccctggttctgacggttttcagaaacttttctttggacaagaggaaattgctattccagttcatcctacaattgaagctgcctgcaatgctcacccaacagctgatgtgtttatcaactttgcatccttccggagtgctgctgcctcttcaatgtcagccttgaagcagccaacaataagggttgtagccattatcgctgagggtgttcctgaatcagatgcaaagcagctaattagttatgcacgtgctaataacaaggtcatcattggacctgcaacagttggaggaattcaagctggtgctttcaagattggtgataccgctggaaccattgacaacataattcagtgcaagctttacaggcctggatctgttggttttgtgtctaaatcgggtggcatgtcaaatgagatgtacaacaccattgccagagtgacagatggtatttatgaaggaattgcaattggaggggatgttttccctggatcaactctgtcagaccacattctgcgttttaataacataccacaggttaaaatgatggttgttcttggggagcttggtggaaaagacgagtattcacttgtggaagcattgaaacaaggaaaggttcagaaaccagttgttgcatgggttagtgggacatgtgcacgtctattcaaatcagaagtgcagtttggtcatgctggtgccaagagtggtgctgagttggaatcagcacaagctaagaatcaggcactaagggaagctggtgcaattgtgccgacttcatatgaagctctagaaagtgcaactaaggaggcatttgacaaactggttgaggaaggaaaaatttctcctgtgactgaaattacacctcctcccattcctgaggaccttaaaactgcaatcaagagtgggaaggtccgagctcctacccacatcatctccacaatctctgatgacagaggtgaggaaccatgctatgctggtgtccctatgtctacaattattgaacagggttatggagttggtgatgttatctctcttttgtggttcaagcgcagccttcctcgctattgcactcagtttattgagatatgcatcatgctttgtgccgaccatggtccctgtgtatctggtgctcataactctatagttactgctagggctggaaaggaccttgtttccagcttggtgtctggattattgacaattggtccccgcttcggtggggcaattgatgacgcagcccgatacttcaaagatgcatgtgacaggaacctcacgccgtacgagtttgttgaaggcatgaaaaagaagggaatccgtgtgcctgggattggtcacaggattaagagcagagacaacagggataagcgtgtgcagcttctacaaaaatatgctcacacacatttcccttcagtcaagtacatggaatacgctgtccaggttgagacctacaccttgtccaaagccaacaatttggttctgaacgtcgatggtgcgatcgggtcacttttcttggatcttctgtctggaagtggaatgttcaccaaacaggagatcgatgagattgtggaaattggttatcttaatgggctctttgtgcttgcgcgttcaattggcctgatcgggcacaccttcgaccagaagaggcttaagcagccactctaccgtcacccatgggaggatgtcctgtacaccaagtga

SEQ ID NO: 3192 - protein, 608 aa, Sorghum bicolor
  misc_feature: Ceres ANNOT ID no. 6029274
  misc_feature (155)..(300): Pfam Id: Ligase_CoA Pfam Desc: CoA-ligase
  misc_feature (1)..(608): NCBI GI: 15919087 NCBI Desc: atp citrate lyase a-subunit [lupinus albus]
  misc_feature (1)..(608): NCBI GI: 124359946 NCBI Desc: atp-citrate lyase/succinyl-coa ligase [medicago truncatula]
  misc_feature (1)..(608): NCBI GI: 13160653 NCBI Desc: atp:citrate lyase [capsicum annuum]
  misc_feature (5)..(608): NCBI GI: 5304837 NCBI Desc: atp citrate lyase [cyanophora paradoxa]
  misc_feature (5)..(523): NCBI GI: 5304835 NCBI Desc: atp citrate lyase [cyanophora paradoxa]
  misc_feature (6)..(606): SWISSPROT Homolog: EC 2.3.3.8 ATP-citrate synthase
  misc_feature: Down-regulated in shoot tissues in response to salicylic acid treatment
MATGQLFSKTTQALFYNYKQLPIQRMLDFDFLCGRETPSVAGIINPGSDGFQKLFFGQEEIAIPVHPTIEAACNAHPTADVFINFASFRSAAASSMSALKQPTIRVVAIIAEGVPESDAKQLISYARANNKVIIGPATVGGIQAGAFKIGDTAGTIDNIIQCKLYRPGSVGFVSKSGGMSNEMYNTIARVTDGIYEGIAIGGDVFPGSTLSDHILRFNNIPQVKMMVVLGELGGKDEYSLVEALKQGKVQKPVVAWVSGTCARLFKSEVQFGHAGAKSGAELESAQAKNQALREAGAIVPTSYEALESATKEAFDKLVEEGKISPVTEITPPPIPEDLKTAIKSGKVRAPTHIISTISDDRGEEPCYAGVPMSTIIEQGYGVGDVISLLWFKRSLPRYCTQFIEICIMLCADHGPCVSGAHNSIVTARAGKDLVSSLVSGLLTIGPRFGGAIDDAARYFKDACDRNLTPYEFVEGMKKKGIRVPGIGHRIKSRDNRDKRVQLLQKYAHTHFPSVKYMEYAVQVETYTLSKANNLVLNVDGAIGSLFLDLLSGSGMFTKQEIDEIVEIGYLNGLFVLARSIGLIGHTFDQKRLKQPLYRHPWEDVLYTK

SEQ ID NO: 3193 - DNA, 1593 bp, Sorghum bicolor
  misc_feature: Ceres ANNOT ID no. 6029290
  misc_feature: Encodes the peptide sequence at SEQ ID NO 3194
atggcgccgccggcccattccgccggcgcccgcctcctactccgccgcctgctctctacggttaccgaagcagcggcggagacaactgcgcccaccgcccctgccgccgcctccggtgtcgctgcgcccaccgctgccgccactcccagtgcctctgccgccgccgcgaaaccggcgaagaaggacccgaagctcctctaccgtcgtctgtcggcgcttggaatagccggggaggggagtgtgtcgcgggtgctgaacaagtgggtgcgggagggcggcgcgccgcgaagcgaggaactcgtcaagcatgtcaaggagctccgcaagtacaagcgccacgcccacgccctcgaggtgatggattggatggtcaatgcaaggggtatgaacatgtcaatcactaaccatgcaatacgtctggatctcatctataaagtgcgtggccttgaggcagctgagaattattttgctaacctccctgatccagccaagaaccatcgaacttatggtgcccttcttagttgttattgctcagcaaaaatggaagagaaagcaacatatctctaccgccagatggatgaacttggcttctggtccggcacactacccatcaataatctgatgtccctttacatgaagttagaccagcataggaaggttgatagtctctttgaggagatgaaagtgaagaatattaaaccagatagcctcacatgctgcattttgatgaccagctatgcagcatcgaacaagatagatgccattgaagaacttcttaaagaaatggtagaaaaagatgtgtctcttgggtggtctgcatatagcacacttgcttctatctatgtaaatgccggacaggttgaaaaagcagaatctgctctgaagaaactcgaggggcttattggtgctgaagatggcaggcaaccttttgatttccttatgagcctatatgcttcactaggcaatttgagcgagatcaatagggtatgggatgtgataaaggccaaattctccacggtaaccaacataagctacctcggcatgcttcatgctctttacaagctcaatgatattgaccgcatgaagcagatttatatggagtgggaatctaattatcaaacctatgatgtaagactgacaaatatgatgattcgtggccatctgaggcttggcatgagcgaagaagcagaaacgttgagggagaaggccaaggaaaaaggtgtggagtttgactccaaaacatgtgagttgtttcttgatcactacatgggcaagggtgacatgaactcagcactcaactgggtagagaacatgaccaaactccccaagaaagcagggaaactcgatcaggacaggatctacaagttccagaagtattttgaagaacacaaggatgctgacagtgccgagaggttctgcaactgcctgaggatgctagggtgtattgacgggaaagcatatgagtccctcttgcgcacatacttggcagccggtaagaaaagctgttcactccgtcaacagataaagaatgataagattgagatctgctacgacattgggaagctactcaagaggttgggcgacgagcgatga

SEQ ID NO: 3194 - protein, 530 aa, Sorghum bicolor
  misc_feature: Ceres ANNOT ID no. 6029290
  misc_feature (202)..(236): Pfam Id: PPR Pfam Desc: PPR repeat
  misc_feature (378)..(412): Pfam Id: PPR Pfam Desc: PPR repeat
  misc_feature (44)..(526): NCBI GI: 16323354 NCBI Desc: at4g01990/t7b11_26 [arabidopsis thaliana]
  misc_feature (6)..(494): NCBI GI: 32488964 NCBI Desc: osjnbb0038f03.9 [oryza sativa (japonica cultivar-group)]
  misc_feature (66)..(491): NCBI GI: 29028736 NCBI Desc: at1g02150/t7i23.8 [arabidopsis thaliana]
  misc_feature (61)..(514): NCBI GI: 87162884 NCBI Desc: tetratricopeptide-like helical [medicago truncatula]
  misc_feature (47)..(467): NCBI GI: 116309055 NCBI Desc: h0107b07.5 [oryza sativa (indica cultivar-group)]
MAPPAHSAGARLLLRRLLSTVTEAAAETTAPTAPAAASGVAAPTAAATPSASAAAAKPAKKDPKLLYRRLSALGIAGEGSVSRVLNKWVREGGAPRSEELVKHVKELRKYKRHAHALEVMDWMVNARGMNMSITNHAIRLDLIYKVRGLEAAENYFANLPDPAKNHRTYGALLSCYCSAKMEEKATYLYRQMDELGFWSGTLPINNLMSLYMKLDQHRKVDSLFEEMKVKNIKPDSLTCCILMTSYAASNKIDAIEELLKEMVEKDVSLGWSAYSTLASIYVNAGQVEKAESALKKLEGLIGAEDGRQPFDFLMSLYASLGNLSEINRVWDVIKAKFSTVTNISYLGMLHALYKLNDIDRMKQIYMEWESNYQTYDVRLTNMMIRGHLRLGMSEEAETLREKAKEKGVEFDSKTCELFLDHYMGKGDMNSALNWVENMTKLPKKAGKLDQDRIYKFQKYFEEHKDADSAERFCNCLRMLGCIDGKAYESLLRTYLAAGKKSCSLRQQIKNDKIEICYDIGKLLKRLGDER

SEQ ID NO: 3195 - DNA, 918 bp, Sorghum bicolor
  misc_feature: Ceres ANNOT ID no. 6029319
  misc_feature: Encodes the peptide sequence at SEQ ID NO 3196
atggaggatctgtacagcatccacccagggatctcgcgggtcggcggcgcggcgagcgaggcgtccgtcgccggcgtcggcggcccctcgccgtcggatctgacggagctcatgaaggcgcagatcgccagccaccctcgctacccctccctcctctccgcctacatcgagtgccgcaaggtgggagcacctccgcaggtggcgtcgctgctggaggaggtcagccgggaccgggagaggcgccccggcgccggcgccggggagatcggcgtcgatcccgagctcgacgagttcatggtctgctcttgggactcctactgccgggtgctggtgcggtacaaggaggagctgtcgcggccgttcgacgaggccgcgtcgttcctgagcagcatccaggcgcagctcagcaacctctgcagcgccggcagctcgccggcggcgaccgccacgcactccgatgacatgatggggtcgtctgaggatgagcagtgctcaggggacactgatgtgccagacatagggcaagaacatagctctcgcttagctgaccacgaactcaaggaaatgcttcttaagaagtacagtggatgcctcagccgtcttcgttcggagttcctgaagaagcggaagaaagggaagctaccgaaggatgcacggacagtattactagagtggtggaacactcactaccgctggccttatcctacggaggaagataaggtgaggcttgcagcgatgaccggtctcgacccaaagcagatcaacaattggttcatcaaccagaggaagaggcattggaaaccatcggaggacatgcggttcgcgctcatggagggtgttgcacaattggaccctgaatcacacaccacttggaatgacaattggccaactcaatcagtagtaagacctggcatgtga

SEQ ID NO: 3196 - protein, 305 aa, Sorghum bicolor
  misc_feature: Ceres ANNOT ID no. 6029319
  misc_feature (85)..(140): Pfam Id: KNOX2 Pfam Desc: KNOX2 domain
  misc_feature (36)..(80): Pfam Id: KNOX1 Pfam Desc: KNOX1 domain
  misc_feature (185)..(206): Pfam Id: ELK Pfam Desc: ELK domain
  misc_feature (1)..(305): NCBI GI: 55416167 NCBI Desc: homeobox protein [saccharum hybrid cultivar]
  misc_feature (1)..(281): NCBI GI: 4240539 NCBI Desc: knotted class 1 homeodomain protein liguleless3 [zea mays]
  misc_feature (1)..(281): NCBI GI: 5103725 NCBI Desc: knotted1-type homeobox protein osh6 [oryza sativa]
  misc_feature (1)..(280): NCBI GI: 51854371 NCBI Desc: knox class homeodomain protein [oryza sativa (japonica cultivar-group)]
  misc_feature (1)..(280): NCBI GI: 2935573 NCBI Desc: knox class homeodomain protein [oryza sativa]
  misc_feature: The sequence is a functional homolog of SEQ ID NO 2674 in the 10/374,780US patent application
  misc_feature: The sequence is a functional homolog of SEQ ID NO 76 in the 10/225,066US patent application
  misc_feature: Useful for making plants with modulated growth and phenotype characteristics
  misc_feature: The sequence is a functional homolog of SEQ ID NO 76 in the 20050160493 US patent application
  misc_feature: The sequence is a functional homolog of SEQ ID NO 2674 in the 10/374,780 US patent application
  misc_feature: The sequence is a functional homolog of SEQ ID NO 76 in the 10/225,066 US patent application
  misc_feature: The sequence is a functional homolog of SEQ ID NO. 320 in the 11/188,298 US application
  misc_feature: The sequence is a functional homolog of SEQ ID NO. 499 in the 11/188,298 US application
MEDLYSIHPGISRVGGAASEASVAGVGGPSPSDLTELMKAQIASHPRYPSLLSAYIECRKVGAPPQVASLLEEVSRDRERRPGAGAGEIGVDPELDEFMVCSWDSYCRVLVRYKEELSRPFDEAASFLSSIQAQLSNLCSAGSSPAATATHSDDMMGSSEDEQCSGDTDVPDIGQEHSSRLADHELKEMLLKKYSGCLSRLRSEFLKKRKKGKLPKDARTVLLEWWNTHYRWPYPTEEDKVRLAAMTGLDPKQINNWFINQRKRHWKPSEDMRFALMEGVAQLDPESHTTWNDNWPTQSVVRPGM

SEQ ID NO: 3197 - DNA, 480 bp, Sorghum bicolor
  misc_feature: Ceres ANNOT ID no. 6029337
  misc_feature: Encodes the peptide sequence at SEQ ID NO 3198
atggacagacggtgcctcctggacctcggccacccgctcctcaaccgcgtcgccgacagcttcatccgcgccgccggtgtcggggcggccagggccgtctccagggaggcctacttcgtcaccgtcgaagggctttcaggagactcgtccgggctggaccccgacggcggcaagaggagccatttctccagcatcagaggtgatgacggccagaggtcgctcgacgcagtggtaaaaacggctggcaaggaggccttccagtgggggttggcagccggagtctattccgggctcacgtacggcctgagggaggccaggggatgccacgactggaagaacagcgcaattgcaggtgcaatcgctggggcggcggtggcgctcacgggtgacgccggcagccactccgacaagctcgtccatttcgccatcaccggcgctgcgctctccagtgccgcgagcttgctctccggcatattctga

SEQ ID NO: 3198 - protein, 159 aa, Sorghum bicolor
  misc_feature: Ceres ANNOT ID no. 6029337
  misc_feature (6)..(159): Pfam Id: Tim17 Pfam Desc: Tim17/Tim22/Tim23 family
  misc_feature (1)..(159): NCBI GI: 16555405 NCBI Desc: stress-inducible membrane pore protein [bromus inermis]
  misc_feature (6)..(159): NCBI GI: 92875018 NCBI Desc: mitochondrial import inner membrane translocase, subunit tim17/22 [medicago truncatula]
  misc_feature (2)..(159): NCBI GI: 87240460 NCBI Desc: mitochondrial import inner membrane translocase, subunit tim17/22 [medicago truncatula]
  misc_feature (6)..(159): NCBI GI: 30683558 NCBI Desc: mitochondrial import inner membrane translocase subunit tim17/tim22/tim23 family protein [arabidopsis thaliana]
  misc_feature (6)..(159): NCBI GI: 21593908 NCBI Desc: pore protein homolog [arabidopsis thaliana]
MDRRCLLDLGHPLLNRVADSFIRAAGVGAARAVSREAYFVTVEGLSGDSSGLDPDGGKRSHFSSIRGDDGQRSLDAVVKTAGKEAFQWGLAAGVYSGLTYGLREARGCHDWKNSAIAGAIAGAAVALTGDAGSHSDKLVHFAITGAALSSAASLLSGIF

SEQ ID NO: 3199 - DNA, 822 bp, Sorghum bicolor
  misc_feature: Ceres ANNOT ID no. 6029373
  misc_feature: Encodes the peptide sequence at SEQ ID NO 3200
atggagaacacgagcagcgaccgcggcggttccaagcccgggatccggttcggcttctcctgggccgacgaggtcgagcgtgaggagcgggagcagcaggaggaggagcagcggcggtgggagacggagagggagcagatcaaggcggacccgttcggcggggcgcggccgcgggaggtggagcagcggcggtgcgagacggagagggagcagatcaaggcggacccgttcggcgcggcgcggccgcgggaggtggtgctagccgagaagggcgtcgactggcgcgcgcgcgaccgcgagctggatctccacctccgcaccagccccgcgcccgcgccgcagccggaagcgcgcggccgctacgggcacgagcaaggggcacgtcgcggcgcacggggcgacgcccgagcgcgccacagcgcgtggggcggaagcaagaggaagtgtgccggggaagggcctgggccgttgcggcgagtccggcaggtggatgatcagaggaggaaggtcttcggcgagctcaacgttggagagggctgcggctcctcgatccgtgcctccaacaacaagagctgcgactccggtggaagtcaagcccaggggatcaaatcgagtatgcccgtggttgctgacggtgagaacagatgtagcatggtgccggcgacgaaggtaaccgcaaccgaggttggtgaatctgctgttgcccagaagagaaggggagggaagaggaggaaggggaaaagatccaagaagactaccaaccaggaaactctggaaaaactcccagactggctcagggagttaaactctcagcgattgtaa

SEQ ID NO: 3200 - protein, 273 aa, Sorghum bicolor
  misc_feature: Ceres ANNOT ID no. 6029373
  misc_feature (7)..(259): NCBI GI: 115436170 NCBI Desc: os01g0306100 [oryza sativa (japonica cultivar-group)]
  misc_feature (41)..(118): NCBI GI: 6739537 NCBI Desc: eukaryotic initiation factor 4b [arabidopsis thaliana]
  misc_feature (41)..(118): NCBI GI: 6739522 NCBI Desc: eukaryotic initiation factor 4b [arabidopsis thaliana]
  misc_feature (41)..(118): NCBI GI: 110739186 NCBI Desc: eukaryotic initiation factor 4b [arabidopsis thaliana]
  misc_feature (57)..(170): NCBI GI: 6739518 NCBI Desc: eukaryotic initiation factor 4b [arabidopsis thaliana]
MENTSSDRGGSKPGIRFGFSWADEVEREEREQQEEEQRRWETEREQIKADPFGGARPREVEQRRCETEREQIKADPFGAARPREVVLAEKGVDWRARDRELDLHLRTSPAPAPQPEARGRYGHEQGARRGARGDARARHSAWGGSKRKCAGEGPGPLRRVRQVDDQRRKVFGELNVGEGCGSSIRASNNKSCDSGGSQAQGIKSSMPVVADGENRCSMVPATKVTATEVGESAVAQKRRGGKRRKGKRSKKTTNQETLEKLPDWLRELNSQRL

SEQ ID NO: 3201 - DNA, 1641 bp, Sorghum bicolor
  misc_feature: Ceres ANNOT ID no. 6029385
  misc_feature: Encodes the peptide sequence at SEQ ID NO 3202
atgggcccttttcacatccccagtacaagtggtcctcgcaagttttatcaccttgtgctcttccatgtgcacccgttctggatccaactcttgtacttcctttccatctccgtcttgggtttcttgatgctgagagctctgcccatgaagtccatctccgtccctaggccctcggctctcgacctagtcttcacgtccgtgtcagcgacgacagtctccagcatggtcgccgtcgagatggaatccttctccaactcccagctcctcctcatgaccctcctgatgctcctcggcggcgaggtgttcacaagcatgcttggtctccacttcaccttcaccaagttcatcaagaagagagaaatacctcatagtaataataatagtctccatggtaatatcaatggaccggcaccggcggcacctagtagcttagagcacggtcaccgtcgccgtcccatggagatggaagcccaggccgccgccgtccaaatggagctagcagggttcaacaacgacgaccaacgtgattttgcatccatagctaggctgctaatgttcatcgtgcttggctacctctcggtggtgcacctcgccggctacacgctcattctaatctacctcagcgtggtcggcagcgcgagagaagtgctggtcggcaagaggatcagcctgagcaccttctccgtcttcacggtcgtctcgacgttcgcgaactgtggcttcgtgccaacgaacgaggggatggcgtccttcaagtccttcccgggcatgctcctcctcgtcatgccacacatcctcctcgggaacacgctcttccccgtcttcctcaggctctccattacagcgctcgagagggtcaccaggaggggagacctccgcgagctgctgagggacggaggacccggcggcggcggcggcggcggcggcggaccagctgctgctgctataggctacgaccacctgctgcccggaggccgcacatggtgcctggctctcaccgtggcggtgttcctggcggggcagctgctgctctactgcgccatggagtggggctccgatgggcttcgagggctcaccgcgttccagaagctcgttgccgcgctcttcatgtccgtcaactccaggcactccggcgagatggttgtcgacctcgccaccgtgtcgtccgccatcgtcgtgctctatgtgctcatgatgtatctaccgccttacaccacatttttacccatagcgatggaagaccaccagcagcagcaaaatgaggcacaatccgacgacaagagcaagagcagcagcagtattagcatctggcagaagctgctcatgtccccgctctcgtgcctaaccatcttcatcgtcgtcatctgcatcaccgagcgccggcagatcgctgacgacccaatcaacttcagcgtcctcaacatcgtcgtcgaagtcatcagtgcgtatggcaatgtgggattcagcaccgggtacagctgcagcaggcaggtgacgcccgacggcagctgcagggacgcgtgggttggcttctccggcaagtggagcagggaagggaagctcacgctcatggccgtcatgttctacggcaggctcaagaagttcagcatgcatgggggtcaggcatggaagctaggctaa

SEQ ID NO: 3202 - protein, 546 aa, Sorghum bicolor
  misc_feature: Ceres ANNOT ID no. 6029385
  misc_feature (171)..(546): Pfam Id: TrkH Pfam Desc: Cation transport protein
  misc_feature (315)..(545): NCBI GI: 109452938 NCBI Desc: hkt8 [triticum aestivum]
  misc_feature (13)..(545): NCBI GI: 73486800 NCBI Desc: sodium transporter [oryza sativa (indica cultivar-group)]
  misc_feature (13)..(545): NCBI GI: 84029310 NCBI Desc: cation transporter hkt8 (oshkt8)
  misc_feature (317)..(545): NCBI GI: 109452932 NCBI Desc: hkt8 [triticum monococcum]
  misc_feature (181)..(412): NCBI GI: 3695407 NCBI Desc: similar to potassium transport proteins [arabidopsis thaliana]
  misc_feature: Useful for making plants with modulated salt sensitivity
  misc_feature: GREAT-hit functional homolog of the protein sequence given in SEQ ID NO 13409
  misc_feature: Useful for making plants with modulated salt sensitivity
  misc_feature: Functional homolog of the protein sequence given in SEQ ID NO 13409
MGPFHIPSTSGPRKFYHLVLFHVHPFWIQLLYFLSISVLGFLMLRALPMKSISVPRPSALDLVFTSVSATTVSSMVAVEMESFSNSQLLLMTLLMLLGGEVFTSMLGLHFTFTKFIKKREIPHSNNNSLHGNINGPAPAAPSSLEHGHRRRPMEMEAQAAAVQMELAGFNNDDQRDFASIARLLMFIVLGYLSVVHLAGYTLILIYLSVVGSAREVLVGKRISLSTFSVFTVVSTFANCGFVPTNEGMASFKSFPGMLLLVMPHILLGNTLFPVFLRLSITALERVTRRGDLRELLRDGGPGGGGGGGGGPAAAAIGYDHLLPGGRTWCLALTVAVFLAGQLLLYCAMEWGSDGLRGLTAFQKLVAALFMSVNSRHSGEMVVDLATVSSAIVVLYVLMMYLPPYTTFLPIAMEDHQQQQNEAQSDDKSKSSSSISIWQKLLMSPLSCLTIFIVVICITERRQIADDPINFSVLNIVVEVISAYGNVGFSTGYSCSRQVTPDGSCRDAWVGFSGKWSREGKLTLMAVMFYGRLKKFSMHGGQAWKLG

SEQ ID NO: 3203 - DNA, 1134 bp, Sorghum bicolor
  misc_feature: Ceres ANNOT ID no. 6029386
  misc_feature: Encodes the peptide sequence at SEQ ID NO 3204
atggccctcgacaccgccgccgccgacgccgacgcgccgcgctcgcgccccgacgccagcgccgctgtgcacccgctcctctccgactccacctccacgtctgcggcgggggagacagcggaggagctggacgccaggtacgccccctacgcgcgccgggacgcgtacgggaccatgggccgcggcccgctgcccgcggcgcaggcggcgcggctggcgctggccgccgcgttgctcctcccgctccgcttcgtcgccgggatgctcgtgctcctgctctactacttggtgtgccgcgcctgcacgctgttcgtggatgcggacgagggccgcccgaggctggcggggtggaggaggaaggcggtgctgcggtccgggtgcgcgctctcccgggcgatgctcttcgtcttcggcttctactggatccgcgagacccacaggaggctccccaatgctgaggatgtaaatcaggaccaatctgaagaatcccaaaggccaggggcaattgtatctaatcatgtgtcttacgtggatattctttatcacatgtcagcatcctttccaagttttgttgctaaggagtcagtgtccaggttgccacttgttggtctcataagcaattgtcttggatgcatttttgttcaacgagaatcgaagtcttcagatgctaaaggtgtttcaggtgctgtaactgaaagggtccgagaggtttgccaagataagaataccccaatgatgttgttgttccctgagggaactaccacaaatggggattaccttcttccatttaagaccggagcctttcttgcaagtgcaccagtgcagccagtcattttgaaatacccttacaagagatttagtccagcatgggattccatggatggagcacgtcatgtgtttttgctgctctgtcaatttgtaaatcacatggaggtggttcggttgcctgtatactatccttctcaacaagaaaaggaagatcctaagctctacgcaaataacgtcagaaaactgatagcaacggagggcaatttaattctttctaatcttgggctggcggagaagcgcgtgtaccatgcagcactgaatggtagtagtctacctggtgctagtagacatcagaaagatgattaa

SEQ ID NO: 3204 - protein, 377 aa, Sorghum bicolor
  misc_feature: Ceres ANNOT ID no. 6029386
  misc_feature (146)..(280): Pfam Id: Acyltransferase Pfam Desc: Acyltransferase
  misc_feature (25)..(377): NCBI GI: 140062229 NCBI Desc: phospholipid/glycerol acyltransferase [medicago truncatula]
  misc_feature (109)..(276): NCBI GI: 6503307 NCBI Desc: is a member of the pf01553 acyltransferase family. [arabidopsis thaliana]
  misc_feature (79)..(362): NCBI GI: 89290368 NCBI Desc: acyltransferase family protein [tetrahymena thermophila sb210]
  misc_feature (68)..(340): NCBI GI: 24640840 NCBI Desc: cg32699-pa [drosophila melanogaster]
  misc_feature (68)..(340): NCBI GI: 28317175 NCBI Desc: hl01250p [drosophila melanogaster]
  misc_feature: The sequence is a functional homolog of SEQ ID NO. 487 in the 11/188,298 US application
MALDTAAADADAPRSRPDASAAVHPLLSDSTSTSAAGETAEELDARYAPYARRDAYGTMGRGPLPAAQAARLALAAALLLPLRFVAGMLVLLLYYLVCRACTLFVDADEGRPRLAGWRRKAVLRSGCALSRAMLFVFGFYWIRETHRRLPNAEDVNQDQSEESQRPGAIVSNHVSYVDILYHMSASFPSFVAKESVSRLPLVGLISNCLGCIFVQRESKSSDAKGVSGAVTERVREVCQDKNTPMMLLFPEGTTTNGDYLLPFKTGAFLASAPVQPVILKYPYKRFSPAWDSMDGARHVFLLLCQFVNHMEVVRLPVYYPSQQEKEDPKLYANNVRKLIATEGNLILSNLGLAEKRVYHAALNGSSLPGASRHQKDD

SEQ ID NO: 3205 - DNA, 2538 bp, Sorghum bicolor
  misc_feature: Ceres ANNOT ID no. 6029411
  misc_feature: Encodes the peptide sequence at SEQ ID NO 3206
atggtttgtgttgggtccaaagcaataagacccaaggggagcacaggaaatggcttgggagatggagctttagatgatagctcacacaagaagagggcaaggaaggataagagcgagaaaccccggaaagggggtcacagctcgagtaaaggaccttctgtagggaaacctcagcatgggaaggataggaagcagagcagcgatgatgggaagaaagggaaacggcgaggaaaggaccatcattcaggaagctctgtgatggtgaatcccaggaccaggaacctcaacaatcaggatgcattaccatcctccattacatcaaaaccagtacaaaatgttcttaggaaaagagttgatcctgaaactgcaaagtactttatggagatctcaaatctctttgataacaaggagattgattgtgaagagcgctcgactatatgtgctaatgccttagaagaatctagagggaaagagcttgaacttgccaccgatgctgttataagccacaccttgcaggttcttatagaaggctgtgagttggagcagttatgcacattcctccgcaattgtattgacaatttttctgtcattgccatggacaaaaatgggtcgcatgtagctgaagcagctctcaagtcactcgcaacacatcttgaagatgaaacctctagggccatgatagaaaagatactgaacaaaatatgcaaggttattgctgcagatgctgctaatgtgatgtccagctgctatggatcacatgttctccgcactctgctttgtctttgtaagggtgttccgtcagagtgtcttcaagacttccacactactaagagatctgctgttctagctgagcggttgagttgtggaacaaatcaacctagtggacatgttccaaagaattttgaaaacggtttctcaggcatgtttaggtctttcgtcagagaaatgctacataatgcaaaagctgacattgcaactttacgagttgacaagaacagtagccttgttttacagactgcattgaagctatcttctggtgatgataatgaattgcttcatataatatcaatacttcttggttatgatgaatataataccctacagaagagagattacagtgaaaaaaaggaggagattgttactttacttgaagaaagtgcttatagtcatctcttggaggtgattgtcgaggttgccccagagcaattgcgcaatggtatgcttgcaggtagtctgaagggtgcattatttgcaatctcatctcatcactgtggcaactatgtggtgcaagctttcatatcatctgctaaaacctcagatcagatgaatcaaatatgggaggaacttggtccaaaaatgaaggaattgcttgaactaggtaaaacaggggttgtagcttccatcttagcggcatgccagcggcttgaaacttatcgccttgagagttctcaagctcttgctgctgcattaagttcagattctgagtctcctgatagcattgttgcacatatactttttcttgagaactacctacatgagagatcttattggaaatggactcatggtgcaaagatgagcattctgggttgcttgatgctgcaatctattttccaatacccgcatcaatatattcgcccatatgtctcaagcttgctggccatgggggatgatcagatcctccaaatttccaaggattcaggaggtagccgtgttcttgaatcttttctaggttcaagtgccactgcaaagcgtaaatttaaagtttttggaaagttgcaaggtcattacggagagattgctatgaatccttctggctcattcttagtagagaagtgctttactgccagcaacttttctcataaagaggctatagtggcagagctgttggctgtgcaatctgaactatctaaaacaagacatgggttccacttgctaaagaagctggatgtcgaaagatatgctaggcgacctgagcagtggagagctagtcaaacttcaaaagaaacaactcaaaagaagtttgaggcagaatttggctcaaacagtcaatctactgggcagaatatcaaagaaaagttctctcaaagtcccatgaagaaacgtaagcagaaagagaaggctgacaaaattactgaggatgccaggagcaacaaaccagatttctctcagaaagaaaacagtaagaggccaaaatctgccaagtcatctgctgagagaggatcaagtgccaagaacacccgtgaaggcactgatgctagtgccagcatgatgttcttgaagggctctgtcaagaggaaatccccaggtttcctttcagataaaccgagcctcaagaaacaaaaacatcacaaactcgtttctggtagaccagacggtaaactttttgttcgagatagtggtactagtgcaccgtttgtcaagaatgctggcaaacagaaacagtccattgctgagctcgcggacctggctggtaaggagaagctgactgcgtctgaagttcgcaaattgctgaagcctgaaatgtcaggcaagagctaa

SEQ ID NO: 3206 - protein, 845 aa, Sorghum bicolor
  misc_feature: Ceres ANNOT ID no. 6029411
  misc_feature (58)..(767): NCBI GI: 42572079 NCBI Desc: pumilio/puf rna-binding domain-containing protein [arabidopsis thaliana]
  misc_feature (298)..(748): NCBI GI: 42733779 NCBI Desc: similar to protein required for cell viability; yjl010cp [saccharomyces cerevisiae] [dictyostelium discoideum]
  misc_feature (98)..(674): NCBI GI: 37589400 NCBI Desc: mgc69156 protein [xenopus laevis]
  misc_feature (55)..(664): NCBI GI: 24899206 NCBI Desc: kiaa2021 protein [homo sapiens]
  misc_feature (73)..(664): NCBI GI: 119586439 NCBI Desc: chromosome 14 open reading frame 21, isoform cra_b [homo sapiens]
MVCVGSKAIRPKGSTGNGLGDGALDDSSHKKRARKDKSEKPRKGGHSSSKGPSVGKPQHGKDRKQSSDDGKKGKRRGKDHHSGSSVMVNPRTRNLNNQDALPSSITSKPVQNVLRKRVDPETAKYFMEISNLFDNKEIDCEERSTICANALEESRGKELELATDAVISHTLQVLIEGCELEQLCTFLRNCIDNFSVIAMDKNGSHVAEAALKSLATHLEDETSRAMIEKILNKICKVIAADAANVMSSCYGSHVLRTLLCLCKGVPSECLQDFHTTKRSAVLAERLSCGTNQPSGHVPKNFENGFSGMFRSFVREMLHNAKADIATLRVDKNSSLVLQTALKLSSGDDNELLHIISILLGYDEYNTLQKRDYSEKKEEIVTLLEESAYSHLLEVIVEVAPEQLRNGMLAGSLKGALFAISSHHCGNYVVQAFISSAKTSDQMNQIWEELGPKMKELLELGKTGVVASILAACQRLETYRLESSQALAAALSSDSESPDSIVAHILFLENYLHERSYWKWTHGAKMSILGCLMLQSIFQYPHQYIRPYVSSLLAMGDDQILQISKDSGGSRVLESFLGSSATAKRKFKVFGKLQGHYGEIAMNPSGSFLVEKCFTASNFSHKEAIVAELLAVQSELSKTRHGFHLLKKLDVERYARRPEQWRASQTSKETTQKKFEAEFGSNSQSTGQNIKEKFSQSPMKKRKQKEKADKITEDARSNKPDFSQKENSKRPKSAKSSAERGSSAKNTREGTDASASMMFLKGSVKRKSPGFLSDKPSLKKQKHHKLVSGRPDGKLFVRDSGTSAPFVKNAGKQKQSIAELADLAGKEKLTASEVRKLLKPEMSGKS

SEQ ID NO: 3207 - DNA, 1923 bp, Sorghum bicolor
  misc_feature: Ceres ANNOT ID no. 6029418
  misc_feature: Encodes the peptide sequence at SEQ ID NO 3208
  misc_feature: Up-regulated in shoot tissues in response to salicylic acid treatment
atggggacggcggcgatggcgacggcggtgggcggcgccatgctgctctacttcgtgctgagccggcggctggcgggcgaggacgtctccgtcggcggcggaggcggagggggaggagtcgggtccgggaagcggcggagggggcgcagcgcgccgcggcgcccggtgcagccgccggcgacgtggatcgaggcggtgggcacgctcgcggagacgctgcggttcacctactcggagacgctcggcaagtggcccatcggggacctcgccttcggaatcaagtacctcatgcgccgacagggcaatttacatgttgccagtgtatatgctggaagcgagtgcattgaactgaaaggacctgaaatcatggaagagctgattgttctacggcggttgattgatctgtgcttccttttctctaagaaaccatttccagtgttccgggagttagctggattttcacaggaggatgttcttattgaagaaccaaaggcggggattttgaagcctgctcatacaattctacgtgatgagtgcaccaaatccttccttgttttgattcgagggactcatagcatgaaagatactctgactgctgctactggggctgtggtgccatttcacctctcacttttggatgaaggcggtgtgagcaaattagtgttaggctatgctcactgtgggatggttgcagcagcccgctggattgcaagaggtgtaacaccatgccttcgtgaagcagtcagacaatgtccagaataccaaatcaagattgttggccattcattgggtggtggtactgctgcattgctaacctacatccttagagaacataaagagttttcttcaacaacttgtgttgcattcgcaccagcttcttgcatgacatgggaattagcagaatcaggcaaacattttgtgactacgattgtcaatggagctgatctggttcccactgtatcgactgcatctattgatgatctccgttctgaggtaacagcttcatcatggttaaatgatttgagggatcaaatacaacagacacgtttcctaaatgtcgtttaccggtcagccactgctttaggaactcgcctgcaatctttttctggtgcgagagagagggttgcaggtgctggagcatttctacgtcctgtttcaaacaaaacccaggttgtgatgaaacaagcacagaatgttgcacaggctgttgctagaagtcggtctgcactttcctcatggtcatgcatgggtgcacgtcgtcgaggtgtaggtgtagttactgcaagttctaaagatgatataagagcagaaacccatgtaacatcgacagttgagtcaaagtccttcgttgtagaacaatgtgtcaccaagaccatagaagaactgcagtatactgcagctagtatttctgttcatgatgcagcagacgaagaagaggctcttttgagtgagcatgaaacctctcgggagaatgccgaagaagaaataacagagggtgaattgtggtacgagttcgagaaggacttggatcgacagactgaagtggaggcacgaactcgagaggaagaggcagctgcagccaaggaaataatggaagaggaaagtgctgtgctaaaaggtgtagaggacaggcagtccttcacatcagatagcttggagaggcagcaattctacccacctggtagaatcatgcacatggttgcaatgcctcccacagatgctgacccagatgatccagtggctgctgacgagtgctctgttggaatatatgagacccctagagatctttacagcaagattcgactctcaaataccatgatcaatgatcactacatgccaatgtataagaagatgatggaaatattgattgagaagttcgcaaaggatgaggacagctattgtacaggttctactgtagaataa

SEQ ID NO: 3208 - protein, 640 aa, Sorghum bicolor
  misc_feature: Ceres ANNOT ID no. 6029418
  misc_feature (184)..(325): Pfam Id: Lipase_3 Pfam Desc: Lipase (class 3)
  misc_feature (50)..(131): Pfam Id: Lipase3_N Pfam Desc: Lipase 3 N-terminal region
  misc_feature (1)..(640): NCBI GI: 20805147 NCBI Desc: lipase class 3-like protein [oryza sativa (japonica cultivar-group)]
  misc_feature (1)..(639): NCBI GI: 47497398 NCBI Desc: lipase class 3 protein-like [oryza sativa (japonica cultivar-group)]
  misc_feature (1)..(540): NCBI GI: 22328699 NCBI Desc: lipase class 3 family protein [arabidopsis thaliana]
  misc_feature (1)..(630): NCBI GI: 27764916 NCBI Desc: at3g14070/mag2_2 [arabidopsis thaliana]
  misc_feature (1)..(494): NCBI GI: 115489010 NCBI Desc: os12g0554500 [oryza sativa (japonica cultivar-group)]
  misc_feature: Up-regulated in shoot tissues in response to salicylic acid treatment
MGTAAMATAVGGAMLLYFVLSRRLAGEDVSVGGGGGGGGVGSGKRRRGRSAPRRPVQPPATWIEAVGTLAETLRFTYSETLGKWPIGDLAFGIKYLMRRQGNLHVASVYAGSECIELKGPEIMEELIVLRRLIDLCFLFSKKPFPVFRELAGFSQEDVLIEEPKAGILKPAHTILRDECTKSFLVLIRGTHSMKDTLTAATGAVVPFHLSLLDEGGVSKLVLGYAHCGMVAAARWIARGVTPCLREAVRQCPEYQIKIVGHSLGGGTAALLTYILREHKEFSSTTCVAFAPASCMTWELAESGKHFVTTIVNGADLVPTVSTASIDDLRSEVTASSWLNDLRDQIQQTRFLNVVYRSATALGTRLQSFSGARERVAGAGAFLRPVSNKTQVVMKQAQNVAQAVARSRSALSSWSCMGARRRGVGVVTASSKDDIRAETHVTSTVESKSFVVEQCVTKTIEELQYTAASISVHDAADEEEALLSEHETSRENAEEEITEGELWYEFEKDLDRQTEVEARTREEEAAAAKEIMEEESAVLKGVEDRQSFTSDSLERQQFYPPGRIMHMVAMPPTDADPDDPVAADECSVGIYETPRDLYSKIRLSNTMINDHYMPMYKKMMEILIEKFAKDEDSYCTGSTVE

SEQ ID NO: 3209 - DNA, 1539 bp, Sorghum bicolor
  misc_feature: Ceres ANNOT ID no. 6029496
  misc_feature: Encodes the peptide sequence at SEQ ID NO 3210
atggcctgggctcgccttgcctcccgctcccgtctgcgccccgcggcctccgcctccgcctccgccgccgtcggccgaccgccaaacgcctcaccgtcggttccgcctcccacaccgcccactgtgcctgcggccacctccgcgccaccgctccggcatctcctcctccttccccggcaccggtttgctgccgccgcgtcctcggcgtcgaccgcgcggctgctcggtgcccggtggccccagggtcacggtaggagatgcttcgcgagcgaggcctccgcggcgcaggcgccgccgggggaggcctctgagctggtggaggtgccactggcgcagactggggaaggcatcgccgagtgcgagctgctgcgctggttcgtcgccgagggtgaccaagtagatgaattccagcccctttgtgaagtacagagtgacaaagcaactatcgagataacaagtcgtttcaagggaaaagtacatcagattaactttggccctggtgacatagtcaaggttggtgaaactttactgaaaatgattgtgggtgacagccaaattgtttccccagataatatagttccatctgctgataagtccaatggagtagagtctgcagtttccttaagtgaaggcaatgttcctagtggaactctctctacaccagctgttaggcatctagcaaagcagtacgggatcaacataaatgaaatcgttggaacagggaaagatggtagggttttgaaagaagatgtgttgaattatgctgtcagcaagggtgtttgcaaagaacaatcgtcagctttggaagggaacattgatcaagttgagttactggaggaagggaaatcattactcgatgagcacgtctatgaagataagaaaatccttctcaggggataccagagatcaatggtcaaatcaatgagcctggctgcaaaagttccacattttcattatctggaggaaataaactgtgattctcttgtacaactaaagaccacatttcaaaatgagaacaaggatcatactatcaagcacacattccttccgttcctcataaagtcactttctatggcactgagtaaataccctatattgaacagctctttcatcgaggaaactagtgaagttgtgttcaaagcacatggattagtcgtgccaaacatcaagaaagtgcagtccctatcaatattggagatcacgaaggaattggcgcgattgcatgagatggcatcgcacaacaggctaagcgctgcagatattgaaggtggcactataacacttagcaacataggtgccattggtggcaagtttggctctccccttctgaacctacctgaagttgccatcattgcccttgggcggattcaaaaacttcctcgctttgatgatgacgaaaacgtttacccttcatccacaatcaatgttactattggagccgatcaccgagttgttgatggggccacggttgcaagattctgtaacgagtggaagagcctcgtggagaagccagagctactcttgctgcatatgcgatga

SEQ ID NO: 3210 - protein, 512 aa, Sorghum bicolor
  misc_feature: Ceres ANNOT ID no. 6029496
  misc_feature (289)..(509): Pfam Id: 2-oxoacid_dh Pfam Desc: 2-oxoacid dehydrogenases acyltransferase (catalytic domain)
  misc_feature (106)..(179): Pfam Id: Biotin_lipoyl Pfam Desc: Biotin-requiring enzyme
  misc_feature (215)..(253): Pfam Id: E3_binding Pfam Desc: e3 binding domain
  misc_feature (40)..(512): NCBI GI: 7549628 NCBI Desc: branched chain alpha-keto acid dehydrogenase e2 subunit [arabidopsis thaliana]
  misc_feature (40)..(512): NCBI GI: 7021284 NCBI Desc: branched chain alpha-keto acid dehydrogenase e2 subunit [arabidopsis thaliana]
  misc_feature (40)..(512): NCBI GI: 3138972 NCBI Desc: dihydrolipoylacyltransferase subunit of the branched-chain alpha-keto acid dehydrogenase complex [arabidopsis thaliana]
  misc_feature (104)..(512): NCBI GI: 55665041 NCBI Desc: otthump00000059032 [homo sapiens]
  misc_feature (104)..(512): NCBI GI: 179354 NCBI Desc: branched chain acyltransferase precursor
MAWARLASRSRLRPAASASASAAVGRPPNASPSVPPPTPPTVPAATSAPPLRHLLLLPRHRFAAAASSASTARLLGARWPQGHGRRCFASEASAAQAPPGEASELVEVPLAQTGEGIAECELLRWFVAEGDQVDEFQPLCEVQSDKATIEITSRFKGKVHQINFGPGDIVKVGETLLKMIVGDSQIVSPDNIVPSADKSNGVESAVSLSEGNVPSGTLSTPAVRHLAKQYGININEIVGTGKDGRVLKEDVLNYAVSKGVCKEQSSALEGNIDQVELLEEGKSLLDEHVYEDKKILLRGYQRSMVKSMSLAAKVPHFHYLEEINCDSLVQLKTTFQNENKDHTIKHTFLPFLIKSLSMALSKYPILNSSFIEETSEVVFKAHGLVVPNIKKVQSLSILEITKELARLHEMASHNRLSAADIEGGTITLSNIGAIGGKFGSPLLNLPEVAIIALGRIQKLPRFDDDENVYPSSTINVTIGADHRVVDGATVARFCNEWKSLVEKPELLLLHMR

SEQ ID NO: 3211 - DNA, 1062 bp, Sorghum bicolor
  misc_feature: Ceres ANNOT ID no. 6029519
  misc_feature: Encodes the peptide sequence at SEQ ID NO 3212
atggatgggatgggatgggacgggacggacgagcaggagtacgtgcggaactcgagaggagtgcagctcttcacctgcggctggctgcccgtcgccacatcgcccaaggcgctcgtcttcctctgccacggctacggcatggagtgcagtggcttcatgagagaatgcggcatgcggctggcggcggccgggtacggcgtgttcgggatggactacgagggccacggcaagtccatgggcgcccgctgctacatccgcagcttccgccgcctcgtcgacgactgcagccatttcttcaagtccatctgcgagcttgaggagtaccggggcaagagccggttcctgtacggcgagtccatgggcggcgcggtggcgctgctgctgcacaggaaggaccccgccttctgggacggcgccgtgctcgtcgcgccgatgtgcaagatatcagagaaggtgaagccacaccctgtggtgatcacgctcctgacgcaggtggaggacgtgatcccaaagtggaagatcgtgcccaccaagcaggacgtcatcgacgccgccttcaaggaccccgtcaagcgtgaaaagatcaggagaaataagctgatttaccaggacaaaccgcggctcaagactgcgctagagatgctcaggaccagcatgtacatagaagacagcttgtcacaggtgaagctgccgttcttcgtcctgcacggcgaggccgacacggtgacggacccggaggtgagccgcgccctgtacgagcgcgcggcgagcgccgacaagaccatcaagctctacccggggatgtggcacggcctcaccgctggggagaccgacgagaacgtggaggccgtcttctccgacatcgtctcctggctcaaccagcgctgccggagctggaccatggaggaccgcttcaggaagctggtgccagcgccggccaagttcatccatggtgacgacgccgtcgacggcaaagcgcagacacaagggcgtcctcggcggcggcgtccgggcctcctctgcgggcttgccggccggacgcatcaccatgcagaaatgtga

SEQ ID NO: 3212 - protein, 353 aa, Sorghum bicolor
  misc_feature: Ceres ANNOT ID no. 6029519
  misc_feature (65)..(290): Pfam Id: Abhydrolase_1 Pfam Desc: alpha/beta hydrolase fold
  misc_feature (11)..(353): NCBI GI: 30695682 NCBI Desc: esterase/lipase/thioesterase family protein [arabidopsis thaliana]
  misc_feature (11)..(327): NCBI GI: 92878320 NCBI Desc: alpha/beta hydrolase [medicago truncatula]
  misc_feature (11)..(295): NCBI GI: 7019651 NCBI Desc: lipase-like protein [arabidopsis thaliana]
  misc_feature (12)..(295): NCBI GI: 7019652 NCBI Desc: lipase-like protein [arabidopsis thaliana]
  misc_feature (7)..(302): NCBI GI: 140063294 NCBI Desc: alpha/beta hydrolase [medicago truncatula]
MDGMGWDGTDEQEYVRNSRGVQLFTCGWLPVATSPKALVFLCHGYGMECSGFMRECGMRLAAAGYGVFGMDYEGHGKSMGARCYIRSFRRLVDDCSHFFKSICELEEYRGKSRFLYGESMGGAVALLLHRKDPAFWDGAVLVAPMCKISEKVKPHPVVITLLTQVEDVIPKWKIVPTKQDVIDAAFKDPVKREKIRRNKLIYQDKPRLKTALEMLRTSMYIEDSLSQVKLPFFVLHGEADTVTDPEVSRALYERAASADKTIKLYPGMWHGLTAGETDENVEAVFSDIVSWLNQRCRSWTMEDRFRKLVPAPAKFIHGDDAVDGKAQTQGRPRRRRPGLLCGLAGRTHHHAEM

SEQ ID NO: 3213 - DNA, 1275 bp, Sorghum bicolor
  misc_feature: Ceres ANNOT ID no. 6029520
  misc_feature: Encodes the peptide sequence at SEQ ID NO 3214
atggcgtcggagctgacgtaccgtggcggcagcgcggcgccaggctccgcctccaacggcggagagtactccccgaagccctccaagccgctctcctggctctcccgcgccgcgcgctacgccgccgccgagcaccgcccggtcttcgccctcgccggcatgctcttcgctgccgccctcttcactttctcctccccctccacctcgtcgccgtccgagcccgccgcgtcggtcggattcaaccaccttgccgtcaccgggcacccgtccttccgcgagtccgtcggcggcaaggtgcccctggggctgcgtcggcgggcgctgcgggtgctcgtgacgggcggcgctgggttcgtggggagccacctggtggaccggctggtggagcgcggcgacagcgtgatcgtggtggacaacttcttcacggggcgcaagggcaacgtggcgcaccatctccagaaccccaggttcgaggtgatccgccacgacgtcgtcgagcccatactgctcgaggtcgaccagatctaccaccttgcctgcccagccagccccgtgcactacaaatggcacaagacgaatgttgttgggacactgaacatgcttgggttggccaagaggattggggcaaggttcctacttacaagcaccagtgaagtctatggtgatcccctccagcaccctcaggtggaaacttattggggcaatgtcaaccctataggtgtcaggagctgctatgatgagggcaagcgtacagctgaaacattaaccatggactaccatcgtggtgccaaccttgaggtaaggattgcccggatcttcaacacatatggtcctcgcatgtgcattgatgacggtcgtgttgtcagtaattttgttgctcaggcgctgaggaaggagcctttgacagtttatggcgatggcaaacagactaggagctttcaatacgtatcagatttggtggaagggctgatgaagctcatggaaggggatcacattggaccattcaacctcggtaatcctggagaattcaccatgctggagctggctaaggtggttcaggacaccatcgacccagaggcgcgcatcgagttccgtccaaacactgcagacgatccacacaagcgcaagcctgacatcagccgcgcaaaagagctccttggctgggagcccaaggttccccttcgtgagggtcttcctcgcatggtcactgacttccgcaaacgtatcttcggggaccaaggagaatccactgaggcagctggtggcctttcttag

SEQ ID NO: 3214 - protein, 424 aa, Sorghum bicolor
  misc_feature: Ceres ANNOT ID no. 6029520
  misc_feature (110)..(338): Pfam Id: Epimerase Pfam Desc: NAD dependent epimerase/dehydratase family
  misc_feature (112)..(320): Pfam Id: NAD_binding_4 Pfam Desc: Male sterility protein
  misc_feature (111)..(365): Pfam Id: 3Beta_HSD Pfam Desc: 3-beta hydroxysteroid dehydrogenase/isomerase family
  misc_feature (1)..(413): NCBI GI: 45421832 NCBI Desc: udp-glucuronic acid decarboxylase [oryza sativa (japonica cultivar-group)]
  misc_feature (39)..(422): NCBI GI: 50659028 NCBI Desc: udp-d-glucuronate decarboxylase [hordeum vulgare]
  misc_feature (1)..(415): NCBI GI: 92878321 NCBI Desc: nad-binding site; nucleotide sugar epimerase [medicago truncatula]
  misc_feature (57)..(422): NCBI GI: 49387469 NCBI Desc: udp-glucuronic acid decarboxylase [oryza sativa (japonica cultivar-group)]
  misc_feature (9)..(412): NCBI GI: 50284521 NCBI Desc: udp-glucuronic acid decarboxylase [oryza sativa (japonica cultivar-group)]
  misc_feature (109)..(409): SWISSPROT Homolog: EC 4.1.1.35 UDP-glucuronic acid decarboxylase 1
  misc_feature: Useful for making plants with altered cell wall content and/or composition
  misc_feature: GREAT-hit functional homolog of the protein sequence encoded by LOCUS at2g47650
  misc_feature: Functional homolog of the protein sequence encoded by LOCUS at3g62830
  misc_feature: Useful for making plants with altered carbohydrate content
  misc_feature: Functional homolog of the protein sequence given in SEQ ID NO 13747
  misc_feature: Useful for making plants with altered cell wall content and/or composition
  misc_feature: Functional homolog of the protein sequence given in SEQ ID NO 13824
MASELTYRGGSAAPGSASNGGEYSPKPSKPLSWLSRAARYAAAEHRPVFALAGMLFAAALFTFSSPSTSSPSEPAASVGFNHLAVTGHPSFRESVGGKVPLGLRRRALRVLVTGGAGFVGSHLVDRLVERGDSVIVVDNFFTGRKGNVAHHLQNPRFEVIRHDVVEPILLEVDQIYHLACPASPVHYKWHKTNVVGTLNMLGLAKRIGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGDHIGPFNLGNPGEFTMLELAKVVQDTIDPEARIEFRPNTADDPHKRKPDISRAKELLGWEPKVPLREGLPRMVTDFRKRIFGDQGESTEAAGGLS

SEQ ID NO: 3215 - DNA, 771 bp, Sorghum bicolor
  misc_feature: Ceres ANNOT ID no. 6029526
  misc_feature: Encodes the peptide sequence at SEQ ID NO 3216
atgagccgacgcaacagccgtaccatctatgtaggcaatctccctggggacatccgtgagagggaggttgaggatctcttctacaagtatggtcgtatcttggatatcgacttgaaaatacctccaagacctcctggatacgctttcgttgagtttgaggatccacgtgatgctgatgatgcaatttatggccgtgatgggtataactttgatggctacaggttgcgcgttgaattagctcatggtggtagaggtcagtcttattcttatgatcgttcaagcagctatagcagtgcacgccgtggaggtgtttctaggcgctctgatttccgtgttatggtcactggtttaccttcatctgcatcgtggcaagatctgaaggaccacatgcggcgcgccggcgatgtctgtttctctgatgtataccgtgaggctggagaaactattggaattgtggactatacaaattatgacgatatgaaatacgcgattaggaagcttgatgactcacagttcaggaatgcattttcaagggcgtatatcagggtgagggagtatgatgccagatcacgaagcagaagccgtagccggtcgtactctagaagccccagttacagcaggagcaggagtccaaaatctctttctcggtcaccctcacctgtggatgaaagatcgctatcaagatctcgatccccagtttcttctccttctcatgccagatctgcgagcagaagcacatcccgttctcggtctcctgtgagatccgattga

SEQ ID NO: 3216 - protein, 256 aa, Sorghum bicolor
  misc_feature: Ceres ANNOT ID no. 6029526
  misc_feature (9)..(77): Pfam Id: RRM_1 Pfam Desc: RNA recognition motif. (a.k.a. RRM, RBD, or RNP domain)
  misc_feature (112)..(179): Pfam Id: RRM_1 Pfam Desc: RNA recognition motif. (a.k.a. RRM, RBD, or RNP domain)
  misc_feature (1)..(256): NCBI GI: 52140009 NCBI Desc: asf/sf2-like pre-mrna splicing factor srp30 [zea mays]
  misc_feature (1)..(224): NCBI GI: 52140010 NCBI Desc: asf/sf2-like pre-mrna splicing factor srp30' [zea mays]
  misc_feature (1)..(254): NCBI GI: 115463447 NCBI Desc: os05g0364600 [oryza sativa (japonica cultivar-group)]
  misc_feature (1)..(255): NCBI GI: 52140012 NCBI Desc: asf/sf2-like pre-mrna splicing factor srp31 [zea mays]
  misc_feature (1)..(255): NCBI GI: 115474019 NCBI Desc: os07g0673500 [oryza sativa (japonica cultivar-group)]
  misc_feature: The plant produces a reduced number of seeds.
  misc_feature: Useful for biocontainment applications
  misc_feature: Useful for making plants with altered Lignin content
  misc_feature: Useful for making plants with altered alkaloid content
  misc_feature: GREAT-hit functional homolog of the protein sequence given in SEQ ID NO 13244
  misc_feature: GREAT-hit functional homolog of the protein sequence given in SEQ ID NO 13245
  misc_feature: Useful for making plants with altered alkaloid content
  misc_feature: Useful for making plants with altered lignin content
  misc_feature: Functional homolog of the protein sequence given in SEQ ID NO 13245
  misc_feature: The sequence is a functional homolog of SEQ ID NO. 339 in the 11/188,298 US application
MSRRNSRTIYVGNLPGDIREREVEDLFYKYGRILDIDLKIPPRPPGYAFVEFEDPRDADDAIYGRDGYNFDGYRLRVELAHGGRGQSYSYDRSSSYSSARRGGVSRRSDFRVMVTGLPSSASWQDLKDHMRRAGDVCFSDVYREAGETIGIVDYTNYDDMKYAIRKLDDSQFRNAFSRAYIRVREYDARSRSRSRSRSYSRSPSYSRSRSPKSLSRSPSPVDERSLSRSRSPVSSPSHARSASRSTSRSRSPVRSD

SEQ ID NO: 3217 - DNA, 1362 bp, Sorghum bicolor
  misc_feature: Ceres ANNOT ID no. 6029536
  misc_feature: Encodes the peptide sequence at SEQ ID NO 3218
atgggggtgcatgcgcatggggctgttgccaaagccaaaccctgcagcagcagcagcagcagcaggcggcttttcctgttggttgttgtactcgtcgtcctcataggtagctactgcgccgccgccgctgcagatgaggagatgaacagcagcagtaataggggcagccggagccggaggaggaggaggagcaggagcaggagacgggccgctgccacggcggccgacgcggtgacgccggcgccgctcatggtgcccatcaccatcctcaagtccgccgtcgactcgggagccgtgtgcatggacggaacaccgcctgcttaccacctacaccctggctccggggctggcaacaatagctggatcgtcaacctggagggaggcggttggtgcaacaacgttcgggcgtgccagttccgcaaggccagccgccgcggctcgtcggacctcatggagaaggagatccccttcggcggcatcatgagcagcagccctgtcgataaccctgatttctacaagtggaaccgggtgaagatccgctactgcgacggcgcgtccttcgccggagaaggcttcgacaaggagaacgggttttacttccgcgggcagcgcatctgggacgccaccgtccggcacctcctctccatcgggatggcctccgcagagcaggtgctgctcaccggctgctccgccggcggcctggccgtcatactgcactgcgaccagttccaggccttcttccctcgctccaccaccgtcgtcaagtgcctcgccgacgccggcctcttcctcgacgcctccgatgtctccggcggccgcagccttcgttcctactactccgacatcgtggccatgcagggcgtggctcccaacctgccgccggcctgcactgcccgtctcgacaccacctcgtgcttcttcccgcagaatgtaatcgatggcatcaacacccccatcttcctgctcaacgcagcatacgacgtatggcagatacaggagagcctggcacccaccggagctgaccccagcggagcctggcgggcctgcaagtccaaccactctgcctgcgacgcatcccagatgaaattcctgcaagatttcagagaccagatggtagcatcggtgaacaacggcttcgctggctccaggagcaacgggctcttcatcaactcctgcttcgcgcactgccagtccgagctgccgatgacatggagcgacaacgcggcaggtggtggtgcctccccggccattcaaagcagggggattgccaagtcagtgggcgactggtactttggtcgagctcaagttaaggccatcgactgcccctacccatgcgaccgaacatgccgcaacatcatatga

SEQ ID NO: 3218 - protein, 453 aa, Sorghum bicolor
  misc_feature: Ceres ANNOT ID no. 6029536
  misc_feature (70)..(439): Pfam Id: PAE Pfam Desc: Pectinacetylesterase
  misc_feature (100)..(453): NCBI GI: 109509142 NCBI Desc: pectin acetylesterase [eucalyptus globulus subsp. globulus]
  misc_feature (100)..(452): NCBI GI: 109509148 NCBI Desc: pectin acetylesterase [eucalyptus globulus subsp. globulus]
  misc_feature (72)..(453): NCBI GI: 140049891 NCBI Desc: pectinacetylesterase [medicago truncatula]
  misc_feature (82)..(453): NCBI GI: 87241323 NCBI Desc: pectinacetylesterase [medicago truncatula]
  misc_feature (73)..(453): NCBI GI: 79366428 NCBI Desc: carboxylic ester hydrolase [arabidopsis thaliana]
  misc_feature: Useful for making plants with altered cell wall content and/or composition
  misc_feature: Functional homolog of the protein sequence encoded by LOCUS at2g46930
  misc_feature: Functional homolog of the protein sequence encoded by LOCUS at5g23870
  misc_feature: Useful for making plants with altered cell wall content and/or composition
  misc_feature: Functional homolog of the protein sequence given in SEQ ID NO 13822
  misc_feature: Useful for making plants with altered carbohydrate content
  misc_feature: Functional homolog of the protein sequence given in SEQ ID NO 13823
MGVHAHGAVAKAKPCSSSSSSRRLFLLVVVLVVLIGSYCAAAAADEEMNSSSNRGSRSRRRRRSRSRRRAAATAADAVTPAPLMVPITILKSAVDSGAVCMDGTPPAYHLHPGSGAGNNSWIVNLEGGGWCNNVRACQFRKASRRGSSDLMEKEIPFGGIMSSSPVDNPDFYKWNRVKIRYCDGASFAGEGFDKENGFYFRGQRIWDATVRHLLSIGMASAEQVLLTGCSAGGLAVILHCDQFQAFFPRSTTVVKCLADAGLFLDASDVSGGRSLRSYYSDIVAMQGVAPNLPPACTARLDTTSCFFPQNVIDGINTPIFLLNAAYDVWQIQESLAPTGADPSGAWRACKSNHSACDASQMKFLQDFRDQMVASVNNGFAGSRSNGLFINSCFAHCQSELPMTWSDNAAGGGASPAIQSRGIAKSVGDWYFGRAQVKAIDCPYPCDRTCRNII

SEQ ID NO: 3219 - DNA, 1254 bp, Sorghum bicolor
  misc_feature: Ceres ANNOT ID no. 6029538
  misc_feature: Encodes the peptide sequence at SEQ ID NO 3220
atgacggatcggccgtcgtttccggctctcattgctctcgccgttcttgtggtgggcagctactgctgcgtggcgacctcggccgcctcgccggcggtggaagatgatgagctgcgtggtcggacgatgcggcggcgccgcgcggcgtcggtgatggtgcccatcaccatcctcaagtccgcagtcagcgacggagctgtgtgcatggatggaacgccacctgcttacaacttggatcctggctccggaacgggtagcagaagctggattgtgaacttagagggaggtgcatggtgcaacagcgccaagacatgccggcttaccaagagctccgggcgcggctcgtcggaccacatggataaagagatccccttcaccggcatcatgagcagcagcagcgccgtcaatcctgatttctacaattggaaccgggtaaagattcgctactgcgacggtggatcttttgccggcgaggcctttgataagaacactgggatttatttccgagggcagcgcatctggaacgcggtcatccggcacctcctctccattgggatggcctctgctgatcgtgtgctgctcaccggctgctcctcggggggtctggcggtgatcctgcactgcgaccagttgcgcgccttcttcccgtccggcaccaccgtcgtcaagtgcatctccgacggcggcctctacctcgacgccgtggatgtctccggtggccggagcctgagatcctacttccgtgacatcgtggccatgcaaggaatagctcagaacctgccgccggcttgcaccgcccgtctcgacgccacctcgtgcttcttcccgcaaaacataatcgatggcatcaagaccccactgtttctgctaaatgcagcatacgacttcattcagattgtgctcagcctggcgccagacagagctgacccaaacggcgcttggcgagcctgcaagtccaaccgcacggcctgcagtgcatcccagatgagtttcctgcaagatttcagggaccagatggtagcatccgtcagaggcttctccggttccaggagcaacgggctcttcataagctcctgcttcgcgcactgccagtcggagcagctgggcacctggaacaccaaaccaggtggctcccccaccattcaaaacaaggggattgcaaaatccgttggtgactggtactttgatcgagctgaagtgaaggcgatcgactgccgctatccctgcgacaacacttgccaccatatcatatga

SEQ ID NO: 3220 - protein, 417 aa, Sorghum bicolor
  misc_feature: Ceres ANNOT ID no. 6029538
  misc_feature (37)..(403): Pfam Id: PAE Pfam Desc: Pectinacetylesterase
  misc_feature (68)..(417): NCBI GI: 109509142 NCBI Desc: pectin acetylesterase [eucalyptus globulus subsp. globulus]
  misc_feature (68)..(416): NCBI GI: 109509148 NCBI Desc: pectin acetylesterase [eucalyptus globulus subsp. globulus]
  misc_feature (51)..(417): NCBI GI: 87241323 NCBI Desc: pectinacetylesterase [medicago truncatula]
  misc_feature (51)..(417): NCBI GI: 140049891 NCBI Desc: pectinacetylesterase [medicago truncatula]
  misc_feature (52)..(417): NCBI GI: 79366428 NCBI Desc: carboxylic ester hydrolase [arabidopsis thaliana]
  misc_feature: Useful for making plants with altered cell wall content and/or composition
  misc_feature: Functional homolog of the protein sequence encoded by LOCUS at2g46930
  misc_feature: Useful for making plants with altered cell wall content and/or composition
  misc_feature: Functional homolog of the protein sequence given in SEQ ID NO 13822
  misc_feature: Useful for making plants with altered carbohydrate content
  misc_feature: Functional homolog of the protein sequence given in SEQ ID NO 13823
MTDRPSFPALIALAVLVVGSYCCVATSAASPAVEDDELRGRTMRRRRAASVMVPITILKSAVSDGAVCMDGTPPAYNLDPGSGTGSRSWIVNLEGGAWCNSAKTCRLTKSSGRGSSDHMDKEIPFTGIMSSSSAVNPDFYNWNRVKIRYCDGGSFAGEAFDKNTGIYFRGQRIWNAVIRHLLSIGMASADRVLLTGCSSGGLAVILHCDQLRAFFPSGTTVVKCISDGGLYLDAVDVSGGRSLRSYFRDIVAMQGIAQNLPPACTARLDATSCFFPQNIIDGIKTPLFLLNAAYDFIQIVLSLAPDRADPNGAWRACKSNRTACSASQMSFLQDFRDQMVASVRGFSGSRSNGLFISSCFAHCQSEQLGTWNTKPGGSPTIQNKGIAKSVGDWYFDRAEVKAIDCRYPCDNTCHHII

SEQ ID NO: 3221 - DNA, 3021 bp, Sorghum bicolor
  misc_feature: Ceres ANNOT ID no. 6029539
  misc_feature: Encodes the peptide sequence at SEQ ID NO 3222
atggcgcctcacgcctcggcggccaccgcagccgctacccctgcgctgcgctttccccacactttgtccgccacgggcctctcctcgtcgcctctcgctgggggctgcggcggctgccgggttcggttccgccccagccggcgcggaccgggtatgcaggggcgccgagaaggtggctcccacttggcgcgcgtggggggcctgctgggcagcgtattcggcgggggcggccgcgacgacggggaggccacgcggaagaagtacgccgacaccgtggcgcgcatcaactccatggagcccgaagtctccgcgctctcagacgccgacttgcgcgcacgcaccgccgcgctccaggaccgcgctcgcaccggggaatccctggattcccttctccccgaagcatttgctgttgtgagggaggcttccaagagagttctaggtctccgtccctttgatgtgcagttgattggtggcatggttctgcacaagggggagattgcagaaatgaagactggagaggggaagactcttgtggccattctgccagcattcttaaatgctttgagtgggaaaggagtgcatgttgtcactgtaaatgattatcttgcaagacgtgattgtgagtgggttggtcaagttccccgatttctaggactgcaggttggcttaattcaacagaacatgacacctgagcaaaggagggaaaattactcatgcgatattacttatgtcacaaacagtgagcttggttttgattatctaagagataaccttgcaatgactgtagatgaacttgtcttgaggaacttcaattactgtgtgatagatgaagttgattcaatccttattgatgaagcaagaacacctcttataatatcaggcctagctgaaaagccaagcgaccggtattacaaagcagcaaaaatagctgatgcttttgagcgagacattcattacacggtggatgaaaagcaaagaaatgttttacttacagaagaaggttatgctgatgctgaagaaatactggacataaatgatctatatgatcctcgtgaacagtgggcttcgtatgttctaaatgcaatcaaggctaaggagctcttccttaaagatgtcaattacattgttcgtagcaaggaagtgcttattgtagatgagtttactggcagagttatgccgggcaggcgatggagtgatggtctccatcaagcaattgaagcaaaagaaggtgtatctatacaaaatgaaaccataactctcgcatcaataagttaccaaaacttctttcttcagtttcccaaactctgtggcatgactggaactgcagctacagagacccaagagtttgagagcatatataaacttaaagttactgttgttccaacaaacaagccaatgatacggaaggatgattcagatgttgtttttagagcaacaaatggaaaatggcgtgctgttcttgtggagatatcaagaatgaataaagttggccgtcctgtgcttgttggtaccaccagtgttgagcaaagtgaatctttatcagagcaattgcgtgaagctgggattcctcatgaggtcctgaatgctaagccagagaatgttgagagggaggcagagatcgtagctcagagtggacgccttggtgctgtgacaattgccaccaatatggcaggacgtggaactgatattattcttggtggcaatgcagaattcatggccaggttgaagttgcgtgagatccttatgccaagagttgtcaatccaatagatggtgttattgtatccaaaaagcagatgccaccacgaaagacatggaagacgaatgaaagcttgttcccatgtgaactttcaaaagaaacattatcatccgtcaaagatacagttgaaatggctgtcaaagaatggggagagaaatcattaactgaactggaagcagaagagcggttgtcctactcatgtgagaagggaccaacacgtgatgaagtaatagcaaatttgagaaatgcatttatgaagatagcagacgaatataaagttttcactgaggaggaaaagaagaaggtcattacagcaggcggacttcatgtagtaggaacagagcgccatgaatcgcgcagaattgacaatcagctccgtggtcgaagtggaagacaaggggatcctggaagctctcgcttctttcttagtctcgaggataatattttccggatctttggaggtgacaggatacagggtctgatgcaagcatttcgagttgaagatctgcctattgaatcgaaaatgctaacaagggctctagatgaagcacaacgaaaagttgagaactacttttttgacatcaggaagcagttgtttgagtatgatgaggtattgaatagccagagagatcgtgtatatgcagaaagaagacgtgctcttgcatctgacagtcttgagtcacttattgtggaatatgctgaattgacaatggacgacatattagaggctaacataggccctgatactccaaaggaaaattgggacctgagcaaacttatagctaagctgcaacagtattgctatctgttggatgatttgacaccagaattgttggagggcaaaagctcaagctatgaggatttgcgggagtacctccgtaagcgaggacgtgaagcttacttccaaaaaactgaaattgtggagaagcaagctccaggattgatgaaggaggctgagcggtttctaattctcagcaatatcgataggctgtggaaagaacacctgcaggcactaaaatttgtccaacaagctgttggtttaaggggttatgcccaacgagatccccttattgagtataaacttgagggatataatcttttcttagacatgatggctcaaatcaggaggaatgttatttattctgtatatcagttcaaaccagtagtgaagaaccaagaagaggaagcatcccaaaagaaggtgtcaaaaaagaaactggacaaaggagctaacaaacttggtgctgcccaagcagcgtcatga

SEQ ID NO: 3222 - protein, 1006 aa, Sorghum bicolor
  misc_feature: Ceres ANNOT ID no. 6029539
  misc_feature (65)..(450): Pfam Id: SecA_DEAD Pfam Desc: SecA DEAD-like domain
  misc_feature (756)..(973): Pfam Id: SecA_SW Pfam Desc: SecA Wing and Scaffold domain
  misc_feature (295)..(406): Pfam Id: SecA_PP_bind Pfam Desc: SecA preprotein cross-linking domain
  misc_feature (40)..(1006): NCBI GI: 939976 NCBI Desc: seca [spinacia oleracea]
  misc_feature (40)..(1006): NCBI GI: 1361973 NCBI Desc: preprotein translocase seca precursor - spinach
  misc_feature (56)..(991): NCBI GI: 1122325 NCBI Desc: chloroplast seca protein [pisum sativum]
  misc_feature (261)..(991): NCBI GI: 140056224 NCBI Desc: seca protein [medicago truncatula]
  misc_feature (1)..(656): NCBI GI: 115436264 NCBI Desc: os01g0321300 [oryza sativa (japonica cultivar-group)]
MAPHASAATAAATPALRFPHTLSATGLSSSPLAGGCGGCRVRFRPSRRGPGMQGRREGGSHLARVGGLLGSVFGGGGRDDGEATRKKYADTVARINSMEPEVSALSDADLRARTAALQDRARTGESLDSLLPEAFAVVREASKRVLGLRPFDVQLIGGMVLHKGEIAEMKTGEGKTLVAILPAFLNALSGKGVHVVTVNDYLARRDCEWVGQVPRFLGLQVGLIQQNMTPEQRRENYSCDITYVTNSELGFDYLRDNLAMTVDELVLRNFNYCVIDEVDSILIDEARTPLIISGLAEKPSDRYYKAAKIADAFERDIHYTVDEKQRNVLLTEEGYADAEEILDINDLYDPREQWASYVLNAIKAKELFLKDVNYIVRSKEVLIVDEFTGRVMPGRRWSDGLHQAIEAKEGVSIQNETITLASISYQNFFLQFPKLCGMTGTAATETQEFESIYKLKVTVVPTNKPMIRKDDSDVVFRATNGKWRAVLVEISRMNKVGRPVLVGTTSVEQSESLSEQLREAGIPHEVLNAKPENVEREAEIVAQSGRLGAVTIATNMAGRGTDIILGGNAEFMARLKLREILMPRVVNPIDGVIVSKKQMPPRKTWKTNESLFPCELSKETLSSVKDTVEMAVKEWGEKSLTELEAEERLSYSCEKGPTRDEVIANLRNAFMKIADEYKVFTEEEKKKVITAGGLHVVGTERHESRRIDNQLRGRSGRQGDPGSSRFFLSLEDNIFRIFGGDRIQGLMQAFRVEDLPIESKMLTRALDEAQRKVENYFFDIRKQLFEYDEVLNSQRDRVYAERRRALASDSLESLIVEYAELTMDDILEANIGPDTPKENWDLSKLIAKLQQYCYLLDDLTPELLEGKSSSYEDLREYLRKRGREAYFQKTEIVEKQAPGLMKEAERFLILSNIDRLWKEHLQALKFVQQAVGLRGYAQRDPLIEYKLEGYNLFLDMMAQIRRNVIYSVYQFKPVVKNQEEEASQKKVSKKKLDKGANKLGAAQAAS

SEQ ID NO: 3223 - DNA, 1554 bp, Sorghum bicolor
  misc_feature: Ceres ANNOT ID no. 6029543
  misc_feature: Encodes the peptide sequence at SEQ ID NO 3224
  misc_feature: Down-regulated in shoot tissues in response to salicylic acid treatment
atggcgtcgtcggcgtcgaccctcgaaatcgaggcccgcgacgtggttaagatagtgctgcagttctgcaaggagaactcgctgcagcagacgttccagacgctgcagaacgagtgccaggtctccctcaacactgtcgacagcatcgacaccttcatcgccgacatcaatgctgggcgctgggacgctgtgcttccccaggtcgcgcagctcaagctgccacgcaagaagctcgaggacctctacgagcagattgtgttggagatggctgagctccgtgaacttgacacggcccgtgccatcctccgccagacgcaggtcatgggtgtcatgaagcaggagcagcctgagcggtacctccgccttgagcacctccttgtccgcacatacttcgacgccaatgaggcctaccaagaatccaccaaggagaagcggcgagcactgattgctcaagctgttgcttctgaagtatcagtagtaccgccatctcgtcttatggcgctgattggtcaggctttgaagtggcaacagcaccaaggattgttgcctcctggcacacagtttgatttatttagaggaactgctgcaatgaagcaagatgaagaagagacataccctacttccttatctcatcaaataaagtttggaaagaaaactcatcctgaatgtgctcgattttcacctgatggtcagtaccttgtttcatgctcagtggatgggataattgaagtctgggattatcttagtggaaagcttaaaaaggaccttcaataccaagctgatgaaagctttatgatgcacgaagaacctgtgctgtgtgttgattttagtagggattctgaaatgctggcatctggagcacaggatggaatgattaaggtttggcgtatacgaactggccagtgcttgcggcgccttgagcgtgcacattccaaaggtgttacaagtgttacattttcacgtgatggaacccaaatattgagtacatcctttgacactaccgcgagggtacatggtctcaagtctggaaagatgctgaaagaatttcgaggtcatacttcctatgtgaattatgccatcttcactactgacggtagccgtgtcattacagcttccagtgattgtactgttaaggtctgggatactaaaacaacagattgcttgcatactttcaagccaccacctcctttgaggggaggagacgcatctgttaattctgtccatttatttccaaaaaatactgatcacattgttgtgtgcaataagacttcatcgatattcatcatgactttacaaggacaggttgtaaagagtttctcgtcaggtaagcgagaagggggagattttgttgcagcttcagtttccccaaaaggagaatggatatattgtgttggtgaagacatgaacatgtattgctttagctaccaatctggtaaactggagcatctgatgaaggtccatgagaaggatgtcataggcattacgcaccatcctcacaggaacttggtagctaccattgctgaggattgtatgatgaagatatggaagccttga

SEQ ID NO: 3224 - protein, 517 aa, Sorghum bicolor
  misc_feature: Ceres ANNOT ID no. 6029543
  misc_feature (208)..(246): Pfam Id: WD40 Pfam Desc: WD domain, G-beta repeat
  misc_feature (258)..(296): Pfam Id: WD40 Pfam Desc: WD domain, G-beta repeat
  misc_feature (300)..(339): Pfam Id: WD40 Pfam Desc: WD domain, G-beta repeat
  misc_feature (343)..(381): Pfam Id: WD40 Pfam Desc: WD domain, G-beta repeat
  misc_feature (5)..(517): NCBI GI: 14031063 NCBI Desc: wd-40 repeat protein [lycopersicon esculentum]
  misc_feature (8)..(517): NCBI GI: 20857033 NCBI Desc: at1g73720/f25p22_14 [arabidopsis thaliana]
  misc_feature (7)..(517): NCBI GI: 83404927 NCBI Desc: smu-1 suppressor of mec-8 and unc-52 homolog [homo sapiens]
  misc_feature (7)..(517): NCBI GI: 55958016 NCBI Desc: otthump00000045234 [homo sapiens]
  misc_feature (7)..(517): NCBI GI: 60652827 NCBI Desc: smu-1 suppressor of mec-8 and unc-52-like [synthetic construct]
  misc_feature: Down-regulated in shoot tissues in response to salicylic acid treatment
  misc_feature: The sequence is a functional homolog of SEQ ID NO. 502 in the 11/188,298 US application
  misc_feature: The sequence is a functional homolog of SEQ ID NO. 485 in the 11/188,298 US application
MASSASTLEIEARDVVKIVLQFCKENSLQQTFQTLQNECQVSLNTVDSIDTFIADINAGRWDAVLPQVAQLKLPRKKLEDLYEQIVLEMAELRELDTARAILRQTQVMGVMKQEQPERYLRLEHLLVRTYFDANEAYQESTKEKRRALIAQAVASEVSVVPPSRLMALIGQALKWQQHQGLLPPGTQFDLFRGTAAMKQDEEETYPTSLSHQIKFGKKTHPECARFSPDGQYLVSCSVDGIIEVWDYLSGKLKKDLQYQADESFMMHEEPVLCVDFSRDSEMLASGAQDGMIKVWRIRTGQCLRRLERAHSKGVTSVTFSRDGTQILSTSFDTTARVHGLKSGKMLKEFRGHTSYVNYAIFTTDGSRVITASSDCTVKVWDTKTTDCLHTFKPPPPLRGGDASVNSVHLFPKNTDHIVVCNKTSSIFIMTLQGQVVKSFSSGKREGGDFVAASVSPKGEWIYCVGEDMNMYCFSYQSGKLEHLMKVHEKDVIGITHHPHRNLVATIAEDCMMKIWKP

SEQ ID NO: 3225 - DNA, 1845 bp, Sorghum bicolor
  misc_feature: Ceres ANNOT ID no. 6029555
  misc_feature: Encodes the peptide sequence at SEQ ID NO 3226
atgccgccaccgccgccgcagggtccagctccctcccacgctggccgcgccaacctcttctccgccccgccgcctgccctctccaaccgccgctaccccagtcagcggtccctgcccctcccgcccgtcccccctcgccgccgcgaccccaagaaccaccgcccgcagccttcccaagaggaagaacgaccgacagacagcggtccaaggagaacggctgccaccaacccggccttccgcgcgtcccacctccgtaccgcgtaccgcaagcccgtgcccccagccgcagccgccggcgaaggcgaggccctcctcgccgccgacccaaccgacgccgcctcggggcgcgccgtcgtcgtgggtccctcgggcctctccttccgcctccccggcgcgccgttcgacttccagttcagctactccgaggggccccgagccccgccgctcgccatccgggagccggccttcgtgcccttcgcgccgccgaccatgccgcggccctggacgggcaaggcgccgctgctgactaaggaggagaaggcgcgccgccggggcgtgcggctgcacacgccgctcgggcaggagccgccgcaaacggtgagcgcgcacgggatcatgatggaggtcagggacaggaggcaaatggacctggccagggtcagccccggtgatggcagaagcagggaggaggtgctcggtgagccgctcaccccatctgaggtgcgcgcgctcgtcaagccgcacatttcacacaaccggcagctcaacattggaagagatggcttgactcacaacatgttggaaatgatacattgtcattggaggcgccaggaaatctgcaaagttagatgccgaggcgttccaactgttgatatgaagaatctctgttatcatcttgaggaaaagtcaggtggaaaagtcattcaccgagtaggtggcgttgtttttgtgtatagaggaagacattatgatccgaagacccgtcctcactatccactaatgctctggaaacctgcgactcctgtgtatccaaaactcatcaaagaagttccagaagggcttacaaaagaagaagcagatgaaatgagaaggaaagggcgtgatcttctgccaatctgtaaattagccaaaaatggaatatacatcactcttgtcaaggatgtgcgagatgcttttgaaggaaatgaccttgtgaagattgactgtgagggtttgaatccaagtgactacaaaaagattggagcgaaactaagggatcttgttccctgtgttcttttatcatttgatgatgaacagatattaatgtacagaggcaaagaatggaaatccagatactcgaagcctcttactctcattccgaaagttccaaagaataatctggcaatgtcatctgacatgaatagttcagatgaagttagtgatgccaacactcaagttgcgataagagaagtattgagacccaaaatgtttaaattatggaagagtgcagtggactcatctctagcattgctgctggatgacgctgaagcaaatgatctcacacccgattcactgctgactttggttgaggagttcagcgtgacatctcaggcagtcgagcactcattccctgctctgcttgtgaccaatggtgaggtgaacaccgaatctctaagtgcagaatacataaatgatgatgagtctgaaacaagcattgctggaaacgaagagggccagctcgagcagtcacctgatctctctggcgatgaacattttgagcttgacatgcttgagcgtctggagtcatctgtgccattgggatcgctgccgattgacggcatgatagagcagctgaacagtgagtga

SEQ ID NO: 3226 - protein, 614 aa, Sorghum bicolor
  misc_feature: Ceres ANNOT ID no. 6029555
  misc_feature (236)..(319): Pfam Id: CRS1_YhbY Pfam Desc: CRS1 / YhbY domain
  misc_feature (354)..(437): Pfam Id: CRS1_YhbY Pfam Desc: CRS1 / YhbY domain
  misc_feature (1)..(614): NCBI GI: 30349369 NCBI Desc: crs2-associated factor 2 [zea mays]
  misc_feature (83)..(493): NCBI GI: 30349367 NCBI Desc: crs2-associated factor 1 [zea mays]
  misc_feature (227)..(454): NCBI GI: 115475115 NCBI Desc: os08g0188000 [oryza sativa (japonica cultivar-group)]
  misc_feature (227)..(454): NCBI GI: 143955290 NCBI Desc: crs2-associated factor 2, mitochondrial precursor
  misc_feature (39)..(109): NCBI GI: 115462513 NCBI Desc: os05g0194000 [oryza sativa (japonica cultivar-group)]
MPPPPPQGPAPSHAGRANLFSAPPPALSNRRYPSQRSLPLPPVPPRRRDPKNHRPQPSQEEERPTDSGPRRTAATNPAFRASHLRTAYRKPVPPAAAAGEGEALLAADPTDAASGRAVVVGPSGLSFRLPGAPFDFQFSYSEGPRAPPLAIREPAFVPFAPPTMPRPWTGKAPLLTKEEKARRRGVRLHTPLGQEPPQTVSAHGIMMEVRDRRQMDLARVSPGDGRSREEVLGEPLTPSEVRALVKPHISHNRQLNIGRDGLTHNMLEMIHCHWRRQEICKVRCRGVPTVDMKNLCYHLEEKSGGKVIHRVGGVVFVYRGRHYDPKTRPHYPLMLWKPATPVYPKLIKEVPEGLTKEEADEMRRKGRDLLPICKLAKNGIYITLVKDVRDAFEGNDLVKIDCEGLNPSDYKKIGAKLRDLVPCVLLSFDDEQILMYRGKEWKSRYSKPLTLIPKVPKNNLAMSSDMNSSDEVSDANTQVAIREVLRPKMFKLWKSAVDSSLALLLDDAEANDLTPDSLLTLVEEFSVTSQAVEHSFPALLVTNGEVNTESLSAEYINDDESETSIAGNEEGQLEQSPDLSGDEHFELDMLERLESSVPLGSLPIDGMIEQLNSE

SEQ ID NO: 3227 - DNA, 1812 bp, Sorghum bicolor
  misc_feature: Ceres ANNOT ID no. 6029562
  misc_feature: Encodes the peptide sequence at SEQ ID NO 3228
atgccttccccaacaccgggccacacgcgccgccgctcaccgccggcgatcaccgccctgctgccgcgtctccgcgccgccgctgggccgaccacgccgcgccgcctgctcctccagtccatggcagtggtcctcacctccgggctctcttcctcccaccccgcgctcgcctcccgcctcctcaactccctcctcccgcacgtccacgcccgccgcctcccggccctcctccgcctcctcccgcccgaccacctcacgctcctgctcctctcctccgccaagcaccaccgcgcccactccctccccgccgcctgcgcgctccacgccctcgccgtgtcctctggccacctcccctctgacctccgcctcgccaactccctcctctctctctacctctccaacggctccacggcctccgcgcgccgcctcctcgccgacatcccccgccccgacaccgtgacctggaacactctcctccgctcctgcctccgcatgggcctcctcccggcggcgcggcgcctgttcgacgaaatgccggagcgggatctcgtcacgtacaattccatgttgtctgggtacgcggtggagggagatatggccaacgccagggagctatttgatggaatgcccgagagggacgtggttacatggaactcaatgcttgctgggtatgcgcagcatggggacatggagaacgccaagaagatgtttgatgtaatgcctgtgagggatgttgtgtcatggaactcgatgctggatgggtatgcccagactggggacattgagatggcaagaatggttttcgatggcatgccgagaaggagcactgtgtcatggaatgtcattgttgcgctatacgcaaaggtgaaggactggcgtgagtgtttgaatctgtttgatgcgatgatggctgtgggggaatgcaaaccaaatgagaagacatttgtgagcgttttcacagcctgtgggaacctgggtgatcttgagaggggaagatgggtgcatcgcttggttcgtgagaggtgggagagacttattcctgacgtactactgcttactgctatgctgacaatgtatgccaagtgtggggtgatggggacagcaaaggagatatttgattctatgaccgaaaagagtgttgcatcctggaactcaatgatcatcgggtatgggttgcatgggctcagtgagaaggcccttgagttgttcatggagatggagaagaatgggcctcagccaaatgagacgactttcatctgcatcttgagctcctgtgcccatggaggcttggtgcttgaaggctggtggtgttttgataggatggtcaggttctacaatattgagcccaaggctgagcactttggctgtatgatggacctccttggtcgtgctggactgctcagagactcagagaagctcatcaagaatttgcaggcaaaggtgtcacctgcattatggggtgccctaatatcagcctctcgaactcaggacagctccaaacttggagaatttattggaactaagctgattgaaatgaggccaacagagttcagctcctacgtgcttctgtcaaacatttatgccgcggaaggaagatgggatgatgttgaaaaagtgaggaaggtgatgaaggagaaagtagtggataaagatgtggggatgagccttgtaagatcaagtgagcctggtcatgttgctgaagatgatatttcatatcaacagaattatgtgatgttttcgctgctgggtgagatgggtgtgcatgtgaaacaaccatctgaagtgttcaactataggagggaacctaattag

SEQ ID NO: 3228 - protein, 603 aa, Sorghum bicolor
  misc_feature: Ceres ANNOT ID no. 6029562
  misc_feature (153)..(187): Pfam Id: PPR Pfam Desc: PPR repeat
  misc_feature (215)..(249): Pfam Id: PPR Pfam Desc: PPR repeat
  misc_feature (381)..(415): Pfam Id: PPR Pfam Desc: PPR repeat
  misc_feature (1)..(603): NCBI GI: 51091564 NCBI Desc: pentatricopeptide (ppr) repeat-containing protein-like [oryza sativa (japonica cultivar-group)]
  misc_feature (9)..(557): NCBI GI: 20804987 NCBI Desc: selenium-binding protein-like [oryza sativa (japonica cultivar-group)]
  misc_feature (151)..(550): NCBI GI: 42407750 NCBI Desc: pentatricopeptide (ppr) repeat-containing protein-like [oryza sativa (japonica cultivar-group)]
  misc_feature (53)..(594): NCBI GI: 42409025 NCBI Desc: pentatricopeptide (ppr) repeat-containing protein-like [oryza sativa (japonica cultivar-group)]
  misc_feature (16)..(591): NCBI GI: 22293716 NCBI Desc: selenium-binding protein-like protein [oryza sativa (japonica cultivar-group)]
MPSPTPGHTRRRSPPAITALLPRLRAAAGPTTPRRLLLQSMAVVLTSGLSSSHPALASRLLNSLLPHVHARRLPALLRLLPPDHLTLLLLSSAKHHRAHSLPAACALHALAVSSGHLPSDLRLANSLLSLYLSNGSTASARRLLADIPRPDTVTWNTLLRSCLRMGLLPAARRLFDEMPERDLVTYNSMLSGYAVEGDMANARELFDGMPERDVVTWNSMLAGYAQHGDMENAKKMFDVMPVRDVVSWNSMLDGYAQTGDIEMARMVFDGMPRRSTVSWNVIVALYAKVKDWRECLNLFDAMMAVGECKPNEKTFVSVFTACGNLGDLERGRWVHRLVRERWERLIPDVLLLTAMLTMYAKCGVMGTAKEIFDSMTEKSVASWNSMIIGYGLHGLSEKALELFMEMEKNGPQPNETTFICILSSCAHGGLVLEGWWCFDRMVRFYNIEPKAEHFGCMMDLLGRAGLLRDSEKLIKNLQAKVSPALWGALISASRTQDSSKLGEFIGTKLIEMRPTEFSSYVLLSNIYAAEGRWDDVEKVRKVMKEKVVDKDVGMSLVRSSEPGHVAEDDISYQQNYVMFSLLGEMGVHVKQPSEVFNYRREPN

SEQ ID NO: 3229 - DNA, 1578 bp, Sorghum bicolor
  misc_feature: Ceres ANNOT ID no. 6029670
  misc_feature: Encodes the peptide sequence at SEQ ID NO 3230
atggccgaggtgaagcctgaggacatggtgcatcatcagcccatggaccagctccagggcttcgagtactgcatcgactccaatccttcctggggcgaagggattgcgttgggcttccaacactacatactgtccctgggcactgctgtcatgatccccacgttgctggttccgcttatgggtggaaatgatgatgacaaggccaaggtggttcaaacactgctatttgttaccgggatcaagacactgctccagacgctatttggcactcgtcttcccacaatcatgggaggttcgtacgcgtatgtggttccgatcctctccataatccgtgatccctcattcacgcagatagcggatggccatactagattcctgcagactatgagagccatacaaggttcactgattgtatcctcaagcatccaaataattcttggatatagccagttatgggcaatatgttctaggttctttagcccacttgggatggttcccgtggttgcattggtggggcttggccttttcgagagaggattcccagtggttgggaaatgcgtggagattagtcttccaatgcttatcctctttgttgcgctttcccagtatctcaagcacgtgaatattcatcatgttcctgttttggagaggttctcactgctgatgtgcatcgctcttgtatgggtatatgcccacatcctcacagcaagtggtgcatacaagcacacagcacttgtcacccagatcaactgtcggacagaccgtgccaatctcatatcttcatcacaatggataagcattccataccctttacaatggggtgcaccaacattcagtgcagaccatgcattcggtatgatggctgcggtgatggtttctttaatagagaccacgggagcattcaaagctgctgcacgattggctagtgcgacacccccaccagcatatgtcctgagcagaggcattgggtggcagggcattggcaccctactagatggcctgtttggcactgggactggttctactgtttctgttgagaacgttggtctcctagggtcaacaagggttggtagcagaagagtgatacaaatttctgctggtttcatgatcttcttctccattctaggaaaatttggagcgctttttgcctcaattcctttcacaatatttgctgccatttactgtgtcatgtttggaattgttgctgctgtggggctctcctttatgcagttcaccaacatgaactcaatgcgcagtctcttcatcatcggtgtctcactcttcctgggtttatctataccagagtacttctctcggtattccacaagttctcaacaaggcccagcgcacacgaaagctggatggttcaatgactacatcaacactatcttctcatcaccgcccactgtcgccctgtttgtagcagtactccttgacaacacacttgatgtaagagatgcagctagggaccgaggaatgccatggtgggcgcgtttcaggacattccgtggcgacagcaggaatgaagagttctacactctgcctttcaacctcaaccgattctttcccccaacataa

SEQ ID NO: 3230 - protein, 525 aa, Sorghum bicolor
  misc_feature: Ceres ANNOT ID no. 6029670
  misc_feature (32)..(439): Pfam Id: Xan_ur_permease Pfam Desc: Permease family
  misc_feature (265)..(525): NCBI GI: 115478518 NCBI Desc: os09g0320400 [oryza sativa (japonica cultivar-group)]
  misc_feature (78)..(525): NCBI GI: 115440067 NCBI Desc: os01g0759900 [oryza sativa (japonica cultivar-group)]
  misc_feature (5)..(523): NCBI GI: 89330191 NCBI Desc: leaf permease 1 [oryza sativa (japonica cultivar-group)]
  misc_feature (183)..(525): NCBI GI: 115476114 NCBI Desc: os08g0369000 [oryza sativa (japonica cultivar-group)]
  misc_feature (4)..(523): NCBI GI: 30696385 NCBI Desc: xanthine/uracil permease family protein [arabidopsis thaliana]
MAEVKPEDMVHHQPMDQLQGFEYCIDSNPSWGEGIALGFQHYILSLGTAVMIPTLLVPLMGGNDDDKAKVVQTLLFVTGIKTLLQTLFGTRLPTIMGGSYAYVVPILSIIRDPSFTQIADGHTRFLQTMRAIQGSLIVSSSIQIILGYSQLWAICSRFFSPLGMVPVVALVGLGLFERGFPVVGKCVEISLPMLILFVALSQYLKHVNIHHVPVLERFSLLMCIALVWVYAHILTASGAYKHTALVTQINCRTDRANLISSSQWISIPYPLQWGAPTFSADHAFGMMAAVMVSLIETTGAFKAAARLASATPPPAYVLSRGIGWQGIGTLLDGLFGTGTGSTVSVENVGLLGSTRVGSRRVIQISAGFMIFFSILGKFGALFASIPFTIFAAIYCVMFGIVAAVGLSFMQFTNMNSMRSLFIIGVSLFLGLSIPEYFSRYSTSSQQGPAHTKAGWFNDYINTIFSSPPTVALFVAVLLDNTLDVRDAARDRGMPWWARFRTFRGDSRNEEFYTLPFNLNRFFPPT

SEQ ID NO: 3231 - DNA, 1131 bp, Sorghum bicolor
  misc_feature: Ceres ANNOT ID no. 6029715
  misc_feature: Encodes the peptide sequence at SEQ ID NO 3232
atgaccgcgtcggcggaagagaccgctgtggcagctgggtcgtcgtccgtgcctgttcccgacgacgtttttgacggcggcgttgttgacctgccgtcctcatcggaagacgaaagcgacaacgaaggcgcggttcatggcgaggacgaagaggacgatctgagcgccgaggcggactacttcagcagcgacgaggagggcgacgacactggtgacgatgacgtcgtcgacagcgacagcgaatttgaagaggacgatgacgaggtgccgaaggtcgtcaagaacggcgtcggcgaggtggcggcagcaccatgcacgttccttgggcagccggcgcggatcgccaccgtccagagcacagtatgcttcgtgaacctcgccacttcctcggcgccaccctgtcagtgtcagtgtcatcacggcggcggcagcggcggcgaaatcatcgtcgactaccgctacacccgcttcttgcggacgcagagcggcggcgacggcgtcgacatgcacatcttgggtcccaaacaagcacgtctccgtttcgtgctcccctctcctttggcctccgactccgatccggagacagcgacgacggtgagcagctcgctgcgattcgccggcgccatgctggcatctctggtccaccccgcctgcttcagcgcgcagctccaggcgctgtggtcggtcacgacggtgccggtactcgtcccggcacgggccacgtgtctcctggtgaccgtcgacgtgggcatactccggcccagcgacttcacggcggcgcgcatgtggcgcatgtgcgaggcgctggagtccgtggctggcgagcgcgcggcgctgcccgccacgtcttttgagtttgacatcgccatcgagctccacctgcctgtgctcctcaggtcggaggaagatgtgcggccgacgaagcggcggaaggtcaccggggaagactgcccgatctgctgcgacgtgctcgaggagcaggggcgcctggcggcgtggccccggtgctcgcacatcttccacgccgggtgcttggagcagcaccttctcagggggtatcaggaatgccctttgtgcaggagtgaactgaagctcagcccgaccccccatcatgtggaaaatgaatactag

SEQ ID NO: 3232 - protein, 376 aa, Sorghum bicolor
  misc_feature: Ceres ANNOT ID no. 6029715
  misc_feature (317)..(359): Pfam Id: zf-C3HC4 Pfam Desc: Zinc finger, C3HC4 type (RING finger)
  misc_feature (294)..(372): NCBI GI: 140053320 NCBI Desc: zinc finger, ring-type [medicago truncatula]
  misc_feature (314)..(369): NCBI GI: 115445315 NCBI Desc: os02g0249300 [oryza sativa (japonica cultivar-group)]
  misc_feature (277)..(367): NCBI GI: 92893519 NCBI Desc: zinc finger, ring-type; ringv [medicago truncatula]
  misc_feature (304)..(376): NCBI GI: 72536737 NCBI Desc: at1g63840-like protein [arabidopsis lyrata]
  misc_feature (304)..(376): NCBI GI: 72536735 NCBI Desc: at1g63840 [arabidopsis thaliana]
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 468 in the 11/188,298 US application
  misc_feature: The sequence is a functional homolog of SEQ ID NO. 350 in the 11/188,298 US application
MTASAEETAVAAGSSSVPVPDDVFDGGVVDLPSSSEDESDNEGAVHGEDEEDDLSAEADYFSSDEEGDDTGDDDVVDSDSEFEEDDDEVPKVVKNGVGEVAAAPCTFLGQPARIATVQSTVCFVNLATSSAPPCQCQCHHGGGSGGEIIVDYRYTRFLRTQSGGDGVDMHILGPKQARLRFVLPSPLASDSDPETATTVSSSLRFAGAMLASLVHPACFSAQLQALWSVTTVPVLVPARATCLLVTVDVGILRPSDFTAARMWRMCEALESVAGERAALPATSFEFDIAIELHLPVLLRSEEDVRPTKRRKVTGEDCPICCDVLEEQGRLAAWPRCSHIFHAGCLEQHLLRGYQECPLCRSELKLSPTPHHVENEY

SEQ ID NO: 3233 - DNA, 1260 bp, Sorghum bicolor
  misc_feature: Ceres ANNOT ID no. 6029823
  misc_feature: Encodes the peptide sequence at SEQ ID NO 3234
atggccagaattagcagcttccatttggccaccgtactgcatgacatccaccagagacagcgagccgatggccccgcggcgatactgggcctcggcacggcaaacccgacgaactgcgtgctacaagaccacttcgctgactggtactttcacgtcaccaagagcgaccgcctcgcagagctcaaggccaagaccaagaagatttgtgacagatcaggaatcaagaagcgttatttttaccacaccgaggagatcatcggcggccacccggagttgatcgaccgcaccctgccgtcgctcaagacgaggttaagcatcatcgcggacgctgcgcccaacctcgcagcggaagcagcctcaagggcgatcgtggactggggccgtccggcggccgacatcaccgatcaaatcgtcgtcaccaactccggcgccaacgaacctggcgctgacctgcgccttgcagggttgcttggcctccgtccgaccgtgcgccgcaccctcctgtacctccacggatgctctgctggtcttaccgcgctccgcatcgctaaggacatcgctgagaacaaccgcggcgcccgcgtgctcgtggcctgcgctcaggccaagatcctgatgttcacttcaccggacgtcgacgccgcggccgacctggacaagatcatcgccatgacgctgttcgctgatggcgccggcgcagtcatcgtcggcgcggagccggcggcaagcagcagccccatccccatggagcggcccatcttccacatggtatccgcctcgcagacgacgttgccgggaacagaacaagcagtggtaatgaatctcagagagaacggccttgtggacagtcacttgtccgtcgaggtgccgaggcttgtctgcggcagcttggagcggtgcctagctgactcgctggcgccgctaggcctcgtgaacgcaagcgacggcgacggtggccggaacgggctcttctgggcggtgcacccaggcggccgtgccatcttggacagctacgaggcaactctcggtctggaacccgggaagcttgctgccagccggcacgtgctaagtgagtacggcaacatgatgggcgcgacggtcatctttgttcttgacgagatacgccgccgccgccgccgccgctgcgaagacgacgctaaggaaaagaactgccagtggggggtcatgtcggggctcggccctggactcacaatcgagacaattgtgttgcatgccacagacaggcaggacgaaaattag

SEQ ID NO: 3234 - protein, 419 aa, Sorghum bicolor
  misc_feature: Ceres ANNOT ID no. 6029823
  misc_feature (11)..(240): Pfam Id: Chal_sti_synt_N Pfam Desc: Chalcone and stilbene synthases, N-terminal domain
  misc_feature (255)..(414): Pfam Id: Chal_sti_synt_C Pfam Desc: Chalcone and stilbene synthases, C-terminal domain
  misc_feature (172)..(260): Pfam Id: ACP_syn_III Pfam Desc: 3-Oxoacyl-[acyl-carrier-protein (ACP)] synthase III
  misc_feature (13)..(377): NCBI GI: 115472461 NCBI Desc: os07g0525900 [oryza sativa (japonica cultivar-group)]
  misc_feature (9)..(412): NCBI GI: 6684404 NCBI Desc: chalcone synthase [arabis alpina]
  misc_feature (13)..(412): NCBI GI: 12002443 NCBI Desc: chalcone synthase [thlaspi arvense]
  misc_feature (13)..(412): NCBI GI: 29423731 NCBI Desc: chalcone synthase [brassica oleracea]
  misc_feature (9)..(412): NCBI GI: 6684405 NCBI Desc: chalcone synthase [arabis alpina]
MARISSFHLATVLHDIHQRQRADGPAAILGLGTANPTNCVLQDHFADWYFHVTKSDRLAELKAKTKKICDRSGIKKRYFYHTEEIIGGHPELIDRTLPSLKTRLSIIADAAPNLAAEAASRAIVDWGRPAADITDQIVVTNSGANEPGADLRLAGLLGLRPTVRRTLLYLHGCSAGLTALRIAKDIAENNRGARVLVACAQAKILMFTSPDVDAAADLDKIIAMTLFADGAGAVIVGAEPAASSSPIPMERPIFHMVSASQTTLPGTEQAVVMNLRENGLVDSHLSVEVPRLVCGSLERCLADSLAPLGLVNASDGDGGRNGLFWAVHPGGRAILDSYEATLGLEPGKLAASRHVLSEYGNMMGATVIFVLDEIRRRRRRRCEDDAKEKNCQWGVMSGLGPGLTIETIVLHATDRQDEN

SEQ ID NO: 3235 - DNA, 2331 bp, Sorghum bicolor
  misc_feature: Ceres ANNOT ID no. 6029890
  misc_feature: Encodes the peptide sequence at SEQ ID NO 3236
atggctcttgaaacggataaacaaaatcctagagaagccaaaaaacttggtggaaaatttcagcgtcatgactccctatatggggatgcagaaagagtatcaggcacaggataccatggctctgagtgcatcggagtgatatatggtgacataggcacatcaccgttgtatgtgtatgaaagcacctttacaagtggtatcaacaatgttgatgacctctatggagtcctgtcacttattctatacagcatgattcttctacctatgatcaagtatgtcttcattgtgctgtatgcaaatgacaacggcgatggtggcacgtttgcactttactcattgatatcacggtatgcaaaagtgagcttgattccaaatcagcaagcagatgatgcaatggtctcaaactatagcctagaaacagtgtcagcccctatgaagagggctcaatggacaaaaaagatgctggaaagcagtaaggtggctaaactcgtaattttcctccttaccgtactgggcacctcaatggttatcagtgatggtgttttgaccccagcaatatctgtgatctctgcggtaagtggtctccaacaaaaagcacctcatctgaaacaggatcaaatggtatggatctctgttgccattctggtggtgctgtttgctgttcagcgttttggcacagataaagttggctactcatttgcacccattattcttctgtggttcctgttcattggtggtattggaatttacaacttaatcaaatacgacatcggtgttctgagagctttctatccaaaatacatcatagactacttcaaaacgaatggaaaggatgcatggatctcccttggtggcatcctattatgctttacaggcacagaagcaatgtttgctgatctaggacatttcaacataaggtcgattcagctcagtttcagctttattctgttcccgtcagtgtcattagcttatattggtcaagcagcattccttcgtaaacacccagaacatgtttttgatactttctataaatcaattccaggaccactgttctggccaaccttcataattgctgtctctgctgcgataattgcaagccaagctatgatatctggttcattcgcaatcatttcacagtcacaaacattgggctgctttccaagggtcaaagtactccacacctcaaaactttatgaggggcaggtgtacattccggaagtaaactttgttcttgggtttctttgtgtgatagtaacattgggcttcaagacaacaactaatattggaaacgcatatggaatttgtgttacttctgtgatggttattacaactattctgcttgtagttgtgatggttctcatatggagggtgagcatttggctgattatacccttctgcctggtatttggttccatagagcttgtctatctttcttcagttctatacaaattcaaacagggaggttacctacctattgtggctgcaacaattctcgtgacaatcatgggtgtttggcattatgtccatgtgaagaaatactggtatgagcttgagcacatagttacaaataaagacatgggagaactcattcaagcacatgatgtaaaaagaactcctggggtaggcttcctgtatacagaattagtgcagggtgtcccaccaattttcccccacctcattgagaaaataccatttgttcattcaatcctagtgtttgtttccatcaaacacctgccgatccctcatgtcgaggttgcagaacgttttcgcttcaggaaagttgaatcaagaacctccaagatgttccggtgtgtggcacgatatgggtacagtgatagaattgaaggggcaaaggaatttgctgcttccctgattgaaggtctccaatcatatattgaagaagggcattttatgacaaacattcaggaaactgaggctgaaacaacctcaatcacagagagtaacacaagaacacgtaaagccagtagctccacggtgtacattgaagaggcactgaggccaagtgaaactacagatctcacccaacctcgcataagcagctactcaggacactcatctggaaggatcagtgaagaccaatcccgcacaattgcagaagaaaaacaatgtattcagagtgagctgcagaaaggagtggtctatattcttggagaaactgaaatccaggcaggaccaaattcttcctttttcaagaagattgttgtcaactacatgtactcgttcctgaggaagaacttcaggcaaggggagaaggcttttgcaatcccaaggcagcaggtgctcaaagtgggaatggtatatgaaatttaa

SEQ ID NO: 3236 - protein, 776 aa, Sorghum bicolor
  misc_feature: Ceres ANNOT ID no. 6029890
  misc_feature (43)..(776): Pfam Id: K_trans Pfam Desc: K+ potassium transporter
  misc_feature (1)..(776): NCBI GI: 12862380 NCBI Desc: high-affinity potassium transporter [phragmites australis]
  misc_feature (1)..(776): NCBI GI: 12862378 NCBI Desc: high-affinity potassium transporter [phragmites australis]
  misc_feature (1)..(776): NCBI GI: 12862384 NCBI Desc: high-affinity potassium transporter [phragmites australis]
  misc_feature (1)..(776): NCBI GI: 109390027 NCBI Desc: high-affinity potassium transporter [aeluropus littoralis]
  misc_feature (1)..(776): NCBI GI: 12862382 NCBI Desc: high-affinity potassium transporter [phragmites australis]
  misc_feature: The sequence is a functional homolog of SEQ ID NO. 279 in the 11/188,298 US application
MALETDKQNPREAKKLGGKFQRHDSLYGDAERVSGTGYHGSECIGVIYGDIGTSPLYVYESTFTSGINNVDDLYGVLSLILYSMILLPMIKYVFIVLYANDNGDGGTFALYSLISRYAKVSLIPNQQADDAMVSNYSLETVSAPMKRAQWTKKMLESSKVAKLVIFLLTVLGTSMVISDGVLTPAISVISAVSGLQQKAPHLKQDQMVWISVAILVVLFAVQRFGTDKVGYSFAPIILLWFLFIGGIGIYNLIKYDIGVLRAFYPKYIIDYFKTNGKDAWISLGGILLCFTGTEAMFADLGHFNIRSIQLSFSFILFPSVSLAYIGQAAFLRKHPEHVFDTFYKSIPGPLFWPTFIIAVSAAIIASQAMISGSFAIISQSQTLGCFPRVKVLHTSKLYEGQVYIPEVNFVLGFLCVIVTLGFKTTTNIGNAYGICVTSVMVITTILLVVVMVLIWRVSIWLIIPFCLVFGSIELVYLSSVLYKFKQGGYLPIVAATILVTIMGVWHYVHVKKYWYELEHIVTNKDMGELIQAHDVKRTPGVGFLYTELVQGVPPIFPHLIEKIPFVHSILVFVSIKHLPIPHVEVAERFRFRKVESRTSKMFRCVARYGYSDRIEGAKEFAASLIEGLQSYIEEGHFMTNIQETEAETTSITESNTRTRKASSSTVYIEEALRPSETTDLTQPRISSYSGHSSGRISEDQSRTIAEEKQCIQSELQKGVVYILGETEIQAGPNSSFFKKIVVNYMYSFLRKNFRQGEKAFAIPRQQVLKVGMVYEI

SEQ ID NO: 3237 - DNA, 2220 bp, Sorghum bicolor
  misc_feature: Ceres ANNOT ID no. 6029901
  misc_feature: Encodes the peptide sequence at SEQ ID NO 3238
atgtctctagaagttgagaacccaccaggaatagagacgaccaaacagctcaagcgacaggactcgctttatggtgatgcagaaaaggtctctagcttcaagcatcatggctctgagggaggctggtcgcggttgctgcatcttgcatttcagagcattggtatcatctatggggacgttgggacatcaccactctatgcgatatccagcaccttccctgatggcatcaagaaccacgatgacctccttggcgtcctctccctcatcctctacaccctcatcctgataccaatggtcaagtacgtcttcattgtgctttatgcagatgacaatggagatggtggcacgtttgctctctactcacttatatcacggcatgccaaggtaaggctgataccaaaccagcaggctgaggatgctatggtgtcaaattatggcattgaagcacccaattcgcaactgaggagggcgcagtggctgaagcagaagctcgagtctagcaaggcagcaaagattggcctctttaccattacaatccttggcacatcaatggtgatgggggatggaaccttgacaccagcaatttctgtgctctctgcagtgagtgggattagagagaaggtgccaagcttaactgaaacgcaggtagtctggatttcagtgccaattttgtttgcgctcttctcagtccagcgctatggtacagacaaggttgggtattcctttgctccgatcatcacagtgtggttttttcttattgctgccattggaatgtataacctcgttgtgcatgagatcggtgttcttcgagccttcaatccaatgtacatagtagattacttcagaagaaacgggaaggaaggatgggtttcactgggtggtgttatcttgtgtgtcacagacctaagccatttcagtatcaaggccattcagatcagctttagcactgtcttattgccctcggtggcactgtgttacatcgggcagacagcttatctgagaaaattcccagaaagtgtcgcagacactttctttagatcaatcccagagataatgttctggccaaccttcattattgccattctttcggctatcattgcaagccaagctatgctgtcaggcgcattcgccatcctctccaaggctttatcccttggctgtttccccagtgttcaagtggttcatacctcaaagagctatgcgggccaggtttacattcctgaagtgaactttttgatgggattagcaagcatcatagtcacgataaccttcagaaccaccaccgaaattggcaatgcttatgggatctgtgttgtgactgtgttctcaatcaccacccacttgacgactattgtgatgttactcgtatggaggaaaaggtttatcttcatcttgcttttctatgtggtgttcagctccatagagctgatttacctctcatccatactgacgaagttcatccaaggtgggtacctgccattctgcttctcacttgtcctcatggccttaatgataacatggcactacgtccacgtcatgaagtactggtatgagctggaccatatcgtgccagctgatgaagtgacagcactgcttgagaagcatgaagtgcggcggatccccggggtgggcctcctttactcagacctggttcaaggcattccccctgtatttccacgtctagtgcagaggataccctctgtgcactcggtcttcctgttcatgtcgatcaagcacctgcctatcccacatgtggctcctgtggagcggttcctctttcggcaagtcggcccaagggagcaccgcatgttccggtgtgtggcgaggtatgggtacagtgacatgctagaagagtcggtgttgttcaaagggttcctcacggagaggctaaaaatgttcatccaggaagaggctgtgtttgcgacgaactctacagccggggatacccagacaagtcccaatgaggatgggaacatcagctctgatttggatctttgggtcaaaaaggaaaagcaaatgattgacacggagatggagcgaggggtggtctaccttatgggcgaagccaatgtcatagcaggaccaaattcatctgccgcaaaaaagatagtcgtagaccatgtctatacattcttgagaaagaacttgacggaaggggagaaagtgctctccattccaaaagaccaactactcaaagtagggataacatacgagatatag

SEQ ID NO: 3238 - protein, 739 aa, Sorghum bicolor
  misc_feature: Ceres ANNOT ID no. 6029901
  misc_feature (47)..(739): Pfam Id: K_trans Pfam Desc: K+ potassium transporter
  misc_feature (1)..(656): NCBI GI: 12862382 NCBI Desc: high-affinity potassium transporter [phragmites australis]
  misc_feature (1)..(656): NCBI GI: 12862380 NCBI Desc: high-affinity potassium transporter [phragmites australis]
  misc_feature (1)..(656): NCBI GI: 12862378 NCBI Desc: high-affinity potassium transporter [phragmites australis]
  misc_feature (1)..(656): NCBI GI: 12862384 NCBI Desc: high-affinity potassium transporter [phragmites australis]
  misc_feature (1)..(648): NCBI GI: 109390027 NCBI Desc: high-affinity potassium transporter [aeluropus littoralis]
  misc_feature: The sequence is a functional homolog of SEQ ID NO. 279 in the 11/188,298 US application
MSLEVENPPGIETTKQLKRQDSLYGDAEKVSSFKHHGSEGGWSRLLHLAFQSIGIIYGDVGTSPLYAISSTFPDGIKNHDDLLGVLSLILYTLILIPMVKYVFIVLYADDNGDGGTFALYSLISRHAKVRLIPNQQAEDAMVSNYGIEAPNSQLRRAQWLKQKLESSKAAKIGLFTITILGTSMVMGDGTLTPAISVLSAVSGIREKVPSLTETQVVWISVPILFALFSVQRYGTDKVGYSFAPIITVWFFLIAAIGMYNLVVHEIGVLRAFNPMYIVDYFRRNGKEGWVSLGGVILCVTDLSHFSIKAIQISFSTVLLPSVALCYIGQTAYLRKFPESVADTFFRSIPEIMFWPTFIIAILSAIIASQAMLSGAFAILSKALSLGCFPSVQVVHTSKSYAGQVYIPEVNFLMGLASIIVTITFRTTTEIGNAYGICVVTVFSITTHLTTIVMLLVWRKRFIFILLFYVVFSSIELIYLSSILTKFIQGGYLPFCFSLVLMALMITWHYVHVMKYWYELDHIVPADEVTALLEKHEVRRIPGVGLLYSDLVQGIPPVFPRLVQRIPSVHSVFLFMSIKHLPIPHVAPVERFLFRQVGPREHRMFRCVARYGYSDMLEESVLFKGFLTERLKMFIQEEAVFATNSTAGDTQTSPNEDGNISSDLDLWVKKEKQMIDTEMERGVVYLMGEANVIAGPNSSAAKKIVVDHVYTFLRKNLTEGEKVLSIPKDQLLKVGITYEI

SEQ ID NO: 3239 - DNA, 1377 bp, Sorghum bicolor
  misc_feature: Ceres ANNOT ID no. 6029928
  misc_feature: Encodes the peptide sequence at SEQ ID NO 3240
atggaagtgaaggtgatgagctctaggcttgtcaagccgtcctatccaccaggtgtgccacaaccagacaccaccgagcatgtgccttgttcggtgttcgacaagatcacataccacatacagatggccatcatctacgcgttctcgccgccggtgccttccatcgccgacattgagcatggcctcgccgccgtgctgggtgtgtaccgggcgttcgctggccaggtccgtccgggcccggccgatggcgagctcggcgtgctgctcaacgaccatggcgcgcgactcatcgaggcgtccgtggacgcccgccttgctgatgttgcaccagcgaagccatcgcctgacgtgcagctgctgcaccctgggttacatgacgccgagatcgaggaggtggtgcaggtgcagctcacgaggttcggatgcggctcgctcatggtggggttcaccgcgaaccacgccgtcgccgacggtcgtgccaccagcaacttcctcgtcgcgtggggccgcaccgtgcgcggggtcccgatcggtcttccgccgcccctgcaccaccacccggggctcttccggctccgagacccgccgcgctttgagttcgagcaccgcggcgtggagttccatgaccgccgcccgaccccgacgacgccggcggcggcatcatccttcctcacggcggcacacggtgagacgaagacgacccgccacgacatcgtgatccacaaggcgcatttcactaaggaattcatcgccgcgctccgcgccaaggcatcagaaggccgccgccaccaccaccaccatttcagccggttcgagaccatcgtcggccatgtgtggcgtgccatgacgcgcgcacggggcctcggtgacggcggtggtgacccgtgccaggcgtctgccatacgactctccgtcgacgggcggccacgcctcggggtgccagaggcatacttcggcaacctcgtgctctgggcgttcccgcgcaccacggtgggcaacctgttgacacagccgctaacccatgcggcgcaggtgatccacgatgcggtgaagcaggtggacgatgcctacttccagtccttcgtggacttcgcgagctccggcgtggtggaggaggagggattggagacgacagccgtgctcaccagggacgtgctgtgcccggatctagatgtcgatagctggctcacgttcccattccaggagctagacctgggcaccggcggcccgtcctacttcatgccgccctacatccccacagaggggatgttcttcctcgtgccgtcgtgccttggtgatggcagtgtcgacgccttcgtgcctgtgttcaagcatagccttgaggccttcaagcaatgctgctgctccgtggagtag

SEQ ID NO: 3240 - protein, 458 aa, Sorghum bicolor
  misc_feature: Ceres ANNOT ID no. 6029928
  misc_feature (1)..(457): Pfam Id: Transferase Pfam Desc: Transferase family
  misc_feature (1)..(454): NCBI GI: 32488652 NCBI Desc: osjnba0087o24.2 [oryza sativa (japonica cultivar-group)]
  misc_feature (1)..(454): NCBI GI: 115461142 NCBI Desc: os04g0664600 [oryza sativa (japonica cultivar-group)]
  misc_feature (179)..(458): NCBI GI: 32488651 NCBI Desc: osjnba0087o24.1 [oryza sativa (japonica cultivar-group)]
  misc_feature (245)..(458): NCBI GI: 77552229 NCBI Desc: transferase family [oryza sativa (japonica cultivar-group)]
  misc_feature (1)..(458): NCBI GI: 115451197 NCBI Desc: os03g0185700 [oryza sativa (japonica cultivar-group)]
MEVKVMSSRLVKPSYPPGVPQPDTTEHVPCSVFDKITYHIQMAIIYAFSPPVPSIADIEHGLAAVLGVYRAFAGQVRPGPADGELGVLLNDHGARLIEASVDARLADVAPAKPSPDVQLLHPGLHDAEIEEVVQVQLTRFGCGSLMVGFTANHAVADGRATSNFLVAWGRTVRGVPIGLPPPLHHHPGLFRLRDPPRFEFEHRGVEFHDRRPTPTTPAAASSFLTAAHGETKTTRHDIVIHKAHFTKEFIAALRAKASEGRRHHHHHFSRFETIVGHVWRAMTRARGLGDGGGDPCQASAIRLSVDGRPRLGVPEAYFGNLVLWAFPRTTVGNLLTQPLTHAAQVIHDAVKQVDDAYFQSFVDFASSGVVEEEGLETTAVLTRDVLCPDLDVDSWLTFPFQELDLGTGGPSYFMPPYIPTEGMFFLVPSCLGDGSVDAFVPVFKHSLEAFKQCCCSVE

SEQ ID NO: 3241 - DNA, 1239 bp, Sorghum bicolor
  misc_feature: Ceres ANNOT ID no. 6029982
  misc_feature: Encodes the peptide sequence at SEQ ID NO 3242
  misc_feature: Up-regulated in shoot tissues in response to methyl jasmonate treatment
  misc_feature: Up-regulated in root tissues in response to methyl jasmonate treatment
atggtttcggatgataaattcgaagaacaggcagcacgcgacggcggtatcatcaagaatggaagggaaatcctattccaggcttttaactgggaatcaaataagcataactggtggaggaatttggaggagaaagttactgatcttgcagaatctgggtttacgtcagtgtggcttcctccaccaacacagtcattatctcgagaaggctatctaccacagaacctgtactgccttgactcatgttatggttccctccacgagctaaaatcgttgcttcataaaatgagcgaacacaatgtaagggctatggcagatgttgttctcaaccatcgaattgggactactcaaggatccaatggcatgtataatcgttatgatggcatcccaatatcatgggatgaacatgctgttacatcttgttctggtgggaagggaaacaagagcactggggataactttgatggggttcccaacatagatcatacacaaccatttgtacgcaaagatattatcgaatggttgatctggcttcgaaaatctgttggttttcaagattttcgctttgatttcacgaaaggttacgcagccaagtttgtgaaagaatacattgaggaatcaaaacctctttttgcagttggggaatactgggatagctgtgaatatagcccccctgactaccgactgaactataatcaagatagccataggcagaaaattattaattggatagataacactggaggactttgtgccgcatttgatttcacgacaaagggtattcttcaggaagctgtcaaaggagagttgtggcgtttgcgagacccagaaggaaaaccacctggtgtgatgggatggtggccttcaagatcagttacatttattgaaaatcatgacactgggtccactcagggtcattggccttttccatctgatcatattatggagggatatgcttatatactcacccaccctggcatccccacggtgttctatgatcacttctatgaccagggagtgcctctccatgatgaaattgctaaactgatgcaaatcaggaaatgccaagacatacatagccgttcatcaatcaaaattctggaggttaggtcagatctgtactcagcaatcatcgacgataagttgtgcatgaagatcggggacggctcgtggtgcccaagcgatccagagtggatgctggcagtctctggcgacagatatgctgtatggcacaagtga

SEQ ID NO: 3242 - protein, 412 aa, Sorghum bicolor
  misc_feature: Ceres ANNOT ID no. 6029982
  misc_feature (23)..(353): Pfam Id: Alpha-amylase Pfam Desc: Alpha amylase, catalytic domain
  misc_feature (354)..(412): Pfam Id: Alpha-amyl_C2 Pfam Desc: Alpha-amylase C-terminal beta-sheet domain
  misc_feature (1)..(412): NCBI GI: 38346145 NCBI Desc: osjnbb0118p14.5 [oryza sativa (japonica cultivar-group)]
  misc_feature (2)..(412): NCBI GI: 115458194 NCBI Desc: os04g0403300 [oryza sativa (japonica cultivar-group)]
  misc_feature (3)..(412): NCBI GI: 60652323 NCBI Desc: cytosolic alpha-amylase [malus x domestica]
  misc_feature (18)..(412): NCBI GI: 52851182 NCBI Desc: alpha-amylase [plantago major]
  misc_feature (3)..(412): NCBI GI: 7532799 NCBI Desc: alpha-amylase [malus x domestica]
  misc_feature (24)..(410): SWISSPROT Homolog: EC 3.2.1.1 Alpha-amylase precursor
  misc_feature: Up-regulated in shoot tissues in response to methyl jasmonate treatment
  misc_feature: Up-regulated in root tissues in response to methyl jasmonate treatment
MVSDDKFEEQAARDGGIIKNGREILFQAFNWESNKHNWWRNLEEKVTDLAESGFTSVWLPPPTQSLSREGYLPQNLYCLDSCYGSLHELKSLLHKMSEHNVRAMADVVLNHRIGTTQGSNGMYNRYDGIPISWDEHAVTSCSGGKGNKSTGDNFDGVPNIDHTQPFVRKDIIEWLIWLRKSVGFQDFRFDFTKGYAAKFVKEYIEESKPLFAVGEYWDSCEYSPPDYRLNYNQDSHRQKIINWIDNTGGLCAAFDFTTKGILQEAVKGELWRLRDPEGKPPGVMGWWPSRSVTFIENHDTGSTQGHWPFPSDHIMEGYAYILTHPGIPTVFYDHFYDQGVPLHDEIAKLMQIRKCQDIHSRSSIKILEVRSDLYSAIIDDKLCMKIGDGSWCPSDPEWMLAVSGDRYAVWHK

SEQ ID NO: 3243 - DNA, 1395 bp, Sorghum bicolor
  misc_feature: Ceres ANNOT ID no. 6029984
  misc_feature: Encodes the peptide sequence at SEQ ID NO 3244
  misc_feature: Down-regulated in shoot tissues in response to aminocyclopropane carboxylic treatment
  misc_feature: Up-regulated in root tissues in response to salicylic acid treatment
atggcggagtcatcgagctcgaggggcaagaggataaggttagaggaggaatcccaccgattcggaggagatcgtggggaagaaagtatctatgccgatgagatcgggcgcctccccgacgacatgctcacaaatatcatcaccctcctccccaccagagacggcgcccgcacgcacgccatctcccggcgatggcggcccctctggcgcgccgcgcctctcaacctgcaggtggatcgcagcctctccggccaggatcgcaagcgtatcatctttgtccctaagatccttgccgatcaccccggcccagcccgccgcttggcactccccatgatccgccttcgcaaccgctacgcccagatcgacggctggttgcgctcgcaagctctcacaggcctccaggagatcaagttctgctacgaggtcgaggacccggaggtgccgtaccctctgccgccttctgcgttacgcttcgcgcccaccctctgcgtagccgagttttgctgctgcgacttccccaatgagatggcgctgtcgctgaactttccctgcctcaagaaccttactctgaacagagcctccatgtcggaggccgcccttcactgcctgctgtctagttgccctgttctggagagcctctggttggaagggaacgtcggcgttggctgcctccacattaactcggcaactcttatgagcatcagcttcagagctttatcctcttggaacagagttagaaatcctatcatgctccaagagcttgtcatcgaagatgccccttgccttcaaaaattgctactgattgatccgaaaaatggtcctgcaaccattctctgcttttctatatgctgcctagtaattgtgcctaatgtctcttgtttttgttttcaaaattttcaccaggaaatggttgccctaagcttgacaaccttgatgcccactgtaaaggtcttgtcacttgtctctttgggacctaatctggactcagttgttcattttctcaagtgtttcccttgtgtggagaagctatatatcacgtctcacacacaaaagaatatgaaaaatgcacggagctatgatccactgaatccaatcgaatgtctcgagcttcatctcaaaaaagttgtcatcaataattatcatggcatgaggcctgacgtcgactttgccaagttctttgttttgaatgcaaaaatgttaagggaaatgatttttggagtcaccaaccactgcagtgataagtggatgtctaatcaacgcagacgtcttcaactagacaacaaagcttcacaaggcgctcaatttgcattcggacgtgattacagcatgtctatcaccaggtctcctaaacctgatgatccctttgagtgtatggaaccaggaaaatttccttag

SEQ ID NO: 3244 - protein, 464 aa, Sorghum bicolor
  misc_feature: Ceres ANNOT ID no. 6029984
  misc_feature (358)..(407): Pfam Id: FBD Pfam Desc: FBD
  misc_feature (33)..(460): NCBI GI: 115471573 NCBI Desc: os07g0287000 [oryza sativa (japonica cultivar-group)]
  misc_feature (67)..(358): NCBI GI: 34395388 NCBI Desc: ribosomal rna apurinic site specific lyase-like protein [oryza sativa (japonica cultivar-group)]
  misc_feature (70)..(437): NCBI GI: 50509648 NCBI Desc: ribosomal rna apurinic site specific lyase-like [oryza sativa (japonica cultivar-group)]
  misc_feature (33)..(457): NCBI GI: 6513849 NCBI Desc: ribosomal rna apurinic site specific lyase [triticum aestivum]
  misc_feature (33)..(409): NCBI GI: 20521321 NCBI Desc: ribosomal rna apurinic site specific lyase-like [oryza sativa (japonica cultivar-group)]
  misc_feature: Down-regulated in shoot tissues in response to aminocyclopropane carboxylic treatment
  misc_feature: Up-regulated in root tissues in response to salicylic acid treatment
MAESSSSRGKRIRLEEESHRFGGDRGEESIYADEIGRLPDDMLTNIITLLPTRDGARTHAISRRWRPLWRAAPLNLQVDRSLSGQDRKRIIFVPKILADHPGPARRLALPMIRLRNRYAQIDGWLRSQALTGLQEIKFCYEVEDPEVPYPLPPSALRFAPTLCVAEFCCCDFPNEMALSLNFPCLKNLTLNRASMSEAALHCLLSSCPVLESLWLEGNVGVGCLHINSATLMSISFRALSSWNRVRNPIMLQELVIEDAPCLQKLLLIDPKNGPATILCFSICCLVIVPNVSCFCFQNFHQEMVALSLTTLMPTVKVLSLVSLGPNLDSVVHFLKCFPCVEKLYITSHTQKNMKNARSYDPLNPIECLELHLKKVVINNYHGMRPDVDFAKFFVLNAKMLREMIFGVTNHCSDKWMSNQRRRLQLDNKASQGAQFAFGRDYSMSITRSPKPDDPFECMEPGKFP

SEQ ID NO: 3245 - DNA, 921 bp, Sorghum bicolor
  misc_feature: Ceres ANNOT ID no. 6029990
  misc_feature: Encodes the peptide sequence at SEQ ID NO 3246
atggcgccctccccgctgctcgtccggccgccggcgatggcgaattcaccccttccgcctccccgatgcgcggccgcggtggcagcggcgccggcggtacggacggctcccgcggccccactctctaggctccgtaccaagtgtaggttcgccgcatcggatgtgagagaagactactcttccaccccgatagatattgtcgctgatgtgaagacggagaagattgtggtgttgggaggaagtggattcgttggctctgcgatctgcaaagctgctgtcgcgacaggcattgaggttgtgagcttcagcaggtcaggaagaccagcttactctgatccctgggttgatcaagtcaattggctagcaggagatgttttctatgcaagatgggatgaagtattggttgggtctaccgctgttgtgtctacccttggaggatttggcaatgaagaacaaatgaaaaggataaatggtgaggcaaatgtcatagcagtaaacgctgcaaaagaatatggagtgccgaaattcattttaatctctgttcatgattacaatcttccatcctttcttcttacatcgggttacttcactggtaagagaaaggcggaatctgaagtcctttccaaatacccagcctcaggtgttgtgttgaggccaggcttcatttacggtaaaaggaaagtaaatggctttgaggtaccgctggacgctgttggacagccattggagaggctgctctcctctgttgaaaatttcaccaaaccattgaactcactgcctgcctctgacctaatccttgcaccccctgtgagcgtggacgatgttgcctatgcagtaatcaacggagtcgtagatgacagcttctttggggtgttcaccattgaacaaatcaaggaagccgcagccaaggtaagagtgtga

SEQ ID NO: 3246 - protein, 306 aa, Sorghum bicolor
  misc_feature: Ceres ANNOT ID no. 6029990
  misc_feature (75)..(278): Pfam Id: Epimerase Pfam Desc: NAD dependent epimerase/dehydratase family
  misc_feature (1)..(306): NCBI GI: 38346147 NCBI Desc: osjnbb0118p14.7 [oryza sativa (japonica cultivar-group)]
  misc_feature (73)..(288): NCBI GI: 46389859 NCBI Desc: dehydrogenase-like protein [oryza sativa (japonica cultivar-group)]
  misc_feature (37)..(299): NCBI GI: 83757807 NCBI Desc: 3-beta hydroxysteroid dehydrogenase/isomerase family [salinibacter ruber]
  misc_feature (74)..(155): NCBI GI: 6323321 NCBI Desc: ylr290cp [saccharomyces cerevisiae]
  misc_feature (74)..(145): NCBI GI: 3395590 NCBI Desc: spcc1840.09 [schizosaccharomyces pombe]
MAPSPLLVRPPAMANSPLPPPRCAAAVAAAPAVRTAPAAPLSRLRTKCRFAASDVREDYSSTPIDIVADVKTEKIVVLGGSGFVGSAICKAAVATGIEVVSFSRSGRPAYSDPWVDQVNWLAGDVFYARWDEVLVGSTAVVSTLGGFGNEEQMKRINGEANVIAVNAAKEYGVPKFILISVHDYNLPSFLLTSGYFTGKRKAESEVLSKYPASGVVLRPGFIYGKRKVNGFEVPLDAVGQPLERLLSSVENFTKPLNSLPASDLILAPPVSVDDVAYAVINGVVDDSFFGVFTIEQIKEAAAKVRV

SEQ ID NO: 3247 - DNA, 1566 bp, Sorghum bicolor
  misc_feature: Ceres ANNOT ID no. 6029992
  misc_feature: Encodes the peptide sequence at SEQ ID NO 3248
atggtggacgtagaactgttctataaggacactagcgatcacagcatcagctctgaggaagaagatatgcttatcaggagttgtagcaatctcaatgtgagttttggataccattgtgattcttctcagagcttttctcctgaaaatgatcatgggaatggcatttctcctaagaacatatttgggactaataccatgatcgggtcacgaaatggctcatttacttgtttatctggtgctgctattagtgcaaattttacactggcaaacacaaatatttgcaatggtcttattggtgaagaaattttaccagaactagattctccaaactccttcagaaaaatcgtttcttctccatcaatgtcaagattggactcatactccacctcacaaggcagccctgtgtcaactgagagctctatatttgagatcagtaaaaatctttggaggtccagtgccccaacaactgtatcatccaattttctgactaatacagaggtgaaaatggctggcggagctgctggagaggatagagtccaagctgtgtgctcagagaaaaatggatggctgatttgtggaatatatgatgggtttaatgggagggatgcagctgattttctcgcggtaactctgtatgataacatagtatattacttgtacctgctggagaatcggataaagcaacaaaatggtttatacaattcatcagaaacctctctcaatggccttaaaagcgagttaacactagccatgagaaattcagaaaatgaagacataaaattttctgaaacatttcgagctggtgtgctgaattgcctttctactgctgttgagcaagctgagaatgactttttatgcatggttgaacaagagatggatgataggccagatttagtttcagtagggtcttgtgttctggttgttcttcttcatggaacagatctgtgcatcttaaatttgggggacagtagagctgtgcttgcttccatgccatatgtacaaaatggtgctttgaaggctactcagctgacagagacccactcgcttgaaaatcctttggagtaccaaagacttttagctgaccatcccgacgattcttcagttgtcaggggtaacaaaataaaaggaaagttgaaggttactcgtgcttttggagttggctatctaaagcagaggaagttcaatgatgcactgatgggcattctacgagtccgcgatttgagcagccctccatatgtttacacaaatccacacacattgagtcacaaagttacagatgatgacttgtttgttgtgctcggtagtgatggcttatttgatttcttcagtaatgatgaagttgtttggttggtttatcaatttatgcgtgataatccaatgggggatcctgcaaaatatctcattgagcaacttatactcaaagcagccaaggaagcagctttaacagccgaagaattgatgaggatacctgttgggagtaggaggaagtaccatgatgatgtgaccgtcattgttatcatccttggaaatgcacagaggacgatgactgcatcaacttccttgtga

SEQ ID NO: 3248 - protein, 521 aa, Sorghum bicolor
  misc_feature: Ceres ANNOT ID no. 6029992
  misc_feature (155)..(484): Pfam Id: PP2C Pfam Desc: Protein phosphatase 2C
  misc_feature (1)..(499): NCBI GI: 115458200 NCBI Desc: os04g0403600 [oryza sativa (japonica cultivar-group)]
  misc_feature (338)..(508): NCBI GI: 30690552 NCBI Desc: protein phosphatase 2c family protein / pp2c family protein [arabidopsis thaliana]
  misc_feature (338)..(508): NCBI GI: 8439909 NCBI Desc: it contains protein phosphatase 2c domain pf00481. ests gbh36120 and gb36519 come from this gene. [arabidopsis thaliana]
  misc_feature (317)..(512): NCBI GI: 42569633 NCBI Desc: protein phosphatase 2c family protein / pp2c family protein [arabidopsis thaliana]
  misc_feature (281)..(508): NCBI GI: 7329635 NCBI Desc: protein phosphatase 2c-like protein [arabidopsis thaliana]
  misc_feature: The sequence is a functional homolog of SEQ ID NO. 448 in the 11/188,298 US application
MVDVELFYKDTSDHSISSEEEDMLIRSCSNLNVSFGYHCDSSQSFSPENDHGNGISPKNIFGTNTMIGSRNGSFTCLSGAAISANFTLANTNICNGLIGEEILPELDSPNSFRKIVSSPSMSRLDSYSTSQGSPVSTESSIFEISKNLWRSSAPTTVSSNFLTNTEVKMAGGAAGEDRVQAVCSEKNGWLICGIYDGFNGRDAADFLAVTLYDNIVYYLYLLENRIKQQNGLYNSSETSLNGLKSELTLAMRNSENEDIKFSETFRAGVLNCLSTAVEQAENDFLCMVEQEMDDRPDLVSVGSCVLVVLLHGTDLCILNLGDSRAVLASMPYVQNGALKATQLTETHSLENPLEYQRLLADHPDDSSVVRGNKIKGKLKVTRAFGVGYLKQRKFNDALMGILRVRDLSSPPYVYTNPHTLSHKVTDDDLFVVLGSDGLFDFFSNDEVVWLVYQFMRDNPMGDPAKYLIEQLILKAAKEAALTAEELMRIPVGSRRKYHDDVTVIVIILGNAQRTMTASTSL

SEQ ID NO: 3249 - DNA, 2217 bp, Sorghum bicolor
  misc_feature: Ceres ANNOT ID no. 6030008
  misc_feature: Encodes the peptide sequence at SEQ ID NO 3250
  misc_feature: Up-regulated in shoot tissues in response to salicylic acid treatment
atggcccagcatatatacgccaccaactgcgggtgtgcccgccccgcgatcccgctactactgctgcccgcgccgaccctcctccctctccctctcgcctcctcctcgtctcggttgcggcgccggagggctggtgccatgggcgcgagcgatcacctggcggcggcggcggccgccgccaagccgcggaacggcaggccgtgcgcggccgtgctgggcgagccgctgccggcgctcgacgaccccggcctcctcgtccaccccagcgccgacttcgccgcccaggcgctcgtctcctccacacagcagtaccgggagatgtatcaaaagtcgatcgacgacccagctgggttctggtcggagatcgcggatgagttctactggaagcagaagtggagccctgatgaagtttgtgcggagaacctcgacgtgaccaaggggccgatcaagattgaatggttcaaggggggaaagaccaacatatgctacaatgcggtggaccgccatgtggaggctgggaatggggacaagattgccatgtactgggaggggaatgagcccagtcaggatgggaagctcacctactctgagctcctggaaaaggtttgccagctgtcgaattacttgaaaagcgtcggcgttggaaagggtgatgccgtggtgatctacctaccaatgttgatggagctgccgattgcaatgcttgcatgtgcccgcattggtgctgttcactcggttgtgtttgctggcttctcagccgaggcactggcccaacgagttattgattgcaagcctaaggttgttattacctgcaatgctgtgaaaagggggttgaaaatcatctttctcaaagatatagtagatgcatctctggatgaaagtgcaaagaatggagttgatgtaggcatttgcttgacatacgaaaaccagtccgcgctgaataaagtagacacgcgatggacaacaggaagagatgtttggtggcaggatgttgtgcccgatttcccaactaaatgtgatgtggaatgggttgatgcagaggatccactgtttcttttgtacacaagtggcagcacaggaaagccaaagggtgtgttgcatacaactgggggctatatggtctactctgctacaacatttaagcatgcatttgactacaagccaacagacatatactggtgcactgcagattgtggctggattactggacatagttatgtgacatatggtccactattgaatggagccacagttcttgtttttgaaggggctccaaattaccctgatcctggtcgctgttgggacatcgttgataaatatggagtgacaatattttatactgcaccaacacttatacgctcgcttatgcgtgatggtactgagtatgttgctcggtactctcgcaagtccctccgagtgcttggaagtgtgggtgagccaatcaaccccaccgcatggaggtggttctatgatgttattggcgactcacgatgccctatatcagatacttggtggcagactgaaactgggggattcatgataactccattacctggtgcttggcctcaaaagccaggatcagcaacatttcctttcttcggtgtgcagccagtcattgttgacgagaaaggtcgggaaatggaaggagaatgcagtgggtatctttgcataaagaaatcgtggcctggggctttccggactctatatggagataaagagagatatgagacgacatacttcaaaccatttgctggatattatttctcgggtgatggctgcagcagggataaagatggttaccactggctgactggaagagttgatgatgttatcaatgtgagtggacaccggattgggacagccgaagttgagtctgctctggtttcacatccaaaatgtgccgaggccgctgttgttggtattgatcacgaggttaaaggtcagggaatatatgctttcgtgactttggtagatggtgttccctacagtgacgatctacggaaaagcctcgttatgacggtccgcagtcagattggcgcgtttgctgctcctgacaagatccactgggcacctgggctcccaaagacgcgaagtgggaagatcatgcgaagaatcttacgaaaaatcgcatccaggcaactagatgagctcggagacacgagcacgcttgctgaccccggtgttgtggaccagctgattgtgctcagtgacagctaa

SEQ ID NO: 3250 - protein, 738 aa, Sorghum bicolor
  misc_feature: Ceres ANNOT ID no. 6030008
  misc_feature (194)..(638): Pfam Id: AMP-binding Pfam Desc: AMP-binding enzyme
  misc_feature (1)..(738): NCBI GI: 116309453 NCBI Desc: h0502b11.5 [oryza sativa (indica cultivar-group)]
  misc_feature (107)..(738): NCBI GI: 38346152 NCBI Desc: osjnbb0118p14.12 [oryza sativa (japonica cultivar-group)]
  misc_feature (424)..(738): NCBI GI: 38569177 NCBI Desc: oj000315_02.12 [oryza sativa (japonica cultivar-group)]
  misc_feature (69)..(737): NCBI GI: 145323645 NCBI Desc: amp binding / acetate-coa ligase/ catalytic [arabidopsis thaliana]
  misc_feature (34)..(738): NCBI GI: 140047441 NCBI Desc: amp-dependent synthetase and ligase [medicago truncatula]
  misc_feature (316)..(732): SWISSPROT Homolog: EC 6.2.1.1 Acetyl-coenzyme A synthetase, cytoplasmic
  misc_feature: Up-regulated in shoot tissues in response to salicylic acid treatment
MAQHIYATNCGCARPAIPLLLLPAPTLLPLPLASSSSRLRRRRAGAMGASDHLAAAAAAAKPRNGRPCAAVLGEPLPALDDPGLLVHPSADFAAQALVSSTQQYREMYQKSIDDPAGFWSEIADEFYWKQKWSPDEVCAENLDVTKGPIKIEWFKGGKTNICYNAVDRHVEAGNGDKIAMYWEGNEPSQDGKLTYSELLEKVCQLSNYLKSVGVGKGDAVVIYLPMLMELPIAMLACARIGAVHSVVFAGFSAEALAQRVIDCKPKVVITCNAVKRGLKIIFLKDIVDASLDESAKNGVDVGICLTYENQSALNKVDTRWTTGRDVWWQDVVPDFPTKCDVEWVDAEDPLFLLYTSGSTGKPKGVLHTTGGYMVYSATTFKHAFDYKPTDIYWCTADCGWITGHSYVTYGPLLNGATVLVFEGAPNYPDPGRCWDIVDKYGVTIFYTAPTLIRSLMRDGTEYVARYSRKSLRVLGSVGEPINPTAWRWFYDVIGDSRCPISDTWWQTETGGFMITPLPGAWPQKPGSATFPFFGVQPVIVDEKGREMEGECSGYLCIKKSWPGAFRTLYGDKERYETTYFKPFAGYYFSGDGCSRDKDGYHWLTGRVDDVINVSGHRIGTAEVESALVSHPKCAEAAVVGIDHEVKGQGIYAFVTLVDGVPYSDDLRKSLVMTVRSQIGAFAAPDKIHWAPGLPKTRSGKIMRRILRKIASRQLDELGDTSTLADPGVVDQLIVLSDS

SEQ ID NO: 3251 - DNA, 819 bp, Sorghum bicolor
  misc_feature: Ceres ANNOT ID no. 6030015
  misc_feature: Encodes the peptide sequence at SEQ ID NO 3252
atggagagggcggaccagaagcgacggccgctgacggtgatggcatcctcatcgtcgcaggtagcagcggcgcggggcatgggcatgggcatggccaacccactggcggagtggaccggccgcgtcaggtcgctggaggccggcgtgcgggcgtggctagcgaagcagcccacccacgtggaggccgcggtggtcacggtggccggggccgtgcagggcgccgcgctcggcgggctcatgggcacgctcgcgcccgacggcggggccgcgctccccgtgccgccgccgccgcctggggccgaccctaaggtcttggcctccttcaagcaagcgcaggctttagccggtggacccctggtgcaagcacgaaactttgcggtcatgactggtgcgaatgcaggcatatcttgtgttatgagaagaataagaggagtggaggatgtccagggcagcatggcagcagcttttggttccggggctctattctccatcgtgagtggaatggggacaccaaatccggtagctaatgcaattacaactggtgttgcttttgctgtatttcaaggtggtttttttatgatcggtcaaaagttttcacagccaaagagtgaagatacatactattctcgtggaagaagcatgctgcaaaagttaggccttcagaactatgagaaaaacttcaagaagggtctcctgactgatcaaaccttgggcctccttacggacagtgcactcagagatgtgaagatccctcctggtcccagactcctcattcttgatcacattaaaagagatccagagctgacaagagcaaattaa

SEQ ID NO: 3252 - protein, 272 aa, Sorghum bicolor
  misc_feature: Ceres ANNOT ID no. 6030015
  misc_feature (53)..(194): Pfam Id: Tim17 Pfam Desc: Tim17/Tim22/Tim23 family
  misc_feature (6)..(271): NCBI GI: 116309456 NCBI Desc: h0502b11.8 [oryza sativa (indica cultivar-group)]
  misc_feature (6)..(264): NCBI GI: 32487911 NCBI Desc: oj000315_02.15 [oryza sativa (japonica cultivar-group)]
  misc_feature (6)..(264): NCBI GI: 115458216 NCBI Desc: os04g0405100 [oryza sativa (japonica cultivar-group)]
  misc_feature (14)..(150): NCBI GI: 115446437 NCBI Desc: os02g0526500 [oryza sativa (japonica cultivar-group)]
  misc_feature (63)..(191): NCBI GI: 145347059 NCBI Desc: mpt family transporter: inner membrane translocase (import) tim22 [ostreococcus lucimarinus cce9901]
MERADQKRRPLTVMASSSSQVAAARGMGMGMANPLAEWTGRVRSLEAGVRAWLAKQPTHVEAAVVTVAGAVQGAALGGLMGTLAPDGGAALPVPPPPPGADPKVLASFKQAQALAGGPLVQARNFAVMTGANAGISCVMRRIRGVEDVQGSMAAAFGSGALFSIVSGMGTPNPVANAITTGVAFAVFQGGFFMIGQKFSQPKSEDTYYSRGRSMLQKLGLQNYEKNFKKGLLTDQTLGLLTDSALRDVKIPPGPRLLILDHIKRDPELTRAN

SEQ ID NO: 3253 - DNA, 2529 bp, Sorghum bicolor
  misc_feature: Ceres ANNOT ID no. 6030125
  misc_feature: Encodes the peptide sequence at SEQ ID NO 3254
atgacgacggaagaggagctgccggaggcggccgaggcggcgcccgagcccgcgccagcaggtgcaggaggcggggacgacgcggagatgcccgatgccgccgcgccgtcgggctccgactcggactcgtcggactccgactccgacgacgagggggccgccgccgccgacgagctccgcatccaggccctagagaaaaccctccaggagcagccgctcgactacgagacccacgtgcagtatatccagtgcctgaggaagtcaggcaacattgagaagcttcgtgcggcaagggaggagatgaacaagtactttcctctcaccccaaagatgtggcaggagtgggctaaggacgagatctcattgagctcgagtgaagaatcttttggtgacattgaaaagctctacgagcgtggggtgcaagaatacctgtccatcaagttatggcgggattaccttgattatgttgaagagcatgatcagtcggtgtctcaatgtacaccttctggcctctccaagatgagaaatttgtttgaaagtgctattactgcaggggggctgcatattactgagggtagcaaactatgggcagcttatagagaatatgagatggccattttgatcaccattgctgatgccaatgatgaggagagggaaaagcaagttcagcgtatacgcacgctattccaccgccagttatctgttcctttggctgatatggaatcaacacttgctgagtataagagctgggaggccgagcaagggaatgcaaatgatccaggtgcagattttgatggtgtcccctcaaatgtcgtatctgcttacaaaaaggccaatgatatgtacaatgaaaggaagcaatacgaggatcaactaagcaatgcaggcacatctgaagctgacaaactgcaggaatttgtgaaatacatcaaatttgaggagtcttctggtgatcctgctcgtgttcaagtcctgtatgagcgagctgtttcagagcttcctgtttcaagtgatatatggatgggatatacaagttacctggatagaaccctgaaggtgccttctgtactcagaagtgtttattacagagccacaagaaattgtacatgggttggtgagctatgggtccattatttgttgtctttggagcgtatccgtgcttctgaagaagagctgcagcatgtatttgaacgggcaatacaatgttccttttcaaccatacaagagtatctcaatatttatcttactcgagttcatggtttaagacgaaggatttctgatgggttggattttcaactgattaggcagacattaacggatgctgcagaatttctctcacctcaactgggtatcaacgagttactgcgcttatatgcttattgggccaaactagagcatagtcttggcaaagatctttctgcagctcgtggagtttgggaaaacgcaatcaagaaaagtgggtctgtttttgaagtttgggtgcagtacatttcaatggagatagaaatgggccatgtacatgaggcgagatccctttataagcgttgttatagcaaaagatttgctggttctggatcagaggagatatgtcactcatggataagatttgaagaggagaatggcaccttggatgattatgaccttgctgttaagaaggttacccctcggctaaaggagcttatgacgttcaagtctcaagaggaggctaaagttgaggcataccctaaccccaatgataattctaatgcaaatgattcctctcagaaaagaaaaccaagtaaaatggccaataaacagcagccccctgctaagaaaagaaaagagaatccaccaaaaagcaccatgccatcagatgaccaaggatcaaatttacaaagtgggcacagtggtgctgttactgctgtagaggttggagaggccagcagggagaaggtcgtggcatctatggagatgaaagtggacggtgacagccaaacagggaaatcaagttcaaatgaaccaaagccatccttctataatgacaagtgtacagtttttgtgtcaaatattgacttgaaggcaaatgaagatgatctcagacgattcttctctgacattggtggtgccacagcaataagattgctgagggacagattcacaaaaaaatcaagggggttggcctatgtggatttttcagacaacaagcatcttgaggcagctgttaagaaaaacaagcagaagttgcttggaaagaaagttagtattgcacgatcagatccaagcaagggtaagaagagccgcgaagcaggtcaagcaagccaggataatttacctcagagtggcggtgatgatgcaaaagcaacaggatccagtggaccagacaatgaagtacctaagggtgatgcaaaaaccacggggaagaatacccgttttgcaccacgagctgtggttaaaactcttgggtggaccaacaaggatgagaagaaaccagatgtcacaggggagttgaagtcaaatgaggagttccgaaatctgttactgaagaagtga

SEQ ID NO: 3254 - protein, 842 aa, Sorghum bicolor
  misc_feature: Ceres ANNOT ID no. 6030125
  misc_feature (678)..(748): Pfam Id: RRM_1 Pfam Desc: RNA recognition motif. (a.k.a. RRM, RBD, or RNP domain)
  misc_feature (28)..(842): NCBI GI: 30686466 NCBI Desc: rna recognition motif (rrm)-containing protein [arabidopsis thaliana]
  misc_feature (28)..(816): NCBI GI: 30686462 NCBI Desc: rna recognition motif (rrm)-containing protein [arabidopsis thaliana]
  misc_feature (28)..(816): NCBI GI: 18700131 NCBI Desc: at4g24270/t22a6_100 [arabidopsis thaliana]
  misc_feature (221)..(644): NCBI GI: 39104520 NCBI Desc: mkiaa0156 protein [mus musculus]
  misc_feature (221)..(644): NCBI GI: 8394239 NCBI Desc: squamous cell carcinoma antigen recognized by t-cells 3 [mus musculus]
  misc_feature: The sequence is a functional homolog of SEQ ID NO. 458 in the 11/188,298 US application
MTTEEELPEAAEAAPEPAPAGAGGGDDAEMPDAAAPSGSDSDSSDSDSDDEGAAAADELRIQALEKTLQEQPLDYETHVQYIQCLRKSGNIEKLRAAREEMNKYFPLTPKMWQEWAKDEISLSSSEESFGDIEKLYERGVQEYLSIKLWRDYLDYVEEHDQSVSQCTPSGLSKMRNLFESAITAGGLHITEGSKLWAAYREYEMAILITIADANDEEREKQVQRIRTLFHRQLSVPLADMESTLAEYKSWEAEQGNANDPGADFDGVPSNVVSAYKKANDMYNERKQYEDQLSNAGTSEADKLQEFVKYIKFEESSGDPARVQVLYERAVSELPVSSDIWMGYTSYLDRTLKVPSVLRSVYYRATRNCTWVGELWVHYLLSLERIRASEEELQHVFERAIQCSFSTIQEYLNIYLTRVHGLRRRISDGLDFQLIRQTLTDAAEFLSPQLGINELLRLYAYWAKLEHSLGKDLSAARGVWENAIKKSGSVFEVWVQYISMEIEMGHVHEARSLYKRCYSKRFAGSGSEEICHSWIRFEEENGTLDDYDLAVKKVTPRLKELMTFKSQEEAKVEAYPNPNDNSNANDSSQKRKPSKMANKQQPPAKKRKENPPKSTMPSDDQGSNLQSGHSGAVTAVEVGEASREKVVASMEMKVDGDSQTGKSSSNEPKPSFYNDKCTVFVSNIDLKANEDDLRRFFSDIGGATAIRLLRDRFTKKSRGLAYVDFSDNKHLEAAVKKNKQKLLGKKVSIARSDPSKGKKSREAGQASQDNLPQSGGDDAKATGSSGPDNEVPKGDAKTTGKNTRFAPRAVVKTLGWTNKDEKKPDVTGELKSNEEFRNLLLKK

SEQ ID NO: 3255 - DNA, 957 bp, Sorghum bicolor
  misc_feature: Ceres ANNOT ID no. 6030133
  misc_feature: Encodes the peptide sequence at SEQ ID NO 3256
atggcgaagatgattgcggccaagaaccttgtgaagctcctcgtcctcctgcaggtggccgccggcggcggcgtggcggcgctcagcatggactactacagcatgagctgcccgttcgcggagatgatggtccgcagcgtcgtctacgacgctctcgccaaggaccccaccctcgccggcagcctcctgaggctgcacttccacgactgcttcgtgcagggctgcgacgcgtcggtgctgatcgactcgacggacggcaacacggcggagaaagacgcgcaggcgaacaagagcctgcgcggcttcgaggtgatcgaccgcatcaaggaggtgctggagtcgcagtgcccgggcgtcgtctcctgcgccgacgtcctggctctggcggcgcgcgacgccgtgctcctcgctcggggcccctactacggcgtgccgctgggccgccgcgacgggacgcggtcggtggactcggacaccttcacggcgctcccgccgcccttcttcaacacgacgtcgctcatcaagctcttcggctcgcacgggttcacggtgcaggacctggtggcgctctccggcggccacacgctggggatcgcgcactgcggcaacttcaaggccaggctcgccgagacggacacgctggacgccgcgctggggtcgtcgctcggcgccacctgcgccgccaacggggacgacggcgccgcgccgttcgaccggaccagcaccaggttcgacaccgtctactaccgggagctgcagatgcggcgagggctcctgagctccgaccagacgctgttcgagtcgccggagaccaagggcatcgtcaacatgttcgccatgaaccaggcatacttcttctacgcgttccagcaggggatgctcaagatggggcagctcgacctcaaggaaggcgacgagggtgagatcaggcacacgtgcggggtcatcaactcctag

SEQ ID NO: 3256 - protein, 318 aa, Sorghum bicolor
  misc_feature: Ceres ANNOT ID no. 6030133
  misc_feature (44)..(281): Pfam Id: peroxidase Pfam Desc: Peroxidase
  misc_feature (8)..(317): NCBI GI: 55701101 NCBI Desc: tpa: class iii peroxidase 117 precursor [oryza sativa (japonica cultivar-group)]
  misc_feature (3)..(317): NCBI GI: 51971821 NCBI Desc: peroxidase atp17a like protein [arabidopsis thaliana]
  misc_feature (4)..(317): NCBI GI: 17530547 NCBI Desc: class iii peroxidase atp32 [arabidopsis thaliana]
  misc_feature (1)..(317): NCBI GI: 55700931 NCBI Desc: tpa: class iii peroxidase 32 precursor [oryza sativa (japonica cultivar-group)]
  misc_feature (11)..(317): NCBI GI: 2429288 NCBI Desc: peroxidase [oryza sativa]
  misc_feature (4)..(317): SWISSPROT Homolog: EC 1.11.1.7 Peroxidase 47 precursor
  misc_feature: Useful for making plants with altered cell wall content and/or composition
  misc_feature: GREAT-hit functional homolog of the protein sequence encoded by LOCUS at4g33420
  misc_feature: Useful for making plants with altered cell wall content and/or composition
  misc_feature: Functional homolog of the protein sequence given in SEQ ID NO 13825
  misc_feature: Useful for making plants with modulated oxidative stress sensitivity
  misc_feature: Functional homolog of the protein sequence given in SEQ ID NO 13607
MAKMIAAKNLVKLLVLLQVAAGGGVAALSMDYYSMSCPFAEMMVRSVVYDALAKDPTLAGSLLRLHFHDCFVQGCDASVLIDSTDGNTAEKDAQANKSLRGFEVIDRIKEVLESQCPGVVSCADVLALAARDAVLLARGPYYGVPLGRRDGTRSVDSDTFTALPPPFFNTTSLIKLFGSHGFTVQDLVALSGGHTLGIAHCGNFKARLAETDTLDAALGSSLGATCAANGDDGAAPFDRTSTRFDTVYYRELQMRRGLLSSDQTLFESPETKGIVNMFAMNQAYFFYAFQQGMLKMGQLDLKEGDEGEIRHTCGVINS

SEQ ID NO: 3257 - DNA, 498 bp, Sorghum bicolor
  misc_feature: Ceres ANNOT ID no. 6030138
  misc_feature: Encodes the peptide sequence at SEQ ID NO 3258
atggggatcggtgagcacttcgagggcttgaagcagcactgggcgagcaacctcgccttcctcgactacttcaagaaggtctacggccgcgccgagcccctccccaagtggaccgacgccgacgtcgacgagttcatcgcctccgaccccgtctacgggccccagctcaaggccctgcgggagtcgaggaagttcgcgctcgccgggggcttcatcggcgccgcccacctcggaggcgtcgcgctcaagttctccaaggcgccgcacggcgtcctgttggcgaccgggttcggggcgatcaccggcgccgtgctgggatctgaggtggcggagcactggtaccagctctacaagatggacaggcagggggccaaccttaggttcatctactggtgggaggacaaggtctcagaatttatgtgtctgaaaacactctttagtctttacacctcagatctactaccactgttgccagaagagctgaatcatgttgaatga

SEQ ID NO: 3258 - protein, 165 aa, Sorghum bicolor
  misc_feature: Ceres ANNOT ID no. 6030138
  misc_feature (66)..(110): Pfam Id: Rick_17kDa_Anti Pfam Desc: Rickettsia 17 kDa surface antigen
  misc_feature (73)..(123): NCBI GI: 115481560 NCBI Desc: os10g0336600 [oryza sativa (japonica cultivar-group)]
MGIGEHFEGLKQHWASNLAFLDYFKKVYGRAEPLPKWTDADVDEFIASDPVYGPQLKALRESRKFALAGGFIGAAHLGGVALKFSKAPHGVLLATGFGAITGAVLGSEVAEHWYQLYKMDRQGANLRFIYWWEDKVSEFMCLKTLFSLYTSDLLPLLPEELNHVE

SEQ ID NO: 3259 - DNA, 684 bp, Sorghum bicolor
  misc_feature: Ceres ANNOT ID no. 6030139
  misc_feature: Encodes the peptide sequence at SEQ ID NO 3260
atggcgcggggcaaagtgcagctgcggcgcatcgagaacccggtgcaccggcaggtgaccttctgcaagcgccgcgcggggctgctcaagaaggcacgggagctctccgtcctctgcgacgcccacatcggcatcatcatcttctccgcgcacggcaagctctacgacctcgccaccaccgggaccatggaagagctgatcgacaggtacaagactgccagcggagaagctgccgacggctccggcgacaacagaatggatccaaaacaagaaaccatggtgctgcaacaggaaatcaatctgctccagaaaggactcaggtacatctacgggaacagggcaaatgaacacatgaatgttgacgaactgaatgcccttgagaggtacttggagatatggatgtacaacatccgctctgcaaagatgcagataatgattcaagagatacaagcactaaaaagcaaggcatgtcaaaaacttgaaggcatgttgaaagctgctaacgaaattctccgggaaaagatagtagaacagagtagtttgcttgatgtaggcatggtggtagcggatcaacagaatgggcattttagtacagtcccactgatagaagagatcactaacccactgactatactgagtggatattctaactgtaggggctcagagatgggctattccttctaa

SEQ ID NO: 3260 - protein, 227 aa, Sorghum bicolor
  misc_feature: Ceres ANNOT ID no. 6030139
  misc_feature (9)..(59): Pfam Id: SRF-TF Pfam Desc: SRF-type transcription factor (DNA-binding and dimerisationdomain)
  misc_feature (77)..(177): Pfam Id: K-box Pfam Desc: K-box region
  misc_feature (1)..(227): NCBI GI: 45385972 NCBI Desc: mads-box protein rmads220 [oryza sativa (japonica cultivar-group)]
  misc_feature (1)..(227): NCBI GI: 115474473 NCBI Desc: os08g0112700 [oryza sativa (japonica cultivar-group)]
  misc_feature (1)..(227): NCBI GI: 95981898 NCBI Desc: mads-box transcription factor taagl32 [triticum aestivum]
  misc_feature (1)..(224): NCBI GI: 21586457 NCBI Desc: mads-box protein fdrmads3 [oryza sativa (indica cultivar-group)]
  misc_feature (12)..(224): NCBI GI: 5230654 NCBI Desc: mads-box protein [oryza sativa]
  misc_feature: Abnormal phyllotaxy, leaf number higher than wild-type
  misc_feature: The plant flowers significantly earllier than wild-type.
  misc_feature: The sequence is a functional homolog of SEQ ID NO 2232 in the 10/374,780US patent application
  misc_feature: The sequence is a functional homolog of SEQ ID NO 232 in the 10/225,068US patent application
  misc_feature: The sequence is a functional homolog of SEQ ID NO 310 in the 10/225,066US patent application
  misc_feature: Useful for making plants with altered terpenoid content
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 12958
  misc_feature: GREAT-hit functional homolog of the protein sequence given in SEQ ID NO 13094
  misc_feature: The sequence is a functional homolog of SEQ ID NO 232 in the 20050120408 US patent application
  misc_feature: Useful for making plants with altered terpenoid content
  misc_feature: Functional homolog of the protein sequence given in SEQ ID NO 13094
  misc_feature: The sequence is a functional homolog of SEQ ID NO 2232 in the 10/374,780 US patent application
  misc_feature: The sequence is a functional homolog of SEQ ID NO 232 in the 10/225,068 US patent application
  misc_feature: The sequence is a functional homolog of SEQ ID NO 310 in the 10/225,066 US patent application
  misc_feature: Useful for making plants with modulated biomass
  misc_feature: Functional homolog of the protein sequence given in SEQ ID NO 13659
  misc_feature: The sequence is a functional homolog of SEQ ID NO 1701 in the 10/412,699 US patent application
  misc_feature: The sequence is a functional homolog of SEQ ID NO 1955 in the 10/412,699 US patent application
  misc_feature: The sequence is a functional homolog of SEQ ID NO 1949 in the 10/412,699 US patent application
  misc_feature: Useful for biocontainment applications
  misc_feature: Useful for making plants with modulated nitrogen use efficiency
  misc_feature: Functional homolog of the protein sequence given in SEQ ID NO 12982
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO. 361 in the 11/188,298 US application
  misc_feature: The sequence is a functional homolog of SEQ ID NO. 273 in the 11/188,298 US application
  misc_feature: The sequence is a functional homolog of SEQ ID NO. 518 in the 11/188,298 US application
  misc_feature: The sequence is a functional homolog of SEQ ID NO. 359 in the 11/188,298 US application
  misc_feature: The sequence is a functional homolog of SEQ ID NO. 420 in the 11/188,298 US application
  misc_feature: The sequence is a functional homolog of SEQ ID NO. 377 in the 11/188,298 US application
MARGKVQLRRIENPVHRQVTFCKRRAGLLKKARELSVLCDAHIGIIIFSAHGKLYDLATTGTMEELIDRYKTASGEAADGSGDNRMDPKQETMVLQQEINLLQKGLRYIYGNRANEHMNVDELNALERYLEIWMYNIRSAKMQIMIQEIQALKSKACQKLEGMLKAANEILREKIVEQSSLLDVGMVVADQQNGHFSTVPLIEEITNPLTILSGYSNCRGSEMGYSF

SEQ ID NO: 3261 - DNA, 798 bp, Sorghum bicolor
  misc_feature: Ceres ANNOT ID no. 6030143
  misc_feature: Encodes the peptide sequence at SEQ ID NO 3262
  misc_feature: Down-regulated in shoot tissues in response to salicylic acid treatment
atggcgctccacgccgtctcccccgcggcggtctcctccccgctgcgcgccctctcgcgcagcctcccccagcgcccaggctgcggttgtttaccaaagcaatccctcgcagtttactcctccataaactttgcgagacttcgggctggaccagtggacttcggtggcaggcctctggttcttcgacactcggacaagagagcagttttgatgcatgctactattgaagaaatcgaagcggagaaatccctcattgaagaccaagctaaagaaaagatggagaaggcaattgaaacagtccaaactaacttcaacactgtgaggacagggcgtgcaaacccagcgatgcttgaccgaattgaggttgagtactacggaactccagtgaacttgaagagcattgcgcagataagcactccagatgcaacttctcttcttatccaaccatatgacaagtcaagcctcaagcttattgagaaaacgatagttgctgcaaatcttggtgtgacaccaagcaatgacggagaagtgatacgagtgactgtcccacctttgacatctgatcgtagaaaggaattagcaaagacagtagctaaattatctgaagatggcaaggttgctataaggaacataagaagagatgcaatcaaagcttatgataaactacagaaggaaaagaagctttctgaggataatgtgaaagatttatcagctgatctacaaaaagtcacagatgagtacatgaaaaagatcgattccatccagaagcagaaggaacaggaactgatgaaaatttag

SEQ ID NO: 3262 - protein, 265 aa, Sorghum bicolor
  misc_feature: Ceres ANNOT ID no. 6030143
  misc_feature (99)..(263): Pfam Id: RRF Pfam Desc: Ribosome recycling factor
  misc_feature (31)..(265): NCBI GI: 4689034 NCBI Desc: chloroplast ribosome recycling factor protein [spinacia oleracea]
  misc_feature (40)..(265): NCBI GI: 7404451 NCBI Desc: ribosome recycling factor, chloroplast precursor (ribosome releasing factor, chloroplast) (nuclear located protein d2)
  misc_feature (111)..(265): NCBI GI: 297891 NCBI Desc: nuclear located protein [daucus carota]
  misc_feature (88)..(262): NCBI GI: 86610317 NCBI Desc: ribosome recycling factor [cyanobacteria bacterium yellowstone b-prime]
  misc_feature (88)..(262): NCBI GI: 86606512 NCBI Desc: ribosome recycling factor [cyanobacteria bacterium yellowstone a-prime]
  misc_feature: Down-regulated in shoot tissues in response to salicylic acid treatment
MALHAVSPAAVSSPLRALSRSLPQRPGCGCLPKQSLAVYSSINFARLRAGPVDFGGRPLVLRHSDKRAVLMHATIEEIEAEKSLIEDQAKEKMEKAIETVQTNFNTVRTGRANPAMLDRIEVEYYGTPVNLKSIAQISTPDATSLLIQPYDKSSLKLIEKTIVAANLGVTPSNDGEVIRVTVPPLTSDRRKELAKTVAKLSEDGKVAIRNIRRDAIKAYDKLQKEKKLSEDNVKDLSADLQKVTDEYMKKIDSIQKQKEQELMKI

SEQ ID NO: 3263 - DNA, 711 bp, Sorghum bicolor
  misc_feature: Ceres ANNOT ID no. 6030149
  misc_feature: Encodes the peptide sequence at SEQ ID NO 3264
atgcaatcgttggtccggaatgtctgccgagccggaagccgtggagcggcggcgaggctcctggagcttgccgctgctcccgtagccgcggctcatccgggggcggcgcagccatcctcggccgtcaaacacctctggcagccttacgggttggctcgcccgatcggggtagatcaatccgtacgtgtgcagagccgggtcattcctgctgctgcctccggtttcggtcactgcgcaaaggttcttgttgcgacgaggggtttgtcgacggtggggaatgcagctgaggttgcttctgattcggacgattccacctctcttgcggttgagcaccccccgcgcatcaagttcaagaggcccgacaagaccgccaggcatattatgaatatcctgaacaaagaggcagtcgataaggtccgctcggagagggagattcctgatgtgcagcctggatgtatgattcagatgagattgcaagttcctgagaacaaacggcgcgagttgacattgaaagggattgtgctaggaaggcgcaatgctggcatcaatacaaccttcagattacgtagattagtgtctggcattggagtcgagtctgtctttccactttactcgccaaacatcaaagaaatcaagatcttggacaggaagaaagtcaggagagctaagctgtattacctgagggacagggtgaacgcacttaaaaaatga

SEQ ID NO: 3264 - protein, 236 aa, Sorghum bicolor
  misc_feature: Ceres ANNOT ID no. 6030149
  misc_feature (128)..(234): Pfam Id: Ribosomal_L19 Pfam Desc: Ribosomal protein L19
  misc_feature (30)..(234): NCBI GI: 21592584 NCBI Desc: contains similarity to plastid ribosomal protein l19 [arabidopsis thaliana]
  misc_feature (17)..(234): NCBI GI: 7582403 NCBI Desc: plastid ribosomal protein l19 precursor [spinacia oleracea]
  misc_feature (93)..(231): NCBI GI: 123965774 NCBI Desc: ribosomal protein l19 [prochlorococcus marinus str. mit 9515]
  misc_feature (128)..(231): NCBI GI: 83589820 NCBI Desc: ribosomal protein l19 [moorella thermoacetica atcc 39073]
  misc_feature (126)..(230): NCBI GI: 23014871 NCBI Desc: cog0335: ribosomal protein l19 [magnetospirillum magnetotacticum ms-1]
MQSLVRNVCRAGSRGAAARLLELAAAPVAAAHPGAAQPSSAVKHLWQPYGLARPIGVDQSVRVQSRVIPAAASGFGHCAKVLVATRGLSTVGNAAEVASDSDDSTSLAVEHPPRIKFKRPDKTARHIMNILNKEAVDKVRSEREIPDVQPGCMIQMRLQVPENKRRELTLKGIVLGRRNAGINTTFRLRRLVSGIGVESVFPLYSPNIKEIKILDRKKVRRAKLYYLRDRVNALKK

SEQ ID NO: 3265 - DNA, 2148 bp, Sorghum bicolor
  misc_feature: Ceres ANNOT ID no. 6030163
  misc_feature: Encodes the peptide sequence at SEQ ID NO 3266
atggcggacgctgacgccgcgccgccaacgccgcctccggaggtattagtccccgaggagcatctcgccgccgtcgaatccgccgtcgccgcggtgcaggaggaggtggccgcgacggccgaagtcgataacaagcggaagctggaggacgtcagcgccgacgcggaggcgaacggcaccggcgaggacgccaagcgcctgcgcgtggacggcgagcccgacgtcgccacaggagcaggggttgagctgcagaaagacggctcctccgtgaatgtggaggagcccgcagctgcggaggataaggttgctcccaccgatggggcggcgatggatggtgataacggcgcggcagccgctcctgctccagattcggcttctgatgagaagccgcttgaagcagcagctgaagctccccagcaggaaggtgatgcagcaactgaagctccccagcaggaaggtgatgcagcaactgatgcacaggatatttctcgtaagatcgaagtgcccaacagcaaggttggtgtcctcattggaaaatctggtgagacaattaggaacttgcaatcgagctcaggtgcacagatccaaatcaccaaggacgctgatgtggacccaaataccctgactcggtcagttgaactagttggaacccttggaagtgttgataaagcagagcagcttattaagtgtgtcatagctgaggctgaggctggcggttcccctgccttgatagctagaggatttggaagtggacagcctggatcagagcaatttgagatgacagttcctgataacaaggttggtctcattattggaaaagggggtgagacaattaaaggcatgcagaccaaatctggtgctcgtattcagttaataccccaacatcctccagagggtgttacattgactgaaagaattgtacgtattactgggaataagaagcagattgaaattgtaaaggatttgatcaagcaagctatgaatcagacattttcaaagcatacaaaccaatctggcggatatggtccacaaggttaccgacctcagggtcatggtgctggttctcagtgggggccacgttctcagaatcatggctatggatacccacctagaggtatgcctccacctcaaaactacaacgcaccctacggtggctacccgccgcagggaccaccaagaggtggtatgggctgggaccagaggcagggccctccaccccatccttcgtaccagggtggtggtgactactacaagcagggctctcagccatatgatagccagccaccaagctaccctcctgggccagggaattacaacagttatgggcaatcccagggtcctaactatggccaacctcagtatccgcaacaggcgcctcaacagaactacagccatgggtatggtgatcctagatacaatgctccccctccgaaccagcagtactatggtcagccaccaatgggcccgcagcaaggctatcctcaacagccagatccctatgctaggcctccatacagtggacctggacaatggccgcccaggggtgctccagccactgatggctcctaccaggcgccacctgcatcttatgggccgccgtctcagcagcctcctgcttatgggcaaacatacagtgcagcaactggacctgatgggtatgcgcaacagggttacccacagcagggtgggccggcaccagctccatatggtcagagtgcaccagcagctccaggctatcctcagcaaggcacacagcaaggtagctatgcacagtacccgcagacccaaccagcatatggtgatcaatcagctcaagctaatgcaaactatgggtaccagggagctccagcagatcctaactatggaagtgcgtactcacagccaggatatggtcctcctggtcaggcaactggtcaggctggttatgccacctctgcgccagcagccggccagcctgcatatggccaggcaggatacacccagccacctacgaatcctccaagttatgatcagtctgcagcaccagcagcgactcagagcagctatgctgcacctccagcaaatccacagcagcctgctgcagcaaaaggggtctcgccacaacctgctgctgctggatatggtgctggtgggcagtggacagcatga

SEQ ID NO: 3266 - protein, 715 aa, Sorghum bicolor
  misc_feature: Ceres ANNOT ID no. 6030163
  misc_feature (163)..(228): Pfam Id: KH_1 Pfam Desc: KH domain
  misc_feature (257)..(323): Pfam Id: KH_1 Pfam Desc: KH domain
  misc_feature (84)..(684): NCBI GI: 22328551 NCBI Desc: kh domain-containing protein [arabidopsis thaliana]
  misc_feature (1)..(329): NCBI GI: 115474453 NCBI Desc: os08g0110800 [oryza sativa (japonica cultivar-group)]
  misc_feature (290)..(635): NCBI GI: 124360408 NCBI Desc: nucleic acid binding , related [medicago truncatula]
  misc_feature (338)..(705): NCBI GI: 46805645 NCBI Desc: high molecular weight glutenin subunit x-like protein [oryza sativa (japonica cultivar-group)]
  misc_feature (76)..(513): NCBI GI: 62088312 NCBI Desc: far upstream element-binding protein variant [homo sapiens]
MADADAAPPTPPPEVLVPEEHLAAVESAVAAVQEEVAATAEVDNKRKLEDVSADAEANGTGEDAKRLRVDGEPDVATGAGVELQKDGSSVNVEEPAAAEDKVAPTDGAAMDGDNGAAAAPAPDSASDEKPLEAAAEAPQQEGDAATEAPQQEGDAATDAQDISRKIEVPNSKVGVLIGKSGETIRNLQSSSGAQIQITKDADVDPNTLTRSVELVGTLGSVDKAEQLIKCVIAEAEAGGSPALIARGFGSGQPGSEQFEMTVPDNKVGLIIGKGGETIKGMQTKSGARIQLIPQHPPEGVTLTERIVRITGNKKQIEIVKDLIKQAMNQTFSKHTNQSGGYGPQGYRPQGHGAGSQWGPRSQNHGYGYPPRGMPPPQNYNAPYGGYPPQGPPRGGMGWDQRQGPPPHPSYQGGGDYYKQGSQPYDSQPPSYPPGPGNYNSYGQSQGPNYGQPQYPQQAPQQNYSHGYGDPRYNAPPPNQQYYGQPPMGPQQGYPQQPDPYARPPYSGPGQWPPRGAPATDGSYQAPPASYGPPSQQPPAYGQTYSAATGPDGYAQQGYPQQGGPAPAPYGQSAPAAPGYPQQGTQQGSYAQYPQTQPAYGDQSAQANANYGYQGAPADPNYGSAYSQPGYGPPGQATGQAGYATSAPAAGQPAYGQAGYTQPPTNPPSYDQSAAPAATQSSYAAPPANPQQPAAAKGVSPQPAAAGYGAGGQWTA

SEQ ID NO: 3267 - DNA, 2472 bp, Sorghum bicolor
  misc_feature: Ceres ANNOT ID no. 6030174
  misc_feature: Encodes the peptide sequence at SEQ ID NO 3268
atggataacctctctccaagcactctgctcaacagtatctcgtgtcttggcgccttaacatctgatgtctctaccgtgagacccaagcctattcagaagtattgcaaaaatgtatatgatgtctcaagcatcgttaatccccttgttgaggatctttgcaagtctcctgaagagcaactcaatgaggtcctaaaagatcttgacactgctgtcaatgaagcttcaggccttattggaaactggcaccagacaaccagcaaaatatatttcggttggcaaatcgagtcagtaatatcagatattcagggatgttcccttcaattgtgtcagctggtcaattcgctcttgccttctctgactggtcgtgcctgcacgtgtattgagaaactccaggacatcaattatgagcgcatgtttgatctgattaaggaggttgccgtggaacttgcagagacaaatgcagtgggttctgagaatctgttgaaactgtcaagtttgttgagcttgtcaacaaacatggaattatacatggaatctgtttcccttgagaatctcaggacaagagcactacgcagtgagaatcgtgaagaactggagctagctgagcagatgattccactggtcaactatatgcatgaccatcttctcagggaaaaacaacagctaagcatcaatggggtgcctattcctgctgatttttgttgtcccctttccttggagctgatgtctgatcctgttattgtagcgtctggacagacctatgagagggtttatatcaagttatggcttgatgagggttttactatctgcccaaaaacacgccaaagacttggccactccaatttaatacctaattatactgtgaaggctctgatagctaactggtgtgaatcgcatgacattaggcttcctgatcctatgaaatcattgaagttgaacttcccttctgctgcctcctcccttcaggattcaagtgctgcaggtggcagccctctacatcctagtgttgtgtcaagggctaatattcctgggtccccagaagctgatgtgtatttgagaaacttgaatggagcatctcctccccatagtttggccaatcagaattctcatgtgcatgaggtctcgacaagtcaaacttcagaaaatgcaaatggttctgcaccagatgtttcaaggttatctcttgcaagttcggaagcaagagagtctagtttggaaggaaggcgtggtggtttgattggacaaatgtcagaacattctacggaggaagcatttcaatcttctaatttggatagggatctgcaggacaacttggctagctcttcattgaatggtagtcttccaaatagtggtcaacttgatggggaatgtgacaatggggttacaagggttccaagtgataggacaaattacagtagtgatgcatctggagaggttacagatggtggtggtgcgcctgtggcctcttctgttcctcaaagggaacatttaatccctccaagattgggtcctagaggacaatttatcaggcggcaaccatcagataggggtttccccagaattatatcttcctcaacgatggatgcacggagtgatctatctgccattgagaatcaggttcggaagctgattgatgatttgagaagtgattctatagatgttcagagatcagcagcatcagatcttcgttctctagctaagcacaacatggagaataggattgtcattgcaaactgtggggctgtaaacttgctggttagtcttcttcattcaccagatgccaaaacccaagaacatgctgtgactgctcttttgaatttgtcgatcaatgacaacaacaaaattgctattgcaaatgctgatgctgtcgatcctctcattcatgtccttgagactgggaaccctgaagctaaagagaattcagcagctactcttttcagtctctcggttattgaagaaaataaagtgaggattgggcgatctggtgccatcaagcctctagtagacttgctaggaaatggcaccccacgaggaaagaaagatgcagctactgcattgtttaatctgtctattcttcatgagaataaagctcgcattgtgcaagctgatgctgtgaggcacctggttgagcttatggatcctgctgctgggatggtcgacaaagctgtggctgtgttggcaaacctcgctacgataccagaaggaaggaatgcaattgggcaggcacgtggcattccagcccttgttgaagttgttgagctgggttctgcaagagggaaggagaatgctgcggctgcattgcttcagctctgtacaaacagcaacagattttgcagtatagttcttcaagagggtgcagtgccccctctagtcgccctttcacagtcaggaacaccgcgggcgagagagaaggcacaagcgcttctgagctacttccgcagccaaagacatgggaattcagcaaggagatag

SEQ ID NO: 3268 - protein, 823 aa, Sorghum bicolor
  misc_feature: Ceres ANNOT ID no. 6030174
  misc_feature (569)..(609): Pfam Id: Arm Pfam Desc: Armadillo/beta-catenin-like repeat
  misc_feature (610)..(650): Pfam Id: Arm Pfam Desc: Armadillo/beta-catenin-like repeat
  misc_feature (651)..(691): Pfam Id: Arm Pfam Desc: Armadillo/beta-catenin-like repeat
  misc_feature (228)..(302): Pfam Id: U-box Pfam Desc: U-box domain
  misc_feature (356)..(822): NCBI GI: 28974687 NCBI Desc: arm repeat-containing protein [nicotiana tabacum]
  misc_feature (9)..(808): NCBI GI: 30681980 NCBI Desc: armadillo/beta-catenin repeat family protein / u-box domain-containing protein [arabidopsis thaliana]
  misc_feature (513)..(822): NCBI GI: 55733751 NCBI Desc: at5g67340 [arabidopsis thaliana]
  misc_feature (542)..(816): NCBI GI: 30694120 NCBI Desc: armadillo/beta-catenin repeat family protein / u-box domain-containing protein [arabidopsis thaliana]
  misc_feature (542)..(816): NCBI GI: 145332841 NCBI Desc: binding / ubiquitin-protein ligase [arabidopsis thaliana]
  misc_feature: The sequence is a functional homolog of SEQ ID NO. 309 in the 11/188,298 US application
  misc_feature: The sequence is a functional homolog of SEQ ID NO. 528 in the 11/188,298 US application
  misc_feature: The sequence is a functional homolog of SEQ ID NO. 308 in the 11/188,298 US application
MDNLSPSTLLNSISCLGALTSDVSTVRPKPIQKYCKNVYDVSSIVNPLVEDLCKSPEEQLNEVLKDLDTAVNEASGLIGNWHQTTSKIYFGWQIESVISDIQGCSLQLCQLVNSLLPSLTGRACTCIEKLQDINYERMFDLIKEVAVELAETNAVGSENLLKLSSLLSLSTNMELYMESVSLENLRTRALRSENREELELAEQMIPLVNYMHDHLLREKQQLSINGVPIPADFCCPLSLELMSDPVIVASGQTYERVYIKLWLDEGFTICPKTRQRLGHSNLIPNYTVKALIANWCESHDIRLPDPMKSLKLNFPSAASSLQDSSAAGGSPLHPSVVSRANIPGSPEADVYLRNLNGASPPHSLANQNSHVHEVSTSQTSENANGSAPDVSRLSLASSEARESSLEGRRGGLIGQMSEHSTEEAFQSSNLDRDLQDNLASSSLNGSLPNSGQLDGECDNGVTRVPSDRTNYSSDASGEVTDGGGAPVASSVPQREHLIPPRLGPRGQFIRRQPSDRGFPRIISSSTMDARSDLSAIENQVRKLIDDLRSDSIDVQRSAASDLRSLAKHNMENRIVIANCGAVNLLVSLLHSPDAKTQEHAVTALLNLSINDNNKIAIANADAVDPLIHVLETGNPEAKENSAATLFSLSVIEENKVRIGRSGAIKPLVDLLGNGTPRGKKDAATALFNLSILHENKARIVQADAVRHLVELMDPAAGMVDKAVAVLANLATIPEGRNAIGQARGIPALVEVVELGSARGKENAAAALLQLCTNSNRFCSIVLQEGAVPPLVALSQSGTPRAREKAQALLSYFRSQRHGNSARR

SEQ ID NO: 3269 - DNA, 2826 bp, Sorghum bicolor
  misc_feature: Ceres ANNOT ID no. 6030175
  misc_feature: Encodes the peptide sequence at SEQ ID NO 3270
atggcggccggcccggacgagagctggggcgcgcggggcggcaacccgggggacgcgcacgcgcaggcgtcgacgagccgcgcgcccccgggcccgggccctgccggggagacggagggcgcgtcgccggactcgttgcggaacacgccctccaacatcgcccggctgcaggacacgatcgggcactgcgcggcgcgccgcaagtacctcgcgcacaccaagagcccctccgatggcaaggacgtccgctggtacttctgcaagctccctctcgccgacaaagtgctctcttcttctgtaccacggacagagatagtggggaaaggagactatttccggttcagcgagagggactctctggcactggaggcgtctttcctggagagggaggaagagctgcttgcgtactggtggagggagtacgctgaatgcagcgcaggaccgagaggatccttggttgaaagtgatgactctgcgtacctttataaggtggaggaagagcgagttggggttcctgtgaaaggtggactatatgaggttgatttgatgaggcggcattgcttccctgtgtactggaacggtgaaaataggcgtgtcttgagaggccactggtttgctcgcaaaggtggcgttgattggattcccttgcgtgaggatgtctctgaacaacttgagttagcgtataattgtcaggtctggcatcgtcgaaaatttcagccttcaggcctatttgcagcaagggttgacctccaaggaagtacaccggatttgcatgctctttttactggagaggatgatacttgggaagcttggcttgtctttgatacaggtcctaaacttggtagcaacacaatcaaattaaggcgcggattttctccttctgaatctgcaagtacaaacccttcacaggatgagttgcgtcagacaaaagaagaggaaatggatgattactgctctcaggttccagttggtcatctggtattcatggttcatggcattggacagaggctggagaaagctaatcttgttgatgatgttgttgatttccgtcgagtaactgctaacctagctgaaagatacttaacttcttatcaaagaagtacccagagggttctatttattccatgtcagtggaggaagggcttgaagctcagtggtgaaagtactgttgagaaactcactttagatggagttaaaggtcttcgagtcgcgttaggtgccacagtacatgatgttctatattatatgagtcctatctactgtcagcatattattgactcggtctcaaaccagttgaacaagctgtatatgaaatttctgaagagaaatcctggttacagtggaaaggtgtcattgtatggccactcgttaggaagtgttctatcgtatgatatactttgtcatcaagaatccctttgggccccatttccaacagagtatctgaacatggaaacatctgatcggagtcaaggagcaaaatcagctaatgaagttgctttgcatgattcaggcgcaaaggatcatgatacttctactctagggcattcttgtgctgataatgaaaacagtgtcgctgatgaggatagcaccataactgacatgtcacatatggacagcatcctcccgtcatgtgtgcccgatgatccatcaaataaccatgaaactgttgtgccacgtggtgcagttgttgctgagaaaaatggagaagaaaataaggttgagaatcatcagacggtgtatactgaggaaggaacaacttcaggtgtaagcacaaaagatgctgaaggatcaagcatttcaagatctgctgaggaagtccatgaagaggtccttgacaaagacaaattgatcatttcactagaagaagaggtgaaatgtcttaaggctagactagatcatcttgaacaacataatcatctagtgactgaaagcaccagtggtatcgagtatcatgaaggcaaaaatggcaatcatgacttgaactctggcaaacttttcatggcgcaaagaattacaaaccagtcctactcaccacaaatcagatacacaaaactaaactttaaggttgacacattctttgctgttggatctcccttgggtgtcttcctttctctgcgtaatgtccgtattggtattggcgaagggaaagattattggcaagatgagaatataattgaagagatgccatgctgcaggcagatgttcaatatttttcatccttttgatcctgtagcatacagagttgaaccacttgtatgtgaagattatctaaagaagcgtcctgtaattgttccctaccatagaggcggaaagcggatacatgttggagtgcaggagttcagagaagatatttctgcatgttctcaagccattgcccgtcaattgaagtcactgaaggtcaaagcagtagctgctatgctagcattgagcagaaatgacacagaagaggatggtgagagtactaatgagaaagaaagatcatatggttccattatgatggaaaagttgaccggttcaccggatggtcgaattgatcatgtgcttcaggagaaaacatttcaacatccatatctatctgctctgggtgctcataccaactattggcgagatcatgatactgctctcttcattctcaaacatttgtatcgtgatatacctgaggatcctccaagcgatgtcattgaaaggatgcctgttaaactattttatgagagaaatccagttgaggaagaaacgcccgtgacattttcagatcatgcagcagttaaggagttctgcagaaagttgagagcttactcaagaaaaacagaggatgccaactgctaa

SEQ ID NO: 3270 - protein, 941 aa, Sorghum bicolor
  misc_feature: Ceres ANNOT ID no. 6030175
  misc_feature (685)..(883): Pfam Id: DDHD Pfam Desc: DDHD domain
  misc_feature (37)..(935): NCBI GI: 22329893 NCBI Desc: shoot gravitropism 2 (sgr2) [arabidopsis thaliana]
  misc_feature (171)..(466): NCBI GI: 119601027 NCBI Desc: ddhd domain containing 1, isoform cra_a [homo sapiens]
  misc_feature (146)..(466): NCBI GI: 28603754 NCBI Desc: ddhd domain containing 1 [bos taurus]
  misc_feature (171)..(466): NCBI GI: 119601028 NCBI Desc: ddhd domain containing 1, isoform cra_b [homo sapiens]
  misc_feature (171)..(466): NCBI GI: 45120113 NCBI Desc: ddhd domain containing 1 [homo sapiens]
MAAGPDESWGARGGNPGDAHAQASTSRAPPGPGPAGETEGASPDSLRNTPSNIARLQDTIGHCAARRKYLAHTKSPSDGKDVRWYFCKLPLADKVLSSSVPRTEIVGKGDYFRFSERDSLALEASFLEREEELLAYWWREYAECSAGPRGSLVESDDSAYLYKVEEERVGVPVKGGLYEVDLMRRHCFPVYWNGENRRVLRGHWFARKGGVDWIPLREDVSEQLELAYNCQVWHRRKFQPSGLFAARVDLQGSTPDLHALFTGEDDTWEAWLVFDTGPKLGSNTIKLRRGFSPSESASTNPSQDELRQTKEEEMDDYCSQVPVGHLVFMVHGIGQRLEKANLVDDVVDFRRVTANLAERYLTSYQRSTQRVLFIPCQWRKGLKLSGESTVEKLTLDGVKGLRVALGATVHDVLYYMSPIYCQHIIDSVSNQLNKLYMKFLKRNPGYSGKVSLYGHSLGSVLSYDILCHQESLWAPFPTEYLNMETSDRSQGAKSANEVALHDSGAKDHDTSTLGHSCADNENSVADEDSTITDMSHMDSILPSCVPDDPSNNHETVVPRGAVVAEKNGEENKVENHQTVYTEEGTTSGVSTKDAEGSSISRSAEEVHEEVLDKDKLIISLEEEVKCLKARLDHLEQHNHLVTESTSGIEYHEGKNGNHDLNSGKLFMAQRITNQSYSPQIRYTKLNFKVDTFFAVGSPLGVFLSLRNVRIGIGEGKDYWQDENIIEEMPCCRQMFNIFHPFDPVAYRVEPLVCEDYLKKRPVIVPYHRGGKRIHVGVQEFREDISACSQAIARQLKSLKVKAVAAMLALSRNDTEEDGESTNEKERSYGSIMMEKLTGSPDGRIDHVLQEKTFQHPYLSALGAHTNYWRDHDTALFILKHLYRDIPEDPPSDVIERMPVKLFYERNPVEEETPVTFSDHAAVKEFCRKLRAYSRKTEDANC

SEQ ID NO: 3271 - DNA, 1170 bp, Sorghum bicolor
  misc_feature: Ceres ANNOT ID no. 6030180
  misc_feature: Encodes the peptide sequence at SEQ ID NO 3272
atgggcaacgcgttcgcgtgcatgccgcgcaaggagcagcggggcgcggccgtggtgtcgcgcagcaagcggatggggagcgcgcggtcggcgcgcggcgggcccaagctcacgcccgcggaggaggagctcctgcaccgccaggcgctggccatggccatccaccagcacctcgacgccggcggctctatgtcgcgccgcatcgacgccggggcctccctgtcccgacgcatggcccccggctcaaccagctcccgccgccgcggcgacctgccggactccgtcacgaatgccaagcccgccccaattgtcctggagaatttagaaacaaagaaaatagtccttgttcatggagaaggatttggtgcttggtgctggtacaagaccatctcacacctggaggaagctggtctagatcctgttgccttagatctcacaggttctggcatagaccatactgatacaaacagcatagctacattagcagattactccaagccattaattgattaccttgaaaaacttcctgaagatgagaaggtcattttggtcggccatagttgcggaggtgcaagtgtgtcatatgcattggagcagtaccccaaaaagatatcaaaggcggtgtttcttacagctacgatggtaaaggatggccagcggccctttgacgtgttctctgaggaactccggtcagcagatgtcttcttgcaagaatcacagtttttagtttatggaaatggaaaggacaagcctcccactgggctgatgttcgataaacagcagatcaaggggctctatttcaaccaaacaccttccaaggatatggcgctagcggcggtgtccatgaggcctatccctctagccccaatcatggagaagctctccctcaccccagagaactacggcaccgtccgccgctacttcatccagacgctcgatgaccacatgctgtcgccagatgcccaggagaagctggtccgcgagaaccctcctgacggcatcttcaagatcaagggcggcgaccactgtcccttcttctcgaagccgcagtccctcaacaagatcctgctggagatcgcacagatccaatcctccgtggggctgctcccaggcaaggcgagcgcggaggagaccaccgctgccacagcagcagcggcagctaagtcatga

SEQ ID NO: 3272 - protein, 389 aa, Sorghum bicolor
  misc_feature: Ceres ANNOT ID no. 6030180
  misc_feature (138)..(358): Pfam Id: Abhydrolase_1 Pfam Desc: alpha/beta hydrolase fold
  misc_feature (82)..(362): NCBI GI: 42562323 NCBI Desc: hydrolase, alpha/beta fold family protein [arabidopsis thaliana]
  misc_feature (82)..(362): NCBI GI: 42563068 NCBI Desc: hydrolase, alpha/beta fold family protein [arabidopsis thaliana]
  misc_feature (105)..(362): NCBI GI: 6730643 NCBI Desc: f4n2.19 [arabidopsis thaliana]
  misc_feature (106)..(360): NCBI GI: 115473231 NCBI Desc: os07g0603600 [oryza sativa (japonica cultivar-group)]
  misc_feature (148)..(385): NCBI GI: 9797761 NCBI Desc: contains similarity to pir7a protein from oryza sativa gbz34271 and contains an alpha/beta hydrolase fold pf00561. [arabidopsis thaliana]
  misc_feature: Useful for making plants with modulated salt sensitivity
  misc_feature: GREAT-hit functional homolog of the protein sequence given in SEQ ID NO 13249
  misc_feature: Useful for making plants with modulated salt sensitivity
  misc_feature: Functional homolog of the protein sequence given in SEQ ID NO 13249
MGNAFACMPRKEQRGAAVVSRSKRMGSARSARGGPKLTPAEEELLHRQALAMAIHQHLDAGGSMSRRIDAGASLSRRMAPGSTSSRRRGDLPDSVTNAKPAPIVLENLETKKIVLVHGEGFGAWCWYKTISHLEEAGLDPVALDLTGSGIDHTDTNSIATLADYSKPLIDYLEKLPEDEKVILVGHSCGGASVSYALEQYPKKISKAVFLTATMVKDGQRPFDVFSEELRSADVFLQESQFLVYGNGKDKPPTGLMFDKQQIKGLYFNQTPSKDMALAAVSMRPIPLAPIMEKLSLTPENYGTVRRYFIQTLDDHMLSPDAQEKLVRENPPDGIFKIKGGDHCPFFSKPQSLNKILLEIAQIQSSVGLLPGKASAEETTAATAAAAAKS

SEQ ID NO: 3273 - DNA, 1845 bp, Sorghum bicolor
  misc_feature: Ceres ANNOT ID no. 6030194
  misc_feature: Encodes the peptide sequence at SEQ ID NO 3274
atgaagcgcaagcgcggccgtaagccggcgggcaagaaggctgctggtccggcggagtccacgtcgccggattccgcgtccagtcccagcacggaggcgtcggacagcccgcgagaccaggcggaggaggaggatgataataataataacgcgccgaccgtcgtcgatgcgggggtagcagtccctgaaccacggccgccgcctcctccttcttctcaacctcaaccttctgagccacctcggaagcccagtgccaccgcgacggctaatcctccagctgacataacgtacagcaggcccaaggtgggagctgtgtacggccgtgtgaaactcaagttcaagtcgtccaagacggtggactcgcccctgcgcccgcagcagcaggattcctcagaatctcatgtgccaccgcccgctgatgctgggaaatcagagagtgctgctgtgtctgaagtaatcaagagagctgacggggagaaggctccggccgtaacggatgggcagcaagcagatgggcaggggctggagtcgagtgacacggataaggaaaaggtggcaaggaaattaggaggcattaagatcaagttggcggggctgccttctgtagaaaacagcacaccggatcggaaagccgattcagcagatgagccttctccgagcaagcaagaagctcttttggaaagcaaaaaaaatgaggatgtggtggaggtgaggagctcacaggagtcggaagaaaagcagtctactccggaacatcagcgcaatgagaaggagctggctgctgcacttgaagctattaagaaagttatgaagatggacgctgctgatccgttcaatgttccagtggatcctgttgcattagaaataccggattattttgatgttattgacactcctatggattttggcacaatatgtcaaaatttggaacgtggtgacaagtacatgaattcagaggatgtatataaggatgtgcagttcatatgggataactgtaccaagtacaacagtaaaggcgattacataattgagcttatgaaacgggtcaagaagggcttcatgaaatattggttggccgctggcttgtattctgatgtgccagacagtggtggtaatgacaatactggtgatgaggatgccaaaggccactcaaaaagcaaggctaagaacaaaaggcgacgcccagggaacgatcgccacaaaagtgactgcatatgtgctgtttgtcaagttacaaggcgcaagaaagaaagggatgaaatattggctattatagacaatgagactgctgcaatggatagtaacacttctgagcagcatgacatggagggaaactctggtggtaataatcttggtaatcatgacacttgctctagccaggagcaaccgtcacaaacttatgtgtacaaagagacatcagaagcaaacgattctgggattcggatggaagatgctggaaagttctccactgatcagacacctagtttgctgctccctgactatgaagatgagggttccagacaatacttggaggaaaaaggacagattgagtatagagatatgaacagtaacggagagcacacccccactcagcctaatgagtactctgatgttgagcatcaccagcaaaaggggcagacagagaccagccaagaggttgaaatggaggaggattatcctatgcagcaggagaacccttcatttctgcaactctgcgctagcctcttccccagcaacgggagcagtactttcagggtgcgacattccctgttccgtccgcgccgccgagctccactgaaggcgagccctctgcatgtagccatggcagcgataatgaagcgttag

SEQ ID NO: 3274 - protein, 614 aa, Sorghum bicolor
  misc_feature: Ceres ANNOT ID no. 6030194
  misc_feature (259)..(348): Pfam Id: Bromodomain Pfam Desc: Bromodomain
  misc_feature (7)..(614): NCBI GI: 42408376 NCBI Desc: dna-binding protein family-like [oryza sativa (japonica cultivar-group)]
  misc_feature (7)..(398): NCBI GI: 115467990 NCBI Desc: os06g0355500 [oryza sativa (japonica cultivar-group)]
  misc_feature (185)..(613): NCBI GI: 79366430 NCBI Desc: dna binding [arabidopsis thaliana]
  misc_feature (160)..(544): NCBI GI: 140053518 NCBI Desc: bromodomain [medicago truncatula]
  misc_feature (140)..(497): NCBI GI: 60462310 NCBI Desc: ankyrin repeat-containing protein [dictyostelium discoideum]
MKRKRGRKPAGKKAAGPAESTSPDSASSPSTEASDSPRDQAEEEDDNNNNAPTVVDAGVAVPEPRPPPPPSSQPQPSEPPRKPSATATANPPADITYSRPKVGAVYGRVKLKFKSSKTVDSPLRPQQQDSSESHVPPPADAGKSESAAVSEVIKRADGEKAPAVTDGQQADGQGLESSDTDKEKVARKLGGIKIKLAGLPSVENSTPDRKADSADEPSPSKQEALLESKKNEDVVEVRSSQESEEKQSTPEHQRNEKELAAALEAIKKVMKMDAADPFNVPVDPVALEIPDYFDVIDTPMDFGTICQNLERGDKYMNSEDVYKDVQFIWDNCTKYNSKGDYIIELMKRVKKGFMKYWLAAGLYSDVPDSGGNDNTGDEDAKGHSKSKAKNKRRRPGNDRHKSDCICAVCQVTRRKKERDEILAIIDNETAAMDSNTSEQHDMEGNSGGNNLGNHDTCSSQEQPSQTYVYKETSEANDSGIRMEDAGKFSTDQTPSLLLPDYEDEGSRQYLEEKGQIEYRDMNSNGEHTPTQPNEYSDVEHHQQKGQTETSQEVEMEEDYPMQQENPSFLQLCASLFPSNGSSTFRVRHSLFRPRRRAPLKASPLHVAMAAIMKR

SEQ ID NO: 3275 - DNA, 858 bp, Sorghum bicolor
  misc_feature: Ceres ANNOT ID no. 6030196
  misc_feature: Encodes the peptide sequence at SEQ ID NO 3276
atggcatcctcttccatggccgccgtcgcctgcgccaccggcaccgccctctcgccgtcgaccgcgacggcccagaggccgtctgtccagggccgcctcgtcttccccgccgcgccctcccgctcccactctctccggctccgcgccgccggccgccggtcaactcgggcatccaaggttgtggtggcagcgttggctgacccactcaaggtcatgatatcaggggctcctgcatctggcaagggcacgcagtgtgagctcatcaagaccaaattcggtttggtgcacatctccgctggagatttgttgcgggcggagatcgctgctggctctgacaatgggaaggcggccaaggatttcatggagaagggccagctcgtgcctgatgagattgtcgttaatatggtgaaggaacgtcttctgcaaccagatgctcaggaaaacggttggcttttggacgggtacccaagaagctattcacaggccatggcgctggaaacccttgaaatccggcctgatactttcattctgttagatgttccagaggaactccttgttgaaagggtggttggaagacggcttgatcctgtaacagggaaaatatatcatttgaagtactctccaccagagaatgaagaaatcgcttcaaggcttacgcagagatttgatgatacagaagaaaaggttaagttgaggctgcagacttattaccaaaatatcgagtccttgctatcaacatatgaggaaattattgtcaaagtgaaaggagatcgcacagtgggcgatgtctttgctgagatcgagaagctgctggcttctagcctgaacaagaaaacagaaatggtgtccagctcatga

SEQ ID NO: 3276 - protein, 285 aa, Sorghum bicolor
  misc_feature: Ceres ANNOT ID no. 6030196
  misc_feature (73)..(252): Pfam Id: ADK Pfam Desc: Adenylate kinase
  misc_feature (64)..(285): NCBI GI: 3114422 NCBI Desc: chain b, adenylate kinase from maize in complex with the inhibitor p1,p5-bis(adenosine-5'-)pentaphosphate (ap5a)
  misc_feature (2)..(283): NCBI GI: 79329010 NCBI Desc: atp binding / nucleotide kinase/ phosphotransferase, phosphate group as acceptor [arabidopsis thaliana]
  misc_feature (72)..(257): NCBI GI: 10176815 NCBI Desc: adenylate kinase-like [arabidopsis thaliana]
  misc_feature (68)..(260): NCBI GI: 37727511 NCBI Desc: adenylate kinase [trypanosoma cruzi]
  misc_feature (1)..(244): NCBI GI: 58613413 NCBI Desc: chloroplast adenylate kinase [heterocapsa triquetra]
  misc_feature (64)..(285): SWISSPROT Homolog: EC 2.7.4.3 Adenylate kinase, chloroplast
MASSSMAAVACATGTALSPSTATAQRPSVQGRLVFPAAPSRSHSLRLRAAGRRSTRASKVVVAALADPLKVMISGAPASGKGTQCELIKTKFGLVHISAGDLLRAEIAAGSDNGKAAKDFMEKGQLVPDEIVVNMVKERLLQPDAQENGWLLDGYPRSYSQAMALETLEIRPDTFILLDVPEELLVERVVGRRLDPVTGKIYHLKYSPPENEEIASRLTQRFDDTEEKVKLRLQTYYQNIESLLSTYEEIIVKVKGDRTVGDVFAEIEKLLASSLNKKTEMVSSS

SEQ ID NO: 3277 - DNA, 2706 bp, Sorghum bicolor
  misc_feature: Ceres ANNOT ID no. 6030201
  misc_feature: Encodes the peptide sequence at SEQ ID NO 3278
atggcggcgggggcggcggcggaggtggacgacccgtcgctggcggcgacgctggagaagttccgcctctacgagacgcgcgcgaggttctacgtgatcgggagctcgcgggagaagcgctggttccgggtgctcaagatcgaccgctccgagccttccgagctcaacgtcagcgaggaccccgtctggtactcgcttcaggaggtcaagagcctcctccagcggatcgacgagggcaaccggtccaccggtggactcaccttcgtcaccaaggcctacggcatcgcaggttgcatcaagttcctggagtcatattacctgattttagtcaccaagcgccgccaaatcggttgcatttgtgggcatgctatatattgtatagatgagagccaaatgatcaccatcccacactcgtcagtgcaaacagatgtcgcgacctctaagaatgagctgaggtacaagaagcttttggctagtgttgatctcaccaaggatttcttctatagctacacatatcccatcatgcagagcctgcagcagaacgttacttctgcaggaatgaaggaaatgccttatgacaatttgtttgtctggaacactttcctgacagaaccaatacgttcaaggtgccgcaatactctctggacagtagctcttgtccatgggcacttcaagcaggtcaagctgtcaatttttggaagagagataaatgttgttcttagctctagaagatcccgacactttgctgggacacggtatttgaaaagaggtgtgaatgaccatggaaaagttgctaatgatgttgaaacagagcagatagtctttgaagaagaggctggttcctggaagggaagaatgagtgccgtagtacagatgcgaggatcaatccctctcttttggtcacaagaggcttctcgacttagtcctaagcctgatatctttgtacagagatatgatcccacatatgaagcaacaaaattacattttgatgatcttgcccgtcgatatggacatcctatcataattcttaatttgataaagactgttgaaaaaaggccacgtgaaatgatgctcaggcgtgaatattgtagagctgttgaatatcttaatcaaaatgtcccagaggagaagaagttgagattcatccactgggattttcataagtttgctaaaagcaaatctgcaaatgtactaggtgttttaggaaaagttgcaggtgaagcactggaccttactgggttttactacagtggaaagccaaaagtccagaaaaaaaggtcaattcagcttagccgaactagcactgcaagggatggctcccttgatataagggctagttctggagatctttcaaggctctctagtaatgctgaagcacttagttctacaggctttcaggatatgagaaatgaggccaacaaacatgagtttcttggtgacactccctgttaccaaactggagttcttcgtacaaattgtatagattgcctggatcgcacaaatgttgcacagtatgcttatggccttgctgctttggggaggcaacttcatgcaatgggactgacagatgtttcaaaaatccaccctgatagcagcattgcttccgctttgatggaaatgtaccagagcatgggtgatgcacttgcccatcagtatggaggatctgcggcacataacacggttttccctgagaggcaagggaagtggaaggctactactcagtctcgggagttcctgaaatcaattaaacggtactacagtaatgcctacactgatggcgagaagcaggatgctataaatctatttcttgggtactttcaaccacaagaaggaaaaccagctctttgggagctggataccgattactatcttcatgtaacaacagctggggatgatcttatgtctgatagctaccacttgagttctgcacctggacataatgtgtttgtgggatttggagctgcattgaaccctggaaccacattgagccctgttccagcatgtaaagaggatttctcaaggatgaaacttacttcgtttgacaaacttatacaaagaacatgtagttcgataaggaatgtaagacttcattgtgatgctgatctaaagctaagtggaggtgttggaacttctggaatggcgccagatgcagctgagatacagctcaaaagcccgaactggttgtttggtcaaagaaaacatacagagacaatgccaactgcaaaagttgccctagttgaaaacgtgaacgaggggaacagagatgagccaaatgtctctctttgtggggaattaaattggctatcctcctcaggatcatgcgaggaggacattttcagaaggtatcttgcattcacaacagcggatgtagagaatggctggtatggtggaacacttatatatgaccgagatgaaaacagcggagcttacaaacactactctgaactctgccagggagctgtcatggatcctttcgagcacgaccctgagaaagagcggcattatgcagaggcccttatcgtggatcttgacgtttcaaatgatgcacgggtagaggccgaaatgcaagctgcgctggatgactaccagatcatagggtcggacctgagcattatcccttcatgcggagcactcgcggaggatccgagtcagctgacgaggtggatcattggagatgagaagctgcttgtgggtgctgcacagtag

SEQ ID NO: 3278 - protein, 901 aa, Sorghum bicolor
  misc_feature: Ceres ANNOT ID no. 6030201
  misc_feature (92)..(398): Pfam Id: Syja_N Pfam Desc: SacI homology domain
  misc_feature (7)..(895): NCBI GI: 31415719 NCBI Desc: sac domain protein 1 [arabidopsis thaliana]
  misc_feature (494)..(897): NCBI GI: 42408373 NCBI Desc: sac domain-containing inositol phosphatase 3-like [oryza sativa (japonica cultivar-group)]
  misc_feature (152)..(548): NCBI GI: 51091054 NCBI Desc: sac domain-containing inositol phosphatase-like [oryza sativa (japonica cultivar-group)]
  misc_feature (8)..(623): NCBI GI: 31415721 NCBI Desc: sac domain protein 2 [arabidopsis thaliana]
  misc_feature (6)..(722): NCBI GI: 31415723 NCBI Desc: sac domain protein 3 [arabidopsis thaliana]
MAAGAAAEVDDPSLAATLEKFRLYETRARFYVIGSSREKRWFRVLKIDRSEPSELNVSEDPVWYSLQEVKSLLQRIDEGNRSTGGLTFVTKAYGIAGCIKFLESYYLILVTKRRQIGCICGHAIYCIDESQMITIPHSSVQTDVATSKNELRYKKLLASVDLTKDFFYSYTYPIMQSLQQNVTSAGMKEMPYDNLFVWNTFLTEPIRSRCRNTLWTVALVHGHFKQVKLSIFGREINVVLSSRRSRHFAGTRYLKRGVNDHGKVANDVETEQIVFEEEAGSWKGRMSAVVQMRGSIPLFWSQEASRLSPKPDIFVQRYDPTYEATKLHFDDLARRYGHPIIILNLIKTVEKRPREMMLRREYCRAVEYLNQNVPEEKKLRFIHWDFHKFAKSKSANVLGVLGKVAGEALDLTGFYYSGKPKVQKKRSIQLSRTSTARDGSLDIRASSGDLSRLSSNAEALSSTGFQDMRNEANKHEFLGDTPCYQTGVLRTNCIDCLDRTNVAQYAYGLAALGRQLHAMGLTDVSKIHPDSSIASALMEMYQSMGDALAHQYGGSAAHNTVFPERQGKWKATTQSREFLKSIKRYYSNAYTDGEKQDAINLFLGYFQPQEGKPALWELDTDYYLHVTTAGDDLMSDSYHLSSAPGHNVFVGFGAALNPGTTLSPVPACKEDFSRMKLTSFDKLIQRTCSSIRNVRLHCDADLKLSGGVGTSGMAPDAAEIQLKSPNWLFGQRKHTETMPTAKVALVENVNEGNRDEPNVSLCGELNWLSSSGSCEEDIFRRYLAFTTADVENGWYGGTLIYDRDENSGAYKHYSELCQGAVMDPFEHDPEKERHYAEALIVDLDVSNDARVEAEMQAALDDYQIIGSDLSIIPSCGALAEDPSQLTRWIIGDEKLLVGAAQ

SEQ ID NO: 3279 - DNA, 1218 bp, Sorghum bicolor
  misc_feature: Ceres ANNOT ID no. 6030202
  misc_feature: Encodes the peptide sequence at SEQ ID NO 3280
  misc_feature: Up-regulated in shoot tissues in response to salicylic acid treatment
atggctgcggaaatggtgaaggcagcgacgagcgacaagctcaaggagatggattgggcaaagaacatcgaaatctgcgagctcgtggcgcaggatcctgggaaagcgaaggatgtgatcaagtccataaaaaagtctatagggagcaggagcaagagcactcaactctttgctgttatgctattggagatgcttttgaataattgcggagagcctatccataggcaggtcatcgataatggccttcttccaatacttgtgaagatagtgaagaaaaagacggatttaccagttcgagaaaaaatatttcttctgttagatgctacacaaacatcccttggtggagctaaagcaaagtttcctcagtactatgaggcatactatgagttggtgtctgctggtgtgcaattttcaaatcgcccaaatgttgttgtcacaagagcagaagtgccagtcccagaaccaagaacagaaccaaataatgaaagtttagcaacccgattgaatgaagcccaacaggaagtgcacactcagcctgctcctgatgcaagtatagtccagaaagcctctagtgtcatggaagtattgagggatgtgcttaattctatggatcctaggcaccctgagggagcaacggatgaatttgtgttggaccttgtcgagcaatgtacgtttcagaagcaaagaataatgcaccttgttatgacatcaagagatgaaatggtggtatcacaagctatagagctaaatgaagagctacataaggtccttgtccggcatgatgcgttgctttctgttcatccgacaacaacagtaccttctaatataaaggaggaagaggaggaagaggatgctgaaagtctctatcggagactgcggaaggggaaagctctgtcgcaggactacacagatgactcggtgccgtcattccgatccatgcccgaggacaagctgcggcggccgctgaccatccaatcgcctcaccccgacaagcgactgggtgcgctgaacatccgctcaccagaccgtgaagagccaaggcctgatcctgctccgctgatcccgccaccgccctcaaagcacgccgagagggagaggttcttccgggagaagagcatcgatggcgtggccagcctgccaggccacctgaggggcctgtcacagcacagccgggacggtagcagctcgtgtagcggcagcactgattacggtgactga

SEQ ID NO: 3280 - protein, 405 aa, Sorghum bicolor
  misc_feature: Ceres ANNOT ID no. 6030202
  misc_feature (1)..(134): Pfam Id: VHS Pfam Desc: VHS domain
  misc_feature (177)..(274): Pfam Id: GAT Pfam Desc: GAT domain
  misc_feature (1)..(396): NCBI GI: 140065047 NCBI Desc: gat; enth/vhs [medicago truncatula]
  misc_feature (1)..(265): NCBI GI: 82791812 NCBI Desc: vhs and gat domain protein [glycine max]
  misc_feature (2)..(265): NCBI GI: 92887452 NCBI Desc: epsin, n-terminal; gat; enth/vhs [medicago truncatula]
  misc_feature (6)..(345): NCBI GI: 42567576 NCBI Desc: vhs domain-containing protein / gat domain-containing protein [arabidopsis thaliana]
  misc_feature (4)..(285): NCBI GI: 21537352 NCBI Desc: tom (target of myb1)-like protein [arabidopsis thaliana]
  misc_feature: Up-regulated in shoot tissues in response to salicylic acid treatment
MAAEMVKAATSDKLKEMDWAKNIEICELVAQDPGKAKDVIKSIKKSIGSRSKSTQLFAVMLLEMLLNNCGEPIHRQVIDNGLLPILVKIVKKKTDLPVREKIFLLLDATQTSLGGAKAKFPQYYEAYYELVSAGVQFSNRPNVVVTRAEVPVPEPRTEPNNESLATRLNEAQQEVHTQPAPDASIVQKASSVMEVLRDVLNSMDPRHPEGATDEFVLDLVEQCTFQKQRIMHLVMTSRDEMVVSQAIELNEELHKVLVRHDALLSVHPTTTVPSNIKEEEEEEDAESLYRRLRKGKALSQDYTDDSVPSFRSMPEDKLRRPLTIQSPHPDKRLGALNIRSPDREEPRPDPAPLIPPPPSKHAERERFFREKSIDGVASLPGHLRGLSQHSRDGSSSCSGSTDYGD

SEQ ID NO: 3281 - DNA, 693 bp, Sorghum bicolor
  misc_feature: Ceres ANNOT ID no. 6030204
  misc_feature: Encodes the peptide sequence at SEQ ID NO 3282
atggagaggaaacggaaggagatggagaagggcaagtctgagctgagagtggccatggaggagcttcgtttgtgcagctcaggagatggggaggaggatcaggtgcaggtgcagcaggtgaaagtgcaggagcagcccaagtcatccaccatggacctcctctctgtctccaagcagctcatccatgtccttgatgagattggaccaacgttgctagtcctgaggcaggacattcagcaaaatgttcagagattacaagatctgcatgaaagagactcttccaaatatgctagcttgacgacgatagttactgaggaaattgagcaagggacagcaaagaagaccaaaagctgcaccagagctatcatctggctgtctaggtcgataaatttctcaaaatatttactggagaagctgctaaaaacacctgagtcaagcctggaagagattgtcgaagaagcctatggaaatactctgaagccatggcatggctggatctcatcagctgcttacaaggtagcactgaagctcatcccagaaagagaattcttcatagcgctgctgatgggtaattgtcaagactttgaggatcttgcagaagatgccaagacgttggcctatgctgtccagcccctgttagaggagatcgatgcaatttcggtcagggcttcgaacttcacatctgtttgctaa

SEQ ID NO: 3282 - protein, 230 aa, Sorghum bicolor
  misc_feature: Ceres ANNOT ID no. 6030204
  misc_feature (34)..(225): Pfam Id: GLTP Pfam Desc: Glycolipid transfer protein (GLTP)
  misc_feature (1)..(223): NCBI GI: 115474419 NCBI Desc: os08g0108700 [oryza sativa (japonica cultivar-group)]
  misc_feature (2)..(222): NCBI GI: 116309799 NCBI Desc: h0525c06.1 [oryza sativa (indica cultivar-group)]
  misc_feature (2)..(222): NCBI GI: 38344077 NCBI Desc: osjnba0006b20.21 [oryza sativa (japonica cultivar-group)]
  misc_feature (50)..(215): NCBI GI: 47847777 NCBI Desc: glycolipid transfer protein-like [oryza sativa (japonica cultivar-group)]
  misc_feature (90)..(219): NCBI GI: 18402939 NCBI Desc: glycolipid transfer protein-related [arabidopsis thaliana]
  misc_feature: Useful for making plants with modulated oxidative stress sensitivity
  misc_feature: Functional homolog of the protein sequence given in SEQ ID NO 13075
MERKRKEMEKGKSELRVAMEELRLCSSGDGEEDQVQVQQVKVQEQPKSSTMDLLSVSKQLIHVLDEIGPTLLVLRQDIQQNVQRLQDLHERDSSKYASLTTIVTEEIEQGTAKKTKSCTRAIIWLSRSINFSKYLLEKLLKTPESSLEEIVEEAYGNTLKPWHGWISSAAYKVALKLIPEREFFIALLMGNCQDFEDLAEDAKTLAYAVQPLLEEIDAISVRASNFTSVC

SEQ ID NO: 3283 - DNA, 1560 bp, Sorghum bicolor
  misc_feature: Ceres ANNOT ID no. 6030216
  misc_feature: Encodes the peptide sequence at SEQ ID NO 3284
atggcctcctgcgacgacgacttcggcctcctcggtgacgacgcccaccagccggcaactcccccgcccgcaccccccatcgcccagcaacccgcgccgccgccgtcgcagcaggccgcccatcccttcagcttcactgtcgcgcctgcgggggttgccgccggcgccggctccttcgcgcaggtccaggaggacagcaaccaccacgccgagagcggcaagccggcgcaacacgccaagcggggcagggagcgcgccgaggagttcagcagcgatgggggcgagtactgttcctacatcaacagcagcggcagcggcggtggggggaagaagggctgtggcggtggagggatttcgagcgtgcgcgacctctaccgtaaggatcgggaggagtggacggacggcgcaatcagcagcctcctcgacgcctacacggaccgatttgagcaactcaaccggggacacctgcggggtcgggactgggaggacgtggccagcgtcgtgaccgacgggaagggcaagactaccgggggcaagagcgtggagcaatgtaagaacaagatcgacaaccttaagaaacgctacaaggtggagtgccagcgtctcaccagttccggcggaggcgccgtcagccactggccctggttcaaaaagatggagcagatcgtcggagactccatgtctcctgcctcctccaagcctcttgctgcagccgaggatgtgaaaccgaggcagcagcagcagcagcacggcagcaaaaggtatcctctttccagcactggtcctcctactggggttggtagctctagaacgaaccctctttcaaatccaagatggaagagggtgcttctgaagattgggggcactgccttatgtggagaggctcctcaaaatgttgatcccaaggtgattatgctgatcgctagagaagttcaagtggcgtgccatcatggtgtggaggtggcgatcgtgctaggagggcggaatatattctgcggtgacaattgggtagctgcaacaggcactgatcgagcctcaacgtacccaattggaatgatggcatcagtgatgaattcagtacttcttcaagcatcactagaaaagataggtgtggagacacgagtccaaactgcattgatgatgcaagaagttgcagaaccttacattaggcgtcgagccatacgccatcttgaaaaagggagggtggtcatctttggtgggattggtgcgggcactgggaatccattgttcacaacagatacagctgctgccttaagagcttcagagatcaatgcagatgttgtccttaaaggcattgttggtgatgatgaatctggttgtcctcctaggagcaacagtaatgcttcatttgagcacatctcctttagggagttagcagcaagaggaatcaccaaaatggacatgacagcagtaacatgttgtgaggagaacaacattcctgttgtcatctttaacatgttagagccgggtaacatctctagagcaatttgtggagatcaaataggcaccttagttgatcagtcaggaaggatcacataa

SEQ ID NO: 3284 - protein, 519 aa, Sorghum bicolor
  misc_feature: Ceres ANNOT ID no. 6030216
  misc_feature (280)..(492): Pfam Id: AA_kinase Pfam Desc: Amino acid kinase family
  misc_feature (1)..(519): NCBI GI: 116309440 NCBI Desc: osigba0142c11.1 [oryza sativa (indica cultivar-group)]
  misc_feature (1)..(351): NCBI GI: 70664002 NCBI Desc: osjnba0042i15.5 [oryza sativa (japonica cultivar-group)]
  misc_feature (219)..(519): NCBI GI: 115458226 NCBI Desc: os04g0405800 [oryza sativa (japonica cultivar-group)]
  misc_feature (1)..(519): NCBI GI: 92887879 NCBI Desc: madf; uridylate kinase; homeodomain-related [medicago truncatula]
  misc_feature (60)..(517): NCBI GI: 21464551 NCBI Desc: at3g10030/t22k18_15 [arabidopsis thaliana]
  misc_feature: The sequence is a functional homolog of SEQ ID NO 1781 in the 11/479,226US patent application
  misc_feature: The sequence is a functional homolog of SEQ ID NO 1844 in the 11/479,226US patent application
  misc_feature: The sequence is a functional homolog of SEQ ID NO 270 in the 10/374,780US patent application
  misc_feature: The sequence is a functional homolog of SEQ ID NO 2856 in the 10/374,780US patent application
  misc_feature: The sequence is a functional homolog of SEQ ID NO 298 in the 10/374,780US patent application
  misc_feature: The sequence is a functional homolog of SEQ ID NO 4 in the 10/225,066US patent application
  misc_feature: The sequence is a functional homolog of SEQ ID NO 46 in the 10/225,066US patent application
  misc_feature: The sequence is a functional homolog of SEQ ID NO 466 in the 10/225,066US patent application
  misc_feature: Useful for making plants with modulated growth and phenotype characteristics
  misc_feature: The sequence is a functional homolog of SEQ ID NO 4 in the 20050160493 US patent application
  misc_feature: The sequence is a functional homolog of SEQ ID NO 46 in the 20050160493 US patent application
  misc_feature: The sequence is a functional homolog of SEQ ID NO 466 in the 20050160493 US patent application
  misc_feature: Useful for biocontainment applications
  misc_feature: Useful for making plants with modulated biomass
  misc_feature: Functional homolog of the protein sequence given in SEQ ID NO 12927
MASCDDDFGLLGDDAHQPATPPPAPPIAQQPAPPPSQQAAHPFSFTVAPAGVAAGAGSFAQVQEDSNHHAESGKPAQHAKRGRERAEEFSSDGGEYCSYINSSGSGGGGKKGCGGGGISSVRDLYRKDREEWTDGAISSLLDAYTDRFEQLNRGHLRGRDWEDVASVVTDGKGKTTGGKSVEQCKNKIDNLKKRYKVECQRLTSSGGGAVSHWPWFKKMEQIVGDSMSPASSKPLAAAEDVKPRQQQQQHGSKRYPLSSTGPPTGVGSSRTNPLSNPRWKRVLLKIGGTALCGEAPQNVDPKVIMLIAREVQVACHHGVEVAIVLGGRNIFCGDNWVAATGTDRASTYPIGMMASVMNSVLLQASLEKIGVETRVQTALMMQEVAEPYIRRRAIRHLEKGRVVIFGGIGAGTGNPLFTTDTAAALRASEINADVVLKGIVGDDESGCPPRSNSNASFEHISFRELAARGITKMDMTAVTCCEENNIPVVIFNMLEPGNISRAICGDQIGTLVDQSGRIT

SEQ ID NO: 3285 - DNA, 1299 bp, Sorghum bicolor
  misc_feature: Ceres ANNOT ID no. 6030226
  misc_feature: Encodes the peptide sequence at SEQ ID NO 3286
atggctgcagcgagtatgatcaaggcgccggtcggccagaatccgaggctcgcgtgccacgccccggcgaggggcggaggcgtggtcaggtgttcgttgcagggcgcggtcgtcggcggccgggcggactggcagagcagctgcgccgtgctgtccagcaaggtggccgcgctcgggacgcactccatcaacggccacgtcgcgccggcgccggccccggagccgagccagaacggggcggtgctggatttggtccccgtgactagtatcaccggcggcgccatcaccaaggcgaacctgccgcagccgctccgcatcgcggacctgtccccggctccgatgcacgggtcgcagctgcgcgtggcgtaccagggcgtgcccggcgcgtacagcgagaaggcggccgggaaggcgtacccgggcagcgacgccatcccctgcgaccagttcgaggtggcgttccaggccgtggagctgtggatcgcggaccgcgccgtgctccccgtggagaactcgctgggcggcagcatccaccgcaactacgacctgctgctccgtcaccggctccacatcgtcggtgaggtgcagctccccgtgcaccactgcctgctggcgctgcccggggtgcgcaaggagtgcctgacccgggtgatgagccacccgcaggcgctggcgcagtgcgagcacacgctcacggccatgggcctcaacgtcgtccgcgaggcgttcgacgacacggcgggcgccgccgagtacgtggccgccaacgggctccgcgacacggccgccatcgcgtcgtcccgcgccgccgagctgtacgggatggaggtgctggccgacggcgtccaggacgactccgggaacgtgacccgcttcgtgatgctggcgagggagcccatcgtgccgcgcacggaccgacctttcaagaccagcatcgtgttcgcgcacgacaaggagggcacctccgtgctcttcaaggtgctctccgccttcgccttccgggacatctcgctcaccaagatcgagagcaggccgcaccgccaccggcccatccgcctcgtcgacgacgccaacgtcggcaccgccaagcacttcgagtacatgttctacgtcgacttccaggcgtccctcgcggagccccgcgcgcagaacgcgctggccgaggtccaggagtacacgtccttcctccgggtgctcgggagctaccccatggacatgacccccatgaccgccggctcatccaccaccatttcctcgtccgatggtccctcgtcgtcgtcgtcgtcgtcgtcgtcatga

SEQ ID NO: 3286 - protein, 432 aa, Sorghum bicolor
  misc_feature: Ceres ANNOT ID no. 6030226
  misc_feature (121)..(300): Pfam Id: PDT Pfam Desc: Prephenate dehydratase
  misc_feature (1)..(425): NCBI GI: 115458232 NCBI Desc: os04g0406600 [oryza sativa (japonica cultivar-group)]
  misc_feature (25)..(425): NCBI GI: 116309442 NCBI Desc: osigba0142c11.3 [oryza sativa (indica cultivar-group)]
  misc_feature (41)..(427): NCBI GI: 115480717 NCBI Desc: os09g0566000 [oryza sativa (japonica cultivar-group)]
  misc_feature (32)..(408): NCBI GI: 23506201 NCBI Desc: at5g22630/mdj22_5 [arabidopsis thaliana]
  misc_feature (100)..(405): NCBI GI: 92887942 NCBI Desc: prephenate dehydratase with act region [medicago truncatula]
  misc_feature: Useful for making plants with altered Lignin content
  misc_feature: GREAT-hit functional homolog of the protein sequence given in SEQ ID NO 13139
  misc_feature: Useful for making plants with altered lignin content
  misc_feature: Functional homolog of the protein sequence given in SEQ ID NO 13139
MAAASMIKAPVGQNPRLACHAPARGGGVVRCSLQGAVVGGRADWQSSCAVLSSKVAALGTHSINGHVAPAPAPEPSQNGAVLDLVPVTSITGGAITKANLPQPLRIADLSPAPMHGSQLRVAYQGVPGAYSEKAAGKAYPGSDAIPCDQFEVAFQAVELWIADRAVLPVENSLGGSIHRNYDLLLRHRLHIVGEVQLPVHHCLLALPGVRKECLTRVMSHPQALAQCEHTLTAMGLNVVREAFDDTAGAAEYVAANGLRDTAAIASSRAAELYGMEVLADGVQDDSGNVTRFVMLAREPIVPRTDRPFKTSIVFAHDKEGTSVLFKVLSAFAFRDISLTKIESRPHRHRPIRLVDDANVGTAKHFEYMFYVDFQASLAEPRAQNALAEVQEYTSFLRVLGSYPMDMTPMTAGSSTTISSSDGPSSSSSSSSS

SEQ ID NO: 3287 - DNA, 510 bp, Sorghum bicolor
  misc_feature: Ceres ANNOT ID no. 6030230
  misc_feature: Encodes the peptide sequence at SEQ ID NO 3288
atgcagggcggcggcggcgtggagcagccgatgcagatggtgctgcgggtgaagcacccgtcgtcgctgggcagcagcgcgggcgacgacgacgaaggcgagggctcctccaggtcggcgctctcggtgttcaaggccaaggaggagcagatcgagaggcgcaagatggaggtccgggagaaggtgttcgcgcacctcggacgcgtcgaggaggagtccaagcgactcgccttcatcaggcaggagctggaagggatggcggatcctacacggaaggaggtggagtcgatacggaagcggattgacacggtgaaccgtcagctcaagcctctcagcaagagctgcgtcaagaaggagaaggagtacaaggaggtcctggaggcgtacaacgagaagagcaaggagaaagcgctgctagtgaacaggctaatcgagcttgtgagcgagagcgagaggatgcggatgaagaagctggaggagctcaacaagacagtcgactcactctactag

SEQ ID NO: 3288 - protein, 169 aa, Sorghum bicolor
  misc_feature: Ceres ANNOT ID no. 6030230
  misc_feature (11)..(169): NCBI GI: 116309421 NCBI Desc: h0321h01.5 [oryza sativa (indica cultivar-group)]
  misc_feature (50)..(167): NCBI GI: 20093662 NCBI Desc: toprim-domain-containing protein, potential nuclease [methanopyrus kandleri av19]
  misc_feature (48)..(165): NCBI GI: 28574871 NCBI Desc: cg33052-pa [drosophila melanogaster]
  misc_feature (34)..(168): NCBI GI: 68449752 NCBI Desc: aci13 [lycopersicon esculentum]
  misc_feature (48)..(166): NCBI GI: 119611284 NCBI Desc: scy1-like 1 binding protein 1, isoform cra_a [homo sapiens]
  misc_feature: The plant is abnormally small.
  misc_feature: Useful for making plants with modulated biomass
  misc_feature: Functional homolog of the protein sequence given in SEQ ID NO 13026
MQGGGGVEQPMQMVLRVKHPSSLGSSAGDDDEGEGSSRSALSVFKAKEEQIERRKMEVREKVFAHLGRVEEESKRLAFIRQELEGMADPTRKEVESIRKRIDTVNRQLKPLSKSCVKKEKEYKEVLEAYNEKSKEKALLVNRLIELVSESERMRMKKLEELNKTVDSLY

SEQ ID NO: 3289 - DNA, 243 bp, Sorghum bicolor
  misc_feature: Ceres ANNOT ID no. 6030231
  misc_feature: Encodes the peptide sequence at SEQ ID NO 3290
atggcggatcagttcgcggattcggcgaacaatgttgtcattgaggaggtgaacaagggcctgaacccaggaatggtggtcctgcttgtagttgcaagcttcctgctgctcttctttgttggaaactatgtgctgtatgtgtatgcacagaagacacttccgccaaagaagaagaagccggtctcgaagaagaagctcaagagggaaaagctgaagcagggggtctctgcgccaggagagtaa

SEQ ID NO: 3290 - protein, 80 aa, Sorghum bicolor
  misc_feature: Ceres ANNOT ID no. 6030231
  misc_feature (10)..(80): Pfam Id: S1FA Pfam Desc: DNA binding protein S1FA
  misc_feature (6)..(80): NCBI GI: 1173350 NCBI Desc: dna-binding protein s1fa1
  misc_feature (18)..(80): NCBI GI: 1173349 NCBI Desc: dna-binding protein s1fa
  misc_feature (12)..(80): NCBI GI: 498705 NCBI Desc: s1fa [spinacia oleracea]
  misc_feature (18)..(80): NCBI GI: 92868251 NCBI Desc: dna binding protein s1fa [medicago truncatula]
  misc_feature (18)..(80): NCBI GI: 92868246 NCBI Desc: dna binding protein s1fa [medicago truncatula]
  misc_feature: The plant is abnormally small.
  misc_feature: The sequence is a functional homolog of SEQ ID NO 1761 in the 11/479,226US patent application
  misc_feature: The sequence is a functional homolog of SEQ ID NO 1769 in the 11/479,226US patent application
  misc_feature: The sequence is a functional homolog of SEQ ID NO 186 in the 11/375,241US patent application
  misc_feature: The sequence is a functional homolog of SEQ ID NO 2604 in the 10/374,780US patent application
  misc_feature: The sequence is a functional homolog of SEQ ID NO 2846 in the 10/374,780US patent application
  misc_feature: The sequence is a functional homolog of SEQ ID NO 96 in the 10/225,066US patent application
  misc_feature: The sequence is a functional homolog of SEQ ID NO 960 in the 10/225,066US patent application
  misc_feature: Useful for making plants with modulated biomass
  misc_feature: Useful for making plants with modulated growth and phenotype characteristics
  misc_feature: Functional homolog of the protein sequence given in SEQ ID NO 13090
  misc_feature: The sequence is a functional homolog of SEQ ID NO 96 in the 20050160493 US patent application
  misc_feature: The sequence is a functional homolog of SEQ ID NO 960 in the 20050160493 US patent application
  misc_feature: The sequence is a functional homolog of SEQ ID NO 1761 in the 20070022495 US patent application
MADQFADSANNVVIEEVNKGLNPGMVVLLVVASFLLLFFVGNYVLYVYAQKTLPPKKKKPVSKKKLKREKLKQGVSAPGE

SEQ ID NO: 3291 - DNA, 2484 bp, Sorghum bicolor
  misc_feature: Ceres ANNOT ID no. 6030235
  misc_feature: Encodes the peptide sequence at SEQ ID NO 3292
atggcgtcgttcgctgtgtccggcgcgggcgcgaggctcggggtcgtgcggcccggcggctcggcgcgatctggcggcggggagcggaggagtggggtggacttgccgtcggtgctcttcaggaggaaggacgccatctctcgtaccgttctgagctgcgctggtgctcctggaaaggtgctggtgcctggaggtggcagtgatgacgtgctttcctccgcagagcctgtcgtggacacttcagagcagcacgaagaactacagatacctgatgcagaacaggttgtggaggagaaagcatactcatcagcagctcaagcaacctcagcagcggctgaagaaagctcagaagttgacgcagccatcaaagccaaagcaccactcgtggaggagaaaccacgagttatctccccaccaggagatggtcagcgaatatatgagattgacccaatgctggaagggtatcggggccaccttgactaccgatacagtgaatataagagaatgcgtgcggctattgatcaacatgaaggtggcttggatgcattttcacgcggttacgaaaagcttggatttactcgcagcgctgaaggtatcacttatagagaatgggctcctggagcatcctctgcagcattagtaggtgacttcaacaactggaatccaaatgctgatgctatgaccagaaatgagtatggcgtttgggagattttcctgcctaataacgctgatggttcccctgctattcctcatggctcacgtgtaaagatacggatggatacaccatctggtgtgaaggattccattcctgcgtggatcaagttttctgtacaagctccaggtgaaataccatacaatggtatatattatgatccacctgaagaggagaaatatgtattcaaacaccctcaacctaagcggccaaagtcactgcggatatacgaatcacatattggaatgagtagtccggaaccaaagataaatacgtatgctaacttccgagatgaggtgctgccaagaattaaaaggcttggatacaatgcagtacagataatggcaatccaggaacactcttattatgcaagctttgggtaccatgttacgaacttttttgcgccaagtagccgttttgggactcctgaggacctaaaatctctgattgacaaagcgcatgagcttggcttgctagtgctcatggatattgttcatagtcattcatcaaataataccttggacggtttgaatggtttcgatggcactgatacacattacttccatggtggtccacggggccatcattggatgtgggattctcgcctattcaattatgggagttgggaagttttgagatatctactgtcaaatgcaagatggtggcttgaagaatataagtttgatggatttcgatttgatggggtgacctccatgatgtatactcaccatggattacaagtggcattcaccgggaactatggcgagtattttggatttgctactgatgttgatgcagtagtttacctaatgctggtaaacgatcttattcatgggctttatccagaagctgtatccattggtgaagatgtcagcggaatgcctacgttttgtattcctgtccaagatggtggtgttggttttgattatcgccttcatatggctgtcccagacaaatggattgaacttctgaagcaaagtgatgaatattggaaaatgggtgatatcgtgcacaccttaacaaatagaaggtggctagaaaagtgtgtcacttattgtgaaagtcatgatcaagctttagttggtgacaagacaattgcattctggttgatggacaaggatatgtatgatttcatggctctggacaggccttcaacacctgtcatcgatcgtgggatagcattacataaaatgattaggcttatcacaatgggtttaggaggtgaaggctatctaaatttcatgggaaatgagtttgggcatcctgaatggatagattttccaagaggtcctcaaagtcttccaaatggctctgtcattcctgggaataactatagctttgataaatgccgtcgtagatttgaccttggagatgcagattatctgagatatcgtggcatgcaagagtttgatcaggcaatgcagcaccttgagggaaaatatgaattcatgacatctgatcactcatatgtatcacggaaacatgaggaggataaggtgatcatcttcgagagaggagatttggtctttgtattcaacttccactggagcaatagctattttgactatcgtgttggttgtttcaagcctgggaagtacaagatcgtgttagattctgacgatggccttttcggtggatttagtcggcttgatcatgatgctgagtacttcactgctgactggccgcatgacaacaggccgtgttctttctcggtctatgcacccagcagaacagccgtcgtatatgcacctgcaggtgaagaggacgaatag

SEQ ID NO: 3292 - protein, 827 aa, Sorghum bicolor
  misc_feature: Ceres ANNOT ID no. 6030235
  misc_feature (727)..(822): Pfam Id: Alpha-amylase_C Pfam Desc: Alpha amylase, C-terminal all-beta domain
  misc_feature (189)..(273): Pfam Id: Isoamylase_N Pfam Desc: Isoamylase N-terminal domain
  misc_feature (317)..(633): Pfam Id: Alpha-amylase Pfam Desc: Alpha amylase, catalytic domain
  misc_feature (89)..(827): NCBI GI: 2340108 NCBI Desc: starch branching enzyme iia [zea mays]
  misc_feature (1)..(820): NCBI GI: 11037534 NCBI Desc: starch branching enzyme 2 [triticum aestivum]
  misc_feature (1)..(820): NCBI GI: 1885344 NCBI Desc: 1,4-alpha-glucan branching enzyme ii [triticum aestivum]
  misc_feature (85)..(820): NCBI GI: 5689138 NCBI Desc: starch branching enzyme rbe4 [oryza sativa]
  misc_feature (85)..(820): NCBI GI: 116309426 NCBI Desc: h0321h01.10 [oryza sativa (indica cultivar-group)]
  misc_feature (87)..(821): SWISSPROT Homolog: EC 2.4.1.18 1,4-alpha-glucan branching enzyme IIB, chloroplast precursor
  misc_feature: The sequence is a functional homolog of SEQ ID NO. 305 in the 11/188,298 US application
MASFAVSGAGARLGVVRPGGSARSGGGERRSGVDLPSVLFRRKDAISRTVLSCAGAPGKVLVPGGGSDDVLSSAEPVVDTSEQHEELQIPDAEQVVEEKAYSSAAQATSAAAEESSEVDAAIKAKAPLVEEKPRVISPPGDGQRIYEIDPMLEGYRGHLDYRYSEYKRMRAAIDQHEGGLDAFSRGYEKLGFTRSAEGITYREWAPGASSAALVGDFNNWNPNADAMTRNEYGVWEIFLPNNADGSPAIPHGSRVKIRMDTPSGVKDSIPAWIKFSVQAPGEIPYNGIYYDPPEEEKYVFKHPQPKRPKSLRIYESHIGMSSPEPKINTYANFRDEVLPRIKRLGYNAVQIMAIQEHSYYASFGYHVTNFFAPSSRFGTPEDLKSLIDKAHELGLLVLMDIVHSHSSNNTLDGLNGFDGTDTHYFHGGPRGHHWMWDSRLFNYGSWEVLRYLLSNARWWLEEYKFDGFRFDGVTSMMYTHHGLQVAFTGNYGEYFGFATDVDAVVYLMLVNDLIHGLYPEAVSIGEDVSGMPTFCIPVQDGGVGFDYRLHMAVPDKWIELLKQSDEYWKMGDIVHTLTNRRWLEKCVTYCESHDQALVGDKTIAFWLMDKDMYDFMALDRPSTPVIDRGIALHKMIRLITMGLGGEGYLNFMGNEFGHPEWIDFPRGPQSLPNGSVIPGNNYSFDKCRRRFDLGDADYLRYRGMQEFDQAMQHLEGKYEFMTSDHSYVSRKHEEDKVIIFERGDLVFVFNFHWSNSYFDYRVGCFKPGKYKIVLDSDDGLFGGFSRLDHDAEYFTADWPHDNRPCSFSVYAPSRTAVVYAPAGEEDE

SEQ ID NO: 3293 - DNA, 471 bp, Sorghum bicolor
  misc_feature: Ceres ANNOT ID no. 6030328
  misc_feature: Encodes the peptide sequence at SEQ ID NO 3294
atggcaactttcacatccccagttctctgcaacttcatgaccatccaacagaagagcacgcctctgctgaacaacaacagcacaaaacggccccagcacctgagcttcccaaggacaagcaggagcgtgccgacgacattgccgggcttcagagcgaggcaagacctgcgcgtcgccgccgtctacaaggtgaagctcgtcggccccgaagggcaggagagcgtgatcgacgtgccggaggacagctacatcctggacgcggccgaggaggccggcgtcgagctgccctactcctgccgcgccggtgcgtgctccacgtgcgccggcaaggtgctggagggctccgtcgaccagtcggaccagtcgttcctcgacgacacgcaggtcggtgccgggtacgcgctcacctgcgtcgcgtacccgacgtctgactgcgtcatccagacgcacagggaggcagacctgtactag

SEQ ID NO: 3294 - protein, 156 aa, Sorghum bicolor
  misc_feature: Ceres ANNOT ID no. 6030328
  misc_feature (67)..(143): Pfam Id: Fer2 Pfam Desc: 2Fe-2S iron-sulfur cluster binding domain
  misc_feature (3)..(156): NCBI GI: 116310147 NCBI Desc: h0717b12.9 [oryza sativa (indica cultivar-group)]
  misc_feature (1)..(156): NCBI GI: 119958 NCBI Desc: ferredoxin iii, chloroplast precursor (fd iii)
  misc_feature (23)..(155): NCBI GI: 1360725 NCBI Desc: non-photosynthetic ferredoxin [citrus sinensis]
  misc_feature (1)..(156): NCBI GI: 53981560 NCBI Desc: ferredoxin [oryza sativa (japonica cultivar-group)]
  misc_feature (60)..(156): NCBI GI: 66360068 NCBI Desc: chain b, crystal structure of 2fe2s ferredoxin from thermophilic cyanobacterium mastigocladus laminosus
MATFTSPVLCNFMTIQQKSTPLLNNNSTKRPQHLSFPRTSRSVPTTLPGFRARQDLRVAAVYKVKLVGPEGQESVIDVPEDSYILDAAEEAGVELPYSCRAGACSTCAGKVLEGSVDQSDQSFLDDTQVGAGYALTCVAYPTSDCVIQTHREADLY

SEQ ID NO: 3295 - DNA, 876 bp, Sorghum bicolor
  misc_feature: Ceres ANNOT ID no. 6030335
  misc_feature: Encodes the peptide sequence at SEQ ID NO 3296
atgacgacaccgacttgcaccaccaatgcagccttcttcttcctcctgctgctgctggtgtgcgcctgctgcttcgccaccacccttgcctgtgaccctaatggcgatggcgccaagttcgggtacatcggctctatgggtcctgctcactggggcagcttgagccctaacttcaggcagtgcgcgagagggactcaccagtccccgatcgacatctccacggccgaagccgttctcaacccggggctgcagccactccacagggactacaccgtcgccaacgctaccctcgtcgacaacgtcttcaacatcgccctgcgcttcgacgacgacgacggagctgcagggagcgtgcggatcgacgggaaggtgtactggctgaagcagatgcactggcactcgccgtccgagcacaccatcaacgggcggcggttccccgtggagctccacatggttcacgccagcgacgacggcaacgtcaccgtcgtggccatgctctaccggtttggcagcaggccggaccctctgctttggcagattcaggacaagctggcggcgctgtacgcggagggctgcagagcggaggagggcggcggcggccaagttcccgccggagacgtgagcctgtggtcgctgaggctgcactcccacacgtactaccgctacgtcgggtccttcaccacgccgccctgcaccgaggacgtcatctggagcgtcatggcccaggtgagggagatgacggtggagcaggccgccgcgctgatggcgccgctggagaaagcttacaggcacaacaacaggccgacgcagccgatgaacggccgcgtcgtccaggtctgccacaggttcgtcatgagcaagaagacggcgccgtag

SEQ ID NO: 3296 - protein, 291 aa, Sorghum bicolor
  misc_feature: Ceres ANNOT ID no. 6030335
  misc_feature (40)..(281): Pfam Id: Carb_anhydrase Pfam Desc: Eukaryotic-type carbonic anhydrase
  misc_feature (15)..(288): NCBI GI: 116310342 NCBI Desc: osigba0134p10.2 [oryza sativa (indica cultivar-group)]
  misc_feature (16)..(281): NCBI GI: 7669946 NCBI Desc: carbonic anhydrase (cah1) [arabidopsis thaliana]
  misc_feature (16)..(243): NCBI GI: 30693691 NCBI Desc: carbonic anhydrase family protein [arabidopsis thaliana]
  misc_feature (36)..(288): NCBI GI: 29468280 NCBI Desc: nectarin iii [nicotiana langsdorffii x nicotiana sanderae]
  misc_feature (17)..(277): NCBI GI: 46917479 NCBI Desc: tuber storage protein [dioscorea batatas]
MTTPTCTTNAAFFFLLLLLVCACCFATTLACDPNGDGAKFGYIGSMGPAHWGSLSPNFRQCARGTHQSPIDISTAEAVLNPGLQPLHRDYTVANATLVDNVFNIALRFDDDDGAAGSVRIDGKVYWLKQMHWHSPSEHTINGRRFPVELHMVHASDDGNVTVVAMLYRFGSRPDPLLWQIQDKLAALYAEGCRAEEGGGGQVPAGDVSLWSLRLHSHTYYRYVGSFTTPPCTEDVIWSVMAQVREMTVEQAAALMAPLEKAYRHNNRPTQPMNGRVVQVCHRFVMSKKTAP

SEQ ID NO: 3297 - DNA, 1356 bp, Sorghum bicolor
  misc_feature: Ceres ANNOT ID no. 6030338
  misc_feature: Encodes the peptide sequence at SEQ ID NO 3298
atggggtgcatctcctcgaagctcctcccgccggggccaggcggcgacggcggcaggcgcgccacggtgcgcggccgcgtcgagcacgtcgtctccctcacctccaccacctacggcgtcctcgacctccaccccaagcacggaggaggagccgtcctcgccgccgccgctgctgacgctggagaggtggagaaggaggagccgccgccgccgccgcaggacaagccgataagcaaggagtggaagcgcgccagcatgcgtccgccgccgattgcggtcccgagcgccgacaagaagccggcggcggggaagccggagtccggcctcgaggtcatcaacgcgtgggagatcatggccgggctcgaggaggcctacgccgccgccgcggtggccgggtcgccgccggcgaagaagccgtccaagccgggccggtggtcgccggccagggtcatcgccatggccctgccgtcgcccaagaggtcggcgacgaggcggaagaacacgccggggaaggagaacagcccgctccagcgctgctcggggaatctcaccagcaaggacaaggacaaggacaagaccgccggcgatgtcgacggcgacagggtgctccgcccgtacaattccatcgacaactccaagctgtcgatggcgtccaagaggttctctccgggcagcgcgcggatcgtccgcaagcccggcaccgccgagaccggcggcggcggcggcaccggcatgtcctcgtcgcggcgcagcctgagcccgctgttcgacccggagctgctcgcgtccatcgagcgcgagctgtcggaggaaggcgcccacatcaagcggatggtagggtccgagaagcccaagcaccccaaggccgcgccgccggcgatcgtggcggccgaggggaagtgcccgcctgggggcgccgaagccgtggtcctctacaccaccacgctccgcggcatccgcaggaccttcgaggagtgcaacgccgtgcgcgcggcgatcgaggcccacgacgtgaaggtgatcgagcgggacgtgtccatggactcgggctaccgcgaggagctgcgcctgctgctgggcgggcgggaggtgcgcgtgcccgccgtgttcgtgcggggcaggcacgtcggcggcgccgccgaggtggccaagctggaggaggaaggcaagctgaaggcgctgctcgagggccttccccgggcgcgggtctggtgcgcgggctgcgccggcgtgcgcttcgtcatgtgccgcgactgcaacggcagccgcaaggtgctcgacgccgagcgcaaggagacggtcaagtgcggcgagtgcaacgagaacggcctcgtccggtgcccgatctgctcgtga

SEQ ID NO: 3298 - protein, 451 aa, Sorghum bicolor
  misc_feature: Ceres ANNOT ID no. 6030338
  misc_feature (310)..(376): Pfam Id: Glutaredoxin Pfam Desc: Glutaredoxin
  misc_feature (1)..(451): NCBI GI: 116310344 NCBI Desc: osigba0134p10.4 [oryza sativa (indica cultivar-group)]
  misc_feature (283)..(451): NCBI GI: 60543345 NCBI Desc: at1g32760 [arabidopsis thaliana]
  misc_feature (284)..(450): NCBI GI: 115448683 NCBI Desc: os02g0748800 [oryza sativa (japonica cultivar-group)]
  misc_feature (303)..(450): NCBI GI: 124359980 NCBI Desc: thioredoxin fold [medicago truncatula]
  misc_feature (302)..(450): NCBI GI: 32490043 NCBI Desc: osjnba0063c18.3 [oryza sativa (japonica cultivar-group)]
MGCISSKLLPPGPGGDGGRRATVRGRVEHVVSLTSTTYGVLDLHPKHGGGAVLAAAAADAGEVEKEEPPPPPQDKPISKEWKRASMRPPPIAVPSADKKPAAGKPESGLEVINAWEIMAGLEEAYAAAAVAGSPPAKKPSKPGRWSPARVIAMALPSPKRSATRRKNTPGKENSPLQRCSGNLTSKDKDKDKTAGDVDGDRVLRPYNSIDNSKLSMASKRFSPGSARIVRKPGTAETGGGGGTGMSSSRRSLSPLFDPELLASIERELSEEGAHIKRMVGSEKPKHPKAAPPAIVAAEGKCPPGGAEAVVLYTTTLRGIRRTFEECNAVRAAIEAHDVKVIERDVSMDSGYREELRLLLGGREVRVPAVFVRGRHVGGAAEVAKLEEEGKLKALLEGLPRARVWCAGCAGVRFVMCRDCNGSRKVLDAERKETVKCGECNENGLVRCPICS

SEQ ID NO: 3299 - DNA, 1827 bp, Sorghum bicolor
  misc_feature: Ceres ANNOT ID no. 6030353
  misc_feature: Encodes the peptide sequence at SEQ ID NO 3300
atgagagcgctagcaggagcaaggcttcttgcttggtcatggctggcggtactgctgctgccggtggtggtgcagctggctggagcctcccatgtcgtctacgaggaagagaagctcgcggtggaggcggcggcggtgccgccgtccatcgtccacccgctgctgagaaccggctaccacttccagcctcccaagaactggatcaatgctccgttctactacaaggggtggtaccatttcttctaccagtacaaccccaaaggcgctgtatggggcaacatcgtatgggcgcactcggtctcacgcgacctcatcaactggatggcattagagccggcgatcaagcccagcatcccctccgacaagtacggctgctggtcgggctcggcgacgaccatgcccgacggcacgccggtgatcatgtacaccggcatcgaccgccccaacaccaactaccaggtccagaacgtcgcctaccctcggaacaagtccgacccgctgctccgggagtgggtgaagccgtcctacaacccggtcatcgtgccggaaggcggcatcaacgcgacgcagttccgcgacccgaccacggcctggcgcgccaccgccggcggcgacggccactggcggctgctcatcggcagcgtgaggacgacgacgacgacgggggccacggcgccgccccggggcgtggcgtatgtgtaccggagccgcgacttcaggcggtggacgcgggtccggcggccgctgcactcggcggcgacggggatgtgggagtgcccggacttctacccggtgagcagcgacgaggacggccgccgccggcgcgtggggctcgagacgtccgtgccgtcgggcgcaagggtgaagcacgtgctcaagaacagcctcgacctgcggcggtacgactactacaccgtcggcacgtacgaccgggacgccgagcggtacgtgccggacgaccccgccggcgacgacgacggcgagcgccgcctgcggtacgactacggcaacttctacgcgtccaagacgttctacgacccggcgaagcggcggcggatcctgtggggctgggccaacgagtccgacaccgccgccgacgatgtcgccaaagggtgggccgggattcaggcgattccgaggacggtgtggctggaccccagcgggaagcagctgctgcagtggcccgtcgaggaggtagaggcgctcagaggcaaggcggtcactctcaagaacagggtaatcaagccaggacagcacgtcgaggtgaccgggatacaaacagcacaggctgacgtggaggtgagcttcgaggtgtcgccgtcggccctggcgggagcggagcggctggacccggcgctcgccgacgacgccgagaggctgtgcggcgtcaagcgcgccgacgtgaagggcggcgtgggtccgttcgggctgtgggtgctggcctccgccaacctcaaggagagaaccgcggtgttcttcagggtgttcaaggccgccgccggcagcagcaacaacaagcccgtcgtgctcatgtgcaccgaccctaccaagtcgtctctgaacccaaacctgtaccgcccgacatttgccggttttgttgacacggacatttcaaatgggaagatatcgctgagaagcttgatcgaccgctcggtggtggagagctttggagccgggggcaagacgtgcatcctgtccagggtctacccgtcgctcgccatcggcaacaacgcgcgcctctacgtgttcaacaacgggaaggcggacgtcagggtgtcccgtctcactgcatgggagatgaagaagccactcatgaatggcgcatga

SEQ ID NO: 3300 - protein, 608 aa, Sorghum bicolor
  misc_feature: Ceres ANNOT ID no. 6030353
  misc_feature (60)..(395): Pfam Id: Glyco_hydro_32N Pfam Desc: Glycosyl hydrolases family 32 N terminal
  misc_feature (436)..(560): Pfam Id: Glyco_hydro_32C Pfam Desc: Glycosyl hydrolases family 32 C terminal
  misc_feature (73)..(608): NCBI GI: 121769367 NCBI Desc: cell wall invertase [sorghum bicolor]
  misc_feature (9)..(608): NCBI GI: 3372518 NCBI Desc: invertase [zea mays]
  misc_feature (9)..(608): NCBI GI: 4105719 NCBI Desc: cell wall invertase incw2; beta-fructosidase [zea mays]
  misc_feature (9)..(608): NCBI GI: 6318659 NCBI Desc: cell wall invertase 2 [zea mays]
  misc_feature (9)..(608): NCBI GI: 6318661 NCBI Desc: cell wall invertase 2 [zea mays]
  misc_feature (6)..(608): SWISSPROT Homolog: EC 3.2.1.26 Beta-fructofuranosidase, insoluble isoenzyme 2 precursor
  misc_feature: Useful for making plants with altered carbohydrate content
  misc_feature: Functional homolog of the protein sequence given in SEQ ID NO 13829
  misc_feature: Useful for making plants with modulated biomass
  misc_feature: Functional homolog of the protein sequence given in SEQ ID NO 13761
MRALAGARLLAWSWLAVLLLPVVVQLAGASHVVYEEEKLAVEAAAVPPSIVHPLLRTGYHFQPPKNWINAPFYYKGWYHFFYQYNPKGAVWGNIVWAHSVSRDLINWMALEPAIKPSIPSDKYGCWSGSATTMPDGTPVIMYTGIDRPNTNYQVQNVAYPRNKSDPLLREWVKPSYNPVIVPEGGINATQFRDPTTAWRATAGGDGHWRLLIGSVRTTTTTGATAPPRGVAYVYRSRDFRRWTRVRRPLHSAATGMWECPDFYPVSSDEDGRRRRVGLETSVPSGARVKHVLKNSLDLRRYDYYTVGTYDRDAERYVPDDPAGDDDGERRLRYDYGNFYASKTFYDPAKRRRILWGWANESDTAADDVAKGWAGIQAIPRTVWLDPSGKQLLQWPVEEVEALRGKAVTLKNRVIKPGQHVEVTGIQTAQADVEVSFEVSPSALAGAERLDPALADDAERLCGVKRADVKGGVGPFGLWVLASANLKERTAVFFRVFKAAAGSSNNKPVVLMCTDPTKSSLNPNLYRPTFAGFVDTDISNGKISLRSLIDRSVVESFGAGGKTCILSRVYPSLAIGNNARLYVFNNGKADVRVSRLTAWEMKKPLMNGA

SEQ ID NO: 3301 - DNA, 1767 bp, Sorghum bicolor
  misc_feature: Ceres ANNOT ID no. 6030359
  misc_feature: Encodes the peptide sequence at SEQ ID NO 3302
atggggactacgggtatggcggcggcgctgttgcttgtggcggttctgctgcactgcacgggcacggccatggtgcgggcgtcgcacactgtgtatccagagctccagtcgttggaggtggagaaggttgatgagatgtcgcgcaccgggtaccacttccagcctccaaagcactggatcaacgatccaaatggaccaatgtactacaaggggctgtaccatctcttctaccagtacaaccccaagggcgcggtgtggggcaacatcgagtgggcgcactcggtgtcaaccgacctgatcgactggacggcactagaccccgggatctacccgtccaagaacttcgacatcaagggctgctggtcaggctccgccaccgtgctccccagcggcatgccgatcgtcatgtacacgggcatcgaccccaacgatcaccaggtgcagaacctggcctaccccaagaacctctccgacccgttcctccgcgagtgggtcaagcccgactacaaccccatcatctcccccgacagcggcatcaacgccagcgccttccgcgacccgaccaccgcctggctcggccccgacaagcactggcgcctgctggtcggcagcagggtcgacgacaagggcctcgccgtgctgtaccggagccgggacttcaagcgctgggtcaaggcgcaccacccgctccactcgggcctcacggggatgtgggagtgcccggacttcttccccgtcgccgtccacggcggcagccgccaccaccgccgcggcgtcgacaccgccgagctgcacgacagggcgctcgccgaggaggtcaagtacgtgctcaaggtcagcctggacatgacgcgctacgagtactacaccgtggggtcctacgaccacgccacggaccgctacacccccgacgccggcttccgcgacaacgactacggcctccgctacgactacggcgacttctacgcgtccaagtcgttctacgatccggccaagcgccgccgcatcctctggggctgggctaacgagtcggacaccgtccccgatgaccgcagaaagggctgggccggcattcaggcgataccgaggaagctgtggctgtcgccgggcgggaagcagctgatccagtggccggtggaggaggtcaaggcgctgcgcgggaagcacgtgaacgtcagtgaccaggtcgtcaagggagggcagtacttcgaggtcgacggcttcaagtccgtgcagtcggacgtggaggtgacgttcgcggtcgacgacctgagcaaggcggagcagttcaacccaaagtggttcactgacccacaaaggctgtgcaagaagcggggcgcccgggagaagggcgaggtgggcccgttcgggctgtgggtgctggccgccggcgacctcacggagaggacggccgtcttcttcagggtgttcaggaccaacaccagcaggctcgtcgtactcatgtgcaacgaccctaccaactccacgttcgaggcgcaggtctaccgccccaccttcgccagcttcgtcaaccacgacatcgccaaaaccaaaaccatcgcactcaggacactgatcgaccactccgtggtggagagcttcggggccggcggaaggacgtgcatcttgtcgagggtgtacccgaagaaggccctgggcgacaacgcgcacctctttgtgttcaaccacggcgaggtggacgtcaaggtcgcgaagctggacgcctgggagatgaggacgccgaagatgaacgcgccggcgcagtag

SEQ ID NO: 3302 - protein, 588 aa, Sorghum bicolor
  misc_feature: Ceres ANNOT ID no. 6030359
  misc_feature (52)..(378): Pfam Id: Glyco_hydro_32N Pfam Desc: Glycosyl hydrolases family 32 N terminal
  misc_feature (419)..(538): Pfam Id: Glyco_hydro_32C Pfam Desc: Glycosyl hydrolases family 32 C terminal
  misc_feature (5)..(588): NCBI GI: 4105123 NCBI Desc: cell wall invertase; incw3; beta-fructofuranosidase [zea mays]
  misc_feature (1)..(585): NCBI GI: 73920069 NCBI Desc: beta-fructofuranosidase, insoluble isoenzyme 3 precursor (sucrose hydrolase 3) (invertase 3) (cell wall beta-fructosidase 3) (oscin3)
  misc_feature (1)..(585): NCBI GI: 29124959 NCBI Desc: apoplastic invertase [oryza sativa (indica cultivar-group)]
  misc_feature (1)..(585): NCBI GI: 50844559 NCBI Desc: cell-wall invertase 3 [oryza sativa (japonica cultivar-group)]
  misc_feature (1)..(585): NCBI GI: 33694264 NCBI Desc: cell wall invertase 3 [oryza sativa (indica cultivar-group)]
  misc_feature (1)..(585): SWISSPROT Homolog: EC 3.2.1.26 Beta-fructofuranosidase, insoluble isoenzyme 3 precursor
  misc_feature: Useful for making plants with altered carbohydrate content
  misc_feature: Functional homolog of the protein sequence given in SEQ ID NO 13829
  misc_feature: Useful for making plants with modulated biomass
  misc_feature: Functional homolog of the protein sequence given in SEQ ID NO 13761
MGTTGMAAALLLVAVLLHCTGTAMVRASHTVYPELQSLEVEKVDEMSRTGYHFQPPKHWINDPNGPMYYKGLYHLFYQYNPKGAVWGNIEWAHSVSTDLIDWTALDPGIYPSKNFDIKGCWSGSATVLPSGMPIVMYTGIDPNDHQVQNLAYPKNLSDPFLREWVKPDYNPIISPDSGINASAFRDPTTAWLGPDKHWRLLVGSRVDDKGLAVLYRSRDFKRWVKAHHPLHSGLTGMWECPDFFPVAVHGGSRHHRRGVDTAELHDRALAEEVKYVLKVSLDMTRYEYYTVGSYDHATDRYTPDAGFRDNDYGLRYDYGDFYASKSFYDPAKRRRILWGWANESDTVPDDRRKGWAGIQAIPRKLWLSPGGKQLIQWPVEEVKALRGKHVNVSDQVVKGGQYFEVDGFKSVQSDVEVTFAVDDLSKAEQFNPKWFTDPQRLCKKRGAREKGEVGPFGLWVLAAGDLTERTAVFFRVFRTNTSRLVVLMCNDPTNSTFEAQVYRPTFASFVNHDIAKTKTIALRTLIDHSVVESFGAGGRTCILSRVYPKKALGDNAHLFVFNHGEVDVKVAKLDAWEMRTPKMNAPAQ

SEQ ID NO: 3303 - DNA, 1128 bp, Sorghum bicolor
  misc_feature: Ceres ANNOT ID no. 6030361
  misc_feature: Encodes the peptide sequence at SEQ ID NO 3304
atggctgccgcttcctgggccgcgcccaccacctccttctcgccggcgccggcgccggcgcgggggccgtgcaggatcaaggcggcgcctttacccatcaggacgcttcaccgccgagtgcttctcaacgcagttggcgaatccgccatggttgctgctggtgacacattgcttggtttatatgagaaagagaggttaggcctctcgcagtatgccaccgacgagtttaatgaagagaggtactgggaaaccttggatgctgatttgcgttactggaccagatccctgcgcccagtgcagtggtatcctggtcatattgcaaaaacagagaaagaattgaaggaacaattgaggctcatggatgttgttatagagatccgtgatgctcggattcccttgtccaccagccatcctaagatggactcatggctaggcaaccggaaaaggatcatagtattgaatcgcgaggacatgatctcaactgaggataggaatgcatgggctacttactttgctaatcagggcaccaaagttgttttctccaacggccagctgggcatgggtacaatgaaactaggtaggatggcaaaatcggtagcatctgttgtgaacacaaagagaaaggaaaagggactacttcctcgtccggttcgagctggaatagttggatatccaaatgttggcaaatcttccttgattaatcgcttgctaaaacgaagaatgtgcccagcagcacctaggccaggtgtcacaagagagctgaagtgggttcgtttcggaacagacctagagttgttagattcacctggaattttgcctatgcgaattagtgaccagacatctgcactcaagcttgctatatgtgatgatattggagaaaggtcatatgatttcgctgatgtggcagcgattcttgtgcagatgttgataaggcatcctgcagcaggttctgaagcatttcgaagacgatataggattgatgtagatagcgattgcggtaaaacgtttgtcacaaagctctctgttcacttgttcaatggagacacaagccaggcggctttccggatattgtctgactacaggaaaggcaaatttggatgggtggcgctggagagacctccaacatga

SEQ ID NO: 3304 - protein, 375 aa, Sorghum bicolor
  misc_feature: Ceres ANNOT ID no. 6030361
  misc_feature (217)..(327): Pfam Id: MMR_HSR1 Pfam Desc: GTPase of unknown function
  misc_feature (99)..(375): NCBI GI: 81299923 NCBI Desc: gtp-binding [synechococcus elongatus pcc 7942]
  misc_feature (99)..(374): NCBI GI: 119491444 NCBI Desc: gtp-binding protein [lyngbya sp. pcc 8106]
  misc_feature (99)..(374): NCBI GI: 113476888 NCBI Desc: gtp-binding [trichodesmium erythraeum ims101]
  misc_feature (96)..(374): NCBI GI: 75910843 NCBI Desc: gtp-binding [anabaena variabilis atcc 29413]
  misc_feature (98)..(375): NCBI GI: 86606591 NCBI Desc: gtpase family protein [cyanobacteria bacterium yellowstone a-prime]
MAAASWAAPTTSFSPAPAPARGPCRIKAAPLPIRTLHRRVLLNAVGESAMVAAGDTLLGLYEKERLGLSQYATDEFNEERYWETLDADLRYWTRSLRPVQWYPGHIAKTEKELKEQLRLMDVVIEIRDARIPLSTSHPKMDSWLGNRKRIIVLNREDMISTEDRNAWATYFANQGTKVVFSNGQLGMGTMKLGRMAKSVASVVNTKRKEKGLLPRPVRAGIVGYPNVGKSSLINRLLKRRMCPAAPRPGVTRELKWVRFGTDLELLDSPGILPMRISDQTSALKLAICDDIGERSYDFADVAAILVQMLIRHPAAGSEAFRRRYRIDVDSDCGKTFVTKLSVHLFNGDTSQAAFRILSDYRKGKFGWVALERPPT

SEQ ID NO: 3305 - DNA, 1389 bp, Sorghum bicolor
  misc_feature: Ceres ANNOT ID no. 6030370
  misc_feature: Encodes the peptide sequence at SEQ ID NO 3306
atggcatctttctcctccctcgctgccacctcctcctccacctccaccccgtctttcaccctccccacaaaaacctcccctggcacagcctccctgtcattccccagggcgagagagtcgctgaagtccagggccaggatggtgacggtgcgggcggaggcggttgacacgaccatcagcccgcgggtgagcgcgctcaggccgtccaagaccatggccatcaccgaccaggccacggcgctgcgacaggccggcgtgccagtcatcggactcgccgccggggagccagacttcgacacgccggccgtgatcgctgaggctgggatgaatgccatcagagatggggctacaagatacacgcctaatgccggaactctggagctgaggaaggctatctgcaaaaagcttgaggaggagaatggtctatcgtacacacccgatcaggtgctagtaagcaatggagccaagcagtgcattacacaagcagtgcttgctgtatgctcacctggtgatgaagttttgatacctgctccatattgggtcagctaccctgagatggctagactggctggtgcaacgccagttattctccctacaagcatatcagacaattacctgctaaggccagagtcacttgcctcagtgatcaatgaaaattcaaggatcttgattctctgctctccatctaatccaacagggtctgtgtatcctaaggagttgcttgaggagattgctgctatagtcagaaagcatcctaggctcctagttttatctgatgagatctatgagcatattatctatcaacctgcgaaacacacaagctttgcttcattgcctggaatgtgggaaagaacgttaactgtgaatggattttctaaggcttttgctatgactggctggagactcggatacttagctgcccctaaacatttcgtcgcggcctgtggaaagatccaaagccagtacacctctggggccagtagtatatcacagaaggcagggcttgcagctttgaacctaggttatgctggtggtgaagcagtatcaaccatggtcaaagcattccaggagcgtcgtgattacctagtaagaagctttagggagctgccaggagtaaagatatccgaacctcagggagccttctatttatttatcgacttcagctcatactatgggtctgaggtggaaggttttggtaccatcaaggactctgagtccctctgtttgttcctgttggaaaaggcacaggttgcacttgtccctggggatgcatttggcgatgataagggcgttcgcatttcatatgctgcagctatgtcaacactgcaagctgcaatgggaaagattaaagaagcaatggctctgctcaagccccctgttgctgtttaa

SEQ ID NO: 3306 - protein, 462 aa, Sorghum bicolor
  misc_feature: Ceres ANNOT ID no. 6030370
  misc_feature (86)..(449): Pfam Id: Aminotran_1_2 Pfam Desc: Aminotransferase class I and II
  misc_feature (55)..(461): NCBI GI: 59932915 NCBI Desc: aspartate aminotransferase [pinus pinaster]
  misc_feature (52)..(462): NCBI GI: 30681649 NCBI Desc: aminotransferase class i and ii family protein [arabidopsis thaliana]
  misc_feature (62)..(457): NCBI GI: 83757397 NCBI Desc: aspartate aminotransferase [salinibacter ruber]
  misc_feature (59)..(457): NCBI GI: 29347825 NCBI Desc: aspartate aminotransferase [bacteroides thetaiotaomicron vpi-5482]
  misc_feature (59)..(457): NCBI GI: 53711886 NCBI Desc: aspartate aminotransferase [bacteroides fragilis ych46]
  misc_feature: Useful for making plants with modulated nitrogen use efficiency
  misc_feature: GREAT-hit functional homolog of the protein sequence encoded by LOCUS at2g22250
  misc_feature: Useful for making plants with modulated nitrogen use efficiency
  misc_feature: Functional homolog of the protein sequence given in SEQ ID NO 13831
  misc_feature: The sequence is a functional homolog of SEQ ID NO. 526 in the 11/188,298 US application
  misc_feature: The sequence is a functional homolog of SEQ ID NO. 286 in the 11/188,298 US application
  misc_feature: The sequence is a functional homolog of SEQ ID NO. 527 in the 11/188,298 US application
MASFSSLAATSSSTSTPSFTLPTKTSPGTASLSFPRARESLKSRARMVTVRAEAVDTTISPRVSALRPSKTMAITDQATALRQAGVPVIGLAAGEPDFDTPAVIAEAGMNAIRDGATRYTPNAGTLELRKAICKKLEEENGLSYTPDQVLVSNGAKQCITQAVLAVCSPGDEVLIPAPYWVSYPEMARLAGATPVILPTSISDNYLLRPESLASVINENSRILILCSPSNPTGSVYPKELLEEIAAIVRKHPRLLVLSDEIYEHIIYQPAKHTSFASLPGMWERTLTVNGFSKAFAMTGWRLGYLAAPKHFVAACGKIQSQYTSGASSISQKAGLAALNLGYAGGEAVSTMVKAFQERRDYLVRSFRELPGVKISEPQGAFYLFIDFSSYYGSEVEGFGTIKDSESLCLFLLEKAQVALVPGDAFGDDKGVRISYAAAMSTLQAAMGKIKEAMALLKPPVAV

SEQ ID NO: 3307 - DNA, 1791 bp, Sorghum bicolor
  misc_feature: Ceres ANNOT ID no. 6030373
  misc_feature: Encodes the peptide sequence at SEQ ID NO 3308
atggaggctgcggtctccagcgccggcggcgagtcagcgggcgagctgcttctccgcgcggcggcgctggtgccgtggacgcgctacgtcctcgcggcgctcgccctcgccgccgcgctcctgtacaggttcctcgagctccacttcctgggcgacctcctccgcggcctccgcggcggccgcgtctcgcttaccttccaccccgactctcaagtgtaccaccgggtcgcctccaagtgccgctcgctgcacggcaggtacctggcgacgccgtggttagcgagtcctcatttgcagacgttgttcctgagcatatctggcaggccaccttcattcacctatgggaggcagctgtacactgttcgtgacggtgggaccattgccttagattggttactagcctctgatcttgaagctggagatgttggcacttgtgatggaaccatttctaaggatgattcaacacctcttgttgttgtgatacctggattaactagtgattctagtgctgcttatgtgaagcacttggtcttttctatggcaatcaaaggatggaatgttgttgtaagcaaccacaggggtctgggtggcatctccataacatctgattgcttttacaatgccgggtggacggaagatatgcgtgaagttgttaatttccttcatcaagagtatccgaaggctccactattcactgttgggacaagcataggtgccaatattgtggtcaagtatcttggagaagaaggtgaaaatacacctgtagctggtgctgcatctatttgttctccctgggatctgctggtgaccaacagatttatttcacgcaagcttgtgcagcgatgttacgatagagctcttgcaattggtctcaaaggatatgcaaaactacatcaaccagtcttggcacgacttgcaaactgggaagctattacatcgtcacactctatccgggaatttgaccgccatgccacttgtgttgttgcaaaatatgagacagtggacacattctaccgcaagtgcagcagtgcaaattatatcagcaacgtttcagttcccctgctttgtatcagtgccttagatgaccccctctgcacaagggaggccattccctgggatgaatgcagggcaaacaaaaacattgtattggcaactacacctaatggcggacatcttgctttctttgaaggcctaactgctagaaagctttggtgggtaaagcctgtttccgagttcctctgtgctctgcatgatggcccctacatgcatcggcagaaggcacaagaacatgatttgcactcatcgttggaatcatcaattgacaaaagcccatatgtgaatttcatggaagatggaatggtagctgcagtaacaaatgatagccctaacaacggtgactccttgcacaacgagatttctggtgaaattgaactcaatgatagcatggttgtccaacacgtacaacacaatcaaaacaccggagcaatacaaaatgagagtgacagttgggcggatgataaaaacagctcagaagggaatgcgatgactgttcaagcacacggaggatctcaagaacagcgagaagagccatatgcgaacaaaatctgtgaagccattggtcctgttaagaaatccataaaccaactcagtcgaacccaggggaggtcagtctggttgcttgcttacattgctcttgtaacctcttggccgttgcttggggccctaggtttttacttcttcaggaaaaggtctagtaattctctgttagctagaaagctgaagaaattgtaa

SEQ ID NO: 3308 - protein, 596 aa, Sorghum bicolor
  misc_feature: Ceres ANNOT ID no. 6030373
  misc_feature (185)..(407): Pfam Id: Abhydrolase_1 Pfam Desc: alpha/beta hydrolase fold
  misc_feature (78)..(440): NCBI GI: 1350545 NCBI Desc: emb8 [picea glauca]
  misc_feature (82)..(377): NCBI GI: 115447607 NCBI Desc: os02g0649400 [oryza sativa (japonica cultivar-group)]
  misc_feature (80)..(418): NCBI GI: 28302356 NCBI Desc: abhd1-prov protein [xenopus laevis]
  misc_feature (80)..(416): NCBI GI: 18203711 NCBI Desc: alpha/beta hydrolase domain containing protein 3 [homo sapiens]
  misc_feature (80)..(416): NCBI GI: 23397663 NCBI Desc: alpha/beta hydrolase domain containing protein 3 [homo sapiens]
MEAAVSSAGGESAGELLLRAAALVPWTRYVLAALALAAALLYRFLELHFLGDLLRGLRGGRVSLTFHPDSQVYHRVASKCRSLHGRYLATPWLASPHLQTLFLSISGRPPSFTYGRQLYTVRDGGTIALDWLLASDLEAGDVGTCDGTISKDDSTPLVVVIPGLTSDSSAAYVKHLVFSMAIKGWNVVVSNHRGLGGISITSDCFYNAGWTEDMREVVNFLHQEYPKAPLFTVGTSIGANIVVKYLGEEGENTPVAGAASICSPWDLLVTNRFISRKLVQRCYDRALAIGLKGYAKLHQPVLARLANWEAITSSHSIREFDRHATCVVAKYETVDTFYRKCSSANYISNVSVPLLCISALDDPLCTREAIPWDECRANKNIVLATTPNGGHLAFFEGLTARKLWWVKPVSEFLCALHDGPYMHRQKAQEHDLHSSLESSIDKSPYVNFMEDGMVAAVTNDSPNNGDSLHNEISGEIELNDSMVVQHVQHNQNTGAIQNESDSWADDKNSSEGNAMTVQAHGGSQEQREEPYANKICEAIGPVKKSINQLSRTQGRSVWLLAYIALVTSWPLLGALGFYFFRKRSSNSLLARKLKKL

SEQ ID NO: 3309 - DNA, 669 bp, Sorghum bicolor
  misc_feature: Ceres ANNOT ID no. 6030396
  misc_feature: Encodes the peptide sequence at SEQ ID NO 3310
atggaacccgccgcggcgatgtcgagatccccgtgctctatcatctcgccggcctccctatcgaccgccccactcctccccgcacgcctcgccgtccggccccgccgccgcgcgcctgctttcgttgcgccctccccctcaggcaggccgctcgtcgcgcggcgcgctgcggccggagacaaggtcgaggccgagacgcccatagagaaaagattccctcccttcccaactgtcatggacatcaaccagatccgtgacatcctgccacataggtttccgtttcttctggttgacagagttattgattacaaaccaggagaatatgctgttgcaatcaagaatgtgacaataaatgataacttcttcccggggcatttccctgaacgacccataatgcctggtgttcttatggttgaggcaatggcccaggttggaggaatagtgatgttgcagcccgaagtaggtggatctcgtgagaacttcttttttgcggggatggataaagtgaggtttcggaagcctgtgattgctggagacaccttgatcatgagaatgactctgatcaagctgcagaagagattcggaattgcaaagatggaagggaaagcttacgttggtgccgacctagtatgcgaaggagagttcttgatggctactggatcagagtga

SEQ ID NO: 3310 - protein, 222 aa, Sorghum bicolor
  misc_feature: Ceres ANNOT ID no. 6030396
  misc_feature (88)..(214): Pfam Id: FabA Pfam Desc: FabA-like domain
  misc_feature (3)..(222): NCBI GI: 72255615 NCBI Desc: 117m18_14 [brassica rapa]
  misc_feature (4)..(221): NCBI GI: 75706918 NCBI Desc: beta-hydroxyacyl-acp dehydratase [picea mariana]
  misc_feature (4)..(221): NCBI GI: 75706919 NCBI Desc: beta-hydroxyacyl-acp dehydratase b [picea mariana]
  misc_feature (3)..(222): NCBI GI: 72384436 NCBI Desc: 52o08_29 [brassica rapa subsp. pekinensis]
  misc_feature (10)..(222): NCBI GI: 72384415 NCBI Desc: 4d11_17 [brassica rapa subsp. pekinensis]
MEPAAAMSRSPCSIISPASLSTAPLLPARLAVRPRRRAPAFVAPSPSGRPLVARRAAAGDKVEAETPIEKRFPPFPTVMDINQIRDILPHRFPFLLVDRVIDYKPGEYAVAIKNVTINDNFFPGHFPERPIMPGVLMVEAMAQVGGIVMLQPEVGGSRENFFFAGMDKVRFRKPVIAGDTLIMRMTLIKLQKRFGIAKMEGKAYVGADLVCEGEFLMATGSE

SEQ ID NO: 3311 - DNA, 804 bp, Sorghum bicolor
  misc_feature: Ceres ANNOT ID no. 6030415
  misc_feature: Encodes the peptide sequence at SEQ ID NO 3312
atggcgtcgtcgcgggtgatggcgtcgtcgtccccgccgcagcacggcgccggctcgtcgtcctcggacctcgcgcgattcaggagcagcagcggcatcggatccatgaacatggacgacatcatccgcaacatctacggccccgacgccgtcaacgccgccgccggcgccggaccggcggagccctccccggcggcggcggcggcggccccggaggctgcggctgcggcggtggcgcggcggacgtcggaggaggtgtggaaggagatctccgccgccggagggctctcggcgcccgtcctcctccctccccctcccgccgcctgctccggcaccggcgggtccagaggcggcgccgcggagatgacgctggaggatttcctcgccagggattcctgcgccagggccgcggtcttggaggggaacatggcgctggggttccctgacgctgacggaggggatgcggcagggagcggcgtggcggggggagtaggagtaggcggcgggaggggaagcaccaggaagcgcgcgcttctggatcccgcggaccgcgccgtgatgcagcggcagaagcgcatgatcaagaaccgcgagtccgcggccaggtccagggacaggaaacaggcgtatgtcgcggagctggaatcgcaggttatgcagctcgaggaggagcaagcagaactgttaagggagcaggaggaccgacggcaaaacaggcttaaggagctaattgaaagggtatttccagtcatcaggaaaaaatcatcacaagatcttagaagaaccaactccatggaatggtag

SEQ ID NO: 3312 - protein, 267 aa, Sorghum bicolor
  misc_feature: Ceres ANNOT ID no. 6030415
  misc_feature (184)..(238): Pfam Id: bZIP_2 Pfam Desc: Basic region leucine zipper
  misc_feature (184)..(244): Pfam Id: bZIP_1 Pfam Desc: bZIP transcription factor
  misc_feature (79)..(267): NCBI GI: 29367541 NCBI Desc: ose2-like protein [oryza sativa (japonica cultivar-group)]
  misc_feature (1)..(267): NCBI GI: 115441267 NCBI Desc: os01g0867300 [oryza sativa (japonica cultivar-group)]
  misc_feature (50)..(267): NCBI GI: 7638404 NCBI Desc: ose2 [oryza sativa]
  misc_feature (50)..(267): NCBI GI: 1753085 NCBI Desc: leucine zipper protein
  misc_feature (75)..(267): NCBI GI: 92876274 NCBI Desc: camp response element binding (creb) protein [medicago truncatula]
  misc_feature: The sequence is a functional homolog of SEQ ID NO 1761 in the 10/374,780US patent application
  misc_feature: The sequence is a functional homolog of SEQ ID NO 1762 in the 10/374,780US patent application
  misc_feature: The sequence is a functional homolog of SEQ ID NO 338 in the 10/374,780US patent application
  misc_feature: The sequence is a functional homolog of SEQ ID NO 770 in the 10/225,066US patent application
  misc_feature: Useful for making plants with modulated growth and phenotype characteristics
  misc_feature: The sequence is a functional homolog of SEQ ID NO 770 in the 20050160493 US patent application
  misc_feature: The sequence is a functional homolog of SEQ ID NO 1761 in the 20060162006 US patent application
  misc_feature: The sequence is a functional homolog of SEQ ID NO 1762 in the 20060162006 US patent application
  misc_feature: The sequence is a functional homolog of SEQ ID NO. 337 in the 11/188,298 US application
MASSRVMASSSPPQHGAGSSSSDLARFRSSSGIGSMNMDDIIRNIYGPDAVNAAAGAGPAEPSPAAAAAAPEAAAAAVARRTSEEVWKEISAAGGLSAPVLLPPPPAACSGTGGSRGGAAEMTLEDFLARDSCARAAVLEGNMALGFPDADGGDAAGSGVAGGVGVGGGRGSTRKRALLDPADRAVMQRQKRMIKNRESAARSRDRKQAYVAELESQVMQLEEEQAELLREQEDRRQNRLKELIERVFPVIRKKSSQDLRRTNSMEW

SEQ ID NO: 3313 - DNA, 1026 bp, Sorghum bicolor
  misc_feature: Ceres ANNOT ID no. 6030429
  misc_feature: Encodes the peptide sequence at SEQ ID NO 3314
atggaccacgcggcggaggcgcagcggacggacctgatgacgatcacgcggcacgtgctgaacgagcagagccgccacccggagtcccgcggcgacttcaccatcctcctctcccacatcgtcctcggctgcaagttcgtcgcctccgccgtcaacaaggccggcctcgccaagctcatcggcctcgctggcgagaccaacgtccagggtgaggagcaaaagaagctggatgtcctgtccaacgaagtctttgtcaaggcgctcgtcagcagcggccgcacctgtgttcttgtgtctgaagagaacgaggaggccatcttcgtcgacccggccctccgcggaaagtactgcgtttgtttcgatccgctggatggctcctccaacatcgactgcggtgtctccatcggaacaatctttgggatttacatgatcaaagataaggacaacgtgactttggaggatgtacttcagcctggaacaaacatgcttgctgctggctattgcatgtatgggagttcctgcacgcttgtgttgagcacgggaaatggagtcaatggtttcactcttgatccttcccttggagagttcattttgacccatccaaatatcaagataccaaagaaagggaagatttattcagtcaacgaagggaatgccaaaaactgggatgggcctacagcaaaatttgtggagaaatgcaaatatcctcaggatggttcatcgcctaaatccttgagatatattggaagtatggttgctgatgtccatcgtaccttactatatgggggcatatttttgtacccagcagaccagaagagtccaaacggaaaactacgtgttctgtatgaagtcttcccgatgtcattcctgatggaacaagctggaggccagtctttcacaggaaaacaacgggcccttgaacttgctcccgctaaacttcacgacagatccccaatattcctcgggagctacgatgacgtggaggagatcaaagcactgtacgcttcagagtcaaacaatgcttga

SEQ ID NO: 3314 - protein, 341 aa, Sorghum bicolor
  misc_feature: Ceres ANNOT ID no. 6030429
  misc_feature (13)..(337): Pfam Id: FBPase Pfam Desc: Fructose-1-6-bisphosphatase
  misc_feature (1)..(341): NCBI GI: 76363515 NCBI Desc: fructose-1,6-bisphosphatase, cytosolic (d-fructose-1,6-bisphosphate 1-phosphohydrolase) (fbpase)
  misc_feature (1)..(338): NCBI GI: 6684169 NCBI Desc: fructose-1,6-bisphosphatase [porteresia coarctata]
  misc_feature (1)..(338): NCBI GI: 56785198 NCBI Desc: fructose-1,6-bisphosphatase [oryza sativa (japonica cultivar-group)]
  misc_feature (1)..(338): NCBI GI: 3041775 NCBI Desc: fructose-1,6-bisphosphatase [oryza sativa]
  misc_feature (1)..(338): NCBI GI: 115441253 NCBI Desc: os01g0866400 [oryza sativa (japonica cultivar-group)]
  misc_feature (1)..(341): SWISSPROT Homolog: EC 3.1.3.11 Fructose-1,6-bisphosphatase, cytosolic
  misc_feature: Useful for making plants with modulated biomass
  misc_feature: GREAT-hit functional homolog of the protein sequence given in SEQ ID NO 13362
  misc_feature: Useful for making plants with modulated biomass
  misc_feature: Functional homolog of the protein sequence given in SEQ ID NO 13362
  misc_feature: The sequence is a functional homolog of SEQ ID NO. 285 in the 11/188,298 US application
  misc_feature: The sequence is a functional homolog of SEQ ID NO. 474 in the 11/188,298 US application
MDHAAEAQRTDLMTITRHVLNEQSRHPESRGDFTILLSHIVLGCKFVASAVNKAGLAKLIGLAGETNVQGEEQKKLDVLSNEVFVKALVSSGRTCVLVSEENEEAIFVDPALRGKYCVCFDPLDGSSNIDCGVSIGTIFGIYMIKDKDNVTLEDVLQPGTNMLAAGYCMYGSSCTLVLSTGNGVNGFTLDPSLGEFILTHPNIKIPKKGKIYSVNEGNAKNWDGPTAKFVEKCKYPQDGSSPKSLRYIGSMVADVHRTLLYGGIFLYPADQKSPNGKLRVLYEVFPMSFLMEQAGGQSFTGKQRALELAPAKLHDRSPIFLGSYDDVEEIKALYASESNNA

SEQ ID NO: 3315 - DNA, 885 bp, Sorghum bicolor
  misc_feature: Ceres ANNOT ID no. 6030442
  misc_feature: Encodes the peptide sequence at SEQ ID NO 3316
atgtctgcagtgcatgcgcggttattttctcccccttcttttgtgagaactttttttcccttgtgttgttgggataggattgggaaggagagcctcaaggcgggagatcacatctactcctggagggccgcgtgggtctacgcgcatcacggaatatatatgggtgatgataaggtgatccattttacaagaggaagtggccaggaggttggaacaggaactgtcgttgatattcttcttgtgagttctgccccaaaacgaagcaacacgccttgcccggtatgcaccaacgaaaccagtgataccagcacagagacaaacggcgtggtatcctcttgcctcagctgcttcctagctgggggtgctctttaccgttttgagtatgcagtcaacccagcgctcttccttgccaaagcgcgaggaggaacgtgcactctcgcgtgctctgatcctgacgatacggtgattcgccgtgcgaagtacttgctgaacaatggtttcaggtgctacaatctgttcaagagcaactgcgaggactttgcgatatactgcaagactggccttcttgtggctgagcgcggtgttgttgggcagagcgggcaggctatctccatcatcggtggacctctcgccgcagtggtctcaaccccgttccgcttggttaccacaaatatctatggaatggcagtgatggccgtcggggtgtactgtgcaagcaggtatgcagctgatattggcaatcgccgtgacgtggtgaaagtggaagtcgaggacctgacggccggactggccagtggcaggatacgtgctgtggagaacatcgcccagctgatggctccggcagcagaaagcccggccacggccacggccacactggctgcttaa

SEQ ID NO: 3316 - protein, 294 aa, Sorghum bicolor
  misc_feature: Ceres ANNOT ID no. 6030442
  misc_feature (126)..(197): Pfam Id: NC Pfam Desc: NC domain
  misc_feature (26)..(275): NCBI GI: 115477657 NCBI Desc: os08g0546900 [oryza sativa (japonica cultivar-group)]
  misc_feature (25)..(263): NCBI GI: 18378812 NCBI Desc: nc domain-containing protein-related [arabidopsis thaliana]
  misc_feature (35)..(83): NCBI GI: 119539525 NCBI Desc: nc domain protein [nocardioides sp. js614]
MSAVHARLFSPPSFVRTFFPLCCWDRIGKESLKAGDHIYSWRAAWVYAHHGIYMGDDKVIHFTRGSGQEVGTGTVVDILLVSSAPKRSNTPCPVCTNETSDTSTETNGVVSSCLSCFLAGGALYRFEYAVNPALFLAKARGGTCTLACSDPDDTVIRRAKYLLNNGFRCYNLFKSNCEDFAIYCKTGLLVAERGVVGQSGQAISIIGGPLAAVVSTPFRLVTTNIYGMAVMAVGVYCASRYAADIGNRRDVVKVEVEDLTAGLASGRIRAVENIAQLMAPAAESPATATATLAA

SEQ ID NO: 3317 - DNA, 1173 bp, Sorghum bicolor
  misc_feature: Ceres ANNOT ID no. 6030443
  misc_feature: Encodes the peptide sequence at SEQ ID NO 3318
atggcgtccgaatcctcaccgccgccggcggaggcgccaccgccggttccgggaaacaagctggcggtattctggcacgagggcatgctggcccacgacgccggccgcggcgtgttcgactcgggccgcgatccgggattcctggatgtgctcgaccagcacccggagaacgccgaccgcgtccgcaacatggtctccatcctccgccgcgggcccatcgcgcacttcctctcctggcactcgggccgccccgcccacgcctccgagcttcgctccttccactcctcagaatacatagaggagcttgtgcaggcgaacgccaccggagccaagaagctctgcgagggcacattcttgaacccgggctcctggggcgcggtgcttctagcggccggaaccacgctctctgctgtgaagcacatactagatgggcacgggaacctggcctacgcgttggttcggccccctggccaccacgcgcagcccggccatgcagatggttactgctttctgaacaatgccggacttgctgtgcagctggctctggattccgggcgtgcaaaggttgctgttgtggatattgatgtacactacgggaatggtactgcagagggcttctatcgcacagacaatgtgttgacaatgtctcttcacatgaggcatggttcttgggggccatcgcatccgcaaagtggctccgtcgatgagattggtgaaggcaaggggcttgggtacaatctcaatatacctttgcctaatggaagtggagatgctgggtatgaatatgcgatgaacgagttggttgttccagcgattgataagtttcagcctcagcttttagttttggtgattggccaagattctagtgcgtttgatcccaatggaagacagtgcttgaccatggaaggctacaggaaaattggacaaataatgaggagcctggctaatcgacatagcaacgggcaaatattggttgtccaggaagggggttaccacatcacttattcagcatactgtctgcatgctacactggaaggagttttggatctggaagccccgctccttgatgacccgatcgcttactaccccgaggatgaggagtacactatgaaagttgtcgacatggtaaggagttgctggaaggaatcggttcctttcctgaaggacatttag

SEQ ID NO: 3318 - protein, 390 aa, Sorghum bicolor
  misc_feature: Ceres ANNOT ID no. 6030443
  misc_feature (20)..(349): Pfam Id: Hist_deacetyl Pfam Desc: Histone deacetylase domain
  misc_feature (19)..(388): NCBI GI: 87240922 NCBI Desc: histone deacetylase superfamily [medicago truncatula]
  misc_feature (19)..(388): NCBI GI: 20453297 NCBI Desc: at1g08460/t27g7_7 [arabidopsis thaliana]
  misc_feature (19)..(290): NCBI GI: 6664310 NCBI Desc: t27g7.14 [arabidopsis thaliana]
  misc_feature (64)..(388): NCBI GI: 16226923 NCBI Desc: at1g08460/t27g7_7 [arabidopsis thaliana]
  misc_feature (179)..(385): NCBI GI: 94442894 NCBI Desc: histone deacetylase [platanus x acerifolia]
MASESSPPPAEAPPPVPGNKLAVFWHEGMLAHDAGRGVFDSGRDPGFLDVLDQHPENADRVRNMVSILRRGPIAHFLSWHSGRPAHASELRSFHSSEYIEELVQANATGAKKLCEGTFLNPGSWGAVLLAAGTTLSAVKHILDGHGNLAYALVRPPGHHAQPGHADGYCFLNNAGLAVQLALDSGRAKVAVVDIDVHYGNGTAEGFYRTDNVLTMSLHMRHGSWGPSHPQSGSVDEIGEGKGLGYNLNIPLPNGSGDAGYEYAMNELVVPAIDKFQPQLLVLVIGQDSSAFDPNGRQCLTMEGYRKIGQIMRSLANRHSNGQILVVQEGGYHITYSAYCLHATLEGVLDLEAPLLDDPIAYYPEDEEYTMKVVDMVRSCWKESVPFLKDI

SEQ ID NO: 3319 - DNA, 2244 bp, Sorghum bicolor
  misc_feature: Ceres ANNOT ID no. 6030461
  misc_feature: Encodes the peptide sequence at SEQ ID NO 3320
  misc_feature: Down-regulated in root tissues in response to methyl jasmonate treatment
  misc_feature: Up-regulated in shoot tissues in response to methyl jasmonate treatment
  misc_feature: Down-regulated in root tissues in response to salicylic acid treatment
atggcggtgcgagccacggtctcccgcttcccggccacgccggaggcgctggagtcgtgcgccgtccagtggggcgtcgccgtgacgcccttcgccgccgccgacgagcgcggccagccgccgaccaccggcgccggcggggaccgcgtcccgcgctgcgagcactgctgggcgtacctgagcagccactgcgatctggagcgctggggctggacctgcgcgctctgcggcacgctcaacggattcgacgacgagaccgagcgacggttccagcgacccgccgcgtgccccgagctcaactcctctttcgtcgacctcgagatcccagtggatgaggcagagggtggaggagatggcgtgcaggcgctgcctgtttatgtggccgcagtggatctcgcatgttccgaagacttcctggaactcatcaagagtgcgcttcttgcggccttagaagctcttattccgggctccctatttgggcttatgacattcagccacaagattgggttgtatgatgtccaaggtccgattccactcgtaaaaaatgtttttattcctccggacttagaagaagatggcctgcctgttgcccttgaagatgccatgcccctacattcttttttggctccagttgacacatgcaaggatcgaattgctgctgctctggagacactgcgacctacatcttcatgggagagaggtgctgcttctgggcaggaagaggatactgttttgctcggaggacgaggttttgggacagccatgtctgctttaattgagtacctaagttcagaatatggttctacttttgctttagctcgggtttttgcttttctgtctggtgctcctgattatggagctggtctgctagataccaggagatatggggagcaatatgctagtaaaggggtagatgctgaccttgcattactccctgaacagatacctttctacagagacctagcagctgttgctgttcaatcaggagtatgcgtagacatatttgctgtaactgatgaatacactgatttggcttcactgaagtttttaagtattgaaagtggtggatctttatttctttatgcaaatacagacgattcaacgcttccccaagacatataccgcttgctaagtcgaccctatgcatttggttgtgttctaaggctcagaacatcttcagattttgaaccaggcaattcttatgggcatttcttccctgaccctcaatatgaaaatgtgcaacacatcatctgctgtgattcatttgccacttatgcttatgactttgagtttgcccataacaacggtttctccaggcacacagatcctgctgttgtccagatcgcttttcagtacagcgtgattgaacctgtcaaggagacattaggcaatggttcacaatcatctgcaagttacaagttctgtctaaagaggcggttgagaataagaacattgcagtatcgtccagctagtaatatcagtgaaatttatgacagtgtagatccagaggttgtactgcatatccttgttcataaggttattttagaatctttggataaaggtgttagagaaggcaggcatcaagtgcatgcttggctatccctccttgcagcccggtataatcaggctctgagctctgatgtgcgaactccgctatcgagcattgacattgacttctcacagtgcccacagcttcaaacgatacctcaacttgtttttgcattgttgagaagccctcttcttcgcttgcatgaagaaggcgtacacccagattacaggatatatctacaatgccttttcagtgcactggagccatcttctctagctaaagccgtatatccagttttagtatcgtattcctcacctgacaagcaagcattcccacgacacactctgagccgtgctgctctaataatgagcgaaagtccaatatttcttctcgacacatttaccaaccttattgtttactatttgtcaactgctgatccttcaattccttttcctccaccccgtgactgtcttttgagaacaacaatcaatagactgaagcaggacagatgtataaccccaaagcttacattcatccatggagggaaagatgattcaacattgtttgagagctatctcattgaagagcaagatgttgatggatcaggctttactactggttcaggttttgtagccttccgtgagagcgtgaggaatgttgcaggggagatcatccaggaagaaattggaagttag

SEQ ID NO: 3320 - protein, 747 aa, Sorghum bicolor
  misc_feature: Ceres ANNOT ID no. 6030461
  misc_feature (121)..(377): Pfam Id: Sec23_trunk Pfam Desc: Sec23/Sec24 trunk domain
  misc_feature (49)..(86): Pfam Id: zf-Sec23_Sec24 Pfam Desc: Sec23/Sec24 zinc finger
  misc_feature (1)..(739): NCBI GI: 38346322 NCBI Desc: oj000126_13.4 [oryza sativa (japonica cultivar-group)]
  misc_feature (1)..(739): NCBI GI: 116310345 NCBI Desc: osigba0134p10.5 [oryza sativa (indica cultivar-group)]
  misc_feature (3)..(657): NCBI GI: 44983230 NCBI Desc: ael272wp [eremothecium gossypii]
  misc_feature (3)..(657): NCBI GI: 45190334 NCBI Desc: ael272wp [eremothecium gossypii]
  misc_feature (3)..(660): NCBI GI: 126273912 NCBI Desc: component of copii coat of er- golgi vesicles [pichia stipitis cbs 6054]
  misc_feature: Down-regulated in root tissues in response to methyl jasmonate treatment
  misc_feature: Up-regulated in shoot tissues in response to methyl jasmonate treatment
  misc_feature: Down-regulated in root tissues in response to salicylic acid treatment
MAVRATVSRFPATPEALESCAVQWGVAVTPFAAADERGQPPTTGAGGDRVPRCEHCWAYLSSHCDLERWGWTCALCGTLNGFDDETERRFQRPAACPELNSSFVDLEIPVDEAEGGGDGVQALPVYVAAVDLACSEDFLELIKSALLAALEALIPGSLFGLMTFSHKIGLYDVQGPIPLVKNVFIPPDLEEDGLPVALEDAMPLHSFLAPVDTCKDRIAAALETLRPTSSWERGAASGQEEDTVLLGGRGFGTAMSALIEYLSSEYGSTFALARVFAFLSGAPDYGAGLLDTRRYGEQYASKGVDADLALLPEQIPFYRDLAAVAVQSGVCVDIFAVTDEYTDLASLKFLSIESGGSLFLYANTDDSTLPQDIYRLLSRPYAFGCVLRLRTSSDFEPGNSYGHFFPDPQYENVQHIICCDSFATYAYDFEFAHNNGFSRHTDPAVVQIAFQYSVIEPVKETLGNGSQSSASYKFCLKRRLRIRTLQYRPASNISEIYDSVDPEVVLHILVHKVILESLDKGVREGRHQVHAWLSLLAARYNQALSSDVRTPLSSIDIDFSQCPQLQTIPQLVFALLRSPLLRLHEEGVHPDYRIYLQCLFSALEPSSLAKAVYPVLVSYSSPDKQAFPRHTLSRAALIMSESPIFLLDTFTNLIVYYLSTADPSIPFPPPRDCLLRTTINRLKQDRCITPKLTFIHGGKDDSTLFESYLIEEQDVDGSGFTTGSGFVAFRESVRNVAGEIIQEEIGS

SEQ ID NO: 3321 - DNA, 1350 bp, Sorghum bicolor
  misc_feature: Ceres ANNOT ID no. 6030466
  misc_feature: Encodes the peptide sequence at SEQ ID NO 3322
atggcaacacagctagttttctccaatgcttccagttgccggtgcccattaggcatttcgccaataaggaagacgcttcttggtgaaagtgcaagttttcagagaaagaagtggtttgctggtgattcctatcgcttttctcgactcgagtgctctgcaaactcccgccgagctgggccaaggcgtaccaaggataccttatatgaccttcaccctgagatctccttgctttatggagaagataatggtgcagctactgtatccagcaaagagcagggcattgacactgcagctgaaagattggtggacactcctccctcttaccgctataatgagcccaggattaaagtcataggggtcgggggtggtggctccaatgctgtgaacaggatgattgaaagctccatgaagggtgtggaattctggattgtgaacactgattttcaggctatgcggatgtcacccatcgaaccagaaaataggctacagattggccaggaattgacacgtggtcttggtgctggtgggaacccagaaattggcatgaatgcaggcaaggaaagccaggagttggtagaacaggcagttgctggtgctgatatggctggaatgggaggtgggacaggcactggtggcgcacctattattgcagggattgcaaagtccatgggtatattgactgttggaattgtcacaaccccattttcattcgagggaagaaggcgggctctccaggcacaagaaggaattgcatcgttgagaagcaatgttgatacactgattgtaattccaaatgataagttactgactgctgtatccccaaatactcctgtgacagaagcattcaatttggcagatgatattcttcggcaaggtgttcgtgggatatcagatataatcactgtgccaggtctggtgaatgtggactttgctgatgttcgatcagttatgtcagatgctggctcatcattgatgggcattggaacagcaacaggcaagacacgagccagagatgccgcactcaatgccatacagtctcctctacttgatattggtattgaaagagtgaatgctgcagctgaagtaatctatgatcttgttgaccctggtgcaaatctgatttttggctctgttatagatccgtcatacactggtcaagtgagcataactctaattgcaactggtttcaagcgccaggaggaaagtgagagccggtcttcacaggctggaggagacagcaaccgtggtcgctcgggttggttttctcccacttcccaggaggatggccatgcattgcaaatcccagagttccttcagaggaaagggcggtcagggtttccacgagtctga

SEQ ID NO: 3322 - protein, 449 aa, Sorghum bicolor
  misc_feature: Ceres ANNOT ID no. 6030466
  misc_feature (113)..(304): Pfam Id: Tubulin Pfam Desc: Tubulin/FtsZ family, GTPase domain
  misc_feature (306)..(408): Pfam Id: Tubulin_C Pfam Desc: Tubulin/FtsZ family, C-terminal domain
  misc_feature (19)..(382): NCBI GI: 6685070 NCBI Desc: ftsz protein [gentiana lutea]
  misc_feature (48)..(382): NCBI GI: 14787784 NCBI Desc: ftsz-like protein [nicotiana tabacum]
  misc_feature (48)..(382): NCBI GI: 7672163 NCBI Desc: chloroplast ftsz-like protein [nicotiana tabacum]
  misc_feature (54)..(382): NCBI GI: 92867662 NCBI Desc: cell division protein ftsz [medicago truncatula]
  misc_feature (45)..(382): NCBI GI: 8570530 NCBI Desc: llftsz [lilium longiflorum]
MATQLVFSNASSCRCPLGISPIRKTLLGESASFQRKKWFAGDSYRFSRLECSANSRRAGPRRTKDTLYDLHPEISLLYGEDNGAATVSSKEQGIDTAAERLVDTPPSYRYNEPRIKVIGVGGGGSNAVNRMIESSMKGVEFWIVNTDFQAMRMSPIEPENRLQIGQELTRGLGAGGNPEIGMNAGKESQELVEQAVAGADMAGMGGGTGTGGAPIIAGIAKSMGILTVGIVTTPFSFEGRRRALQAQEGIASLRSNVDTLIVIPNDKLLTAVSPNTPVTEAFNLADDILRQGVRGISDIITVPGLVNVDFADVRSVMSDAGSSLMGIGTATGKTRARDAALNAIQSPLLDIGIERVNAAAEVIYDLVDPGANLIFGSVIDPSYTGQVSITLIATGFKRQEESESRSSQAGGDSNRGRSGWFSPTSQEDGHALQIPEFLQRKGRSGFPRV

SEQ ID NO: 3323 - DNA, 201 bp, Sorghum bicolor
  misc_feature: Ceres ANNOT ID no. 6030542
  misc_feature: Encodes the peptide sequence at SEQ ID NO 3324
atggccggcggtaccgagaagacgtcatggccggaggtggtcgggctgagcgtggagaaggccaagaaaaccatcctcaaagacaagcctgacgccgacatcatcgtgctgcccgtcggcacgccggtgcccaaggatttccagcctaaccgggtgcgcatcttcgtcgacatcgtcgtggagacgccccatgttggctag

SEQ ID NO: 3324 - protein, 66 aa, Sorghum bicolor
  misc_feature: Ceres ANNOT ID no. 6030542
  misc_feature (7)..(66): Pfam Id: potato_inhibit Pfam Desc: Potato inhibitor I family
  misc_feature (3)..(66): NCBI GI: 48093402 NCBI Desc: mpi [zea perennis]
  misc_feature (3)..(66): NCBI GI: 48093414 NCBI Desc: mpi [zea perennis]
  misc_feature (3)..(66): NCBI GI: 48093416 NCBI Desc: mpi [zea perennis]
  misc_feature (3)..(66): NCBI GI: 48093384 NCBI Desc: mpi [zea diploperennis]
  misc_feature (3)..(66): NCBI GI: 48093378 NCBI Desc: mpi [zea diploperennis]
MAGGTEKTSWPEVVGLSVEKAKKTILKDKPDADIIVLPVGTPVPKDFQPNRVRIFVDIVVETPHVG

SEQ ID NO: 3325 - DNA, 222 bp, Sorghum bicolor
  misc_feature: Ceres ANNOT ID no. 6030543
  misc_feature: Encodes the peptide sequence at SEQ ID NO 3326
atgagctcctcggcggaagcggagcgcggcggcgccaagaagcagtcatggccagaggtggtcggactgagcgtggaggaggccaagaaggttatcctcaaagataagcccgatgcagacattttcgtgctgcccgtcggatcgccggtgaccagggatttccgtccgaaccgtgtccgcatcttcgtcgacaccgtcgccgagacgccccgtgtcggctag

SEQ ID NO: 3326 - protein, 73 aa, Sorghum bicolor
  misc_feature: Ceres ANNOT ID no. 6030543
  misc_feature (14)..(73): Pfam Id: potato_inhibit Pfam Desc: Potato inhibitor I family
  misc_feature (3)..(73): NCBI GI: 48093416 NCBI Desc: mpi [zea perennis]
  misc_feature (3)..(73): NCBI GI: 48093384 NCBI Desc: mpi [zea diploperennis]
  misc_feature (3)..(73): NCBI GI: 48093370 NCBI Desc: mpi [zea diploperennis]
  misc_feature (1)..(73): NCBI GI: 48093418 NCBI Desc: mpi [tripsacum dactyloides]
  misc_feature (3)..(73): NCBI GI: 48093402 NCBI Desc: mpi [zea perennis]
MSSSAEAERGGAKKQSWPEVVGLSVEEAKKVILKDKPDADIFVLPVGSPVTRDFRPNRVRIFVDTVAETPRVG

SEQ ID NO: 3327 - DNA, 237 bp, Sorghum bicolor
  misc_feature: Ceres ANNOT ID no. 6030547
  misc_feature: Encodes the peptide sequence at SEQ ID NO 3328
atggatatgaccagtgaccagaagaaatcatgttcttttgaggaaactcagaagaaaacatgttggcctgagtttgtaggcctgtccatcacacaggcagtcccaagcattctaaaagacatgcctaacgccgaaattgaagtgctggctcttggctcgcctatgactcatgacttccgccccaaccgtgtccgcatcttcgttgataccgttgctcagaccccgatggttggctga

SEQ ID NO: 3328 - protein, 78 aa, Sorghum bicolor
  misc_feature: Ceres ANNOT ID no. 6030547
  misc_feature (19)..(78): Pfam Id: potato_inhibit Pfam Desc: Potato inhibitor I family
  misc_feature (17)..(78): NCBI GI: 20513869 NCBI Desc: ci2c [hordeum vulgare]
  misc_feature (19)..(78): NCBI GI: 48093370 NCBI Desc: mpi [zea diploperennis]
  misc_feature (19)..(78): NCBI GI: 48093402 NCBI Desc: mpi [zea perennis]
  misc_feature (19)..(78): NCBI GI: 48093414 NCBI Desc: mpi [zea perennis]
  misc_feature (19)..(78): NCBI GI: 48093416 NCBI Desc: mpi [zea perennis]
MDMTSDQKKSCSFEETQKKTCWPEFVGLSITQAVPSILKDMPNAEIEVLALGSPMTHDFRPNRVRIFVDTVAQTPMVG

SEQ ID NO: 3329 - DNA, 222 bp, Sorghum bicolor
  misc_feature: Ceres ANNOT ID no. 6030548
  misc_feature: Encodes the peptide sequence at SEQ ID NO 3330
atgagctccacaacgggggttcagagcactggtggcgtgtggtcgtggcctaacattattgggtttacaatggaagatgccatgattatcatccttagggacaagcctgatgctgatattgtctttctgccagttggctcgccggtgaccacaaacgacttccgccccaaccgcgttcgcatatttctggacactatcgtctccccgccccgtgtgggctag

SEQ ID NO: 3330 - protein, 73 aa, Sorghum bicolor
  misc_feature: Ceres ANNOT ID no. 6030548
  misc_feature (15)..(73): Pfam Id: potato_inhibit Pfam Desc: Potato inhibitor I family
  misc_feature (1)..(73): NCBI GI: 75994169 NCBI Desc: maize protease inhibitor [zea mays subsp. parviglumis]
  misc_feature (1)..(73): NCBI GI: 75994171 NCBI Desc: maize protease inhibitor [zea mays subsp. parviglumis]
  misc_feature (1)..(73): NCBI GI: 475253 NCBI Desc: proteinase inhibitor [zea mays]
  misc_feature (1)..(73): NCBI GI: 48093416 NCBI Desc: mpi [zea perennis]
  misc_feature (1)..(73): NCBI GI: 75994145 NCBI Desc: maize protease inhibitor [zea mays subsp. parviglumis]
MSSTTGVQSTGGVWSWPNIIGFTMEDAMIIILRDKPDADIVFLPVGSPVTTNDFRPNRVRIFLDTIVSPPRVG

SEQ ID NO: 3331 - DNA, 2625 bp, Sorghum bicolor
  misc_feature: Ceres ANNOT ID no. 6030549
  misc_feature: Encodes the peptide sequence at SEQ ID NO 3332
atggcggcgcgtggcggcgaggcggcggcgttcggggcctcggaggcggaccgcggcgacttcgaggtgttccgcagcggctccgcgccgcccaccgtcgagggtgccctgggcgccgccgctgcagccgccgccggcggcctgctcgtggacgatgagctccgctctgacccggcgtatcagagctattactactccaatgcgcacctcaacccgcgcctcccgccgccgctcctctccaaggaggactggcggtcctcgcaccaccgcctccgctcctccgcgggcttcggcgggatcggggacggcaggaggcagcagcagcagcaggcgtcggctgccgaagggacggtcggactgcccgggatcgatctcggtcgccagaggagcttctcttcagtctttcaggaggactcgtatcagcgtgatatggataggcagactgctagccacaatactaatgacttactaggttcttctggaatacagtatggtctaaatcgtggacctggaactattggaggcctgcactctagcaatagtttacggagcttggatgaatttcagaacactgatctgccatcaaatacatttgcttctattttagggtcatctctttctaggagtgcatctccagatcctgagcttgtgaggagggcccctagtccatctctgcctccaattggtgtgaaagttagtaacactgataagaagatcaatggtggttcctcttctttccgtcgtagttcatccgcaatcggtgaatctgatgatctggtggctgctttatctgggatgaacttatcatctagggcaatgagtgggcaaactatggaccagtctcagctgtatcaggatgtcgataatgtccagaagttcctttttgatcgacagggtgaccagacaaatggcaatcagcagcactacatgagacgtcctgagcatgggcaatctaagttaccagatggatattcttccaatttggtcaattcatctacgatgaggaaccagattaatgctggaagtttcacatcttttgacagtttgtctcttggatctggctttgcttcccctaggattggttctagatcccctggagggactgtatcttctcgacaaaatttagctggtatgtctaacatgctaaactataatggaattggaagtccaactgcatcaccttctcttcagacctctattgatccagcgtatatccagtaccttgcccaacttgcagctacctgtgatgatcctctaatggacaggggccatctgggaaattcttacatggacttacttggtactcagaaagctaaccttggccctttactccagtcgcaaaagcaatatggttactatggtaatcttggatttaaccttggatatgctggaagtccattgacaagtcctgttcttccctcttcacctattgcgccaggaagtccacttaggcatggtgagcgcaacatgcgctttccatcaggcatgagaaacttcggtaattcctttggttcatggaattcaggcatgggtggaaagatggatgccaatttgatgccctcacttctggaggagttcaagagcaacaaaagtaaatcatatgagctctcggaaatagctggccatgttgttgagtttagtgctgatcaatatgggagtcggttcatacaacagaagctagagacagccagtactgaagaaaaggacatggttttttcagaaatcatgcctcaagctctcacattgatgactgatgtatttggaaattatgttgttcaaaagttttttgagcatggaagcactgcccagataaaggaattggctggtcagcttattggacgtgtccttgctcttagtcttcagatgtatgggtgccgggttatacagaaggctatagaagttgttgatttggatctgcagactaaaatggttgcagagctggagggccatgtcatgcgctgtgtacgtgatcaaaatgggaaccatgttatacagaaatgcatagagtgcattcctcagcatgctatcgagtttattgtctcgacattctatggtcaagttgtaatgctatccactcatccatatggttgtcgagttattcagagggttctagagcattgtgatgatcctaagacacagcaaataatgatggatgagattctccagtctgtttgcttgctagctcaggaccagtatggcaactatgttgttcagcatgttctggaacatggcaaaccacatgagagatcggctattattgagaagctaattggccaaattgtgcaaatgagccagcaaaagtttgcctcaaatgtcatcgagaagtgcttagcctttggaaatcctgtagagcgtcaggttctgattggtgagatgcttggatccactagtgaaagcgaacctcttgaggtaatgatgaaagaccagtttgcaaactatgtggtgcagaaggtgttagaaacttgtgatgatcagcagagagagatgatcctaacaaggataaagacacacctgaacaccctcaagaagtacacatacgggaagcacatagtagcacgtgtagagaagcttgttgctgctggagagaagcgccttgggcttcaaccagcatgcaccgctgcctga

SEQ ID NO: 3332 - protein, 874 aa, Sorghum bicolor
  misc_feature: Ceres ANNOT ID no. 6030549
  misc_feature (219)..(537): Pfam Id: NABP Pfam Desc: Nucleic acid binding protein NABP
  misc_feature (538)..(572): Pfam Id: PUF Pfam Desc: Pumilio-family RNA binding repeat
  misc_feature (574)..(608): Pfam Id: PUF Pfam Desc: Pumilio-family RNA binding repeat
  misc_feature (610)..(644): Pfam Id: PUF Pfam Desc: Pumilio-family RNA binding repeat
  misc_feature (646)..(680): Pfam Id: PUF Pfam Desc: Pumilio-family RNA binding repeat
  misc_feature (682)..(716): Pfam Id: PUF Pfam Desc: Pumilio-family RNA binding repeat
  misc_feature (719)..(753): Pfam Id: PUF Pfam Desc: Pumilio-family RNA binding repeat
  misc_feature (755)..(789): Pfam Id: PUF Pfam Desc: Pumilio-family RNA binding repeat
  misc_feature (797)..(831): Pfam Id: PUF Pfam Desc: Pumilio-family RNA binding repeat
  misc_feature (1)..(874): NCBI GI: 115461673 NCBI Desc: os05g0109600 [oryza sativa (japonica cultivar-group)]
  misc_feature (136)..(874): NCBI GI: 20513851 NCBI Desc: bpm [hordeum vulgare]
  misc_feature (323)..(868): NCBI GI: 115441005 NCBI Desc: os01g0844800 [oryza sativa (japonica cultivar-group)]
  misc_feature (146)..(868): NCBI GI: 87241276 NCBI Desc: nucleic acid binding nabp [medicago truncatula]
  misc_feature (374)..(867): NCBI GI: 92885524 NCBI Desc: nucleic acid binding nabp [medicago truncatula]
  misc_feature: The sequence is a functional homolog of SEQ ID NO 1232 in the 10/666,642US patent application
  misc_feature: Useful for making plants with modulated growth and phenotype characteristics
  misc_feature: The sequence is a functional homolog of SEQ ID NO 1232 in the 20070033671 US patent application
  misc_feature: The sequence is a functional homolog of SEQ ID NO 1232 in the 10/666,642 US patent application
MAARGGEAAAFGASEADRGDFEVFRSGSAPPTVEGALGAAAAAAAGGLLVDDELRSDPAYQSYYYSNAHLNPRLPPPLLSKEDWRSSHHRLRSSAGFGGIGDGRRQQQQQASAAEGTVGLPGIDLGRQRSFSSVFQEDSYQRDMDRQTASHNTNDLLGSSGIQYGLNRGPGTIGGLHSSNSLRSLDEFQNTDLPSNTFASILGSSLSRSASPDPELVRRAPSPSLPPIGVKVSNTDKKINGGSSSFRRSSSAIGESDDLVAALSGMNLSSRAMSGQTMDQSQLYQDVDNVQKFLFDRQGDQTNGNQQHYMRRPEHGQSKLPDGYSSNLVNSSTMRNQINAGSFTSFDSLSLGSGFASPRIGSRSPGGTVSSRQNLAGMSNMLNYNGIGSPTASPSLQTSIDPAYIQYLAQLAATCDDPLMDRGHLGNSYMDLLGTQKANLGPLLQSQKQYGYYGNLGFNLGYAGSPLTSPVLPSSPIAPGSPLRHGERNMRFPSGMRNFGNSFGSWNSGMGGKMDANLMPSLLEEFKSNKSKSYELSEIAGHVVEFSADQYGSRFIQQKLETASTEEKDMVFSEIMPQALTLMTDVFGNYVVQKFFEHGSTAQIKELAGQLIGRVLALSLQMYGCRVIQKAIEVVDLDLQTKMVAELEGHVMRCVRDQNGNHVIQKCIECIPQHAIEFIVSTFYGQVVMLSTHPYGCRVIQRVLEHCDDPKTQQIMMDEILQSVCLLAQDQYGNYVVQHVLEHGKPHERSAIIEKLIGQIVQMSQQKFASNVIEKCLAFGNPVERQVLIGEMLGSTSESEPLEVMMKDQFANYVVQKVLETCDDQQREMILTRIKTHLNTLKKYTYGKHIVARVEKLVAAGEKRLGLQPACTAA

SEQ ID NO: 3333 - DNA, 2661 bp, Sorghum bicolor
  misc_feature: Ceres ANNOT ID no. 6030552
  misc_feature: Encodes the peptide sequence at SEQ ID NO 3334
atgtcttcgccggacccttcgccagcgacgagcaccccctcgccggcgacgagcacccaacagcagaagcaatcggagagtttggtaaatctactggcagaggcaagcaggttctaccgcagagcatataatgaactgttctcaggtgttactactgagcaggagcctgaatcatcgactaatactcctgagtatatgctttttgggtggtatctcttcttaatgcttcattcgagatcaccagaattgttcaaggatctggtgtcctgcatccatggattagttgctgtgttggccatacttttgatccacgtgccagttaaatttaggagcttcactgttgaaggctcttctcacttaatcaaacaaactgagaaaggcatggatcttattgcttcgttatgccataattatcatgcctctgaagaacgtttgaaagaaatgatggacaagtctcacaaggcaatagaagacgtttttggcatgaaagcactaagtgcttcagagtgcaaaacagaaaatttggatatgataggcacaggcatggaacccttcctcacatatggcctgatgtatttcaaaggtctcattgatatggagtgtttccagtcaaatctggaaaaaatggagaaactatgtaattctaatagcagtgaagggaagcttgattttaaatcaattttgatcaataatgattatattccctgtgctgagaacttgtctggggattccaccaatttaggacattcaaagcatgtctttgaaatattggcatctcccacaaagacaataaagaacatgttgactgttcctagttcccctttgtcacccgccaccagtggttcagtcaagattgtgcaaatgacaccagtaacttctgccatgacgacagctaagtggctccgtgaggtgatatcttcattgccagagaagccttcatctaagcttcagcagttgctgtcatcatgcgatagggatttgacaaatgctgtcacagaaagggtcagcatagttttggaagcaatttttccaaccaagtcttctgctgatgggggtggctcattaggcctcaattgtgcaaatgtctttgatattccatgggcagaagccagaaaaatggaggcttccaagttgtactacagggtattagaggcaatctgcagagctgagttacaaaacagcaatgtaaataatctaactccattgctgttaaatgagcgttttcaccgatgtttgattgcatgttcagcagagctagtgttggcgacacataagccagtcttcatgatgtttcctgctgttcttgagagcacgggtctaactgcatttgatttgagcaaaataattgagaattttgtgagacatgaagagaccctcccaagacaattgaaaaggcacctaaattccttagaagaacagcttttggaaagcatggtatgggagaaaggatcatcattgtataactcactgattgttgccaggccatctattgcttcagaaataaaacaccttggtcttttggctgaaccaatgccatctctggatgacttagtggcaaggcagaatattcatgttgagggcttgcctgctacaccatctaaaaaacgtgatgctggtccagaagatgacaatgctgatcctcgatcaccaaagagatcgtgcaatgaatctaggaacacagtggtagagcacaatttgctgacacctccacccaagcaccacatggtgtcgactagtttgaaagcaaaatgccatccactcgagtccacatttgcaagtccgactgtcagtaatcctgttggtgggaatgaaaaatgtgctgacgtggcaattcagatattcttttccaaaattctgaagttggctgctgttagaataagaaacttgtgtgaaagggttcaacatgtggaactgacagagcgtgtctataatgtcttcaatcagattcttgatcaacagacaacattattctttaatagacacatcgatcaacttatcctttgctgtctttatggtgttgcaaaggcttgtaaagtagaactctcattcaaggagttactcaactattacagaaaagaagcacaatgcaaaccagaagtttttcaaaatatctatattgggagtaggaatagtaatgacgtattagtatcacgccatgttagtatcattagtttttacaacgcggtgtttgttccagcagccaagcctttcctggtgtcactaatatcatctggtacttgtccagaagacaagaagaatgctagtggcccaattcctggatcacccaagccatctcctctcccaaataatttaccagatatgtccccgaagaaagtttcagcatctcataatgtatacgtgtctcctttgcggcaaaccaaggctatggatgcacttctgtcaccaagttccaggagtttttatgcatgcattggtgaaggcacccatgcttatcagagcccatctaaagatttggctgctataaatagtcgcctaaattatagcggccggagaataaacagtcgattaaactttgacatggtgagcgactcagtggtagctggtagtctgggccagccaaatggtggttctacctccttcaatcccgcagctgcatttagccccctttcaaagaagagaaagccagatgatcaaatataa

SEQ ID NO: 3334 - protein, 886 aa, Sorghum bicolor
  misc_feature: Ceres ANNOT ID no. 6030552
  misc_feature (289)..(490): Pfam Id: RB_A Pfam Desc: Retinoblastoma-associated protein A domain
  misc_feature (609)..(736): Pfam Id: RB_B Pfam Desc: Retinoblastoma-associated protein B domain
  misc_feature (1)..(883): NCBI GI: 2352795 NCBI Desc: retinoblastoma-related protein 1 [zea mays]
  misc_feature (13)..(883): NCBI GI: 9716502 NCBI Desc: retinoblastoma related protein rbr1 [zea mays]
  misc_feature (1)..(883): NCBI GI: 24561941 NCBI Desc: retinoblastoma-related protein [zea mays]
  misc_feature (199)..(883): NCBI GI: 1617474 NCBI Desc: rb1 protein [zea mays]
  misc_feature (271)..(848): NCBI GI: 2352799 NCBI Desc: retinoblastoma-related protein 2b [zea mays]
MSSPDPSPATSTPSPATSTQQQKQSESLVNLLAEASRFYRRAYNELFSGVTTEQEPESSTNTPEYMLFGWYLFLMLHSRSPELFKDLVSCIHGLVAVLAILLIHVPVKFRSFTVEGSSHLIKQTEKGMDLIASLCHNYHASEERLKEMMDKSHKAIEDVFGMKALSASECKTENLDMIGTGMEPFLTYGLMYFKGLIDMECFQSNLEKMEKLCNSNSSEGKLDFKSILINNDYIPCAENLSGDSTNLGHSKHVFEILASPTKTIKNMLTVPSSPLSPATSGSVKIVQMTPVTSAMTTAKWLREVISSLPEKPSSKLQQLLSSCDRDLTNAVTERVSIVLEAIFPTKSSADGGGSLGLNCANVFDIPWAEARKMEASKLYYRVLEAICRAELQNSNVNNLTPLLLNERFHRCLIACSAELVLATHKPVFMMFPAVLESTGLTAFDLSKIIENFVRHEETLPRQLKRHLNSLEEQLLESMVWEKGSSLYNSLIVARPSIASEIKHLGLLAEPMPSLDDLVARQNIHVEGLPATPSKKRDAGPEDDNADPRSPKRSCNESRNTVVEHNLLTPPPKHHMVSTSLKAKCHPLESTFASPTVSNPVGGNEKCADVAIQIFFSKILKLAAVRIRNLCERVQHVELTERVYNVFNQILDQQTTLFFNRHIDQLILCCLYGVAKACKVELSFKELLNYYRKEAQCKPEVFQNIYIGSRNSNDVLVSRHVSIISFYNAVFVPAAKPFLVSLISSGTCPEDKKNASGPIPGSPKPSPLPNNLPDMSPKKVSASHNVYVSPLRQTKAMDALLSPSSRSFYACIGEGTHAYQSPSKDLAAINSRLNYSGRRINSRLNFDMVSDSVVAGSLGQPNGGSTSFNPAAAFSPLSKKRKPDDQI

SEQ ID NO: 3335 - DNA, 1872 bp, Sorghum bicolor
  misc_feature: Ceres ANNOT ID no. 6030558
  misc_feature: Encodes the peptide sequence at SEQ ID NO 3336
atggaaagtcctgagtattgtgagataaactcaaatatgactctcgactacataaaccaactgttaatggatgagggcactgatgagaaggacagcatataccaacaatttgatgcacttcaggccatagagaagccattttatgatattcttggacagacatatccatcctcacctaaggagacaatgatcagtggagataccgaagtagattgtccccaagacaattatagtaaacaggcacgcagtggttgttttgtcaatgacgttttaggaccacaaggtacgcacctggtaactcatgattggacttctgaatgtgaccgtttgtctttgcaatttgagagaggtgctgaggaagcaaataagttagttcccagtattgtgaaattggttgatctggacagtaatgggctttctgattccaatcaaatgatagaagcaacaattggacaaaagggcaagcatgtaagcaaaatacgaagccatgtggacttggagtttttggaagcaaggaacagtaagcatttggccatctcggctagtgaaacaacccgggatgaaatgtttgacagtgttctgctctgtgattggcagtttaattgtgatgctgctcatcttagagaaatcaaggaaaaacaagcaaacaacagttcgcagaatgtttggagaaaaggatatggtcaagggcaagtgaagttgcgagttaagaaagaggaggggattgacctcagggctcatctcatgcagtgtgcacaagcaatcgtagtaaacaaccttccatttgccagtgacctactggagaagataaggtgtcacgcttcaccatatggagatggctctcagaggctggcactttaccttgcaaatggtcttgatgcacgcttggccggaacagggagtcatgtgtatcagaaactgatggagaaacgaacaagggccacagacatgttaaaggcctaccgccttttcattgcagtgtgccctttctctaaggtagcatactacttctccaaccaaacaattgtagacctatcaaacggacgaccaaaggtgcatatcattgattttggcatcacactaggctttcagtggccatcactaatccagcgctttgcgaagcgagaaggtgggccccctaagcttcgtatcacaggcatagatgcacctcagccaggttttcgcccccgtgcaataattgaggcgacaggaaaacggttggctgagtatgcagaaatgttcaatgtaccttttgagtaccaaggtatcgcctcacaatgggaagatatctgcatcgagaatctcaatattgacaatgatgaggtgcttatagtcaactgcatgtaccgaacaaaatatcttggcgatgagacagaagacatagatagtgcaagggatagggtactgcgtaccatgaagaggatcaacccagaggttctcattcttggcgttctaaatgggctctacagctccccattcttcctgccacgattcagagaggttttgttccattattctgcgctgtttgacatgctcgatgcaactgctctccggagtcatgaagataggatacagctagagagggatctgtttgggccagaagcacttaatgttgtagcgtgtgagggtgcagaaaggatcgagaggccagagacttacaaacaatggcaagtgagatgtctcaaggctgggttcaagcaacttcctgttgataaagcaatcctgaagagatcaatagacgaaaaaaacaagcattatcatgaaggctttgtcattgacgaagatagcagatggctgctacaaggatggaaggggaggataatgcatgcggtatcctcatggaaaccaaaagaatcgtacactaatcagtaa

SEQ ID NO: 3336 - protein, 623 aa, Sorghum bicolor
  misc_feature: Ceres ANNOT ID no. 6030558
  misc_feature (218)..(524): Pfam Id: GRAS Pfam Desc: GRAS family transcription factor
  misc_feature (91)..(616): NCBI GI: 32813435 NCBI Desc: scarecrow-like protein [lilium longiflorum]
  misc_feature (152)..(616): NCBI GI: 125743130 NCBI Desc: scarecrow-like protein 1 [pinus radiata]
  misc_feature (165)..(619): NCBI GI: 15222433 NCBI Desc: scarecrow-like transcription factor 14 (scl14) [arabidopsis thaliana]
  misc_feature (165)..(608): NCBI GI: 8778540 NCBI Desc: f22g5.9 [arabidopsis thaliana]
  misc_feature (154)..(619): NCBI GI: 89474466 NCBI Desc: gras4 [solanum lycopersicum]
  misc_feature: The sequence is a functional homolog of SEQ ID NO 1327 in the 10/374,780US patent application
  misc_feature: Useful for making plants with modulated growth and phenotype characteristics
  misc_feature: The sequence is a functional homolog of SEQ ID NO 1327 in the 20060162006 US patent application
  misc_feature: The sequence is a functional homolog of SEQ ID NO 1324 in the 10/374,780 US patent application
  misc_feature: The sequence is a functional homolog of SEQ ID NO 1471 in the 10/412,699 US patent application
MESPEYCEINSNMTLDYINQLLMDEGTDEKDSIYQQFDALQAIEKPFYDILGQTYPSSPKETMISGDTEVDCPQDNYSKQARSGCFVNDVLGPQGTHLVTHDWTSECDRLSLQFERGAEEANKLVPSIVKLVDLDSNGLSDSNQMIEATIGQKGKHVSKIRSHVDLEFLEARNSKHLAISASETTRDEMFDSVLLCDWQFNCDAAHLREIKEKQANNSSQNVWRKGYGQGQVKLRVKKEEGIDLRAHLMQCAQAIVVNNLPFASDLLEKIRCHASPYGDGSQRLALYLANGLDARLAGTGSHVYQKLMEKRTRATDMLKAYRLFIAVCPFSKVAYYFSNQTIVDLSNGRPKVHIIDFGITLGFQWPSLIQRFAKREGGPPKLRITGIDAPQPGFRPRAIIEATGKRLAEYAEMFNVPFEYQGIASQWEDICIENLNIDNDEVLIVNCMYRTKYLGDETEDIDSARDRVLRTMKRINPEVLILGVLNGLYSSPFFLPRFREVLFHYSALFDMLDATALRSHEDRIQLERDLFGPEALNVVACEGAERIERPETYKQWQVRCLKAGFKQLPVDKAILKRSIDEKNKHYHEGFVIDEDSRWLLQGWKGRIMHAVSSWKPKESYTNQ

SEQ ID NO: 3337 - DNA, 1881 bp, Sorghum bicolor
  misc_feature: Ceres ANNOT ID no. 6030560
  misc_feature: Encodes the peptide sequence at SEQ ID NO 3338
atggacaaccctgagtactgtgagataaactcaaacataactctcaactatgtaaaccaactattgatggaagaaagcgctgatgagaatattagcacatacaaacatcatgatgcactccaggccatggagaagcccttctacgatattcttggaaaggcatatccatcctcacctaaacagactgtgatcaatagtggcagtcaatcaaatttccctgatgatattaacaacaattatcatgacctggaatgcagtggtagctctgtcagtgatattcttgggtgcaaggctgtgcgcttgatagacatagatggcggttctgaactttgcaatgtggttttgcaattcaacagaactgctgaggaagcaaggaagcttgttccaagtatcgagaaattggtagttgatccagagagcaatggcctttccagttccaaacaaacaattgaggcaacaattggacaacatagcaagcatacaaacaaaataaggagccaccctcatgtggacttggagttggtggagaggagaaacagtaagcattcagcaatctcaacaagtgaaataatccgggatgaaatatttgacagagttctgctctgtgatgaacagtatcattgcgatgttgctcaccttagagaaatgaaggcaaaagaagcaaacatatctctgcagtatgttcgaaacacaggatccgcccaaggaaaagagaagtcacaaggtaagaagcaagaaaaggaagaggttgatctcagggctcttctaatccagtgtgcacaggcgatatcatctaacaaccatccatttgccagtgagctactgaaaaagatcaggcatcattcttcgccatatggagatggttttcagaggctggcaatttattttgcagatgctcttgaggcacgtgtggctgggactgggagtcaaatgtatcagaagttagtggtgaagcaaacaagctgcttagacatgctgaaggcctacagccttttcattgcagcaagccctttcgtcagggtagcatactactttggcaataaaacaatcgttgatgtactggggggtcgaccaagggtgcatataattgattttggcatcttgtttggctttcaatggccatcgctaatccagcggcttgcaaagcgagaaggtggaccccctcaacttcgcatcacaggtatcaatgtacctgagacaggttttcgcccctgcaaaacaattgaggagacaggaaagcggttggctgagtatgcaagaatgttcaatgtaccttttcagtaccaaggtgttgcctcacgatgggaagacatatacattccagatctcaacattgacaaggacgaggtgctcatagtcaactgcttgcacaaaatgaaaaaccttggcgatgagacagaagacatagatagtgcaagggatagggtactgcgtatcatgaagaggatgaatccaaatgttctcataattggtgtcatgaatgggttgtacagctccccgttcttcctaccacgattcagagaggctttgttctattactcatcacagtttgacatgctaaattcaactgttgcacagaatcacgaggcaaggatcctgatagagagggatctccttggggcagatgtgtttaatgttgtagcatgtgaaggtgcagagaggatcgagaggccagagagttacaaacaatggcaagtaagaatcctcaaggctgggttcaagcaacttcctgttaatcagaccattctaaagagttcactagacagaaaggagctttatcatgaagactttgtcattgacgaagatagtggctggttgctgcagggatggaaaggaaggataatgcatgcactttcttcatggaaacgtaaagattcatag

SEQ ID NO: 3338 - protein, 626 aa, Sorghum bicolor
  misc_feature: Ceres ANNOT ID no. 6030560
  misc_feature (228)..(532): Pfam Id: GRAS Pfam Desc: GRAS family transcription factor
  misc_feature (86)..(621): NCBI GI: 32813435 NCBI Desc: scarecrow-like protein [lilium longiflorum]
  misc_feature (157)..(622): NCBI GI: 125743130 NCBI Desc: scarecrow-like protein 1 [pinus radiata]
  misc_feature (161)..(621): NCBI GI: 15222433 NCBI Desc: scarecrow-like transcription factor 14 (scl14) [arabidopsis thaliana]
  misc_feature (161)..(615): NCBI GI: 8778540 NCBI Desc: f22g5.9 [arabidopsis thaliana]
  misc_feature (165)..(621): NCBI GI: 125743148 NCBI Desc: scarecrow-like protein 1 [castanea sativa]
  misc_feature: The sequence is a functional homolog of SEQ ID NO 1327 in the 10/374,780US patent application
  misc_feature: Useful for making plants with modulated growth and phenotype characteristics
  misc_feature: The sequence is a functional homolog of SEQ ID NO 1327 in the 20060162006 US patent application
  misc_feature: The sequence is a functional homolog of SEQ ID NO 1324 in the 10/374,780 US patent application
  misc_feature: The sequence is a functional homolog of SEQ ID NO 1471 in the 10/412,699 US patent application
MDNPEYCEINSNITLNYVNQLLMEESADENISTYKHHDALQAMEKPFYDILGKAYPSSPKQTVINSGSQSNFPDDINNNYHDLECSGSSVSDILGCKAVRLIDIDGGSELCNVVLQFNRTAEEARKLVPSIEKLVVDPESNGLSSSKQTIEATIGQHSKHTNKIRSHPHVDLELVERRNSKHSAISTSEIIRDEIFDRVLLCDEQYHCDVAHLREMKAKEANISLQYVRNTGSAQGKEKSQGKKQEKEEVDLRALLIQCAQAISSNNHPFASELLKKIRHHSSPYGDGFQRLAIYFADALEARVAGTGSQMYQKLVVKQTSCLDMLKAYSLFIAASPFVRVAYYFGNKTIVDVLGGRPRVHIIDFGILFGFQWPSLIQRLAKREGGPPQLRITGINVPETGFRPCKTIEETGKRLAEYARMFNVPFQYQGVASRWEDIYIPDLNIDKDEVLIVNCLHKMKNLGDETEDIDSARDRVLRIMKRMNPNVLIIGVMNGLYSSPFFLPRFREALFYYSSQFDMLNSTVAQNHEARILIERDLLGADVFNVVACEGAERIERPESYKQWQVRILKAGFKQLPVNQTILKSSLDRKELYHEDFVIDEDSGWLLQGWKGRIMHALSSWKRKDS

SEQ ID NO: 3339 - DNA, 1308 bp, Sorghum bicolor
  misc_feature: Ceres ANNOT ID no. 6030604
  misc_feature: Encodes the peptide sequence at SEQ ID NO 3340
atgccgccgccgtcgccgtcggccccggcctcgcaccacgtgcgcctgtggtggaggcgccgcggccgggccggcgcagtcggggccaccttcaccgtcgcgctcctcgcggccgcgctgctcctcgcgctctccagctacgcctccgtagtattccccgcgtccggtggccgccgcggccccgccctcgtcgggctcaccctcgtccgccgcgccagagagaagggcgcgctgtgcttggatgggagcgcgcccgggtaccatctgcagagagggtctgggagtggatcgcagagctggctaatccacttggagggtggaggctggtgccgtaatctcaagtcatgtgcgtcacgtcagagatcaatgttgggctcatcccggtacatggaaggccaggttgagtttacagggatcttgagcgatgacagatctcagaatcccgacttttacaattggaataaagtgaagataaggtattgtgatggggcatcattctctgggaatgtaaaagatgaattgcagaatggcacaagattcttcttcagaggccagcgtatctgggaagcagttatgaacgaacttgtagttaaggggctccgaaatgctaaacaggctttcctaacaggatgctctgctggtgggctagccacttacattcactgtgattcttttcgtgcgctgctaccaaaggattctagggttaagtgtcttgcggatggcggatttttccttgatgtagaagacatttctgggagaaggacaatgcagtctttctacagtgatgttgtgcgccttcagggtctaagggaaaggttttcacattgtaactcaaacatggaggcgggccagtgtttatttccacgtgaagttgtgaaacacattgtcaacccagtctttgttcttaatccagcatatgatgcttggcaggtggtacaacatgcgttggctccagaagcatctgaccctcaacattcatggctggactgcagattggatattagcaagtgcggctctgaacaacttgaaattctccaaggtttcaggaaagaactgcatgacgctataagtgaagtgaagcagaaaagggactggggattctatatcaactcgtgttttgttcactgccagtcgctaaactcgttgacttggcactctccaacttctcccagagtcaacaataagagcattgcagaagcagttggagactggttctttgacagaagagaggtgaaggagatagattgcgaatacccctgcaacccgacgtgccacaacttggtgttcgcaaaggctttcaagatttga

SEQ ID NO: 3340 - protein, 435 aa, Sorghum bicolor
  misc_feature: Ceres ANNOT ID no. 6030604
  misc_feature (40)..(414): Pfam Id: PAE Pfam Desc: Pectinacetylesterase
  misc_feature (57)..(430): NCBI GI: 87241323 NCBI Desc: pectinacetylesterase [medicago truncatula]
  misc_feature (63)..(395): NCBI GI: 145362432 NCBI Desc: pectinacetylesterase family protein [arabidopsis thaliana]
  misc_feature (40)..(424): NCBI GI: 115441561 NCBI Desc: os01g0892400 [oryza sativa (japonica cultivar-group)]
  misc_feature (63)..(431): NCBI GI: 79366428 NCBI Desc: carboxylic ester hydrolase [arabidopsis thaliana]
  misc_feature (61)..(429): NCBI GI: 140049891 NCBI Desc: pectinacetylesterase [medicago truncatula]
  misc_feature: Useful for making plants with altered cell wall content and/or composition
  misc_feature: GREAT-hit functional homolog of the protein sequence encoded by LOCUS at3g09410
  misc_feature: GREAT-hit functional homolog of the protein sequence encoded by LOCUS at3g09420
  misc_feature: Useful for making plants with altered carbohydrate content
  misc_feature: Functional homolog of the protein sequence given in SEQ ID NO 13670
  misc_feature: Useful for making plants with altered cell wall content and/or composition
  misc_feature: Functional homolog of the protein sequence given in SEQ ID NO 13834
MPPPSPSAPASHHVRLWWRRRGRAGAVGATFTVALLAAALLLALSSYASVVFPASGGRRGPALVGLTLVRRAREKGALCLDGSAPGYHLQRGSGSGSQSWLIHLEGGGWCRNLKSCASRQRSMLGSSRYMEGQVEFTGILSDDRSQNPDFYNWNKVKIRYCDGASFSGNVKDELQNGTRFFFRGQRIWEAVMNELVVKGLRNAKQAFLTGCSAGGLATYIHCDSFRALLPKDSRVKCLADGGFFLDVEDISGRRTMQSFYSDVVRLQGLRERFSHCNSNMEAGQCLFPREVVKHIVNPVFVLNPAYDAWQVVQHALAPEASDPQHSWLDCRLDISKCGSEQLEILQGFRKELHDAISEVKQKRDWGFYINSCFVHCQSLNSLTWHSPTSPRVNNKSIAEAVGDWFFDRREVKEIDCEYPCNPTCHNLVFAKAFKI

SEQ ID NO: 3341 - DNA, 2580 bp, Sorghum bicolor
  misc_feature: Ceres ANNOT ID no. 6030643
  misc_feature: Encodes the peptide sequence at SEQ ID NO 3342
atgtcgtcgccggtgtcggaggcggagatgtcggcggtgaagacgtcgtcgaacggggtatggcagggggacgacccactccacttcgcgttcccgctgctcatcctccaggcgctgctgatcctagtcctgagccgcttcctggccttcctgctccgcccactccgccaacccaaggtgatcgccgagatcgtggcggggatcctcctcggcccctccgcgctgggccgcaacgccgcctacctccacgcgctgttcccgccgtggagcacgccggtgctggagtccgtcgccagcctcggcctcctcttcttcctcttcctcgtaggcctcgagctcgacctccgctccgtccgccgcagcggccgccgcgccttcgccatcgccgcggccgggatctccctcccgttcgcgtgcggcgtcggcgtcgccttcgtgctccgctccgccgtcccaggcgccgaccaggcaggctacgcgccgttcctcgtcttcatgggcgtcgcgctctccatcaccgcgttccccgtcatggcgcgcatcctcgccgagctcaagctcctcaccacacccatcggggagacggcgctcgccgccgccgccttcaacgacgtcgccgcctgggtcctcctcgcgctggccgtcgccatctccgggtcaggttccggttccggttccggcggcgaccaccaccgtagcccgatcgtgtcgctgtgggtgctgctgtgcggggcggcgttcgtggcggcgtggatggtggtggtgaagccggcgatggcgtgggtggcgcggcgcgcggacgcggccggagacggcggcggtggggaggcgtgggtggcggtgacgctggcgggtgtgctggcgtcggggttcgcgacggacgtgatcgggatccacgccatcttcggcgccttcgtgttcgggctgacggtgcccaaggaaggagggttcgccgggagggtgacggcgagggtggaggacctggtgtcggagctgctgctgccgctctacttcgcctccagtgggctcaagacggacgtggccaccatccggggcggcgaggcctgggcgatgctcgcgctcgtcatcgccaccgcatgcgccggcaagatcgccggcacgttcggggtcgccatggcgtgcgggatgggagctcgggaggcgatcgtgctcggcgtcgtcatgaacaccaagggtctcgtcgagctcatcgtgctcaacatcggcagggagcgcaaggttctgaacgaggagacgttcgccatcctggtgctcatggcgctggtgaccaccttcatcaccacgcccacggtgatggccatctacaagcccgcgcgcgccgccggccgccggcgcctccaccaccgcaagctccagggccccgacccttccgcgccgtcctcgccgtccgcctcggccggcgccggcgccgccatggagctgcgcgtgctggcctgcatccacggcggtcaggacgtgcccgcggtgatcaacctcatcgagaccatccgcggccacacgcagccgcgccgcctcgtcaagctctacatcctccgcatggtggagctgacggagcgcacctcctccatcctcatggcgcgcgccgcgcgccggaacgggctgccgttcctgcgcccgcgccgcgcgggggagccgcacgaccaggtggacgtggccttcgacacgtacgcgcagctcggccacgtccacgtccgcgccatgaccgccgtgtccgcgctccacaccatgcacgacgacgtcgcggcagtcgccgaggacaagcgcgtctccctcgtcgtcctgccgttccacaagcgccagacgggaggacacggcggcggcgacgacgtcgagaacctcggccccgagtggcgcgccgttaaccgccggattctccgcgaggcgccctgctccgtcgccgtcctcgtcgaccgcggcttcggcggcggcgagcaggtcagctcggagcaggtggcgcacggtgtctgcgtcgtgttcttcggcgggcccgacgacagggaggcacttgagctcgccgggaggatggccgagcaccccggcgtgcaggtcactgtcgtgcggttcgtcgacggcaaggacggcagcgaggagcagtccgaggtcacgctgcgcccgtcccacaccaagaacgccgaccggagctacacgttctccacggccgtcgtcgatgccgccaaggagaaggagctggacgaggcggcggtggcggagttccggcagaggatgggcacccttgtgcagttcgaggagcgggtggtggtcggcaacgtgatcgaggaggtggtgtcgatcgggaagagcagggagtacggcctggtcgtcgtcggcaagggccggctgccatccccgatggtggcgcagctcgccgtccgcccggcagagcacccggagctcgggcccatcggcgacgcgctcgcatcgtccggccatggggtgacgtcgtcggtgctcgtggtccagcagcacgacatgagcaacgccgacgaggtgccggtctccgtggtggtcgatggccgtgctcaggacggcgagttcgccaaggacatggccgagccgtga

SEQ ID NO: 3342 - protein, 859 aa, Sorghum bicolor
  misc_feature: Ceres ANNOT ID no. 6030643
  misc_feature (38)..(440): Pfam Id: Na_H_Exchanger Pfam Desc: Sodium/hydrogen exchanger family
  misc_feature (32)..(859): NCBI GI: 115461711 NCBI Desc: os05g0113300 [oryza sativa (japonica cultivar-group)]
  misc_feature (10)..(843): NCBI GI: 61658329 NCBI Desc: cation/h+ exchanger [arabidopsis thaliana]
  misc_feature (13)..(534): NCBI GI: 9294151 NCBI Desc: na+/h+ exchangeing protein-like [arabidopsis thaliana]
  misc_feature (13)..(505): NCBI GI: 92870446 NCBI Desc: na+/h+ antiporter-like protein [medicago truncatula]
  misc_feature (11)..(534): NCBI GI: 115489590 NCBI Desc: os12g0616500 [oryza sativa (japonica cultivar-group)]
MSSPVSEAEMSAVKTSSNGVWQGDDPLHFAFPLLILQALLILVLSRFLAFLLRPLRQPKVIAEIVAGILLGPSALGRNAAYLHALFPPWSTPVLESVASLGLLFFLFLVGLELDLRSVRRSGRRAFAIAAAGISLPFACGVGVAFVLRSAVPGADQAGYAPFLVFMGVALSITAFPVMARILAELKLLTTPIGETALAAAAFNDVAAWVLLALAVAISGSGSGSGSGGDHHRSPIVSLWVLLCGAAFVAAWMVVVKPAMAWVARRADAAGDGGGGEAWVAVTLAGVLASGFATDVIGIHAIFGAFVFGLTVPKEGGFAGRVTARVEDLVSELLLPLYFASSGLKTDVATIRGGEAWAMLALVIATACAGKIAGTFGVAMACGMGAREAIVLGVVMNTKGLVELIVLNIGRERKVLNEETFAILVLMALVTTFITTPTVMAIYKPARAAGRRRLHHRKLQGPDPSAPSSPSASAGAGAAMELRVLACIHGGQDVPAVINLIETIRGHTQPRRLVKLYILRMVELTERTSSILMARAARRNGLPFLRPRRAGEPHDQVDVAFDTYAQLGHVHVRAMTAVSALHTMHDDVAAVAEDKRVSLVVLPFHKRQTGGHGGGDDVENLGPEWRAVNRRILREAPCSVAVLVDRGFGGGEQVSSEQVAHGVCVVFFGGPDDREALELAGRMAEHPGVQVTVVRFVDGKDGSEEQSEVTLRPSHTKNADRSYTFSTAVVDAAKEKELDEAAVAEFRQRMGTLVQFEERVVVGNVIEEVVSIGKSREYGLVVVGKGRLPSPMVAQLAVRPAEHPELGPIGDALASSGHGVTSSVLVVQQHDMSNADEVPVSVVVDGRAQDGEFAKDMAEP

SEQ ID NO: 3343 - DNA, 447 bp, Sorghum bicolor
  misc_feature: Ceres ANNOT ID no. 6030650
  misc_feature: Encodes the peptide sequence at SEQ ID NO 3344
atgaaagtgaaagctagagtctggtacaaagcgaacgcggcgtcagggatggccgtggacgatgactgcaagcgccggttcctggagctcaaggccaagaggacccaccgcttcatcatctacaagatcgacgagaagaagaagatggtggtggtggagcaggtgggtgagcctgtgctcaactacgatgacttcgccgccagcctccctgccaacgagtgcaggtacgccatcttcgactacgacttcgtcaccgaggagaactgccagaagagcaagatcttcttcatcgcctggtctcctgacacggcgcgcgtgaggagcaagatgatctacgccagctccaaggagaggttcaagcgggagctggacggcattcaggtggagctccaggccaccgattccgccgaggttggccttgacgtgatccagggccgtgcaaactga

SEQ ID NO: 3344 - protein, 148 aa, Sorghum bicolor
  misc_feature: Ceres ANNOT ID no. 6030650
  misc_feature (21)..(148): Pfam Id: Cofilin_ADF Pfam Desc: Cofilin/tropomyosin-type actin-binding protein
  misc_feature (11)..(148): NCBI GI: 115461713 NCBI Desc: os05g0113400 [oryza sativa (japonica cultivar-group)]
  misc_feature (11)..(148): NCBI GI: 126215670 NCBI Desc: actin-depolymerizing factor 7 (adf-7) (osadf7)
  misc_feature (11)..(148): NCBI GI: 106879609 NCBI Desc: actin-depolymerizing factor [plantago major]
  misc_feature (11)..(148): NCBI GI: 14906219 NCBI Desc: actin-depolymerizing factor 1 [petunia x hybrida]
  misc_feature (11)..(148): NCBI GI: 21536985 NCBI Desc: actin depolymerizing factor 4-like protein [arabidopsis thaliana]
  misc_feature: The plant senesces significantly late compared to wild-type.
  misc_feature: Useful for making plants with modulated time to senescence
  misc_feature: GREAT-hit functional homolog of the protein sequence given in SEQ ID NO 13287
  misc_feature: Useful for making plants with modulated time to senescence
  misc_feature: Functional homolog of the protein sequence given in SEQ ID NO 13287
MKVKARVWYKANAASGMAVDDDCKRRFLELKAKRTHRFIIYKIDEKKKMVVVEQVGEPVLNYDDFAASLPANECRYAIFDYDFVTEENCQKSKIFFIAWSPDTARVRSKMIYASSKERFKRELDGIQVELQATDSAEVGLDVIQGRAN

SEQ ID NO: 3345 - DNA, 864 bp, Sorghum bicolor
  misc_feature: Ceres ANNOT ID no. 6030680
  misc_feature: Encodes the peptide sequence at SEQ ID NO 3346
atggaggctgcggcagcggctccagcgccagcggcggacagggacccggccgcggagcaccaccacgggtgtctggccgtcaggacatcgctgccgcggtgcgccctcggcaccggcagcggcggcggctcctcgctgcctggatcttccgatgaagcgtcatgtggatcaccgagatggatagggagaggcctctcttgtgtgtgcatcaagcgaaaaggcacatatgaaagaatatgcatgaacctcacaccagtgcaggaagaaaggcttcagagattgaagcatcgcatgaaggtttactttgatccatctagacgagatcaccaggaagccctgaaagctctttggcatgcaacataccctgatcaagaacttcaaggtttgatatctgaacagtggaaggacatgggttggcaaggaagagacccatcaactgactttagaggtgcaggattcatatctctggagaatcttttgttctttgccaagacattctccgcctcatttcagagacttctaaagaaacagtgtggtaacagagccacatgggagtacccatttgcagttgctggtgtaaatattacattcatgatcatgcagatgctcgatctccagtcaactaagccaagaacatttgtacgagccatttttatccaaatgctctcagaggatgagtgggcatttgatctgctctactgcgttgcatttgttgtgatggacaagcagtggctggacaagaacgcgtcttacatggacttcaatgaagtgctgaagtcgacaagagcccagctggagagagagcttatgctggacgatgtcatccgtatcgaagacatgccatcatacagcctgctttgctag

SEQ ID NO: 3346 - protein, 287 aa, Sorghum bicolor
  misc_feature: Ceres ANNOT ID no. 6030680
  misc_feature (107)..(268): Pfam Id: ELMO_CED12 Pfam Desc: ELMO/CED-12 family
  misc_feature (50)..(286): NCBI GI: 9828622 NCBI Desc: f1n21.22 [arabidopsis thaliana]
  misc_feature (40)..(286): NCBI GI: 49387507 NCBI Desc: phagocytosis and cell motility protein elmo1-like [oryza sativa (japonica cultivar-group)]
  misc_feature (36)..(286): NCBI GI: 124359479 NCBI Desc: engulfment and cell motility, elm [medicago truncatula]
  misc_feature (42)..(286): NCBI GI: 38345956 NCBI Desc: osjnbb0038f03.14 [oryza sativa (japonica cultivar-group)]
  misc_feature (42)..(286): NCBI GI: 116310243 NCBI Desc: osigba0101c23.3 [oryza sativa (indica cultivar-group)]
MEAAAAAPAPAADRDPAAEHHHGCLAVRTSLPRCALGTGSGGGSSLPGSSDEASCGSPRWIGRGLSCVCIKRKGTYERICMNLTPVQEERLQRLKHRMKVYFDPSRRDHQEALKALWHATYPDQELQGLISEQWKDMGWQGRDPSTDFRGAGFISLENLLFFAKTFSASFQRLLKKQCGNRATWEYPFAVAGVNITFMIMQMLDLQSTKPRTFVRAIFIQMLSEDEWAFDLLYCVAFVVMDKQWLDKNASYMDFNEVLKSTRAQLERELMLDDVIRIEDMPSYSLLC

SEQ ID NO: 3347 - DNA, 1554 bp, Sorghum bicolor
  misc_feature: Ceres ANNOT ID no. 6030698
  misc_feature: Encodes the peptide sequence at SEQ ID NO 3348
atggcttgcggcgggtgcagctgcgaggcggcggtgggggcgacggcgtcggaggcgtacctggagggggagccggtgcgggaggcgcgggagctggtggcggagctctgtcggcacttctacgcgcagggatgggtcacgggcaccggcggcagcatcaccgtcaaggtcaacgaccccgccgtgccgctcgccgaccgcctcatcgtcatgtcaccctccggtgtgcagaaggagaggatggtagcagaggacatgtatgtgatggctgcagatggaaaagtgctttctgcgccagtagcaaagccatggccaaacaagcctccaaagtgtacggactgtgctcctctgttcatgaaggcgtatctgatgagaggagctggggctgtcattcacagccatggaatggagacttgcattgcaacaatgctcaaccctggtgcaaaggagttcaggatgacccacatggaaatgatcaaaggaatcaaaggtcatggctaccgtgatgaattggtcattcctattgttgagaatactccttatgagtatgagctcaccgactccctaagtgaggcgattgcagcatacccaaaggcaactgctgtgcttgtaaggaaccacggaatatatgtatggggtgactcttggatcaatgccaagacacaggctgaatgctatcattaccttttagatgcttgcatcaagctctatcagctgggtattgattggacaactcctgagcatggtccaataaacaatgcaaagagacagcgcagcattttgagctctgaaattcctaatggatgtcgtgctgctgattcatcaaagtgtgttgtactagatattgaggggacaaccactccaatatcattcgtgactgatgttatgttcccttatgcccgtgataatgtacgagaacatctgacttctacgtttgattctgaggaaactaaagacgacatcaaactattgcgcatccaaattgaagatgatttacgaaatgggatttctggggctgttccagttccacccgatgaggctggcaaagaagaggttatcaattcattggttgccaatgttgaatcgatgattaaagcagaccggaagatcacaccattgaaacaacttcagggtcatatttggaggactggatttgaaaagaaagaactacagggagttgtctttgaggatgtgcctgtggcgctaaagaactggcattctagtggcataaaggtctacatatactcaagtggaagtagagaagcacaaaggctgctatttggcaatacaacatatggtgacctgcgaaagttcctgtgtgggtattttgataccaccactggaaacaaaagagaaacaaggagttattttgaggtctctcaatcacttggggtggacagtccatctcaaatcttatttatcaccgatgttttccaagaagctgttgcagcaaaaaacactggttttgaggtgataatctccattcgcccaggaaatgctccacttcctgacaatcatggtttccgcactatcaaatcattcagtgagatctga

SEQ ID NO: 3348 - protein, 517 aa, Sorghum bicolor
  misc_feature: Ceres ANNOT ID no. 6030698
  misc_feature (31)..(248): Pfam Id: Aldolase_II Pfam Desc: Class II Aldolase and Adducin N-terminal domain
  misc_feature (18)..(411): NCBI GI: 30696383 NCBI Desc: haloacid dehalogenase-like hydrolase family protein [arabidopsis thaliana]
  misc_feature (18)..(411): NCBI GI: 42573672 NCBI Desc: haloacid dehalogenase-like hydrolase family protein [arabidopsis thaliana]
  misc_feature (259)..(517): NCBI GI: 115433966 NCBI Desc: os01g0101200 [oryza sativa (japonica cultivar-group)]
  misc_feature (8)..(242): NCBI GI: 14250071 NCBI Desc: cgi-29 protein [homo sapiens]
  misc_feature (8)..(242): NCBI GI: 14290597 NCBI Desc: cgi-29 protein [homo sapiens]
MACGGCSCEAAVGATASEAYLEGEPVREARELVAELCRHFYAQGWVTGTGGSITVKVNDPAVPLADRLIVMSPSGVQKERMVAEDMYVMAADGKVLSAPVAKPWPNKPPKCTDCAPLFMKAYLMRGAGAVIHSHGMETCIATMLNPGAKEFRMTHMEMIKGIKGHGYRDELVIPIVENTPYEYELTDSLSEAIAAYPKATAVLVRNHGIYVWGDSWINAKTQAECYHYLLDACIKLYQLGIDWTTPEHGPINNAKRQRSILSSEIPNGCRAADSSKCVVLDIEGTTTPISFVTDVMFPYARDNVREHLTSTFDSEETKDDIKLLRIQIEDDLRNGISGAVPVPPDEAGKEEVINSLVANVESMIKADRKITPLKQLQGHIWRTGFEKKELQGVVFEDVPVALKNWHSSGIKVYIYSSGSREAQRLLFGNTTYGDLRKFLCGYFDTTTGNKRETRSYFEVSQSLGVDSPSQILFITDVFQEAVAAKNTGFEVIISIRPGNAPLPDNHGFRTIKSFSEI

SEQ ID NO: 3349 - DNA, 1524 bp, Sorghum bicolor
  misc_feature: Ceres ANNOT ID no. 6030816
  misc_feature: Encodes the peptide sequence at SEQ ID NO 3350
  misc_feature: Down-regulated in shoot tissues in response to aminocyclopropane carboxylic treatment
  misc_feature: Down-regulated in shoot tissues in response to salicylic acid treatment
atgcggggcgggacgctgcagatcaactggcacgaccagcagccggtgctcagcctcgacttccaccccgcctcccgccgcctcgccaccgccggcgccgaccacgacatcaagatctgggaggtagcatcggatggttcggacgacaagctccccaccgccaccttcaagtacgccctcgtccccaataacaccgcccacagctccgcggtcaacgtcctccgcttctccccttcaggggagtatctcgcctctggtgctgacggtggcggcatcatcctctggaaactgcaccccgctgatgacggtgaggcatggaaaattcacaagacgttgctattccatcacaaggatgttcttgacctccagtggtcgcatgacagcgcattccttgtttctgcatcagttgacaacacttgcataatttgggaagctagtaaaggcacggtgcaccaaaagatagagggtcatctgcattatgttcagggtgtggcgtgggatcctttgggccagtatattgcttcactgagttctgacagaacctgtaaaatatatgcaaataagcctcagggcaaatccaagaacgcggagaggttgaactttgtttgccagcatacactagtgaaaatagaatatcagaatcatgatgaatctaagccaccaattaaatctcatttgtttcatgacgagacactaccatctttcttccggaggttggcatggtcacctgatggatcttttctagtattgccagcaggcctttccaaacactcttctgaagtgattaataccgcttatataatgtccaggcgtgacctctcaaggcctgcaatacaactccctggggccagtaaagctatagtagcagtacgcttctgcccagtgctattcaaaccacgtggttctaacccagatggtctcttcaagcttccttatagagttgtttttgctgttgccactttgaactctctgtatgtctatgatacagaaagtgttcctccaattctagtccatgctggtctacactatgctgccattactgatattgcatggtcttctgatgctaagtacttggcagcgtcatcacgagatggctactgtactataatagagtttgagaatgaggaactgggagagcttcacatcctccctggatcaaaagaagttgctaaagggaatttgacacctgagaccaagaaacctgtatctgcagatagcatgaaggttgatattagtgccagcacgcttaagatggaagccagccctgtggctgtaggagttagagcaccactgctgccaaccgagaacatcacgagaacaggggagcttgctgaaggaaatgtgacctgtgaaaacaagaagccggtaacagtagacagtatggaagtagatgtcgatgataacaaagtcaaggaggcaaccattcccgtggtggctgaagtgacaccgccgccagtaccgaccaagaacagcgcatcgagtaagcctgctaagaggcgaattactcctatcgcaatcaactaa

SEQ ID NO: 3350 - protein, 507 aa, Sorghum bicolor
  misc_feature: Ceres ANNOT ID no. 6030816
  misc_feature (3)..(41): Pfam Id: WD40 Pfam Desc: WD domain, G-beta repeat
  misc_feature (58)..(96): Pfam Id: WD40 Pfam Desc: WD domain, G-beta repeat
  misc_feature (106)..(144): Pfam Id: WD40 Pfam Desc: WD domain, G-beta repeat
  misc_feature (148)..(186): Pfam Id: WD40 Pfam Desc: WD domain, G-beta repeat
  misc_feature (1)..(484): NCBI GI: 10178066 NCBI Desc: fas2 [arabidopsis thaliana]
  misc_feature (1)..(385): NCBI GI: 14030689 NCBI Desc: at5g64630/mub3_15 [arabidopsis thaliana]
  misc_feature (1)..(424): NCBI GI: 11096297 NCBI Desc: fas2 [glycine max]
  misc_feature (1)..(390): NCBI GI: 140071562 NCBI Desc: wd40-like [medicago truncatula]
  misc_feature (81)..(484): NCBI GI: 42573792 NCBI Desc: transducin family protein / wd-40 repeat family protein [arabidopsis thaliana]
  misc_feature: Down-regulated in shoot tissues in response to aminocyclopropane carboxylic treatment
  misc_feature: Down-regulated in shoot tissues in response to salicylic acid treatment
  misc_feature: The sequence is a functional homolog of SEQ ID NO. 502 in the 11/188,298 US application
  misc_feature: The sequence is a functional homolog of SEQ ID NO. 485 in the 11/188,298 US application
MRGGTLQINWHDQQPVLSLDFHPASRRLATAGADHDIKIWEVASDGSDDKLPTATFKYALVPNNTAHSSAVNVLRFSPSGEYLASGADGGGIILWKLHPADDGEAWKIHKTLLFHHKDVLDLQWSHDSAFLVSASVDNTCIIWEASKGTVHQKIEGHLHYVQGVAWDPLGQYIASLSSDRTCKIYANKPQGKSKNAERLNFVCQHTLVKIEYQNHDESKPPIKSHLFHDETLPSFFRRLAWSPDGSFLVLPAGLSKHSSEVINTAYIMSRRDLSRPAIQLPGASKAIVAVRFCPVLFKPRGSNPDGLFKLPYRVVFAVATLNSLYVYDTESVPPILVHAGLHYAAITDIAWSSDAKYLAASSRDGYCTIIEFENEELGELHILPGSKEVAKGNLTPETKKPVSADSMKVDISASTLKMEASPVAVGVRAPLLPTENITRTGELAEGNVTCENKKPVTVDSMEVDVDDNKVKEATIPVVAEVTPPPVPTKNSASSKPAKRRITPIAIN

SEQ ID NO: 3351 - DNA, 681 bp, Sorghum bicolor
  misc_feature: Ceres ANNOT ID no. 6030821
  misc_feature: Encodes the peptide sequence at SEQ ID NO 3352
atggcggccagcaccaggaaggcagcactcgtgctaaccctaacaatggcgctcctcgctccgagcatcctcggcgcccgcaccagaccgccgtcgtctccgcaccatagccagggccacaagcgctcgccgcctcccgcttctcctcctccgccgccggcgcccgccgcacccacggccgccgccggactcgtccaatccacgtgcaacgcgacggcctactacgacctatgcatgtcaacgctgggcgccgacgcatccagcgccacggccgacgtgcgaggcctctcatccatcgccgtctccgccgccgccgtgaacgcctcgggcggcgcggccacggccgtcgcgctgctggccaccgccggcgccggcggcggcaacaccacgaccgccgtcgacggcaccacgcaggcgctgctccgcacttgcgccaccaagtacggcgaggcccgcgacgcgctgtcggccgccagggactccatcgcgcaggagaactacgactacgcgtccgtgcacgtcagcgccgccgccgagtacccgcaggtgtgccgggtgttgttccagcggcagaggcctggggagtacccgccggagctggcggccagggaggaggctctccgacggctttgcaccgtggcgctagacatcatcacgctcctcaccaacaacaccaactga

SEQ ID NO: 3352 - protein, 226 aa, Sorghum bicolor
  misc_feature: Ceres ANNOT ID no. 6030821
  misc_feature (59)..(217): Pfam Id: PMEI Pfam Desc: Plant invertase/pectin methylesterase inhibitor
  misc_feature (1)..(224): NCBI GI: 115474413 NCBI Desc: os08g0108100 [oryza sativa (japonica cultivar-group)]
  misc_feature (8)..(224): NCBI GI: 42408239 NCBI Desc: nvertase/pectin methylesterase inhibitor -like [oryza sativa (japonica cultivar-group)]
  misc_feature (53)..(221): NCBI GI: 27544452 NCBI Desc: pectinmethylesterase inhibitor [actinidia deliciosa]
  misc_feature (64)..(221): NCBI GI: 20455196 NCBI Desc: pectinesterase inhibitor (pectin methylesterase inhibitor) (pmei)
  misc_feature (64)..(221): NCBI GI: 62738429 NCBI Desc: chain b, crystal structure of the complex between pectin methylesterase and its inhibitor protein
MAASTRKAALVLTLTMALLAPSILGARTRPPSSPHHSQGHKRSPPPASPPPPPAPAAPTAAAGLVQSTCNATAYYDLCMSTLGADASSATADVRGLSSIAVSAAAVNASGGAATAVALLATAGAGGGNTTTAVDGTTQALLRTCATKYGEARDALSAARDSIAQENYDYASVHVSAAAEYPQVCRVLFQRQRPGEYPPELAAREEALRRLCTVALDIITLLTNNTN

SEQ ID NO: 3353 - DNA, 723 bp, Sorghum bicolor
  misc_feature: Ceres ANNOT ID no. 6030823
  misc_feature: Encodes the peptide sequence at SEQ ID NO 3354
atggcagcagcagccaccaccaagaacgtcatggtgctcctcctcctagcactcctccctctcgccacactctcctcccgcgccggcccatcatcggcttacaaaagccacggccacagccacaggtcatcgccgtcggccaagcacccaccgccgtctccttctcctccgtcctcaccaccttctgctccctcgcctgctccggcggcgaccgccgcgctagtgcgcgcgacctgcaactccacggcgtactacgacctgtgcgtgtccgcgctgggcgcggacccgtccagcgccacggccgacgtgcggggcctgtcggccatcgcggtctcggtcgcggcggccaacgcctcgggcggcgcggcgaccgccgcggcgctggcggcgaacggcaccgccccgacgggcaccgccgccgctgcttccagttccacggtcgtcgacggcaccgtgcaggcgctgctccacgcctgcgcggccaagtacgccagcgcccgcgacgcgctggccgccgccggagactccatcgcgctcgaggactacgacttcgcgtccgtgcacgtcagcgccgccgccgagtacccgcaggtgtgccgcacgctgttccggcggcagaggccaggacagtaccccgcggagctcgccgccagggaggagacgctgaaacagctctgctccgtcgcgctcgacatcatcgggctgctctcaaacagcagctag

SEQ ID NO: 3354 - protein, 240 aa, Sorghum bicolor
  misc_feature: Ceres ANNOT ID no. 6030823
  misc_feature (69)..(232): Pfam Id: PMEI Pfam Desc: Plant invertase/pectin methylesterase inhibitor
  misc_feature (40)..(239): NCBI GI: 115474413 NCBI Desc: os08g0108100 [oryza sativa (japonica cultivar-group)]
  misc_feature (40)..(239): NCBI GI: 42408239 NCBI Desc: nvertase/pectin methylesterase inhibitor -like [oryza sativa (japonica cultivar-group)]
  misc_feature (15)..(173): NCBI GI: 76262423 NCBI Desc: antifreeze glycoprotein [eleginus gracilis]
  misc_feature (25)..(166): NCBI GI: 5420389 NCBI Desc: proteophosphoglycan [leishmania major]
  misc_feature (61)..(203): NCBI GI: 27544452 NCBI Desc: pectinmethylesterase inhibitor [actinidia deliciosa]
MAAAATTKNVMVLLLLALLPLATLSSRAGPSSAYKSHGHSHRSSPSAKHPPPSPSPPSSPPSAPSPAPAATAALVRATCNSTAYYDLCVSALGADPSSATADVRGLSAIAVSVAAANASGGAATAAALAANGTAPTGTAAAASSSTVVDGTVQALLHACAAKYASARDALAAAGDSIALEDYDFASVHVSAAAEYPQVCRTLFRRQRPGQYPAELAAREETLKQLCSVALDIIGLLSNSS

SEQ ID NO: 3355 - DNA, 480 bp, Sorghum bicolor
  misc_feature: Ceres ANNOT ID no. 6030824
  misc_feature: Encodes the peptide sequence at SEQ ID NO 3356
atggcggcggccggcggcgagaacagcggcgcgggcgagggggagttctacctgcggtactacgtgggtcacaagggcaagttcgggcacgagttcctcgagttcgagttccgccccgacggcaagctccgctacgccaacaactccaactacaagaacgacaccatgatccgcaaggaggtcttcgtctccccctccgtcctccgcgaggccaggaggatcatccaggagtccgatatcatgaaggaggacgatagcaactggcccgaacccgaccgcatcggccgccaggagctcgagatcgtcatgggcaacgagcacatttcattcaccacttccaagatcggctccctcgtcgatgtccagtccagcaaggacccggagggcctccggatcttctactacctcgtccaggatctgaagtgttttgtgttttcactcatcaacctccacttcaagatcaagccaatccagtcttga

SEQ ID NO: 3356 - protein, 159 aa, Sorghum bicolor
  misc_feature: Ceres ANNOT ID no. 6030824
  misc_feature (15)..(157): Pfam Id: Mago_nashi Pfam Desc: Mago nashi protein
  misc_feature (4)..(159): NCBI GI: 115488204 NCBI Desc: os12g0287200 [oryza sativa (japonica cultivar-group)]
  misc_feature (4)..(159): NCBI GI: 55977745 NCBI Desc: mago nashi protein homolog (mago nashi-like protein)
  misc_feature (14)..(157): NCBI GI: 82798420 NCBI Desc: mago nashi [taiwania cryptomerioides]
  misc_feature (14)..(157): NCBI GI: 146220096 NCBI Desc: mago nashi-like protein 1 [physalis pubescens]
  misc_feature (9)..(159): NCBI GI: 42565403 NCBI Desc: mago nashi-like protein [hyacinthus orientalis]
MAAAGGENSGAGEGEFYLRYYVGHKGKFGHEFLEFEFRPDGKLRYANNSNYKNDTMIRKEVFVSPSVLREARRIIQESDIMKEDDSNWPEPDRIGRQELEIVMGNEHISFTTSKIGSLVDVQSSKDPEGLRIFYYLVQDLKCFVFSLINLHFKIKPIQS

SEQ ID NO: 3357 - DNA, 1752 bp, Sorghum bicolor
  misc_feature: Ceres ANNOT ID no. 6030847
  misc_feature: Encodes the peptide sequence at SEQ ID NO 3358
atggatccccaccaccaccaccgccgctcgccggaatacaactccctcctcctcgccggcgcgcgcctgggccctctgaagcaagcccacgcgcgcctcgtcgtctccggccacgcccattccttacctctcaccaccaagctagccacgctcgcggttgcggcgggcgccgcctcctacgccggcctcctcgccgcctcccacccatcaccggactccttcctcttctgctcgctcacgcgcgccgccgcgcgccggggcctccccgccgccgccctcgccttctaccgccgccttctcgccgccgccctccctttctccagcttcgccttcacctccgtcgccaaggcctgcgcggacctgtccgcgctccgcgccgggatgggcgtccacgcccacgccgtcctcctcggcttcggctccgaccggttcgtgcagacggcgctcgtcgtgctgtactccaagtgcggcaagctggatgtcgcgcgcaagctgttcgacgcgattcgtgacaggagcgtcgtcgcttggaacgcgatgatttcagggtacgagcagaatgggctcgctggtcgggcgattgaggtgtatagagagatgcgggtggctggggaggctcccgattccgcgacgtttgtggccacgctctctgcctgtgcgcaggctggtgctctggacttgggacatgaagtggagaggctcattgtctctgaaaggatggagatgaatgtggttcttggtgctgcgcttgtgaacatgtacgccaggtgtgggcttgtgaacaaggctcgtgagtggttcgacatgctccaggaacgcaatgtggttacgtggacctccatgatcgcaggatatggcatgcacggacatggcggtgaggcagtcaagctattcgatttgatgagacagcaagggccaccacccaatgatgtcacttttgttgcggttctatctgcgtgcgcgcatgctggattggtcagtgatggtcgggatgcttttgcttcgatgaagagtgtctatggattggtccctcgtgctgagcactattgctctatggttgatatgtatggaagggcgggacttcttgatgacgcgatgcagtttatacacgactctatacccggagagcctgggcctgaagtttggacagctatgcttggtgcatgcaagatgcacaagaatttcagtcttggagtggaggttgctgagcgactgattgccctcgagcctgagaatccatcacaccgtgtgctgctttctaatatatacgctttatctggtaaaatgaaccatgtcgagaaggtgaggaatacaatgatcaagagaagattgaagaagccaataggatatagcttgattgagatcggtggtgttgctcatgtgtttcgcatgggggagaagtctcaccccaaaactccagagatttaccagtatctggagaaactgatccataggattactgatgctggttacatgcctgaaactgactcggtgctgcatgagttggaagaagaggaaagggagtttgcattaagataccatggcgaaaaactggccgtagcctttggactcatgatgacctctgggtgcaccgctccaatcaggataataaaaaacctgcgtatatgtggggattgtcatctagctatcaaatatatgtcagccgtggagaatcgagagataattgtcagagatatgcaccggtttcaccatttcaaagctggaaagtgttcctgtcaggaatattggtga

SEQ ID NO: 3358 - protein, 583 aa, Sorghum bicolor
  misc_feature: Ceres ANNOT ID no. 6030847
  misc_feature (175)..(209): Pfam Id: PPR Pfam Desc: PPR repeat
  misc_feature (276)..(310): Pfam Id: PPR Pfam Desc: PPR repeat
  misc_feature (46)..(583): NCBI GI: 92870153 NCBI Desc: tetratricopeptide-like helical [medicago truncatula]
  misc_feature (19)..(583): NCBI GI: 115465982 NCBI Desc: os06g0112000 [oryza sativa (japonica cultivar-group)]
  misc_feature (96)..(583): NCBI GI: 87240699 NCBI Desc: tetratricopeptide-like helical [medicago truncatula]
  misc_feature (92)..(583): NCBI GI: 54695180 NCBI Desc: ppr986-12 [physcomitrella patens]
  misc_feature (18)..(583): NCBI GI: 9758973 NCBI Desc: selenium-binding protein-like [arabidopsis thaliana]
MDPHHHHRRSPEYNSLLLAGARLGPLKQAHARLVVSGHAHSLPLTTKLATLAVAAGAASYAGLLAASHPSPDSFLFCSLTRAAARRGLPAAALAFYRRLLAAALPFSSFAFTSVAKACADLSALRAGMGVHAHAVLLGFGSDRFVQTALVVLYSKCGKLDVARKLFDAIRDRSVVAWNAMISGYEQNGLAGRAIEVYREMRVAGEAPDSATFVATLSACAQAGALDLGHEVERLIVSERMEMNVVLGAALVNMYARCGLVNKAREWFDMLQERNVVTWTSMIAGYGMHGHGGEAVKLFDLMRQQGPPPNDVTFVAVLSACAHAGLVSDGRDAFASMKSVYGLVPRAEHYCSMVDMYGRAGLLDDAMQFIHDSIPGEPGPEVWTAMLGACKMHKNFSLGVEVAERLIALEPENPSHRVLLSNIYALSGKMNHVEKVRNTMIKRRLKKPIGYSLIEIGGVAHVFRMGEKSHPKTPEIYQYLEKLIHRITDAGYMPETDSVLHELEEEEREFALRYHGEKLAVAFGLMMTSGCTAPIRIIKNLRICGDCHLAIKYMSAVENREIIVRDMHRFHHFKAGKCSCQEYW

SEQ ID NO: 3359 - DNA, 1506 bp, Sorghum bicolor
  misc_feature: Ceres ANNOT ID no. 6030849
  misc_feature: Encodes the peptide sequence at SEQ ID NO 3360
atggccgccgcgcacgccaccaaggccgcccacgccgccgacgaccacgacgtctcgcctctcccgctcccatggccacgcccggcgccgctcctcgtcatcctatccctgctcgccggggcctcctacctagccctcacgcgcgtccccgccttcgcgtcttcgggccgcctagtacccgccgcgctcctcccgatcgcgcctcctcgcccccacgactcgcgatccagggacagctgcgcggggttctacgcgggcgcggggccatcacgcgcggtcacggcgtccgtggaggagttcggggccgtgggcgacggcgccacgcccaacaccgccgcgttccggcgcgccgtcgcggagctggaggccagagccggtgcgggaggggctaggctcgaggttccacccgggcgatggctcacgggcagcttcaacctcaccagccgcttcaccctcttcctgcaccgcggcgccgtcatcctcggctcccaggatccagaagagtggcctctcattgcccctttgccatcttatgggcgtggaagggaacggttaggaccacgccatatcagcctcattcatggagagggcttaaatgatgttgtgattactggtatggcgaatggtagcaatgggaccatagatggccaaggaaatatgtggtgggagctatggtggaaccgaactttgaatcacacaagaggccatctcattgagcttgtgaactcgaccaacatccttatatccagtatcacactgcgcaactcgcctttctggacagtacacccggtctactgcagcaacgtggtgatgaaggatttgaccatactggctcccctgaatgctccaaacacagatggcattgatccagactcgagctcagaagtttgcattgaagactgctacatcgaaagcggagatgatcttgttgctgtcaagagtggttgggatcagtacgggatctctcttggcaaaccaagtacaaacatcgtcattcagagggtttcaggcacaactccgacatgctcaggtgtaggttttggtagcgagatgtcaggtggcatatctaatgtgcttgtccgtgacctgcacgtatggaattctgcgcaagctgtgaggctcaagactgatgtagggcgaggtgggtacataaccaacatcaccatatccaatgtgacgatggagaaggtcaaagtaccaataagattcagtcgaggtgcagatgaccattctgatgacaactatgaccgaaccgcactgccaaggataagcaatgtacttatcagtgacgttgtcggtgtagacctgcagcgagcaccaatgctggaggcagtgcctggtgcagtttatgaagagatctgcttcagaaactttagcttaagaggcatacggcggcaggacaggtggcattgcgagtccgtgtatggagaggcgcatgaagttttccctgcaccttgtgaagagttcaggaaaaacggatcttcgtcatggtgtggatttatttga

SEQ ID NO: 3360 - protein, 501 aa, Sorghum bicolor
  misc_feature: Ceres ANNOT ID no. 6030849
  misc_feature (126)..(486): Pfam Id: Glyco_hydro_28 Pfam Desc: Glycosyl hydrolases family 28
  misc_feature (96)..(488): NCBI GI: 50897172 NCBI Desc: at5g41870 [arabidopsis thaliana]
  misc_feature (91)..(489): NCBI GI: 15221958 NCBI Desc: glycoside hydrolase family 28 protein / polygalacturonase (pectinase) family protein [arabidopsis thaliana]
  misc_feature (91)..(487): NCBI GI: 87241007 NCBI Desc: glycoside hydrolase, family 28 [medicago truncatula]
  misc_feature (164)..(489): NCBI GI: 8954055 NCBI Desc: contains similarity to a polygalacturonase-like protein gi7529266 from arabidopsis thaliana bac f18p9 gbal138654 and contains multiple polygalacturonase (pectinase) pf00295
  misc_feature (164)..(489): NCBI GI: 8954055 (continued) domains
  misc_feature (91)..(486): NCBI GI: 6522571 NCBI Desc: endo-polygalacturonase-like protein [arabidopsis thaliana]
  misc_feature: Useful for making plants with altered cell wall content and/or composition
  misc_feature: GREAT-hit functional homolog of the protein sequence encoded by LOCUS at4g33440
  misc_feature: Useful for making plants with altered carbohydrate content
  misc_feature: Functional homolog of the protein sequence given in SEQ ID NO 13832
  misc_feature: Useful for making plants with altered cell wall content and/or composition
  misc_feature: Functional homolog of the protein sequence given in SEQ ID NO 13833
  misc_feature: The sequence is a functional homolog of SEQ ID NO. 450 in the 11/188,298 US application
MAAAHATKAAHAADDHDVSPLPLPWPRPAPLLVILSLLAGASYLALTRVPAFASSGRLVPAALLPIAPPRPHDSRSRDSCAGFYAGAGPSRAVTASVEEFGAVGDGATPNTAAFRRAVAELEARAGAGGARLEVPPGRWLTGSFNLTSRFTLFLHRGAVILGSQDPEEWPLIAPLPSYGRGRERLGPRHISLIHGEGLNDVVITGMANGSNGTIDGQGNMWWELWWNRTLNHTRGHLIELVNSTNILISSITLRNSPFWTVHPVYCSNVVMKDLTILAPLNAPNTDGIDPDSSSEVCIEDCYIESGDDLVAVKSGWDQYGISLGKPSTNIVIQRVSGTTPTCSGVGFGSEMSGGISNVLVRDLHVWNSAQAVRLKTDVGRGGYITNITISNVTMEKVKVPIRFSRGADDHSDDNYDRTALPRISNVLISDVVGVDLQRAPMLEAVPGAVYEEICFRNFSLRGIRRQDRWHCESVYGEAHEVFPAPCEEFRKNGSSSWCGFI

SEQ ID NO: 3361 - DNA, 753 bp, Sorghum bicolor
  misc_feature: Ceres ANNOT ID no. 6030866
  misc_feature: Encodes the peptide sequence at SEQ ID NO 3362
atggcatcttcttcctcctccgcctcggtccggcagaggccatctgccgccgcggcgccagcaggtcacggtcagcagcagcaaccgatcatcctccaagacgaacaacagcagcaacaagaccaagccgccgccgccgccgccgccggcgaggcacccccgccacctcctcctcaaacgtcgtcggcgctgtcccaggcgctcgcctccacagcgaacctcgcgaacctgctccccaccggcactctcctggccttcaacctcctggccccgaccttcaccaaccacggcgcctgcgacgcgacgacgtcgctcctcacccgctgcctcctcgccgtcctcgcgctcgccagcgcgctggcgtgcttcaccgactccctgaaatccccgcacgacggccacgtctactacggcgtcgccacgcggaccgggctctggctcatcgactacccgcccgacgcgccgccgctgccgacgacgacggctagctgcaggtacaggctcgccttcatcgacttcgtgcacgccgcgctgtccgccgccgtcttcggggtcgtcgccgccagggacagggacgtcgtcgcgtgcctgtgtggccccacgccccgcagggagaccaaggagctcatcgacgtcctgccgctcggtgttggcgtgctctgtagcctcctcttcgtcgcgtttcccactaggcgccacggcatcggataccccgtcgtcgtcgttgccaacggcgccgccaactcgtcttaa

SEQ ID NO: 3362 - protein, 250 aa, Sorghum bicolor
  misc_feature: Ceres ANNOT ID no. 6030866
  misc_feature (50)..(237): NCBI GI: 15528693 NCBI Desc: p0560b06.26 [oryza sativa (japonica cultivar-group)]
  misc_feature (50)..(237): NCBI GI: 115436576 NCBI Desc: os01g0368700 [oryza sativa (japonica cultivar-group)]
  misc_feature (1)..(236): NCBI GI: 72384432 NCBI Desc: 52o08_3 [brassica rapa subsp. pekinensis]
  misc_feature (68)..(241): NCBI GI: 115441457 NCBI Desc: os01g0882400 [oryza sativa (japonica cultivar-group)]
  misc_feature (34)..(140): NCBI GI: 15528687 NCBI Desc: p0560b06.19 [oryza sativa (japonica cultivar-group)]
MASSSSSASVRQRPSAAAAPAGHGQQQQPIILQDEQQQQQDQAAAAAAAGEAPPPPPPQTSSALSQALASTANLANLLPTGTLLAFNLLAPTFTNHGACDATTSLLTRCLLAVLALASALACFTDSLKSPHDGHVYYGVATRTGLWLIDYPPDAPPLPTTTASCRYRLAFIDFVHAALSAAVFGVVAARDRDVVACLCGPTPRRETKELIDVLPLGVGVLCSLLFVAFPTRRHGIGYPVVVVANGAANSS

SEQ ID NO: 3363 - DNA, 996 bp, Sorghum bicolor
  misc_feature: Ceres ANNOT ID no. 6030884
  misc_feature: Encodes the peptide sequence at SEQ ID NO 3364
atggggaacgccgccaccatccgcgccgtgctcgccatcctccagtggtggggattcaacgtcaccgtcatcatcatcaacaagtggatcttccagaaactggagttcaagttccctctgacggtgtcgtgcgtccacttcatatgctcttctatcggagcctacatcgcaatcaaagttctgaaaacaaagccactgatcgaggttgccacggaggaccgatggagaaggatattcccaatgtcattcgtgttctgcataaacattgtgctggggaatgtgagcttgcggtacattccggtctccttcatgcagaccataaaatctttcactccttggttggtgtggaggaaatacttcgaatggcgcatctgggcttctttgatccctattgtgggaggcattcttctgacttcggtaactgagctgagcttcaacacgtttggcttctgcgccgccatggtgggctgcctggccacatccacaaagaccattttggcagagtcactgctccatggatacaaattcgacagcatcaacacggtgtactacatggctccctttgcgacgatgatcctgtcagtgccagccatggtgctggagggcagcggcgtggtgagctggctctacacgtacgagtccgtggggccagcgctggcgatcatcgtcacgtcgggggtgctggccttctgcctcaacttctccatcttctacgtgatccactcgacgacggccgtgacgttcaacgtggccggcaacctcaaggtggccgtggcggtgctggtgtcgtggatgatcttccggaaccccatctcggccatgaacgccgtcggctgcgctgtcacgctcgtcggctgcaccttctacggctacgtgaggcacctcatctcgcagcatcaggccaccgtggcgaccggcggcggcggcccccgcacgcccagaggccgcttggagatgctgccgctcaccgccgagaagcaaggcgacaagatatag

SEQ ID NO: 3364 - protein, 331 aa, Sorghum bicolor
  misc_feature: Ceres ANNOT ID no. 6030884
  misc_feature (149)..(291): Pfam Id: TPT Pfam Desc: Triose-phosphate Transporter family
  misc_feature (9)..(297): Pfam Id: UAA Pfam Desc: UAA transporter family
  misc_feature (8)..(331): NCBI GI: 29329825 NCBI Desc: gonst5 golgi nucleotide sugar transporter [arabidopsis thaliana]
  misc_feature (13)..(289): NCBI GI: 9759107 NCBI Desc: phosphate/phosphoenolpyruvate translocator protein-like [arabidopsis thaliana]
  misc_feature (13)..(289): NCBI GI: 52421287 NCBI Desc: at5g05820 [arabidopsis thaliana]
  misc_feature (1)..(289): NCBI GI: 61651608 NCBI Desc: plastidic phosphate translocator-like protein2 [mesembryanthemum crystallinum]
  misc_feature (13)..(290): NCBI GI: 21536504 NCBI Desc: phosphate/phosphoenolpyruvate translocator-like protein [arabidopsis thaliana]
  misc_feature: The sequence is a functional homolog of SEQ ID NO. 360 in the 11/188,298 US application
  misc_feature: The sequence is a functional homolog of SEQ ID NO. 484 in the 11/188,298 US application
MGNAATIRAVLAILQWWGFNVTVIIINKWIFQKLEFKFPLTVSCVHFICSSIGAYIAIKVLKTKPLIEVATEDRWRRIFPMSFVFCINIVLGNVSLRYIPVSFMQTIKSFTPWLVWRKYFEWRIWASLIPIVGGILLTSVTELSFNTFGFCAAMVGCLATSTKTILAESLLHGYKFDSINTVYYMAPFATMILSVPAMVLEGSGVVSWLYTYESVGPALAIIVTSGVLAFCLNFSIFYVIHSTTAVTFNVAGNLKVAVAVLVSWMIFRNPISAMNAVGCAVTLVGCTFYGYVRHLISQHQATVATGGGGPRTPRGRLEMLPLTAEKQGDKI

SEQ ID NO: 3365 - DNA, 1083 bp, Sorghum bicolor
  misc_feature: Ceres ANNOT ID no. 6030887
  misc_feature: Encodes the peptide sequence at SEQ ID NO 3366
atggacgccggcgacgacgagccccccgttctcctcgaccgcgccgcgcgcgccacccgaggcaagaggataaccaagctcctcgaggacgaggtcgagcaggacgaggctttctggaaccaagaagccctcaaggatgaggagaacgatgacaactacgtggaagagcaggatgctggtgacgaattcgacagtgattttggtgaagatgaatctgaacctgacgatgagccggagagggaagaacgtgagaggttacctatcaagaaacggctaatgtttcctggcaagacgctgaggaagaccaatgtcaagaagaagaaggtgaccccaaaaccagaagatgacgcaaaagctgacaagtctgctgataagcccagttcgtccacacaagcagatgttcctgatgaactggaggttgagaagaccatccggaaatcaaccagaacatcggtcattgtgagacaagctgaaagagaagcgatacgtgccgaaaaagaagcaacggccaagccaattaagaggaaaaaggagggagaagaaaagcggatgacgcaagaggagatgcttttggaagcagctgaaacagagatcatgaacatgagaaatctagaacgtgtactggcaagagaggaggaagtgaagaaaaaagctgttattcataaggacacttatgagggtcctacagttcggtttttctcaagagatggggaatcacgtctggaattcataaatggggcaacatttgggtctgaactttctataacatcatccccttatccggagaaacctgtttgtgtggtgacaggacttccagccaaataccgtgatccgaagacagggctgccttatgcaactatggaagcattcaaaataatccgggagcgtttcctgaaagaggaggctgatagaaagaggccgaacatgttgaatatgggagagctttttgaatcaataactggtgaacatttgatgcctaagaagagaagggttgagataaggtctccgaacatatcaggaggctcgaggcatggaggacgcttctggagaatacctgctcttgatatggtggacgaggactaa

SEQ ID NO: 3366 - protein, 360 aa, Sorghum bicolor
  misc_feature: Ceres ANNOT ID no. 6030887
  misc_feature (11)..(236): Pfam Id: YL1 Pfam Desc: YL1 nuclear protein
  misc_feature (264)..(293): Pfam Id: YL1_C Pfam Desc: YL1 nuclear protein C-terminal domain
  misc_feature (3)..(360): NCBI GI: 58257479 NCBI Desc: drp1 protein [triticum turgidum subsp. durum]
  misc_feature (3)..(360): NCBI GI: 118505100 NCBI Desc: srg6 [triticum aestivum]
  misc_feature (14)..(360): NCBI GI: 12054307 NCBI Desc: stress responsive gene 6, srg6 [hordeum vulgare subsp. vulgare]
  misc_feature (70)..(360): NCBI GI: 12054303 NCBI Desc: stress responsive gene 6 protein, srg6 [hordeum vulgare subsp. vulgare]
  misc_feature (1)..(360): NCBI GI: 79568513 NCBI Desc: dna binding / transcription factor [arabidopsis thaliana]
MDAGDDEPPVLLDRAARATRGKRITKLLEDEVEQDEAFWNQEALKDEENDDNYVEEQDAGDEFDSDFGEDESEPDDEPEREERERLPIKKRLMFPGKTLRKTNVKKKKVTPKPEDDAKADKSADKPSSSTQADVPDELEVEKTIRKSTRTSVIVRQAEREAIRAEKEATAKPIKRKKEGEEKRMTQEEMLLEAAETEIMNMRNLERVLAREEEVKKKAVIHKDTYEGPTVRFFSRDGESRLEFINGATFGSELSITSSPYPEKPVCVVTGLPAKYRDPKTGLPYATMEAFKIIRERFLKEEADRKRPNMLNMGELFESITGEHLMPKKRRVEIRSPNISGGSRHGGRFWRIPALDMVDED

SEQ ID NO: 3367 - DNA, 1347 bp, Sorghum bicolor
  misc_feature: Ceres ANNOT ID no. 6030908
  misc_feature: Encodes the peptide sequence at SEQ ID NO 3368
atgtcctttcgcagcatagtccgtgatgttagcgaaagctttggtagcttatcaagacggagctttgaggtcaggatttccggtttgcctggtctgtctggtcatcatagagggaaatctgttggatctctgagcgacagacctgtagtagttgatcaaagcaggtgggttggtcttcctcctgaattgcttcgagatgtaatgaaaaggcttgaggaaggggagagcaattggccatcccgaaaaaatgttgttgcctgtgcagcagtctgcggaacatggagagagatatgcaaggatatagtgctgagtccggagttttgtgggaagctcacttttccagtatcacttaaacagccgggaccaagaagtggaatgatccagtgttttataaaaagggacaaatcaacgtcaacttattatctttacctatgtcttagccctgctgtcctcagcgaggatgggaaatttctgctagcagctaagaggaatcgccgtacgacatatactgagtacatcatttctgtggatcgtaaaaatatatcacggtcaagtaatggctatgttggaaaaatgaggtcaaattttcttggcactaaattcgtcgtgtatgacactcaaacaccacacaatgctgggagccttctctcgtgtgagcgtgggagccgcagaatctcctctaggagggtttcccccaaagtaccgactgctagctaccccattgcccgggtgaactatgagctaaaccttcttggcacaagggggcctaggcgtatgaattgcacgatgcattccatcccagcctcagcgctggaccctgaaggcatggtgcctggccaacccaagcagctcttcatccctggctcatcttcctttggagaatcctttcgcagtgcaaacacctcttccagctcaaggttctcggttacagaccgctccttggacttcagctcctcgcgcttctcagagataagtggattggctcagcaagatgagggcagtggccaggctaaggagaggcctttggctctccgcaataaggagccaaggtggcatgagcaactgcagtgttggtgcctcaacttccgtggtcgggtgaccgtggcttctgtgaagaacttccagttgatagctgcaccacaactagattctgaatcgtcgcagcaagctcagcagcaagcccagccttcgaattcatcttcagtactggatcatgacaaagtgatcctgcagtttggtaaggttgccaaggacatgttcacgatggactaccgatacccgctctcggcattccaggccttcaccatctgtttgaccagcttcgacagcaagctggcttgtgaatag

SEQ ID NO: 3368 - protein, 448 aa, Sorghum bicolor
  misc_feature: Ceres ANNOT ID no. 6030908
  misc_feature (120)..(442): Pfam Id: Tub Pfam Desc: Tub family
  misc_feature (54)..(109): Pfam Id: F-box Pfam Desc: F-box domain
  misc_feature (1)..(448): NCBI GI: 32480039 NCBI Desc: osjnba0039k24.2 [oryza sativa (japonica cultivar-group)]
  misc_feature (1)..(448): NCBI GI: 90399022 NCBI Desc: h0701f11.8 [oryza sativa (indica cultivar-group)]
  misc_feature (1)..(448): NCBI GI: 5777631 NCBI Desc: caa303719.1 protein [oryza sativa]
  misc_feature (1)..(381): NCBI GI: 5689214 NCBI Desc: tubby-like protein [lemna paucicostata]
  misc_feature (13)..(314): NCBI GI: 79322458 NCBI Desc: phosphoric diester hydrolase/ transcription factor [arabidopsis thaliana]
  misc_feature: The sequence is a functional homolog of SEQ ID NO 130 in the 10/225,068US patent application
  misc_feature: The sequence is a functional homolog of SEQ ID NO 2896 in the 10/374,780US patent application
  misc_feature: Useful for making plants with modulated growth and phenotype characteristics
  misc_feature: The sequence is a functional homolog of SEQ ID NO 130 in the 20050120408 US patent application
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 458 in the 10/666,642 US patent application
MSFRSIVRDVSESFGSLSRRSFEVRISGLPGLSGHHRGKSVGSLSDRPVVVDQSRWVGLPPELLRDVMKRLEEGESNWPSRKNVVACAAVCGTWREICKDIVLSPEFCGKLTFPVSLKQPGPRSGMIQCFIKRDKSTSTYYLYLCLSPAVLSEDGKFLLAAKRNRRTTYTEYIISVDRKNISRSSNGYVGKMRSNFLGTKFVVYDTQTPHNAGSLLSCERGSRRISSRRVSPKVPTASYPIARVNYELNLLGTRGPRRMNCTMHSIPASALDPEGMVPGQPKQLFIPGSSSFGESFRSANTSSSSRFSVTDRSLDFSSSRFSEISGLAQQDEGSGQAKERPLALRNKEPRWHEQLQCWCLNFRGRVTVASVKNFQLIAAPQLDSESSQQAQQQAQPSNSSSVLDHDKVILQFGKVAKDMFTMDYRYPLSAFQAFTICLTSFDSKLACE

SEQ ID NO: 3369 - DNA, 270 bp, Sorghum bicolor
  misc_feature: Ceres ANNOT ID no. 6030931
  misc_feature: Encodes the peptide sequence at SEQ ID NO 3370
atggcgaaggcggtggcgatgctgatggcccttgcggtggtagtggcggtgagctcaggcggggcatcagcggactgcaacatcgcagcgctagcgagctgcaatgcggcggtcatccaaggggcgaaacccacggcgatgtgctgctccagcctacgagcgcaggagccatgcttgtgcacataccagaacaacccaaagtacggcaaataccacccaaatgcccggaaaatggtcacctcctgcggcatggccatccccaactgctag

SEQ ID NO: 3370 - protein, 89 aa, Sorghum bicolor
  misc_feature: Ceres ANNOT ID no. 6030931
  misc_feature (1)..(89): NCBI GI: 1041815 NCBI Desc: lipid transfer protein [oryza sativa]
  misc_feature (3)..(89): NCBI GI: 84617211 NCBI Desc: type 2 non specific lipid transfer protein precursor [triticum aestivum]
  misc_feature (1)..(89): NCBI GI: 110832071 NCBI Desc: nonspecific lipid-transfer protein 2 precursor (nsltp2) (7 kda lipid transfer protein)
  misc_feature (3)..(89): NCBI GI: 84617215 NCBI Desc: type 2 non specific lipid transfer protein precursor [triticum aestivum]
  misc_feature (3)..(89): NCBI GI: 84617209 NCBI Desc: type 2 non specific lipid transfer protein precursor [triticum aestivum]
  misc_feature: The sequence is a functional homolog of SEQ ID NO. 364 in the 11/188,298 US application
MAKAVAMLMALAVVVAVSSGGASADCNIAALASCNAAVIQGAKPTAMCCSSLRAQEPCLCTYQNNPKYGKYHPNARKMVTSCGMAIPNC

SEQ ID NO: 3371 - DNA, 1662 bp, Sorghum bicolor
  misc_feature: Ceres ANNOT ID no. 6030933
  misc_feature: Encodes the peptide sequence at SEQ ID NO 3372
atgtctccctccggcgagctgctggcctccatctcctctgccctcgccgtcgccttcgtcctcctcgcctgcgtcgagctcggcgacgccgccgccgccgtcggcgtctaccgcctcatccagtacgacctcgccggcgccccgctcggctcccgcgccgcggtcatcaaccaccacgccgccgcgctcccgctccccgccggcgcggacctctcccgctccgccctcgtcgcgccgctcctcgacctcccgctctccttcctcagagagtacctggtggagaaaaaacatctggggggattgctcattctgctcccgacaaaccgcggcggtgataaggacagtgcagatgacaaggggaaggtcaaaggtgtactgactgagctggagaagttgcttgtgcatgaacaagttccatatccagtgtactttgctttgcacgacgacagttttgataacctgctggcagatatccataaaattgcctcttcaggtcaaccagcctctgcaacaacaggaggttacaaacttgtcgtgtcgtcagcagagcctagaaaagtgtcatctccgaccatttctaatatccagggatggttacctggattgaaaggagagggtgatagcgaacagcttccgactattgccatagttgcaaactatgacaccttcggtgctgcacctgcactttctgtgggaagcgacagcaatggaagtggagttgtggctcttttagagattgcaagattattttcgcgtttgtattcaaatcctaagacaaggggcaagtacaatattctctttgggttaacatctggtggaccctacaattacaatggaactagcaaatggcttaggagttttgatcagcgtgtacgcgagagcattgactacgcaatctgcttgaacagtgttggttcctggagcagtgacctctggatgcatgtatcaaagcctccagaaaatccctatatcaagcaaatctttgaagaattttctgatgtctctaaagaaatgggtgtttcagttggaatcaagcacaagaagattaatgtctcaaatcctagagtagcatgggaacacgaacagttctcaaggtttagagtgactgcacttactctttcagaaatgtctacccctcctgaatttttggaaagcactggtggtcttcacgacactagagaatctacagatgttgagtcagtaacccgaactgtgagattagtttctgagagtcttgcgagacacatctacggattgaaaggaaggaacatcgacgtttttgcagagaatagcagcttagcaattaatcctcactatatccggtcctggttggatcttttgtcacggacaccacgtgttgcaccttttctgcagaaaaatgatcccttcatatcagcactgaaaaaggaactgtctgaacacactactgatgtgcatattcaaagtgatgcgcttgatggcatgttcactttctatgatgcaacgaaagcaactctaaatgtgtaccaggttgcaagtgtgacctttgatctgctgttccttctggtgctcggttcctatctgatcgttctcttctgtttcctagtaatcactacacggggtgttgatgatctcattaacatattccggcggcctccatcacgcaagctcaagggggcgtag

SEQ ID NO: 3372 - protein, 553 aa, Sorghum bicolor
  misc_feature: Ceres ANNOT ID no. 6030933
  misc_feature (212)..(417): Pfam Id: Nicastrin Pfam Desc: Nicastrin
  misc_feature (7)..(521): NCBI GI: 49065558 NCBI Desc: loc56926 [homo sapiens]
  misc_feature (16)..(521): NCBI GI: 68052797 NCBI Desc: nicalin precursor (nicastrin-like protein)
  misc_feature (16)..(521): NCBI GI: 19684113 NCBI Desc: nicalin protein [homo sapiens]
  misc_feature (16)..(521): NCBI GI: 119589740 NCBI Desc: nicalin homolog (zebrafish), isoform cra_d [homo sapiens]
  misc_feature (16)..(521): NCBI GI: 119589737 NCBI Desc: nicalin homolog (zebrafish), isoform cra_b [homo sapiens]
MSPSGELLASISSALAVAFVLLACVELGDAAAAVGVYRLIQYDLAGAPLGSRAAVINHHAAALPLPAGADLSRSALVAPLLDLPLSFLREYLVEKKHLGGLLILLPTNRGGDKDSADDKGKVKGVLTELEKLLVHEQVPYPVYFALHDDSFDNLLADIHKIASSGQPASATTGGYKLVVSSAEPRKVSSPTISNIQGWLPGLKGEGDSEQLPTIAIVANYDTFGAAPALSVGSDSNGSGVVALLEIARLFSRLYSNPKTRGKYNILFGLTSGGPYNYNGTSKWLRSFDQRVRESIDYAICLNSVGSWSSDLWMHVSKPPENPYIKQIFEEFSDVSKEMGVSVGIKHKKINVSNPRVAWEHEQFSRFRVTALTLSEMSTPPEFLESTGGLHDTRESTDVESVTRTVRLVSESLARHIYGLKGRNIDVFAENSSLAINPHYIRSWLDLLSRTPRVAPFLQKNDPFISALKKELSEHTTDVHIQSDALDGMFTFYDATKATLNVYQVASVTFDLLFLLVLGSYLIVLFCFLVITTRGVDDLINIFRRPPSRKLKGA

SEQ ID NO: 3373 - DNA, 654 bp, Sorghum bicolor
  misc_feature: Ceres ANNOT ID no. 6030936
  misc_feature: Encodes the peptide sequence at SEQ ID NO 3374
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
atggcgatcgtctacgccctggtcgctcggggcacggtggttctggccgagttcgccgccgtctcaggcaacgccggcgccgtggcccgccggatcctcgagaagctgccgcccgacgccgagtccaggctgtgctttgcgcaggaccggtacatcttccacgtcctccggtctgacgccgccggcatcaccttcctctgtatggccaacgacaccttcggaagaagaatcccctttctctacctggaggacatccaaatgaggttcatgaaaaactacggcagagtcgcccactctgcgctggcttacgccatgaacgatgaattctccagggtgctccatcagcaaatggagttcttctccagcaacccaagtgctgacacactcaaccgtctccgcggagaaatacacaccgtcatggtcgacaacattgagaaaattcttgacagaggcgaccgcatctcgctccttgtggacaagacatccaccatgcaggacagctcctttcacttccgcaagcaatccaagaggctccgcagagctctttggatgaagaatgccaaagttgtgttgacagttgtcatagtagtgctgctctacttgatcatttctgctttctgtggaggcctttccttatcatcatgcagatcatga

SEQ ID NO: 3374 - protein, 217 aa, Sorghum bicolor
  misc_feature: Ceres ANNOT ID no. 6030936
  misc_feature (125)..(208): Pfam Id: Synaptobrevin Pfam Desc: Synaptobrevin
  misc_feature (1)..(217): NCBI GI: 126009434 NCBI Desc: synaptobrevin-like protein [brassica juncea]
  misc_feature (1)..(217): NCBI GI: 9757817 NCBI Desc: synaptobrevin-like protein [arabidopsis thaliana]
  misc_feature (37)..(217): NCBI GI: 110743436 NCBI Desc: synaptobrevin-like protein [arabidopsis thaliana]
  misc_feature (1)..(215): NCBI GI: 92874038 NCBI Desc: longin-like [medicago truncatula]
  misc_feature (1)..(215): NCBI GI: 21593706 NCBI Desc: synaptobrevin-like protein [arabidopsis thaliana]
  misc_feature: Useful for making plants with modulated heat sensitivity
  misc_feature: Functional homolog of the protein sequence given in SEQ ID NO 13180
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
MAIVYALVARGTVVLAEFAAVSGNAGAVARRILEKLPPDAESRLCFAQDRYIFHVLRSDAAGITFLCMANDTFGRRIPFLYLEDIQMRFMKNYGRVAHSALAYAMNDEFSRVLHQQMEFFSSNPSADTLNRLRGEIHTVMVDNIEKILDRGDRISLLVDKTSTMQDSSFHFRKQSKRLRRALWMKNAKVVLTVVIVVLLYLIISAFCGGLSLSSCRS

SEQ ID NO: 3375 - DNA, 681 bp, Sorghum bicolor
  misc_feature: Ceres ANNOT ID no. 6030945
  misc_feature: Encodes the peptide sequence at SEQ ID NO 3376
atggctggaggcaagtccggcggcaacgccgcgcgcagcaggaagcgcgtcgaggccaccgtcctcaagcgctccagggacggcagcgcattcaccagatgcgaggcctgcaacaaggatgtccccgtcgtcctcatcgacatgcacagctgcagcctcgacaagcacatcaggatgatgctcgaggcgcaggtcgtcgagaagaccgtcgaggtcgccgccaagcccgccgaacgcaacaagtcctccgccaagggacacggaggcggcggcaacaaggatgccaagcgcaagcgctcgcccacagccttcttcctcttcatgtatgcaatgcgactggacgacttcaggaaggagttcaaggccgcccatcctgacaacaagagtgtcgccaccgttgcaaaggaaggaggggagaagtggaagtccatgacagacgaggagaagaagccttacgttgaaaaggccgcggagctcaaggctcaagccgagaatggcgagggcagtggtgagaacaatgttgccaagaagaaagccaaggcagatgacaaggatggggagcaggaggtggatcagcctgcaaagaagcgcatcaggcgcaaggctcttgacgaggacgaggatgacgctggcgaccaggaagatgaggatgagcagaacgagttggatgatgacatgtag

SEQ ID NO: 3376 - protein, 226 aa, Sorghum bicolor
  misc_feature: Ceres ANNOT ID no. 6030945
  misc_feature (98)..(166): Pfam Id: HMG_box Pfam Desc: HMG (high mobility group) box
  misc_feature (59)..(226): NCBI GI: 22135475 NCBI Desc: nucleasome/chromatin assembly factor d protein nfd106 [zea mays]
  misc_feature (71)..(218): NCBI GI: 115470082 NCBI Desc: os06g0728000 [oryza sativa (japonica cultivar-group)]
  misc_feature (71)..(218): NCBI GI: 30267833 NCBI Desc: hmgb1 [oryza sativa (indica cultivar-group)]
  misc_feature (71)..(218): NCBI GI: 21803 NCBI Desc: high mobility group protein [triticum aestivum]
  misc_feature (63)..(218): NCBI GI: 397396 NCBI Desc: dna-binding protein [zea mays]
  misc_feature: The plant flowers significantly late compared to wild-type.
  misc_feature: The plant is abnormally large.
  misc_feature: The sequence is a functional homolog of SEQ ID NO 1446 in the 11/479,226US patent application
  misc_feature: The sequence is a functional homolog of SEQ ID NO 682 in the 10/412,699US patent application
  misc_feature: Useful for making plants with altered Lignin content
  misc_feature: Useful for making plants with altered alkaloid content
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated drought sensitivity
  misc_feature: GREAT-hit functional homolog of the protein sequence given in SEQ ID NO 12991
  misc_feature: Functional homolog of the protein sequence given in SEQ ID NO 13265
  misc_feature: Functional homolog of the protein sequence given in SEQ ID NO 13267
  misc_feature: The sequence is a functional homolog of SEQ ID NO 682 in the 20040045049 US patent application
  misc_feature: Useful for making plants with altered alkaloid content
  misc_feature: Useful for making plants with altered lignin content
  misc_feature: Functional homolog of the protein sequence given in SEQ ID NO 12991
  misc_feature: The sequence is a functional homolog of SEQ ID NO 1446 in the 11/479,226 US patent application
  misc_feature: The sequence is a functional homolog of SEQ ID NO 682 in the 10/412,699 US patent application
MAGGKSGGNAARSRKRVEATVLKRSRDGSAFTRCEACNKDVPVVLIDMHSCSLDKHIRMMLEAQVVEKTVEVAAKPAERNKSSAKGHGGGGNKDAKRKRSPTAFFLFMYAMRLDDFRKEFKAAHPDNKSVATVAKEGGEKWKSMTDEEKKPYVEKAAELKAQAENGEGSGENNVAKKKAKADDKDGEQEVDQPAKKRIRRKALDEDEDDAGDQEDEDEQNELDDDM

SEQ ID NO: 3377 - DNA, 1116 bp, Sorghum bicolor
  misc_feature: Ceres ANNOT ID no. 6030946
  misc_feature: Encodes the peptide sequence at SEQ ID NO 3378
atggggcagatgggaggacccgacggcgacggcgacggcggcggcgggggcccgcaccaccagtaccactaccaggccctcctcgccgccgtgcagaatcccagccagggcctgcacccctttcccctccccttccacctgcctctccacgcaggggcgcccgccgccggacctgttgtggctgatgctgatgccgcctccacacacggtgccaatgccaatgccgctccccactctcagcctccaagaggtttcaccgattggagcccgtccaacagtgccttcgccgccgttgccgcacagcccgcccctgctaccaccaatacacccttccattacaacgtcccccagtcttatgccctgtggacccattacatgcttaacaagaatgtatcctgctctacttaccctacacaacatgaggagaatccccacccattgcgccagacccacatcccggaggagaatccccacccattgcgccattcccacatcccggataaggattcaggttgtgcatccagccttgggtttgactctttcactacaatgtcccttggaccaaatatttgtgcccacatgacgcccatggaaggatctatatctgccaaagaacctgagaattcacaggatttgcctgcagtagttagaagcagtgatgaaatggacactagaaacagtggcgaagttcatcgtgacacagctggcactcttcctgagtcgaagcagagccatgaaagttgcgcttccatgagtaataagttcaactctggagagtaccaagtcattttgcgcaaggagttgacaaagagtgatgtcgcaaattctgggcgaattgtgcttcccaagaaggatgctgaggctggtcttccaccattggtgcaaggggatcctctgatactgcagatggatgacatggtgcttccgattatatggaaatttaagtatagattttggccaaacaacaaaagcagaatgtatattctggaagctgcaggtgaattcgtgaagacacatggccttcaggcaggggatgcactcattatctacaaaaactccgtgcctggcaaatttattattcgtggggagaagtccattcagcagacaaacccctag

SEQ ID NO: 3378 - protein, 371 aa, Sorghum bicolor
  misc_feature: Ceres ANNOT ID no. 6030946
  misc_feature (263)..(366): Pfam Id: B3 Pfam Desc: B3 DNA binding domain
  misc_feature (1)..(371): NCBI GI: 38637288 NCBI Desc: transcription factor viviparous 1-like [oryza sativa (japonica cultivar-group)]
  misc_feature (211)..(367): NCBI GI: 32487512 NCBI Desc: osjnba0064g10.7 [oryza sativa (japonica cultivar-group)]
  misc_feature (17)..(367): NCBI GI: 32487511 NCBI Desc: osjnba0064g10.6 [oryza sativa (japonica cultivar-group)]
  misc_feature (180)..(368): NCBI GI: 134244196 NCBI Desc: lfl1 [oryza sativa (japonica cultivar-group)]
  misc_feature (263)..(364): NCBI GI: 109150382 NCBI Desc: abscisic acid insensitive 3 [arabidopsis thaliana]
  misc_feature: Useful for making plants with modulated drought sensitivity
  misc_feature: Functional homolog of the protein sequence given in SEQ ID NO 13375
MGQMGGPDGDGDGGGGGPHHQYHYQALLAAVQNPSQGLHPFPLPFHLPLHAGAPAAGPVVADADAASTHGANANAAPHSQPPRGFTDWSPSNSAFAAVAAQPAPATTNTPFHYNVPQSYALWTHYMLNKNVSCSTYPTQHEENPHPLRQTHIPEENPHPLRHSHIPDKDSGCASSLGFDSFTTMSLGPNICAHMTPMEGSISAKEPENSQDLPAVVRSSDEMDTRNSGEVHRDTAGTLPESKQSHESCASMSNKFNSGEYQVILRKELTKSDVANSGRIVLPKKDAEAGLPPLVQGDPLILQMDDMVLPIIWKFKYRFWPNNKSRMYILEAAGEFVKTHGLQAGDALIIYKNSVPGKFIIRGEKSIQQTNP

SEQ ID NO: 3379 - DNA, 858 bp, Sorghum bicolor
  misc_feature: Ceres ANNOT ID no. 6031086
  misc_feature: Encodes the peptide sequence at SEQ ID NO 3380
atgacttatctgctcaagagcaggagtgaaccaacgcagctgttaccggcgtcttcagaagaacagcagagaaagataaatgaggtccgggaactccttggcgatctgccgacagagatgccgaacttcctttcggatgccactatccgccggttcctccgagcaagaaactggagtacgacgaaagctactaagagtctcaaagaaactaccagttggagacgtcactacaagccagagaaaattcgttgggaaagcattgccgatagtgagaatgaggctaagcgagcgtacataccggactaccttgacaagaacggaagaatggtcttcgtaacacttccagcaataaagaccaaaacttcagagaaggatcatctaaagtatctagtgtataacctggaaaccctgctcatgtattctgaagatgcagaagaagagtgtattgtttggatctctgacttccaaggctgggcaatatcaagtacaccattttcgttgacccgacaatcactacacataattcaacaatactatccaggattgatagcagtcgctattctaaccaacccaccaataatttttgaatccttttggaagataataaaacgtttcctagagccacgaatgaatgaaaaagtgaaatttatttatagcaacaattcagagagccagaagataatgggtgacatgtttgacctcgacaaactggagtatatatttggaggaagaaacacagctgagtttgacatcaacatgtatgcagagagaatgaaacgacgagatcgcgtacggggatcttggacacaggacaatggcgaggcctcctcgaataatactaaaccgaatgaagattga

SEQ ID NO: 3380 - protein, 285 aa, Sorghum bicolor
  misc_feature: Ceres ANNOT ID no. 6031086
  misc_feature (95)..(266): Pfam Id: CRAL_TRIO Pfam Desc: CRAL/TRIO domain
  misc_feature (13)..(82): Pfam Id: CRAL_TRIO_N Pfam Desc: CRAL/TRIO, N-terminus
  misc_feature (20)..(280): NCBI GI: 30687745 NCBI Desc: sec14 cytosolic factor family protein / phosphoglyceride transfer family protein [arabidopsis thaliana]
  misc_feature (18)..(263): NCBI GI: 92893041 NCBI Desc: cellular retinaldehyde-binding/triple function, n-terminal [medicago truncatula]
  misc_feature (20)..(262): NCBI GI: 83283975 NCBI Desc: transporter-like protein [solanum tuberosum]
  misc_feature (12)..(272): NCBI GI: 92868927 NCBI Desc: cellular retinaldehyde-binding/triple function, n-terminal [medicago truncatula]
  misc_feature (67)..(262): NCBI GI: 145334241 NCBI Desc: sec14 cytosolic factor family protein / phosphoglyceride transfer family protein [arabidopsis thaliana]
MTYLLKSRSEPTQLLPASSEEQQRKINEVRELLGDLPTEMPNFLSDATIRRFLRARNWSTTKATKSLKETTSWRRHYKPEKIRWESIADSENEAKRAYIPDYLDKNGRMVFVTLPAIKTKTSEKDHLKYLVYNLETLLMYSEDAEEECIVWISDFQGWAISSTPFSLTRQSLHIIQQYYPGLIAVAILTNPPIIFESFWKIIKRFLEPRMNEKVKFIYSNNSESQKIMGDMFDLDKLEYIFGGRNTAEFDINMYAERMKRRDRVRGSWTQDNGEASSNNTKPNED

SEQ ID NO: 3381 - DNA, 732 bp, Sorghum bicolor
  misc_feature: Ceres ANNOT ID no. 6031105
  misc_feature: Encodes the peptide sequence at SEQ ID NO 3382
atggcgatggggccggcgctgcgggcggctgccgctgacgcggtggtgacgttcctgtgggtgctgtgcgtctccacgctgggggcctcgacggcggcggtgacctcctacctgagtttgcagggcgtccactacgcgctcctggtcaccgtctccctcctctccgtgctcctcttcaccttcaatatcctctgcgacgcactcggcggcgccagcttcaaccccaccggcatcgccgccttctacgccgccggagtcaccagcccctccctcttctccgtcgcgctccggttaccggcacaggccgccggcgctgtgggcggcgctcttgccatctcggagctgatgccggcgcagtacaagcacatgcttgggggaccctcgctcaaggtggatccccacaccggtgccatcgccgaattagtgcttactttcgtcatcaccctggccgtgctcttgatcatagtcaaggggccccggaaccccatcatcaagacatggatgatctccatctgcaccctgtgcctcgtcctctccggcgcagcatacaccggcccttccatgaacccagccaatgcatttggctgggcgtatgttaacaatcgccataatacttgggagcagttctatgtgtactggatatgccccttcattggtgccattcttgctgcgtggatcttcagggctttgttcctagcaccgccacctaagcccaaggccaagaaagcatga

SEQ ID NO: 3382 - protein, 243 aa, Sorghum bicolor
  misc_feature: Ceres ANNOT ID no. 6031105
  misc_feature (1)..(227): Pfam Id: MIP Pfam Desc: Major intrinsic protein
  misc_feature (1)..(243): NCBI GI: 13447815 NCBI Desc: small basic membrane integral protein zmsip1-2 [zea mays]
  misc_feature (1)..(243): NCBI GI: 13447813 NCBI Desc: small basic membrane integral protein zmsip1-1 [zea mays]
  misc_feature (3)..(240): NCBI GI: 88604775 NCBI Desc: small basic intrinsic protein 1 [vitis vinifera]
  misc_feature (3)..(240): NCBI GI: 140038995 NCBI Desc: major intrinsic protein [medicago truncatula]
  misc_feature (5)..(242): NCBI GI: 13447817 NCBI Desc: small basic membrane integral protein zmsip2-1 [zea mays]
MAMGPALRAAAADAVVTFLWVLCVSTLGASTAAVTSYLSLQGVHYALLVTVSLLSVLLFTFNILCDALGGASFNPTGIAAFYAAGVTSPSLFSVALRLPAQAAGAVGGALAISELMPAQYKHMLGGPSLKVDPHTGAIAELVLTFVITLAVLLIIVKGPRNPIIKTWMISICTLCLVLSGAAYTGPSMNPANAFGWAYVNNRHNTWEQFYVYWICPFIGAILAAWIFRALFLAPPPKPKAKKA

SEQ ID NO: 3383 - DNA, 1497 bp, Sorghum bicolor
  misc_feature: Ceres ANNOT ID no. 6031111
  misc_feature: Encodes the peptide sequence at SEQ ID NO 3384
atgatgaagtcgctcctcttctccgtccaccccacgccgccgctcctccccaccccccgccttcgcaggctcctgcgcttccgcgcctcctcctcagcctccgcctccgcctccgcgccgccccgagccgaccgccgctcgccccggcccgcgccgtcgcgccgcccatcctcctcctccctctatgcgcgccccagcctcctcgagatggagcgcgagcgcgccgcccgccgcgcggacgttgacgccttcctcacctccctcggcgtcgacccgggcgagctcgcgggcctcgagctcccggtcaccgtcgacgtcatgcgggagcgcgccgagttcctgggctccctcgggctcacccgcgaggacctcgccgcgtaccctctcgctctcggctgcagcgtgcgcaagaacatggtccccgtcctcgactacctcggcaagctcggcgtccgccgcgacgcgctcccggacctgctgagacggtacccgcaggtgctacacgccagcgtcgtcgtcgaccttgcccccgtcgtcaagtacctccagggtatggacgtgaggcccgctgacgtgccgcgcgtgctcgagcggtacccggagctcctcgggttcaagctcgagggcaccatgagtacttccgtcgcctacctcgttggcattggagtggggaggcgtcagataggcagcgtcatcacccgttttccagaggtgcttggtatgcgcgtggggaagataataaagcctttcgtcgaacaccttgagggcatcgggctgcagaggttagctgttgcgagaataatagagaagaagccatatgtacttggatttgggctagaggagaaggttaagcctaacactgaggctcttatggactttggagtgaggaaggaggctctagcatccattgtgatgcaataccccgacgttcttggacttgaactgagggacaagcttgttgcacagcagagcttgtttgaatcgagcattttggttagccgtgaagattttgggagagtggtcgagaggatgccgcaagccattagtcttggacgagctgcggttcagaagcatgttaatttcctcacagcttgtggatttatgctctctcaagtgagcaaaatggttgtggcttgcccccaactgcttgcactaaatatggatataatgaggatgaatttcgaatacttcaagaatgagatggagagggatttggaggagctggttgagttccctgcgttcttcacatatggcctcgagtcgactgtgaggcctcggcatgagatggtgtcccagaagggcttcacatgctctcttgcatggcttcttaactgttctgatgccaaatttgatgagcgcatgaagtatgacacaattggggttgaggaaatggagcgtgaggattcttctgacatgaatgcatctatggaggaggtagagagtgaggagtatgaagacagtgattatgatgactctgatgatgagtttgttcgataa

SEQ ID NO: 3384 - protein, 498 aa, Sorghum bicolor
  misc_feature: Ceres ANNOT ID no. 6031111
  misc_feature (105)..(452): Pfam Id: mTERF Pfam Desc: mTERF
  misc_feature (40)..(495): NCBI GI: 47497486 NCBI Desc: mitochondrial transcription termination factor-like [oryza sativa (japonica cultivar-group)]
  misc_feature (36)..(315): NCBI GI: 92898511 NCBI Desc: mitochodrial transcription termination factor-related [medicago truncatula]
  misc_feature (112)..(425): NCBI GI: 92891194 NCBI Desc: mitochodrial transcription termination factor-related [medicago truncatula]
  misc_feature (344)..(496): NCBI GI: 15450557 NCBI Desc: at4g02990/t4i9_13 [arabidopsis thaliana]
  misc_feature (104)..(495): NCBI GI: 42569224 NCBI Desc: mitochondrial transcription termination factor-related / mterf-related [arabidopsis thaliana]
MMKSLLFSVHPTPPLLPTPRLRRLLRFRASSSASASASAPPRADRRSPRPAPSRRPSSSSLYARPSLLEMERERAARRADVDAFLTSLGVDPGELAGLELPVTVDVMRERAEFLGSLGLTREDLAAYPLALGCSVRKNMVPVLDYLGKLGVRRDALPDLLRRYPQVLHASVVVDLAPVVKYLQGMDVRPADVPRVLERYPELLGFKLEGTMSTSVAYLVGIGVGRRQIGSVITRFPEVLGMRVGKIIKPFVEHLEGIGLQRLAVARIIEKKPYVLGFGLEEKVKPNTEALMDFGVRKEALASIVMQYPDVLGLELRDKLVAQQSLFESSILVSREDFGRVVERMPQAISLGRAAVQKHVNFLTACGFMLSQVSKMVVACPQLLALNMDIMRMNFEYFKNEMERDLEELVEFPAFFTYGLESTVRPRHEMVSQKGFTCSLAWLLNCSDAKFDERMKYDTIGVEEMEREDSSDMNASMEEVESEEYEDSDYDDSDDEFVR

SEQ ID NO: 3385 - DNA, 657 bp, Sorghum bicolor
  misc_feature: Ceres ANNOT ID no. 6031114
  misc_feature: Encodes the peptide sequence at SEQ ID NO 3386
atgggcgtccagcgtctgctgaggctgaggatggcgtcacactcctgctcccgccccccggccgccgccttggcgccgcgcgccgcgcgcccgctctcctctctcctcctcgccccttcgccctccaccgcgcgccctccgtccgcgcccctctcgtgcgcagctcggccgtgccggggccacgcccacgcggcggcgtccgcgtcgcgcggcgcggcagggcggaggcccccgagcgtggcggcgatgtcgtcgtcgacgccgccgccggggcccgtgcagaagtcggaggaggagtggcaggccatcctcacgccggagcagttcaacatcctacgccgcaagggcaccgagtaccctggaacgggtgaatatgacaagttctttgaggagggcatttataaatgtgctggatgtggaactcccttatacaaatcatctacaaagttcaactcagggtgtggctggccggcattctatgagggacttcctggggccataaaacagacgccggaccctgatgggaggcggacagagatcacatgtactgcctgtggaggacatttggggcatatattcaaaggggaggggtttaaaacgcctaccaacgagcgacactgtgttaacagcatttcgcttaagttcactccatcctag

SEQ ID NO: 3386 - protein, 218 aa, Sorghum bicolor
  misc_feature: Ceres ANNOT ID no. 6031114
  misc_feature (97)..(218): Pfam Id: SelR Pfam Desc: SelR domain
  misc_feature (80)..(218): NCBI GI: 144922977 NCBI Desc: mss4-like [medicago truncatula]
  misc_feature (93)..(216): NCBI GI: 108936784 NCBI Desc: methionine sulfoxide reductase [plantago major]
  misc_feature (79)..(218): NCBI GI: 18412703 NCBI Desc: methionine sulfoxide reductase domain-containing protein / seir domain-containing protein [arabidopsis thaliana]
  misc_feature (90)..(218): NCBI GI: 4115939 NCBI Desc: contains similarity to methanobacterium thermoautotrophicum transcriptional regulator (gb:ae000850) [arabidopsis thaliana]
  misc_feature (77)..(216): NCBI GI: 21592485 NCBI Desc: contains similarity to helicobacter pylori peptide methionine sulfoxide reductase (msra) (gb:ae000542) [arabidopsis thaliana]
  misc_feature (93)..(215): SWISSPROT Homolog: EC 1.8.4.12 Peptide methionine sulfoxide reductase msrB
  misc_feature: Useful for making plants with modulated heat sensitivity
  misc_feature: Functional homolog of the protein sequence given in SEQ ID NO 12940
  misc_feature: Useful for making plants with modulated heat sensitivity
  misc_feature: Functional homolog of the protein sequence given in SEQ ID NO 12940
  misc_feature: The sequence is a functional homolog of SEQ ID NO. 421 in the 11/188,298 US application
MGVQRLLRLRMASHSCSRPPAAALAPRAARPLSSLLLAPSPSTARPPSAPLSCAARPCRGHAHAAASASRGAAGRRPPSVAAMSSSTPPPGPVQKSEEEWQAILTPEQFNILRRKGTEYPGTGEYDKFFEEGIYKCAGCGTPLYKSSTKFNSGCGWPAFYEGLPGAIKQTPDPDGRRTEITCTACGGHLGHIFKGEGFKTPTNERHCVNSISLKFTPS

SEQ ID NO: 3387 - DNA, 1647 bp, Sorghum bicolor
  misc_feature: Ceres ANNOT ID no. 6031121
  misc_feature: Encodes the peptide sequence at SEQ ID NO 3388
atgcctcgatttatccgcacccgctggcgtaatcgcaagccctggaaaccgggagagcgcgccatcggcactctccgctcggttcaccgctcccgcctcagctctgccataggtaagaagagtttatacctgcccctgcgtgcgtcgtcttatagtgacgaccgcgtcagtgccctcaccgatgatctgctgctcctcatcttacgccgcctggatacccgcagcgccctcgccaccgcaaccctttcaaagcgctgggctagcatcccgcgcgggcttgacgcccttagtttcagggtcaatgatattcttcctccgcgctaccaccagtgcaccaggatccacagggaagccaattttagtgcatatggctaccttgccaatttcagggcgcttgccgccaacattaggcgttatgaacgacgtgccatgcgctccatgtccatctccatcaacaacttactggatgcagatgattaccatgagaatgaccccgatggccgaagtttgcggagtgtttcaacactgagggttgagttctttgctacctggccctcctcgggctgcatcaaccgcttgatagccaaggctgtggacacttggggggttcaagatcttgagatttcagcaaaggctacattctttcggctggattcccacagttttccccatcatggtctctgcaatgatccgcagaattctcgtctgcgaagtctgaagctagcagcttgccatcttccacaattgcaggacttccgcacgctcaccagtctggtcttgcaaggtttgccagactcaactccaactgcagcatatgtggctgtgttcaccttgtgcccacagctacaagcagtgcacatcaagtcttgcaatatcaagcaaggtgatatggtcatccatgcccccagatcagagattaagcagcttatcattgagcattgctcatttggacagttcaagctgtacactctcccaatgcttgaacgcatggctgtcattgacacttcagtgttttacaatcttagctccttcccatgcctcaaacacttgaatattacacgatgctatggcgccttcaaaagacgtacaattaccatacctagttgggacctcaatatgtttcttggaggcagcccaggaataactgatctcgttgtccgctttactggatatgatagatggtttaagatatggagctccgcactgttgttacctaaactcaggaggctcctgattgctgatctgccttcatcctgggatgtttcttggccccgcctcctcatcgaggcggcgccatgccttgagagccttcacatccatattagcccttgggaagaggatccttgtgatgacatcgtatggcaatcccctaaggtctgccacaatcagcttaaggagtttgtgataactggttttcagggaacagaaagacagatttactttgttagctttgtcatgaaagtagcaacaaagttggagtctgtttctttgttaaaaaatgggcttgttcagggcagaggccattgggactgggacatggtgaagcagcaacaccaatggggcaatgaagaaagaatcaaaatacttaaccagatttctaaagatgttccttgctcaacaagtactgttcaagtggttctggagtaa

SEQ ID NO: 3388 - protein, 548 aa, Sorghum bicolor
  misc_feature: Ceres ANNOT ID no. 6031121
  misc_feature (54)..(101): Pfam Id: F-box Pfam Desc: F-box domain
  misc_feature (47)..(547): NCBI GI: 115455907 NCBI Desc: os03g0796100 [oryza sativa (japonica cultivar-group)]
  misc_feature (53)..(514): NCBI GI: 21743052 NCBI Desc: osjnba0083d01.2 [oryza sativa (japonica cultivar-group)]
  misc_feature (53)..(548): NCBI GI: 38346115 NCBI Desc: osjnbb0006n15.10 [oryza sativa (japonica cultivar-group)]
  misc_feature (62)..(514): NCBI GI: 32526680 NCBI Desc: plant disease resistance polyprotein -like protein [oryza sativa (japonica cultivar-group)]
  misc_feature (45)..(211): NCBI GI: 21743054 NCBI Desc: osjnba0083d01.4 [oryza sativa (japonica cultivar-group)]
MPRFIRTRWRNRKPWKPGERAIGTLRSVHRSRLSSAIGKKSLYLPLRASSYSDDRVSALTDDLLLLILRRLDTRSALATATLSKRWASIPRGLDALSFRVNDILPPRYHQCTRIHREANFSAYGYLANFRALAANIRRYERRAMRSMSISINNLLDADDYHENDPDGRSLRSVSTLRVEFFATWPSSGCINRLIAKAVDTWGVQDLEISAKATFFRLDSHSFPHHGLCNDPQNSRLRSLKLAACHLPQLQDFRTLTSLVLQGLPDSTPTAAYVAVFTLCPQLQAVHIKSCNIKQGDMVIHAPRSEIKQLIIEHCSFGQFKLYTLPMLERMAVIDTSVFYNLSSFPCLKHLNITRCYGAFKRRTITIPSWDLNMFLGGSPGITDLVVRFTGYDRWFKIWSSALLLPKLRRLLIADLPSSWDVSWPRLLIEAAPCLESLHIHISPWEEDPCDDIVWQSPKVCHNQLKEFVITGFQGTERQIYFVSFVMKVATKLESVSLLKNGLVQGRGHWDWDMVKQQHQWGNEERIKILNQISKDVPCSTSTVQVVLE

SEQ ID NO: 3389 - DNA, 543 bp, Sorghum bicolor
  misc_feature: Ceres ANNOT ID no. 6031141
  misc_feature: Encodes the peptide sequence at SEQ ID NO 3390
atgcagacatgttttacatctattgttaccttagttgctggtgtgctgagaaagcggggttctaccgaagattctgttggcttgtatgcagtgcaatgccacaagtgctacaaatggagtacggttccaaaagaagaatttgagacacttcgtgagaacttcactaaggatccatggttctgcagcagacgaccagactgctcttgtgaagatgatgctgacattgagtatgacaacagccacatctgggtttttgacaatcccaacataccaaagcctccaccagggacggagaggctagtgattatgaggagtgactacagtgaaatggacccatattatgtcatgcccaatgggaagcatgcaaagtgtgctggtgatgtggataagtttctggaggcaaatccagagtacaaaaaccgcatgtctgcttcggatttcagctttgcaccactcaaggttgttgaggaaactgttcctcgcaactcaggcaggaaggctgccaaggccaagaagcagaaggcaaggcacaaaagtgattga

SEQ ID NO: 3390 - protein, 180 aa, Sorghum bicolor
  misc_feature: Ceres ANNOT ID no. 6031141
  misc_feature (28)..(76): Pfam Id: zf-CW Pfam Desc: CW-type Zinc Finger
  misc_feature (17)..(174): NCBI GI: 13936238 NCBI Desc: methyl-binding domain protein mbd101 [zea mays]
  misc_feature (17)..(173): NCBI GI: 134285524 NCBI Desc: mbd1 [triticum aestivum]
  misc_feature (26)..(174): NCBI GI: 115463813 NCBI Desc: os05g0404700 [oryza sativa (japonica cultivar-group)]
  misc_feature (15)..(160): NCBI GI: 54261715 NCBI Desc: at4g22745 [arabidopsis thaliana]
  misc_feature (25)..(149): NCBI GI: 115479913 NCBI Desc: os09g0494300 [oryza sativa (japonica cultivar-group)]
  misc_feature: Useful for making plants with altered Lignin content
  misc_feature: Useful for making plants with altered alkaloid content
  misc_feature: GREAT-hit functional homolog of the protein sequence given in SEQ ID NO 12992
MQTCFTSIVTLVAGVLRKRGSTEDSVGLYAVQCHKCYKWSTVPKEEFETLRENFTKDPWFCSRRPDCSCEDDADIEYDNSHIWVFDNPNIPKPPPGTERLVIMRSDYSEMDPYYVMPNGKHAKCAGDVDKFLEANPEYKNRMSASDFSFAPLKVVEETVPRNSGRKAAKAKKQKARHKSD

SEQ ID NO: 3391 - DNA, 1197 bp, Sorghum bicolor
  misc_feature: Ceres ANNOT ID no. 6031160
  misc_feature: Encodes the peptide sequence at SEQ ID NO 3392
atgcttgcgcagttgtgccggcggcggctcaccatccccctctccccaatcctcgccgccgccgccgccagcggcaagaaccccatccactccaaccacgcgcgcgccctcctctctcaaagtgactcctcctcgtccgccgtcgaggcggcgcccgaccgcaagccctgccccaccacggtctcctacctggtttcctgcggtgtctcccccgccgtcgccgccgctcgcaaggtccgcatccgggacacagcccgggctgacgccgttcaggccctcctgcgcgagtacggcttctccgacgcggatatcacccgcacggtgcgtagtgacccgctgctgctcaccttcgatcccgaccgcaccattcgccccaagctcgacttcttcctctcgctcgggatccagcctcgcttgctcgccaccgacccccacatcttcgcgcgcagcctcgacaagcacatcataccctgcgtcgagtacctccgcaccatcctgggctccgatgacaacatccgcgtcgccgtctcccgcgtgccccgcgcgctcatggccgacctcgacagcaccatgcgccccgccgtcgaggcgttcctcagccagggtctctccaaggaagccatcgccaagcttttcgtgatccacatgggaatgatcaagacatcgcccgagcgcatccgcgaggccttccatgacctcaaggcgctcggcttccgcgtcacggatacgggcttcctctacgccttccgcgtgatttgcagccttaggagggagacgtgggtgcgcaaggtggcgcttttccagagcttcggggtgtccgaggctcacctgctcagagcgttcaagacgcagcccaccatactgctcgtcggagaagagaccttgaagaagaagttcaggtttttcctggacgtgatgaaggttgagatggatgatgtgatggcgcagccactgactctggcattgagcttggagaagaatatcatgccaaagtgcgccgtgctgagcgtgttgatgagggagggtaagattaggattgagcggtcacagaagttgattccgccactgctttccaattctaaggtcttctcgcagaggtatgtgttgaggtatgctaaggatgtgcctgatgttgttaaggcatttgagggcaagattaaatttcaagggtttggctgtttggggatcagaagttag

SEQ ID NO: 3392 - protein, 398 aa, Sorghum bicolor
  misc_feature: Ceres ANNOT ID no. 6031160
  misc_feature (91)..(365): Pfam Id: mTERF Pfam Desc: mTERF
  misc_feature (35)..(382): NCBI GI: 15218140 NCBI Desc: mitochondrial transcription termination factor family protein / mterf family protein [arabidopsis thaliana]
  misc_feature (58)..(387): NCBI GI: 140038634 NCBI Desc: mitochodrial transcription termination factor-related [medicago truncatula]
  misc_feature (63)..(382): NCBI GI: 115467190 NCBI Desc: os06g0225100 [oryza sativa (japonica cultivar-group)]
  misc_feature (36)..(386): NCBI GI: 115460850 NCBI Desc: os04g0637500 [oryza sativa (japonica cultivar-group)]
  misc_feature (45)..(382): NCBI GI: 51536063 NCBI Desc: mitochondrial transcription termination factor-like [oryza sativa (japonica cultivar-group)]
  misc_feature: Useful for making plants with altered alkaloid content
  misc_feature: Useful for making plants with altered terpenoid content
  misc_feature: GREAT-hit functional homolog of the protein sequence given in SEQ ID NO 13002
  misc_feature: GREAT-hit functional homolog of the protein sequence given in SEQ ID NO 13214
  misc_feature: Useful for making plants with altered terpenoid content
  misc_feature: Functional homolog of the protein sequence given in SEQ ID NO 13150
MLAQLCRRRLTIPLSPILAAAAASGKNPIHSNHARALLSQSDSSSSAVEAAPDRKPCPTTVSYLVSCGVSPAVAAARKVRIRDTARADAVQALLREYGFSDADITRTVRSDPLLLTFDPDRTIRPKLDFFLSLGIQPRLLATDPHIFARSLDKHIIPCVEYLRTILGSDDNIRVAVSRVPRALMADLDSTMRPAVEAFLSQGLSKEAIAKLFVIHMGMIKTSPERIREAFHDLKALGFRVTDTGFLYAFRVICSLRRETWVRKVALFQSFGVSEAHLLRAFKTQPTILLVGEETLKKKFRFFLDVMKVEMDDVMAQPLTLALSLEKNIMPKCAVLSVLMREGKIRIERSQKLIPPLLSNSKVFSQRYVLRYAKDVPDVVKAFEGKIKFQGFGCLGIRS

SEQ ID NO: 3393 - DNA, 3021 bp, Sorghum bicolor
  misc_feature: Ceres ANNOT ID no. 6031162
  misc_feature: Encodes the peptide sequence at SEQ ID NO 3394
atgaagcgggggaaggggggaaggaatgggctgctgccgagctcgctgcggatcatctcgtcctgcctcaagacggtcacctccaacgccggctccgtcgcgtccaccgttcgctcggccggagcctccgtcgccgcctccatctcctcccaggccgaggacgagaaggaccaggttttatgggctggattcgataaactagagcttcatccatcatcgttcaagaatgtcctgcttgttggttattcaaatgggtttcaagtgctcgatgttgaagatgctgccaatgtttgtgaattggtctcaaaacgtgatggcccagttacgtttttacaaatgcaacccactccagtcagctctgaaggcatcgaaggattcagagcgtcacatcccatgcttctagttgttgctggtgatgagacaaatggcctgggtgcggttcaaggtggtcgcttaagtgctcttatcagagacacaaacagtgagcctcaagctggaaattgcatttctacccctacagttgtccgtttctactctatgaagtctcacacatatgtacacgttcttcgattccggtctgctgtatatttagttcgctgcagtccaaggattgttgctgtagcacttgcagcacaaatctactgcttcgacgctgttactcttgagaacaagctcagtgttttaacatatcctttgcaaggtgcacctggggtaaatattgggtatggccctatggctgttggccccagatggttagcctatgccacaaatactcctttattgtcaaacacaggccgtctaagtccacagaacctcacaccttcgccaggagtgagcccatctacttctcctagcagtggaagtttagttgctagatatgcaatggagtctagcaagcaattagcttctggtattattgacatgggatataaaacattttcaaagtactgccaggaacttctgccagatggttctaactcccctttgtcatcaagcccaggcaggagatctggtaaaattccttccagtgtgcatccactggaagctgacaatgcaggaatggtagtcatcaaggatttcacttccaaagctgttgtctcacagtttagggctcacacaagtccgatatctgctctttgtttcgaccctagtggaacacttttggtgacaacctctgttcatggccataacataaatgttttcaggatcatgccaacctgcattgctaatggctcaggcgcaacgcgctatgattggacagcatctcatgttcatctttataaactgtatcgcggcatgacatcagctgtcatacaagacatctcgttcagtcattttagccaatggatatctattgtttcatctcgtggtacctgccatatttttacgttgtccccatttggtggtgatgcgagtctgcagccacagaattctcacagtgatgggccacctcttgccccatgtcagtcaaggccatggtggtcaaagccatcctttcttatggaccaacagcttcatcaagtcccctcaactgtgacaaattcggtagtcagtaggataaagaataacacttctggttggctaaatactgtcagcaatgtggctgcttctgcaagtggaaaactatctgtaccatctggcgctgtaactgctgttttccataattccatctaccagggttctttgccagttccatctaaggctaatgctttagagcatctactggtgtattcgccatctggtcatgttattcaacatgaacttttaccttcttcaggttctgagtccactggtagcagcccgagagttggttcagctcctaactcgcaactccaagatgatgagatgcatgttactgctgaaccaattcaatggtgggatgtgtgccgtaggacaaactggccagaaagagatgaaaacattgcaaacattgtattgtataaccaaagaagcagtataatggctatggatgcttctgactgtgaagatagcgagcattcagattccactgcatcaaatgatggtatctctgggaaagagattatgagagtccgagaaaggtcaagctggtatctatctaatgcagaagtacagataaactcgtggcggattcccatctggcagaaatccaagatttgcttctatgtgatggaccatcctgctgcagagtcggtcgaatcagttagtagcagtggtggagaaattgagattgagaagttacctcttcacgaggttgagatcaggagaagggaattgctccctgtattcaagcagttccaatattctgagcgacattctagtgataggaatgttgcaaatggaagaagtattgcaaatggaagctttcagaatgccttgtcccacatcagtgatgcacagtacggctctgtaaaggataatggtgaatatgaaaccaaaccggtggctcctttgtctgggttttatgctgatacgaggaaaacatctaacacaaatggtctagctaggcaaacattctctggacctggctcagctgttaatctacagcaagtgggaaagtgcaattctattgaatctcctaatgctgcaattttggctggcaaagcagagaatgagagcaatggttatatatccactccacctgaaacaaatgcatctatcagatcattgagcagctattctctcttggatggacctgttgacggaatgctgtctcctgcaaataacgcatcatacaagcctgaaacaacaaataattctgtgctcagcaatgttgcaagcactgacataccaaatgggtgtctcaccactgtcgattctggacagcaggaggcgtctgattctcacagctcagtggagtttacccagtatttccaagagggctattgtaaaatatcagaactcgatgactgccgtgagttaactgaagctgttactgatgctgacagcagcagcagccactgcgagagagagaagcccgaggaagatggggataacgatgacttgcttggaggagtttttgccttcagtgaagaaggttga

SEQ ID NO: 3394 - protein, 1006 aa, Sorghum bicolor
  misc_feature: Ceres ANNOT ID no. 6031162
  misc_feature (1)..(1006): NCBI GI: 115463821 NCBI Desc: os05g0405900 [oryza sativa (japonica cultivar-group)]
  misc_feature (2)..(897): NCBI GI: 140071470 NCBI Desc: wd40-like [medicago truncatula]
  misc_feature (7)..(744): NCBI GI: 3776567 NCBI Desc: strong similarity to f21b7.33 gi2809264 from a. thaliana bac gbac002560. est gbn65119 comes from this gene. [arabidopsis thaliana]
  misc_feature (113)..(880): NCBI GI: 9280639 NCBI Desc: f21b7.1 [arabidopsis thaliana]
  misc_feature (3)..(840): NCBI GI: 115440391 NCBI Desc: os01g0786900 [oryza sativa (japonica cultivar-group)]
MKRGKGGRNGLLPSSLRIISSCLKTVTSNAGSVASTVRSAGASVAASISSQAEDEKDQVLWAGFDKLELHPSSFKNVLLVGYSNGFQVLDVEDAANVCELVSKRDGPVTFLQMQPTPVSSEGIEGFRASHPMLLVVAGDETNGLGAVQGGRLSALIRDTNSEPQAGNCISTPTVVRFYSMKSHTYVHVLRFRSAVYLVRCSPRIVAVALAAQIYCFDAVTLENKLSVLTYPLQGAPGVNIGYGPMAVGPRWLAYATNTPLLSNTGRLSPQNLTPSPGVSPSTSPSSGSLVARYAMESSKQLASGIIDMGYKTFSKYCQELLPDGSNSPLSSSPGRRSGKIPSSVHPLEADNAGMVVIKDFTSKAVVSQFRAHTSPISALCFDPSGTLLVTTSVHGHNINVFRIMPTCIANGSGATRYDWTASHVHLYKLYRGMTSAVIQDISFSHFSQWISIVSSRGTCHIFTLSPFGGDASLQPQNSHSDGPPLAPCQSRPWWSKPSFLMDQQLHQVPSTVTNSVVSRIKNNTSGWLNTVSNVAASASGKLSVPSGAVTAVFHNSIYQGSLPVPSKANALEHLLVYSPSGHVIQHELLPSSGSESTGSSPRVGSAPNSQLQDDEMHVTAEPIQWWDVCRRTNWPERDENIANIVLYNQRSSIMAMDASDCEDSEHSDSTASNDGISGKEIMRVRERSSWYLSNAEVQINSWRIPIWQKSKICFYVMDHPAAESVESVSSSGGEIEIEKLPLHEVEIRRRELLPVFKQFQYSERHSSDRNVANGRSIANGSFQNALSHISDAQYGSVKDNGEYETKPVAPLSGFYADTRKTSNTNGLARQTFSGPGSAVNLQQVGKCNSIESPNAAILAGKAENESNGYISTPPETNASIRSLSSYSLLDGPVDGMLSPANNASYKPETTNNSVLSNVASTDIPNGCLTTVDSGQQEASDSHSSVEFTQYFQEGYCKISELDDCRELTEAVTDADSSSSHCEREKPEEDGDNDDLLGGVFAFSEEG

SEQ ID NO: 3395 - DNA, 1521 bp, Sorghum bicolor
  misc_feature: Ceres ANNOT ID no. 6031182
  misc_feature: Encodes the peptide sequence at SEQ ID NO 3396
atgtcccgccgccccgcctgctccctcgtccccctgctccgcagccgccgctgcccccacgacgccaccacccctcggtccttcaccgccggctccgtcccacccggcgtgatctcctacacctggccgccgccgccgcctcctccgcccaatcccaccgggtcgtggtgcccggcggcgtcttattcttccacgtcgccgccgctcccgcccttcgcggcatcccatctccgcgccgccgtctcctcgctcgccgcctcgctcaccgcgatcccggggcctgacccggacccggtgcccgccctccacgagcactccttccctaccctcctcgccgtctctccgctcgcgtcgctcgagctcctctcgctgctccggtccaggccgcggctagggctcgccgtattctcattccgccgcgcgctctccccggtcccctcgctcggcgagttcgccctcgccatctcgctcgcgagccgcgcccgcgaccatgacgcggcggccgcgctctttgccgacggcaccgctacccattccccgaaccaggggctgtacaacgctcttatggcggcatacatgcacaacggcctcctagacagctgcatcgagaccttccacgcgctggagcgcgacccaaggtgcggtccgcccaacgtggactcgtacaacatcctcatagccctgtacggtcgctccctcctcgttgaccacatggaggccacgctccagtcgctggatgcttctggccaaccccgcactattggtacgtacaatgcaatcatctctggttacctcaccgcgtggatgtgggacaaaatggaagccgtgtttcatgagatggtgtcgggccatgttgctccagatgctactacgcatctgttgatgttaagaggatatgcacatgccgggaggatctataaaatggagcaagcttatgagcatgcttgcaaacttgtcagaaagtttgacattgtgcatatacgtgcaatgctttgcgcatactgcaagttttaccatgtaggtagaatccaaaagattgaggatttgctcaagcagttgggtcctgatgattataggccgtggctaaatgtgctcttaattaaggtgtacgctcaggaggggttggttgatgggatggagctgcatatttctgaggcattgcaacacaataccattgtcaacacaataaaggtgatgcgagccatcatatgtagctattttcgatatgacgcagttgacaaacttgtacattttgtacgtctggctgaggaggctggttggaagctgtgccggagtttgtaccactgcaagatggtaatgtatgggaatcaccatcgattggaagagatgcatggggtgctagatgagatggaatgttttaagattgatcgaacaaagaagacattttggatcatgtacaaggcatatgttagttgtgggcggagggctgaggccaacactatacttggcatgatgtggaagcatgggtttggacttcctcgcaacatatctgttcaataa

SEQ ID NO: 3396 - protein, 506 aa, Sorghum bicolor
  misc_feature: Ceres ANNOT ID no. 6031182
  misc_feature (255)..(289): Pfam Id: PPR Pfam Desc: PPR repeat
  misc_feature (81)..(500): NCBI GI: 87241379 NCBI Desc: pentatricopeptide repeat [medicago truncatula]
  misc_feature (131)..(343): NCBI GI: 1785620 NCBI Desc: orfb [arabidopsis thaliana]
  misc_feature (70)..(488): NCBI GI: 115450301 NCBI Desc: os03g0115300 [oryza sativa (japonica cultivar-group)]
  misc_feature (146)..(476): NCBI GI: 30961817 NCBI Desc: ppr2 [zea mays]
  misc_feature (30)..(496): NCBI GI: 3289002 NCBI Desc: crp1 [zea mays]
MSRRPACSLVPLLRSRRCPHDATTPRSFTAGSVPPGVISYTWPPPPPPPPNPTGSWCPAASYSSTSPPLPPFAASHLRAAVSSLAASLTAIPGPDPDPVPALHEHSFPTLLAVSPLASLELLSLLRSRPRLGLAVFSFRRALSPVPSLGEFALAISLASRARDHDAAAALFADGTATHSPNQGLYNALMAAYMHNGLLDSCIETFHALERDPRCGPPNVDSYNILIALYGRSLLVDHMEATLQSLDASGQPRTIGTYNAIISGYLTAWMWDKMEAVFHEMVSGHVAPDATTHLLMLRGYAHAGRIYKMEQAYEHACKLVRKFDIVHIRAMLCAYCKFYHVGRIQKIEDLLKQLGPDDYRPWLNVLLIKVYAQEGLVDGMELHISEALQHNTIVNTIKVMRAIICSYFRYDAVDKLVHFVRLAEEAGWKLCRSLYHCKMVMYGNHHRLEEMHGVLDEMECFKIDRTKKTFWIMYKAYVSCGRRAEANTILGMMWKHGFGLPRNISVQ

SEQ ID NO: 3397 - DNA, 1398 bp, Sorghum bicolor
  misc_feature: Ceres ANNOT ID no. 6031189
  misc_feature: Encodes the peptide sequence at SEQ ID NO 3398
atggagctcggggtcagcgccaccgtgcacatgctcttcggcctctacgtcttcagcacggccgtcgccgccgacatctcgcaggccgccgcggcgtcggggtgcctcctgctgcgccgcccatgggcgcctcccgagggagcgccgctcgtcgacgtcgccgccgcgggggagagcgacgaccgcaggggcgccgcgcccgtcatcctccacgcctcgccgccgcccatcgtcctcgtccacggcatcttcggattcggcaaagggaggctcggtggcctctcctacttcgccggcgccgagaagaaggacgaccgcgtgctcgtcccggatttggggtcgctcaccagcatccatgacagggcgcgcgagctgttctactaccttaagggcgggcaggtggactacggcgaggagcacagcaaggcttgcggccacagcaggtttgggagaatatatcacacagggcactatcctgcgtgggacgagcacagcccggtgcattttgtcgggcactctgctggcgcacaggttgtgagggtgctgcatcagatgcttgccgacaaggctttccctggtcatgatacttctgaagattgggttctgagcctgacttccttgtcgggcgcacttaatggaaccacaagaacttactacgatggcatgctggttgaagatggtaggtccatgaaatatatctgtcttcttcagctctgccggctcggagttattgtgtacgattggctagatattccttggctgaagaattactacaattttggttttgaccactatgagatgtcacggaggaaagtaggcttttcaggtctaattaatctgcttgtggggcacacgggcccatttgccagcggagattggattctacctgaccttacaatccaaggatccatgaaactaaactctagacttaggacctttcccaatacattctacttcagttatgctacaaagaaaacaagaaaattatttggaattacagtgccttcaagtgttcttggagtgcaccccatgctctttctgagagtcctccagatgtgtatgtggcggcaccctcaaagtgcacctctgccttacaaaggatacagggatgaagattgggaagacaatgatggggctttgaacacaatctctatgacacacccccgcattcccattgagcatccacaccgtctggtagtggacgattctgactgccatcctttgcaacctgggatatggtattacaagattattgaagctgaccacattctattcattgtgaatcgggaaagagctggagtgcagttcgatttgctgtacgatggcatttttcagcgctgcagaaagcatgcctttaggaagagcccacctactgtaccaaacgaaacaagtcaatag

SEQ ID NO: 3398 - protein, 465 aa, Sorghum bicolor
  misc_feature: Ceres ANNOT ID no. 6031189
  misc_feature (115)..(369): NCBI GI: 6573747 NCBI Desc: f20b24.17 [arabidopsis thaliana]
  misc_feature (76)..(423): NCBI GI: 145965991 NCBI Desc: pla depolymerase [uncultured bacterium]
  misc_feature (76)..(390): NCBI GI: 145965989 NCBI Desc: pla depolymerase [uncultured bacterium]
  misc_feature (76)..(390): NCBI GI: 118443364 NCBI Desc: lipase [clostridium novyi nt]
  misc_feature (70)..(426): NCBI GI: 24987389 NCBI Desc: chain b, crystal structure of the first thermostable bacterial lipase from bacillus stearothermophilus
  misc_feature: Useful for making plants with modulated cold sensitivity
  misc_feature: Functional homolog of the protein sequence given in SEQ ID NO 12936
  misc_feature: Useful for making plants with modulated cold sensitivity
  misc_feature: Functional homolog of the protein sequence given in SEQ ID NO 12936
MELGVSATVHMLFGLYVFSTAVAADISQAAAASGCLLLRRPWAPPEGAPLVDVAAAGESDDRRGAAPVILHASPPPIVLVHGIFGFGKGRLGGLSYFAGAEKKDDRVLVPDLGSLTSIHDRARELFYYLKGGQVDYGEEHSKACGHSRFGRIYHTGHYPAWDEHSPVHFVGHSAGAQVVRVLHQMLADKAFPGHDTSEDWVLSLTSLSGALNGTTRTYYDGMLVEDGRSMKYICLLQLCRLGVIVYDWLDIPWLKNYYNFGFDHYEMSRRKVGFSGLINLLVGHTGPFASGDWILPDLTIQGSMKLNSRLRTFPNTFYFSYATKKTRKLFGITVPSSVLGVHPMLFLRVLQMCMWRHPQSAPLPYKGYRDEDWEDNDGALNTISMTHPRIPIEHPHRLVVDDSDCHPLQPGIWYYKIIEADHILFIVNRERAGVQFDLLYDGIFQRCRKHAFRKSPPTVPNETSQ

SEQ ID NO: 3399 - DNA, 525 bp, Sorghum bicolor
  misc_feature: Ceres ANNOT ID no. 6031207
  misc_feature: Encodes the peptide sequence at SEQ ID NO 3400
atgcctcgctgcgcggtcgtcgtcctcttcgccgcggtgctcctcgcggcctccgccgccgcggtctccgggttccacctcggcggggacgagagcggcctcgtcaggggcgtgctcgccgcgctccgcgagcgggccgaggccgaggacgccgcgcgcttcgccgtcgcccaccacaacaagaaccagggtgctgctttggagtttacaagggtgctcaaatctaagcggcaggtggtgaccgggaccctgcatgacctgatactggaggcagctgatgctggaaaaaagagtctgtacagagcaaaggtttgggtgaagccgtgggaggatttcaagtctgttgtggagtttcgccttgttggagactctgaatctgaatccgagtcttctgtcacttctgatgttagctctgggcaagcgattgccaagctctctcttgaagcagacattgcacaagaggaggctcacctgcacaccattgagaatgatggactttccggcgatttcgcatcatcctcttag

SEQ ID NO: 3400 - protein, 174 aa, Sorghum bicolor
  misc_feature: Ceres ANNOT ID no. 6031207
  misc_feature (37)..(122): Pfam Id: Cystatin Pfam Desc: Cystatin domain
  misc_feature (4)..(173): NCBI GI: 109238641 NCBI Desc: cystatin hv-cpi3 [hordeum vulgare subsp. vulgare]
  misc_feature (11)..(167): NCBI GI: 75259840 NCBI Desc: cysteine proteinase inhibitor 3 precursor (oryzacystatin-3) (oryzacystatin iii) (oc-iii)
  misc_feature (33)..(126): NCBI GI: 18874516 NCBI Desc: cystatin [sandersonia aurantiaca]
  misc_feature (5)..(124): NCBI GI: 115435888 NCBI Desc: os01g0270100 [oryza sativa (japonica cultivar-group)]
  misc_feature (5)..(124): NCBI GI: 122228720 NCBI Desc: cysteine proteinase inhibitor 12 precursor (oryzacystatin-12) (oryzacystatin xii) (oc-xii)
  misc_feature: The sequence is a functional homolog of SEQ ID NO. 303 in the 11/188,298 US application
MPRCAVVVLFAAVLLAASAAAVSGFHLGGDESGLVRGVLAALRERAEAEDAARFAVAHHNKNQGAALEFTRVLKSKRQVVTGTLHDLILEAADAGKKSLYRAKVWVKPWEDFKSVVEFRLVGDSESESESSVTSDVSSGQAIAKLSLEADIAQEEAHLHTIENDGLSGDFASSS

SEQ ID NO: 3401 - DNA, 1200 bp, Sorghum bicolor
  misc_feature: Ceres ANNOT ID no. 6031211
  misc_feature: Encodes the peptide sequence at SEQ ID NO 3402
atggcgggcgtgaaagatgccgccggcggcgagtcgctgatgcagcggtgcaagccgtacgtggcgatgatctcgctgcagttcgggtacgccggcatgaacgtcatcaccaaggtgtcgctcaaccacggcatgagccactacgtgctcgtcgtctaccgccacgccttcgccacgctctccatcgcgcccttcgcgctcgtgctcgagcgcaaggtccgcccccggatgacgccgtgggtcttcctccagatcttcgtcctcgcgctgctcgggccggtgatcgaccagaacttctactacgcggggctcaagttcacctcgccgaccttctcctgcgccatgagcaacatgctccccgccatgaccttcatcctggccgtgctcttcaggatggagaaggtgaacctgaagaaggcgaggtgcgtggccaaggtggtgggcacgctcgtgacggtggccggcgccatgctcatgacgctctacaagggccgcgtcgtcgagatggtgtggaccaagcacatgcacctgcacggcccgcacccggcggacgccgccgccgacaaggactggttcacgggctccattttcctcatcatcgccacccttgcctgggcgtccctcttcatcctccaggccgccacgctcaagaggtacgacgcgccgctgtcgctgaccaccctcatctgcttcgtgggcaccctgcaggccgtcgtcgtcaccttcgtcatggagcgccagacctccgtctggaggatcggcttcgacatgaacctcctagccgccgcttacgctggcatagtgacgtctagcattgcctactacgtgcaagggctagtgatccagagcagaggccccgtcttcgcctcggccttcagccccctcatgatgatcatcgtcgccatcatgggctccttcatcctcgccgagaacatctacctcggcgggatcatcgggtccgtgctgattgtcgccggcctctactcggtgctgtggggtaagcacaaagagaacctggagaagctcgaggcacaggccatggagatccccgtggcgatcaaggccgtcgacggcaacggcaggatcatggaaatcgtggagctggacgaggtgcagctggagaaggcccaggccaacgccgcagtcgccgtcagggtccccgcagaggaggcccggatgcagggcaaggaccaggcttaa

SEQ ID NO: 3402 - protein, 399 aa, Sorghum bicolor
  misc_feature: Ceres ANNOT ID no. 6031211
  misc_feature (8)..(265): NCBI GI: 115463859 NCBI Desc: os05g0409500 [oryza sativa (japonica cultivar-group)]
  misc_feature (12)..(362): NCBI GI: 52851166 NCBI Desc: nodulin-like protein [plantago major]
  misc_feature (4)..(394): NCBI GI: 9759561 NCBI Desc: mtn21 nodulin protein-like [arabidopsis thaliana]
  misc_feature (15)..(384): NCBI GI: 2598575 NCBI Desc: mtn21 [medicago truncatula]
  misc_feature (23)..(394): NCBI GI: 42567710 NCBI Desc: nodulin mtn21 family protein [arabidopsis thaliana]
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
  misc_feature: Functional homolog of the protein sequence given in SEQ ID NO 12887
  misc_feature: The sequence is a functional homolog of SEQ ID NO. 334 in the 11/188,298 US application
MAGVKDAAGGESLMQRCKPYVAMISLQFGYAGMNVITKVSLNHGMSHYVLVVYRHAFATLSIAPFALVLERKVRPRMTPWVFLQIFVLALLGPVIDQNFYYAGLKFTSPTFSCAMSNMLPAMTFILAVLFRMEKVNLKKARCVAKVVGTLVTVAGAMLMTLYKGRVVEMVWTKHMHLHGPHPADAAADKDWFTGSIFLIIATLAWASLFILQAATLKRYDAPLSLTTLICFVGTLQAVVVTFVMERQTSVWRIGFDMNLLAAAYAGIVTSSIAYYVQGLVIQSRGPVFASAFSPLMMIIVAIMGSFILAENIYLGGIIGSVLIVAGLYSVLWGKHKENLEKLEAQAMEIPVAIKAVDGNGRIMEIVELDEVQLEKAQANAAVAVRVPAEEARMQGKDQA

SEQ ID NO: 3403 - DNA, 1089 bp, Sorghum bicolor
  misc_feature: Ceres ANNOT ID no. 6031218
  misc_feature: Encodes the peptide sequence at SEQ ID NO 3404
atggccaatgccactgtccccgagtcgcagccgccggcgcaagcggcgggtggccgccgcaaggtggtggacgaggtgtccggctggctgcgtgtgctggacgacggcagcgtggaccgcacgtggaccggcccacccgaggtcctcccgatgatgcagcccgtgccgccgtacgccgtgccccgcgacgggcacacgctgcacgacctccctggggaccccagtttccggatctacctccccgagcccgaggtcgtcgtcgacggcgaccgcaagggcgggcgcctgcccgtcatcgtgcacttccacggcggcggcttctgcttctcccacccgtcctgggtcatgtaccaccacttctactcgcgcctcgcgtgcgccgtccccgccgtcgtcgtctctgtcgagctcccgctcgcgcccgagcgccgcctgcctgcgcacatcgacacgggcgtcgccgcgctccgccggctccgctccatcatcgcgctgtcggaggacggagctcttgatgacaaggcagctgctaagctcctccgtcaggccgcagacatctcccgggtgttcctcgtcggggacagctctggcgctaacatcagccacttcgccgccgcgcgtgtgggcgccgacggcgctggcatctgggcgccgctgtgcgtcgccggttgcgttctgatccagccaggattcatgcgcgcaacaaggagccgatcggagctggaggtgggagagtcggtgttctttacgctggacatgctggacaagtgcaacgccatggcgctgccggttggcgccaccaaggagcacccgttcacgtgccccatgggtccgcaggcgccgccgctggagtccgtgccgctcccgccgatgctggtggccgtcgccgaaaacgacctcgtccgcgacacagacctcgagtactgcgacgcgctgcgcgccgccggtaaggaggtggaggtgctgctcagccgcggcatgagccatgcattctacctcaacaagttcgccgttgacatggaccccagcacaggggagcggacgcaggggctgattgacgccatcgtgagcttcatcgcttgccactga

SEQ ID NO: 3404 - protein, 362 aa, Sorghum bicolor
  misc_feature: Ceres ANNOT ID no. 6031218
  misc_feature (99)..(333): Pfam Id: Abhydrolase_3 Pfam Desc: alpha/beta hydrolase fold
  misc_feature (19)..(362): NCBI GI: 4190952 NCBI Desc: similar to hsr203j [lycopersicon esculentum]
  misc_feature (20)..(362): NCBI GI: 7417008 NCBI Desc: cell death associated protein [nicotiana tabacum]
  misc_feature (20)..(362): NCBI GI: 71142986 NCBI Desc: hsr203j [solanum tuberosum]
  misc_feature (20)..(362): NCBI GI: 42557349 NCBI Desc: hsr203j like protein [capsicum chinense]
  misc_feature (19)..(362): NCBI GI: 82697955 NCBI Desc: cxe carboxylesterase [malus pumila]
MANATVPESQPPAQAAGGRRKVVDEVSGWLRVLDDGSVDRTWTGPPEVLPMMQPVPPYAVPRDGHTLHDLPGDPSFRIYLPEPEVVVDGDRKGGRLPVIVHFHGGGFCFSHPSWVMYHHFYSRLACAVPAVVVSVELPLAPERRLPAHIDTGVAALRRLRSIIALSEDGALDDKAAAKLLRQAADISRVFLVGDSSGANISHFAAARVGADGAGIWAPLCVAGCVLIQPGFMRATRSRSELEVGESVFFTLDMLDKCNAMALPVGATKEHPFTCPMGPQAPPLESVPLPPMLVAVAENDLVRDTDLEYCDALRAAGKEVEVLLSRGMSHAFYLNKFAVDMDPSTGERTQGLIDAIVSFIACH

SEQ ID NO: 3405 - DNA, 1092 bp, Sorghum bicolor
  misc_feature: Ceres ANNOT ID no. 6031224
  misc_feature: Encodes the peptide sequence at SEQ ID NO 3406
atggctccccctgccaatgcccaggagcagccgcagccgcaggtgcagctggtgggtggccgcaaggtggtggacgaggtttccggctggctgcgcgtgctggacgacggcagcgtcgaccgcacctggaccgggccaccggaggccctcccgctgatggagccggtggcgccgtacgcggtgccgcgagacgggcacacgctccacgacctgcccggagagccgaacctgcgcgtgtacctccccgaggcgaagggggagaccgccggcgcgcgcctgcccgtcatcctgcagctccacggcggcggcttctgcatctcccacccgtcgtggctcatgtaccaccacttctacgcgcgcctcgcgtgcgccgtccccgccgtggtggtcgccgtcgagctcccgctcgcgcccgagcgccgcctccccgcgcacatcgacacgggcgtcgccgcgctccgcaggctccgctccatcgcgctgtcggccgaggacggcgccctcgatgacccggcggcggccgcgctcctccgtgaggccgccgacgtgtcccgggtgttcctcatcggggacagctcgggtggcaacctcgtccacctcgtcgccgcccgcgtgggccaggaattagcagacacgggcaataattgggctccactccgcgtcgccggcggcatcccgatccacccggggttcgtgcgcgccacgaggagcaggtcggagctggagacgaaggcggagtcggtgttcttcacgctggacatgctggacaagttcctcgccctcgcgctgccggagggcgcgaccaaggaccaccccttcacctgcccgatgggtccgcaggcgccgccgctggagtccgtgccgctgccgccgatgcttgtgtccgtggccgagaacgacctcatccgcgacactaacctcgagtactgcaacgcgctgcgcgccgccggcaaggaggtggaggtgctgatcaaccacggcatgagccactccttctacctcaacaagtacgccgtcgacatggatcccaccactggggaacgagcccaagagctcatcgacgccatcaggagcttcatctcgcgccactga

SEQ ID NO: 3406 - protein, 363 aa, Sorghum bicolor
  misc_feature: Ceres ANNOT ID no. 6031224
  misc_feature (96)..(334): Pfam Id: Abhydrolase_3 Pfam Desc: alpha/beta hydrolase fold
  misc_feature (17)..(363): NCBI GI: 82697955 NCBI Desc: cxe carboxylesterase [malus pumila]
  misc_feature (17)..(363): NCBI GI: 7417008 NCBI Desc: cell death associated protein [nicotiana tabacum]
  misc_feature (17)..(363): NCBI GI: 444002 NCBI Desc: hsr203j [nicotiana tabacum]
  misc_feature (17)..(363): NCBI GI: 4190952 NCBI Desc: similar to hsr203j [lycopersicon esculentum]
  misc_feature (17)..(363): NCBI GI: 42557349 NCBI Desc: hsr203j like protein [capsicum chinense]
MAPPANAQEQPQPQVQLVGGRKVVDEVSGWLRVLDDGSVDRTWTGPPEALPLMEPVAPYAVPRDGHTLHDLPGEPNLRVYLPEAKGETAGARLPVILQLHGGGFCISHPSWLMYHHFYARLACAVPAVVVAVELPLAPERRLPAHIDTGVAALRRLRSIALSAEDGALDDPAAAALLREAADVSRVFLIGDSSGGNLVHLVAARVGQELADTGNNWAPLRVAGGIPIHPGFVRATRSRSELETKAESVFFTLDMLDKFLALALPEGATKDHPFTCPMGPQAPPLESVPLPPMLVSVAENDLIRDTNLEYCNALRAAGKEVEVLINHGMSHSFYLNKYAVDMDPTTGERAQELIDAIRSFISRH

SEQ ID NO: 3407 - DNA, 1794 bp, Sorghum bicolor
  misc_feature: Ceres ANNOT ID no. 6031241
  misc_feature: Encodes the peptide sequence at SEQ ID NO 3408
atggacctgcatagaataaatgtggttccttctatgcttcctgacgaggctttcactgtcatccgcaagtcattcgacgcacgaaaggttttgaaagaacctcagttcacttacattgttgatatggatgttaagaagattcttgatatagagccaagggcatgggattttattgctcggttggagcccaaacttggagctgtagaatacatgcctggagagaagtcagcagctgatctggtcagcatgctcaatgttaataacaaaggctccaataatgtactaggaatcagggatactcatagtgatatgatttatcatcaacaaaagaagccgagagtggcagttataggaagtggaccatctggcttgtttgcttcccttgtgctaggagaacttggtgcagaagttaccttattggagcgtggtcagcctgttgaacagagaggtcgtgatattggtgcgctagcagttagacgaatcctacaatcagagagcaacttttgctttggcgagggtggtgcaggtacatggagtgatgggaagctgatgaccaggataggaagaaacactgatggtgttcaggctgttatgaaaacatttgttcactttggagcccctccaaacattttggttgatgggaaaccacacttgggtactgataaacttgttccactgctgcgaaatttcaggcatcacttaagagagttgggtgttaccataagatttaacgctagagtagatgaccttatagtggaagatgggcaggtaaaaggaattgtagtctctgatgcagaactacggccaggttctgccagccagaaactagcatttgatgcagttgtattggcagttggtcactcagctcgtgacacatatagtatgctttggcagcataatgtagacatgagcccaaaaagttttgctgttggcttaagaattgagcacccccaagaactgataaacagtatccaatactccgaactggcggctgaagtgcagagaggacgtgggcggatacctgtggcagattacaaaatagcaaagtctgttggtgaaagagacacagagaatgaacttggcatagctgagccaagtcgcagttgctactcgttttgcatgtgcccgggtggacaggttgttccaaccagcacaaatccatcagaactgtgcatcaatggcatgtcgttctcaaggcgtgcatcaaagtgggcaaactcagctcttgtagtcactgtatcatctcaagatttcaagccatttcaatcccatggtcctcttgctggtgttgaattccagagagaatttgaaagaagagcagctatgatgggtggagggaattttgttgttcctgcacagtgtgtcaccgattttatcagcaacagactgtcagttacaacactgccaccatcaagctacagattaggagttcgtccatctaatctccatgagctattccctccttacataactgaagctttacaacagtcaataataatgattgacagagagatgccaggctttgtttctagcaaggccctacttcatggtgtggagactaggacaagttctcccttacaaatttcacgacatggagaaacatacgaaagtacatcactgcgaggattatatccaattggggaaggtgctggctatgctgggggcatattaagtgctgctgtggatggtatgtattgtggttttgctttagctaaacagctatctctattccacggtgatatagagtcatttcttggcaaagcacaaaaacaaacaggttttgtaaagtattga

SEQ ID NO: 3408 - protein, 597 aa, Sorghum bicolor
  misc_feature: Ceres ANNOT ID no. 6031241
  misc_feature (113)..(554): Pfam Id: Pyr_redox_2 Pfam Desc: Pyridine nucleotide-disulphide oxidoreductase
  misc_feature (113)..(354): Pfam Id: DAO Pfam Desc: FAD dependent oxidoreductase
  misc_feature (113)..(570): Pfam Id: FAD_binding_2 Pfam Desc: FAD binding domain
  misc_feature (112)..(565): Pfam Id: HI0933_like Pfam Desc: HI0933-like protein
  misc_feature (9)..(597): NCBI GI: 145350106 NCBI Desc: monooxygenase [arabidopsis thaliana]
  misc_feature (367)..(579): NCBI GI: 113866994 NCBI Desc: uncharacterized fad-dependent dehydrogenase [ralstonia eutropha h16]
  misc_feature (113)..(348): NCBI GI: 110600592 NCBI Desc: hi0933-like protein:fad dependent oxidoreductase [geobacter sp. frc-32]
  misc_feature (367)..(574): NCBI GI: 118699416 NCBI Desc: fad dependent oxidoreductase [burkholderia ambifaria mc40-6]
  misc_feature (363)..(575): NCBI GI: 94309814 NCBI Desc: fad dependent oxidoreductase [ralstonia metallidurans ch34]
MDLHRINVVPSMLPDEAFTVIRKSFDARKVLKEPQFTYIVDMDVKKILDIEPRAWDFIARLEPKLGAVEYMPGEKSAADLVSMLNVNNKGSNNVLGIRDTHSDMIYHQQKKPRVAVIGSGPSGLFASLVLGELGAEVTLLERGQPVEQRGRDIGALAVRRILQSESNFCFGEGGAGTWSDGKLMTRIGRNTDGVQAVMKTFVHFGAPPNILVDGKPHLGTDKLVPLLRNFRHHLRELGVTIRFNARVDDLIVEDGQVKGIVVSDAELRPGSASQKLAFDAVVLAVGHSARDTYSMLWQHNVDMSPKSFAVGLRIEHPQELINSIQYSELAAEVQRGRGRIPVADYKIAKSVGERDTENELGIAEPSRSCYSFCMCPGGQVVPTSTNPSELCINGMSFSRRASKWANSALVVTVSSQDFKPFQSHGPLAGVEFQREFERRAAMMGGGNFVVPAQCVTDFISNRLSVTTLPPSSYRLGVRPSNLHELFPPYITEALQQSIIMIDREMPGFVSSKALLHGVETRTSSPLQISRHGETYESTSLRGLYPIGEGAGYAGGILSAAVDGMYCGFALAKQLSLFHGDIESFLGKAQKQTGFVKY

SEQ ID NO: 3409 - DNA, 1965 bp, Sorghum bicolor
  misc_feature: Ceres ANNOT ID no. 6031244
  misc_feature: Encodes the peptide sequence at SEQ ID NO 3410
atggcggagccggccctcctggacccctcctccgccttcgatctccgccactacccggcgcacatcttcgacccggacctccccctcgacgccggcggtctcccgcttggtgaattcgccggcgacgaaggctgcgatggcctggacttcgacctgccggtggatttctccatcgacgacttcctcctccgctcccctgaccgcggggacgacggcgacgactccggcgagggctccgccgccggatccggccccaccgcgtcctcctcggcctccccggccacctccggcgccaactccgccgtggccaacgccggcgtccacgaggtgaagcacgaggactcggacgaggggaggagcggcgccgccccgaactggagcctcaagcggaagcaggcgagtcccggaggagcgatctcggacggggccaagtgccgccgatccggcgacggggagctttccccatcggcatcggcgtcgcgtgccgtcgcggaggactccgacgagaggtgcgcgggcggcgaggaagaagaggacaagcgccggactgcgcgcctgatgcgcaaccgtgagagcgcgcagctctctcggcagaggaagaagcggtacgtcgaggagctggaggagaaggtgaaatcgatgcactcggtgataaatgacctcaattctaagatctccttcatcgcggccgagaacgccacactgaggcagaaactcggtggtgccggggtgagtggcccgccatctggggtgtacccaccgccaccgctgccaggcattcatttcccctgggttcctgggtatgcaatgcggcctcatggctcccatgtcccacttgtgccaatcccacgattgaagccacagcaggcagcagctgcagggaaggtatccaagaaaccggaggtcaagaagtctgcggacagcaagagtaagaccaagaccaagaccaagaaggtggcaagtattagccttcttggtttgctgtttgttgcacttgtctttggtgcttttgttcccgggttcaatcatagtcttggaatgagaggaatgagcgacaatatgatgtttggaaatttcggccattctgatgctagggtgtttagtgtcactaaccatggtaaagggcctaaaggtggtttaaatagtagtgatgtcatcagtactgatcctggaatgattactgggcatgctgatggagcagggcagaagcatcgagctgcaaataactccagtgagatcttgcctgctttgttgtatgtgccgaggaatggaaaacatgttaagatcaatggcaatttgattattcattctgtgcttgcaagtgagaaagcagtggcacataaggcctcaaatggtcagtcagttaaagatcgcaaggagaccagtgttgctatagctcgctatctgtccccacctggaacggatctgaattcaaaagagacgctcccgccagatgcaccactgccacagtggtttcgtgaaggaatggaaggacctgttttgaactcgggaatgtgcagtgaggtattccagttcgatatttccgcagcttcagccaaatctggtggcattatacctgcttctccaactgtgaactcctcaagtgtcaatgctacccagaaaattccgaagcctgctcctgcttttgggggcaagctgaaaaacaggaggatcatgtataacgaggcgattccactcactggaaaaacggtgaacaacacagagcctcggtcttttaacagcacttctgaaagcagcaaggtacctgatagcaagccagcatcatcagttatcgtctctgtgctagctgatcccagggaggctggcaatggggatggtgatccaagagtatcaacaaaacccctctccaggatatttgtcgtcgtactgcttgatggtgtcagatacgtgacttactcgtgcacacttcctttcaagagtgccaccccccaccttgtgaactaa

SEQ ID NO: 3410 - protein, 654 aa, Sorghum bicolor
  misc_feature: Ceres ANNOT ID no. 6031244
  misc_feature (177)..(240): Pfam Id: bZIP_1 Pfam Desc: bZIP transcription factor
  misc_feature (177)..(231): Pfam Id: bZIP_2 Pfam Desc: Basic region leucine zipper
  misc_feature (211)..(604): NCBI GI: 115463875 NCBI Desc: os05g0411300 [oryza sativa (japonica cultivar-group)]
  misc_feature (42)..(465): NCBI GI: 124361217 NCBI Desc: camp response element binding (creb) protein [medicago truncatula]
  misc_feature (14)..(482): NCBI GI: 20196934 NCBI Desc: bzip family transcription factor [arabidopsis thaliana]
  misc_feature (57)..(299): NCBI GI: 7594544 NCBI Desc: transcription factor-like protein [arabidopsis thaliana]
  misc_feature (4)..(653): NCBI GI: 110742142 NCBI Desc: bzip transcription factor atbzip28 [arabidopsis thaliana]
  misc_feature: The sequence is a functional homolog of SEQ ID NO 1474 in the 11/479,226US patent application
  misc_feature: The sequence is a functional homolog of SEQ ID NO 368 in the 10/412,699US patent application
  misc_feature: The sequence is a functional homolog of SEQ ID NO 4 in the 10/286,264US patent application
  misc_feature: The sequence is a functional homolog of SEQ ID NO 42 in the 10/286,264US patent application
  misc_feature: The sequence is a functional homolog of SEQ ID NO 704 in the 10/412,699US patent application
  misc_feature: The sequence is a functional homolog of SEQ ID NO 859 in the 11/479,226US patent application
  misc_feature: The sequence is a functional homolog of SEQ ID NO 912 in the 10/374,780US patent application
  misc_feature: The sequence is a functional homolog of SEQ ID NO 913 in the 10/374,780US patent application
  misc_feature: Useful for making plants with modulated growth and phenotype characteristics
  misc_feature: The sequence is a functional homolog of SEQ ID NO 4 in the 20030093837 US patent application
  misc_feature: The sequence is a functional homolog of SEQ ID NO 42 in the 20030093837 US patent application
  misc_feature: The sequence is a functional homolog of SEQ ID NO 704 in the 20040045049 US patent application
  misc_feature: The sequence is a functional homolog of SEQ ID NO 912 in the 20060162006 US patent application
  misc_feature: The sequence is a functional homolog of SEQ ID NO. 512 in the 11/188,298 US application
  misc_feature: The sequence is a functional homolog of SEQ ID NO. 337 in the 11/188,298 US application
MAEPALLDPSSAFDLRHYPAHIFDPDLPLDAGGLPLGEFAGDEGCDGLDFDLPVDFSIDDFLLRSPDRGDDGDDSGEGSAAGSGPTASSSASPATSGANSAVANAGVHEVKHEDSDEGRSGAAPNWSLKRKQASPGGAISDGAKCRRSGDGELSPSASASRAVAEDSDERCAGGEEEEDKRRTARLMRNRESAQLSRQRKKRYVEELEEKVKSMHSVINDLNSKISFIAAENATLRQKLGGAGVSGPPSGVYPPPPLPGIHFPWVPGYAMRPHGSHVPLVPIPRLKPQQAAAAGKVSKKPEVKKSADSKSKTKTKTKKVASISLLGLLFVALVFGAFVPGFNHSLGMRGMSDNMMFGNFGHSDARVFSVTNHGKGPKGGLNSSDVISTDPGMITGHADGAGQKHRAANNSSEILPALLYVPRNGKHVKINGNLIIHSVLASEKAVAHKASNGQSVKDRKETSVAIARYLSPPGTDLNSKETLPPDAPLPQWFREGMEGPVLNSGMCSEVFQFDISAASAKSGGIIPASPTVNSSSVNATQKIPKPAPAFGGKLKNRRIMYNEAIPLTGKTVNNTEPRSFNSTSESSKVPDSKPASSVIVSVLADPREAGNGDGDPRVSTKPLSRIFVVVLLDGVRYVTYSCTLPFKSATPHLVN

SEQ ID NO: 3411 - DNA, 1599 bp, Sorghum bicolor
  misc_feature: Ceres ANNOT ID no. 6031259
  misc_feature: Encodes the peptide sequence at SEQ ID NO 3412
atggcgtcgccggcactgaggctgaggctgaggctgctgctgctgctcgcggtggcggccacagcgaccgcccgtggcgccggcgccggccgcgtcgatctttggccaatgccggcgtcggtggcccgcggcgcgcagacgctcctcgtcagcaaggacctcaagctgtccacggccgggagcagctacgccgacgggaagggcatcctgaaggaggctttccagcggatgctggccgtcgtggagctggaccacgccatcaacgggacctactcctcccacggcgcgcccgtgctcgccggcgtccgcgtcgccgtccgttcgcccaacgacgagctcaacttcggggtggatgaatcgtacaagctgtctgtgcctgccaccgggaatccgctctatgcccagatcgaggctcaaacagtttatggagcgcttcatgccttggagacatttagtcaactgtgcaactttgacttcaatgcaaacttgattgaacttcaatcagctccatggactatcctggacgctcccagattcccttaccgagggctccttattgatacttcaaggcactatcttcctgtcccagtaataaaaagtgtaattgattcaatgaccttcagtaagctgaacgttcttcattggcatatcgtggatgagcaatcatttcctctgcaaataccttcctacccaaaattatggaatggtgcatactcttattcagagagatatacatttgatgatgcaatcgacattgtacagtatgctgaaaaacgaggcgtgaatgtcttggcggagattgatgtacctggccatgctctttcatggggtgttggatatccatcattgtggccatcagctacatgcaaagaaccgcttgatgtcagcaatgagtttacatttcaagtgattaatggaattctttcagatttcagcaagatttttaagttcaagtttgtccatttggggggagatgaagtaaacacaagttgctggagtaccacaccacacattaagtcatggctgatgcaacatggcatgaatgaatctgatgcctacagatattttgtactgcgagctcaaaagatagcaatatcacacggttatgacatcattaattgggaagagacatttaacaactttggagacaagctggatcgtaaaactgtggtgcataactggcttggaagtggagttgctgagaaagtggttgctgctggtttgagatgcatcgtaagcaaccaggataagtggtacctagatcacttggatgctacatgggaaggattttacacgaatgaaccactgacaaatatctataacccggagcagcagaaattagtacttggtggtgaggtatgcatgtggggtgaacacatcgatgcatcagacattcagcagaccatttggccacgtgctgcagcagctgcagagcggttatggacaccaattgagaagcttgcgaaggacacaagatcggtcactgcaagattggcacgcttcaggtgcttgctgaatcaaagaggggttgctgctgcaccactagctggttatggccgctcagcaccatcagaaccaggttcctgcctaaggcagtag

SEQ ID NO: 3412 - protein, 532 aa, Sorghum bicolor
  misc_feature: Ceres ANNOT ID no. 6031259
  misc_feature (179)..(484): Pfam Id: Glyco_hydro_20 Pfam Desc: Glycosyl hydrolase family 20, catalytic domain
  misc_feature (46)..(177): Pfam Id: Glyco_hydro_20b Pfam Desc: Glycosyl hydrolase family 20, domain 2
  misc_feature (13)..(532): NCBI GI: 23463073 NCBI Desc: at1g65600/f5i14_13 [arabidopsis thaliana]
  misc_feature (148)..(532): NCBI GI: 2190547 NCBI Desc: ests gbt43256,gb46316,gbn64930,gbaa395255,gbaa404382 come from this gene. [arabidopsis thaliana]
  misc_feature (1)..(532): NCBI GI: 30694211 NCBI Desc: glycosyl hydrolase family 20 protein [arabidopsis thaliana]
  misc_feature (1)..(532): NCBI GI: 110742769 NCBI Desc: beta-n-acetylhexosaminidase -like protein [arabidopsis thaliana]
  misc_feature (134)..(532): NCBI GI: 7019659 NCBI Desc: beta-n-acetylhexosaminidase-like protein [arabidopsis thaliana]
  misc_feature: Useful for making plants with altered carbohydrate content
  misc_feature: Functional homolog of the protein sequence given in SEQ ID NO 13835
MASPALRLRLRLLLLLAVAATATARGAGAGRVDLWPMPASVARGAQTLLVSKDLKLSTAGSSYADGKGILKEAFQRMLAVVELDHAINGTYSSHGAPVLAGVRVAVRSPNDELNFGVDESYKLSVPATGNPLYAQIEAQTVYGALHALETFSQLCNFDFNANLIELQSAPWTILDAPRFPYRGLLIDTSRHYLPVPVIKSVIDSMTFSKLNVLHWHIVDEQSFPLQIPSYPKLWNGAYSYSERYTFDDAIDIVQYAEKRGVNVLAEIDVPGHALSWGVGYPSLWPSATCKEPLDVSNEFTFQVINGILSDFSKIFKFKFVHLGGDEVNTSCWSTTPHIKSWLMQHGMNESDAYRYFVLRAQKIAISHGYDIINWEETFNNFGDKLDRKTVVHNWLGSGVAEKVVAAGLRCIVSNQDKWYLDHLDATWEGFYTNEPLTNIYNPEQQKLVLGGEVCMWGEHIDASDIQQTIWPRAAAAAERLWTPIEKLAKDTRSVTARLARFRCLLNQRGVAAAPLAGYGRSAPSEPGSCLRQ

SEQ ID NO: 3413 - DNA, 1071 bp, Sorghum bicolor
  misc_feature: Ceres ANNOT ID no. 6031270
  misc_feature: Encodes the peptide sequence at SEQ ID NO 3414
atggaggcgctccacgaggagatgcccttcgacctcgacttccacccgtcctcacccctcgtcgtcacctccctcatcaccggcgatctctgcctgttccgctacggcccggagtctccgcctgagaggttattttcggtaaaagctcacaaggagtcatgcagagctgttcgttttgtggactcaggaaaagtgattttgtcagggtcagctgattgctcagttcttgcctctgatgtagaatcaggcaaggccattgcccgcttggaggatgcacatgagaatgccataaaccgccttgtctgtcttactgaatctacgattgccacaggtgacgacgagggctgcattaaggtatgggatacccgggaacgatcttgctgcaacagttttgaagtccatgatgattacatttcagatatgacctatgtggctgactcgaatcagatactggccacaagtggggatggaactttgtctgtgaacaacctccgaaggaataaagtaaggtcacgatctgaattttcagaagatgagttgctatccttggtggtaatgaagaatggtaaaaaggttgtttgtggaactccaagtggagcgctcttattatattcatggggatactttaaggattgcagtgaccgctttctcggacacacgcaatctgtggatacaatgctgaagctggatgaagaaactttggtttctggttcatcagatggtgtgatcagattagtgggcatcttacctaataggataatacagccacttgctgaacattcagaatatcccattgagggtcttgctttctcaaatgataagaaatatctcggcagcatctcacatgataaaatgctgaagctctgggacttggaagaactcttgaatggctcacaggtagtcaatggtgatgaacctgctgaagctggtagtgatgatagcgatgatgatagcgatgataatgcgatggatgtagacatggcggcaacctcttctaaagggtcaaggagtaaaaaggcaggtaaaggaaagtcaagtaggccggcgtcggatttctttgcagatttatag

SEQ ID NO: 3414 - protein, 356 aa, Sorghum bicolor
  misc_feature: Ceres ANNOT ID no. 6031270
  misc_feature (66)..(356): NCBI GI: 42571045 NCBI Desc: transducin family protein / wd-40 repeat family protein [arabidopsis thaliana]
  misc_feature (12)..(294): NCBI GI: 119582428 NCBI Desc: wd repeat domain 55, isoform cra_a [homo sapiens]
  misc_feature (6)..(321): NCBI GI: 89287767 NCBI Desc: transducin-related [tetrahymena thermophila sb210]
  misc_feature (12)..(294): NCBI GI: 45478106 NCBI Desc: lrrg00133 [rattus norvegicus]
  misc_feature (11)..(356): NCBI GI: 67475470 NCBI Desc: wd repeat protein [entamoeba histolytica hm-1:imss]
MEALHEEMPFDLDFHPSSPLVVTSLITGDLCLFRYGPESPPERLFSVKAHKESCRAVRFVDSGKVILSGSADCSVLASDVESGKAIARLEDAHENAINRLVCLTESTIATGDDEGCIKVWDTRERSCCNSFEVHDDYISDMTYVADSNQILATSGDGTLSVNNLRRNKVRSRSEFSEDELLSLVVMKNGKKVVCGTPSGALLLYSWGYFKDCSDRFLGHTQSVDTMLKLDEETLVSGSSDGVIRLVGILPNRIIQPLAEHSEYPIEGLAFSNDKKYLGSISHDKMLKLWDLEELLNGSQVVNGDEPAEAGSDDSDDDSDDNAMDVDMAATSSKGSRSKKAGKGKSSRPASDFFADL

SEQ ID NO: 3415 - DNA, 1764 bp, Sorghum bicolor
  misc_feature: Ceres ANNOT ID no. 6031276
  misc_feature: Encodes the peptide sequence at SEQ ID NO 3416
atgctcgccgccgctcgctccctcccccgcctctcctcttcctgctccgcccgcgcccttcgccgcgtcctcctgcaccctccaccaccccagccctcgcttccgcctcctctcccgcctctccgaacccttacacgcaccctcctcccgcacctcgccgccgcccaacggttctccactacctccttctctacctccgccccatcacgcctaggagaatgcgttggcgtgcggggagcaccggcgatacccgaggaggaggaggaggaggaggagagggaggagacgggggcgttggcgcggcatgacacggatgcgtacgcggcggtagagctggctctggactcagtggtgaaggtgttcacggtgtccagcagccccaactacttcttgccatggcaaaacaaggcgcagcgggagagcatgggctctgggtttgtgattcctggaagaaggattgtgacgaatgcacatgtggtagctgatcatacttttgttcttgtgaggaagcatggttcgcctactaagtacaaggccgaagtccaagctgtcggtcatgagtgcgacttggctctgttgacagttgagagtgaggagttttgggatggggtgaacagtttggagcttggagacatcccctttttgcaagaagccgtcgccgtggttggctaccctcaaggtggagataatatttctgtcaccaagggggttgtatctagagttgaaccaacacaatatgcccatggtgctacgcagcttatggctatacaaatagacgcagctataaatccaggcaatagtggagggcctgccattatgggtgataaagtagccggagttgctttccagaatttgtcaggggcagaaaacattggttatatcataccggtgcccgtaattaagcgtttcatttctggagtagaagagagtggtaaatattctgggttctgtactcttggagtatcttgccaggctactgaaaatattcagttaagagaatgctttgggatgcggcctgaaatgactggagttttagttagtagaataaaccctctatctgatgcttacaagattttgaagaaggatgacatccttcttgagtttgatggtgtgcctatcgcaaatgatggcacagttccattccggaatagagagagaatcacctttgatcatctggtgtccatgaaaaaacctgaagaaacagctgttctcaaagtattacgagatggtaaagagcaagaattgaaagtaacacttagacctctgcaacctttagtcccagtccatcaatttgataaattaccaagctactacatatttgctggttttgttttcatcccgcttacccagccttatctccatgaatttggagaagactggtataatgcctcgccacgccgattatgtgaacgggcactaagggagcttccaaagaaggctggtgaacaattagttatcctatctcaggttctaatggatgacatcaatgtcggttatgaaaggcttgctgaactacaggtaaagaaggtaaatggtgtggaggttgaaaacctgaagcacctgtgcagcctcgtggaaggctgcaccgaagaaaacttaaggtttgacctggacgatgaaagagtcattgtcctgaagtaccagaacgcaaggcttgccacatcccgggtcctcaaacggcacaggataccgtctgccatatcgagcgaccttgtccaagatgaagcaactaatggcgaggttgagacatcatgcaccagctga

SEQ ID NO: 3416 - protein, 587 aa, Sorghum bicolor
  misc_feature: Ceres ANNOT ID no. 6031276
  misc_feature (119)..(304): Pfam Id: Trypsin Pfam Desc: Trypsin
  misc_feature (108)..(488): NCBI GI: 91806029 NCBI Desc: degp protease [arabidopsis thaliana]
  misc_feature (108)..(484): NCBI GI: 2190549 NCBI Desc: f5i14.17 gene product [arabidopsis thaliana]
  misc_feature (108)..(387): NCBI GI: 2190559 NCBI Desc: f5i14.16 [arabidopsis thaliana]
  misc_feature (76)..(565): NCBI GI: 84999382 NCBI Desc: serine protease [theileria annulata strain ankara]
  misc_feature (85)..(369): NCBI GI: 33332321 NCBI Desc: degp-like serine protease 1 precursor [plasmodium falciparum]
MLAAARSLPRLSSSCSARALRRVLLHPPPPQPSLPPPLPPLRTLTRTLLPHLAAAQRFSTTSFSTSAPSRLGECVGVRGAPAIPEEEEEEEEREETGALARHDTDAYAAVELALDSVVKVFTVSSSPNYFLPWQNKAQRESMGSGFVIPGRRIVTNAHVVADHTFVLVRKHGSPTKYKAEVQAVGHECDLALLTVESEEFWDGVNSLELGDIPFLQEAVAVVGYPQGGDNISVTKGVVSRVEPTQYAHGATQLMAIQIDAAINPGNSGGPAIMGDKVAGVAFQNLSGAENIGYIIPVPVIKRFISGVEESGKYSGFCTLGVSCQATENIQLRECFGMRPEMTGVLVSRINPLSDAYKILKKDDILLEFDGVPIANDGTVPFRNRERITFDHLVSMKKPEETAVLKVLRDGKEQELKVTLRPLQPLVPVHQFDKLPSYYIFAGFVFIPLTQPYLHEFGEDWYNASPRRLCERALRELPKKAGEQLVILSQVLMDDINVGYERLAELQVKKVNGVEVENLKHLCSLVEGCTEENLRFDLDDERVIVLKYQNARLATSRVLKRHRIPSAISSDLVQDEATNGEVETSCTS

SEQ ID NO: 3417 - DNA, 1338 bp, Sorghum bicolor
  misc_feature: Ceres ANNOT ID no. 6031281
  misc_feature: Encodes the peptide sequence at SEQ ID NO 3418
atggatgaggagtacgacgtgatcgttctgggcacggggctcaaggagtgcatcctcagcggtctcctctccgtcgacggcctcaaggttttgcatatggacagaaatgactactatggaggcgattccacctcgctcaaccttaatcagctctggaagaggtttagaggggaagacaagcccccagcacatctaggtgcaagcagagactacaatgtggacatggtgccaaagtttatgatggcaaatgggacattggttcgaaccctcatccacactgacgtgacaaagtacttgtcattcaaagctgttgatgggagctatgttttcagcaaagggaagatttacaaggtccctgccactgatatggaggctctgaagtcccctttgatgggcctattcgagaagcgcagagcaaggaacttcttcatttatgtccaagattacaatgaagctgatccaaggacacatcaaggattggacctaactagggtgacaactagagaacttatatcaaaatatggtttaagtgatgatacagtggattttgtcggacatgcacttgctcttcatagagatgatcgatatcttgatgaaccggcactcgatacagtgaaaagaatgaaactatatgcagagtctcttgcacgctttcaaggaggctcgccatatatctatccactatatgggcttggtgagctaccacagggttttgcgcgactgagtgctgtttatggtggtacttacatgttaaacaagccagagtgcaaggttgaattcgacatggaggggaaagtgtgcggtgtcacatctgaaggtgaaactgcaaagtgcaagaaggtggtctgtgatccttcatatttaccaaacaaggttaggaagatcggtagagttgtacgagcaattgctatcatgagccacccaatccctaatacaaatgagtcccactcggttcaaattattttgcctcagaaacaacttggacgcagatcagacatgtatgttttctgttgctcatacacgcacaatgttgcgcccagagggaagttcattgcatttgtgtctgcagaagcagagactgatagtccccagtctgagctaaagcctggaattgatctacttggttctgtagatgagatattctatgatatttatgacagatatgaaccagtgaatgaaccatctcttgacaattgctttgtctcgacgagctatgatgccaccacacattttgaaacaactgtaacagatgttctgaacatgtatacaatgatcactggaaagactgtggatcttagtgtggatctgagtgctgctagtgctgctgaagaatattga

SEQ ID NO: 3418 - protein, 445 aa, Sorghum bicolor
  misc_feature: Ceres ANNOT ID no. 6031281
  misc_feature (1)..(438): Pfam Id: GDI Pfam Desc: GDP dissociation inhibitor
  misc_feature (1)..(445): NCBI GI: 2384758 NCBI Desc: gdp dissociation inhibitor protein osgdi1 [oryza sativa]
  misc_feature (1)..(445): NCBI GI: 2384760 NCBI Desc: gdp dissociation inhibitor protein osgdi2 [oryza sativa]
  misc_feature (1)..(444): NCBI GI: 2501850 NCBI Desc: gdp dissociation inhibitor [nicotiana tabacum]
  misc_feature (1)..(444): NCBI GI: 82623395 NCBI Desc: gdp dissociation inhibitor 1-like [solanum tuberosum]
  misc_feature (1)..(444): NCBI GI: 58465454 NCBI Desc: gdp dissociation inhibitor 1 [lycopersicon chilense]
MDEEYDVIVLGTGLKECILSGLLSVDGLKVLHMDRNDYYGGDSTSLNLNQLWKRFRGEDKPPAHLGASRDYNVDMVPKFMMANGTLVRTLIHTDVTKYLSFKAVDGSYVFSKGKIYKVPATDMEALKSPLMGLFEKRRARNFFIYVQDYNEADPRTHQGLDLTRVTTRELISKYGLSDDTVDFVGHALALHRDDRYLDEPALDTVKRMKLYAESLARFQGGSPYIYPLYGLGELPQGFARLSAVYGGTYMLNKPECKVEFDMEGKVCGVTSEGETAKCKKVVCDPSYLPNKVRKIGRVVRAIAIMSHPIPNTNESHSVQIILPQKQLGRRSDMYVFCCSYTHNVAPRGKFIAFVSAEAETDSPQSELKPGIDLLGSVDEIFYDIYDRYEPVNEPSLDNCFVSTSYDATTHFETTVTDVLNMYTMITGKTVDLSVDLSAASAAEEY

SEQ ID NO: 3419 - DNA, 1134 bp, Sorghum bicolor
  misc_feature: Ceres ANNOT ID no. 6031296
  misc_feature: Encodes the peptide sequence at SEQ ID NO 3420
atggcagcagttgccgcccaccaccaccgcctctccttctcctcgaccgctgctccaaccacaccttgccgacgccaccgcttctcgtcgctccctttctccgggcggccctcttcccatggccgtctcaggtcccgagccgcgacccgcgtcctcacgcgcgccggaagcaccggcaccagcagcgccgcgacgacgacgtcgctggaggagctgcgccggggctgctccacctggacgtggcgagggatgcgcgtgaactacctcgacagagggcagggcccgcccgtcctgctcgtccacggcttcggcgcctccgtcgcgcactggcgcaggaacattggggtgttgtctgaatcctacaccgtctacgcgatcgatttactggggttcggtgcatcggacaagcctgctggattttcttacacgatggagacatgggctgagttgatattggatttcttggaggaggtggtcaggaggcccacggttctcgtcggcaactctgttggaagccttgcatgtgtcattgctgcctcagagtccaaccgagaagccgttcgtgggcttgttctgctgaactgcgccggcggcatgaacaacaaggcgatcgtcgacgactggaggatcaagctgctcctgcctctgctcctgctgattgacttcctgctgaaacaacggccgatagcatcagcgctctttaaccgctttggattcaacagggacaatctgaaggacatcttgctctctgtttacgggaacaaagatgccgtggacgacgaattggttgacatcataagcggaccagctgacactgagggcgccctggacgcgttcgtgtcgacggtgaccggcccgccggggccgagcccgataccgctgatgccgcggctggccgacctgcccgtgctggtgctgtggggggaccgggaccccttcaccccgatcgacgggcccgtggggaagttcttctccaagctgccgtcggagctccccaacgtgacgctctacatgttggagggcgtcgggcactgcccgcacgacgaccggccggacctcgtccacgccaggctgctcccgtggctggaagcgctcccgccgcctgcggctggcacagtgaccacgacggtgtag

SEQ ID NO: 3420 - protein, 377 aa, Sorghum bicolor
  misc_feature: Ceres ANNOT ID no. 6031296
  misc_feature (121)..(360): Pfam Id: Abhydrolase_1 Pfam Desc: alpha/beta hydrolase fold
  misc_feature (44)..(365): NCBI GI: 145334673 NCBI Desc: hydrolase, alpha/beta fold family protein [arabidopsis thaliana]
  misc_feature (79)..(365): NCBI GI: 67922359 NCBI Desc: alpha/beta hydrolase fold [crocosphaera watsonii wh 8501]
  misc_feature (78)..(362): NCBI GI: 86606615 NCBI Desc: hydrolase, alpha/beta fold family [cyanobacteria bacterium yellowstone a-prime]
  misc_feature (58)..(362): NCBI GI: 119511283 NCBI Desc: alpha/beta hydrolase fold protein [nodularia spumigena ccy9414]
  misc_feature (79)..(362): NCBI GI: 86608627 NCBI Desc: hydrolase, alpha/beta fold family [cyanobacteria bacterium yellowstone b-prime]
MAAVAAHHHRLSFSSTAAPTTPCRRHRFSSLPFSGRPSSHGRLRSRAATRVLTRAGSTGTSSAATTTSLEELRRGCSTWTWRGMRVNYLDRGQGPPVLLVHGFGASVAHWRRNIGVLSESYTVYAIDLLGFGASDKPAGFSYTMETWAELILDFLEEVVRRPTVLVGNSVGSLACVIAASESNREAVRGLVLLNCAGGMNNKAIVDDWRIKLLLPLLLLIDFLLKQRPIASALFNRFGFNRDNLKDILLSVYGNKDAVDDELVDIISGPADTEGALDAFVSTVTGPPGPSPIPLMPRLADLPVLVLWGDRDPFTPIDGPVGKFFSKLPSELPNVTLYMLEGVGHCPHDDRPDLVHARLLPWLEALPPPAAGTVTTTV

SEQ ID NO: 3421 - DNA, 879 bp, Sorghum bicolor
  misc_feature: Ceres ANNOT ID no. 6031301
  misc_feature: Encodes the peptide sequence at SEQ ID NO 3422
atggatgagaggatcccaccgccccctttcttccagtactcaccatccggtgtccattcctcccctcatcgccacaattccatgacgtattcttcctcagacagggagagatatcttgctgaattacttgccgagaggcagaaattagccccattcatgcaagttcttcctttttgtaacagatttctgaaccaagaaattttgcgagcatcttctttgccacctaacccaaattttgttgaacctgagagaatcgatcatggcagcccaagcccattaagattagctggtcacccaatgaatggtcaaccaatggatctagagggatggtcaggaatgcaaacagagtatcgtggtgtactccaatcgccatccgcaaactggaatgggtctcctggagttgttgggaaccctactgtgaaaaaggttgttaggatggatgttcctgttgacaagtatcccaactacaactttgttggtcgtttgttggggccacgagggaactccttgaaaagagttgaagctacaacccactgtagagtttatatttgtggacggggttcagtgaaagactctgttaaggaagacaaactcagagacaagcctggctatgagcacttaaatgatccattgcatgttcttgtggaagctgagttcccagcagatatcgtcgatgcccgactaaaccaagcagttgccatattggaggatcttctgaaaccagtggatgagtccatggactactacaagaaacaacagctaagagaattggctatacttaatggcactctaagagaggagagcccaagcccctatcttagtcccagtgtgtcccccttcaattccacagggatgaagcgtgcaaagacagggcggtga

SEQ ID NO: 3422 - protein, 292 aa, Sorghum bicolor
  misc_feature: Ceres ANNOT ID no. 6031301
  misc_feature (1)..(290): NCBI GI: 19310523 NCBI Desc: at1g09660/f21m12_5 [arabidopsis thaliana]
  misc_feature (6)..(292): NCBI GI: 92893883 NCBI Desc: kh [medicago truncatula]
  misc_feature (21)..(289): NCBI GI: 24060154 NCBI Desc: kh domain-like protein [oryza sativa (japonica cultivar-group)]
  misc_feature (13)..(289): NCBI GI: 115464523 NCBI Desc: os05g0481500 [oryza sativa (japonica cultivar-group)]
  misc_feature (132)..(290): NCBI GI: 2160160 NCBI Desc: f21m12.5 gene product [arabidopsis thaliana]
MDERIPPPPFFQYSPSGVHSSPHRHNSMTYSSSDRERYLAELLAERQKLAPFMQVLPFCNRFLNQEILRASSLPPNPNFVEPERIDHGSPSPLRLAGHPMNGQPMDLEGWSGMQTEYRGVLQSPSANWNGSPGVVGNPTVKKVVRMDVPVDKYPNYNFVGRLLGPRGNSLKRVEATTHCRVYICGRGSVKDSVKEDKLRDKPGYEHLNDPLHVLVEAEFPADIVDARLNQAVAILEDLLKPVDESMDYYKKQQLRELAILNGTLREESPSPYLSPSVSPFNSTGMKRAKTGR

SEQ ID NO: 3423 - DNA, 639 bp, Sorghum bicolor
  misc_feature: Ceres ANNOT ID no. 6031322
  misc_feature: Encodes the peptide sequence at SEQ ID NO 3424
atggggcgcggcaagatcgagatcaagaggatcgagaactccaccaacaggcaagtgaccgtctccaagcgccgggccggactggtcaagaaggccagggagatcggcgtgctctgcgacgccgaggtcggcgtcgtcatcttctccagcggaggcaagctccacgactactgctcgcctaggacctcgttgtccaggatcttggagaagtaccagactaactccgggaagatactgtgggatgagaagcacaagatcctgagtgcagagatcgacagaatcaagaaggagaacgacaacatgcagattcagctcaggcatctgaaaggcgaggacctgaactcgctgcagcccagggagctgatcgccattgaagagggtctccagaatgggcagaccaacatgcgcgagaagcagatggatcactggaggatgcgcaagaggaatgggaagatgctggaggacgagaacaggatgctgtcttttaggatgcatcaacaggctgttgatctgagcggcggcatgagggagctggaaatcggataccatcaggtccagcatgacagggaattcacttcccaaatgccgttcaccttccgggtgcagcccaaccaccccaatctgcaggaagacgagtag

SEQ ID NO: 3424 - protein, 212 aa, Sorghum bicolor
  misc_feature: Ceres ANNOT ID no. 6031322
  misc_feature (9)..(59): Pfam Id: SRF-TF Pfam Desc: SRF-type transcription factor (DNA-binding and dimerisationdomain)
  misc_feature (71)..(170): Pfam Id: K-box Pfam Desc: K-box region
  misc_feature (1)..(212): NCBI GI: 2961437 NCBI Desc: mads box protein [oryza sativa]
  misc_feature (1)..(212): NCBI GI: 73920927 NCBI Desc: mads-box transcription factor 4 (osmads4) (pistillata-like protein)
  misc_feature (1)..(212): NCBI GI: 44888601 NCBI Desc: pistillata-like protein [hordeum vulgare subsp. vulgare]
  misc_feature (1)..(212): NCBI GI: 110798215 NCBI Desc: pi [joinvillea ascendens]
  misc_feature (1)..(212): NCBI GI: 45356041 NCBI Desc: pistillata-like mads box protein [triticum aestivum]
  misc_feature: Abnormal phyllotaxy, leaf number higher than wild-type
  misc_feature: The plant flowers significantly earllier than wild-type.
  misc_feature: Useful for making plants with altered Lignin content
  misc_feature: Useful for making plants with modulated biomass
  misc_feature: Useful for making plants with modulated flowering time
  misc_feature: Functional homolog of the protein sequence given in SEQ ID NO 12958
  misc_feature: Functional homolog of the protein sequence given in SEQ ID NO 13170
  misc_feature: Useful for making plants with altered lignin content
  misc_feature: Functional homolog of the protein sequence given in SEQ ID NO 13170
  misc_feature: The sequence is a functional homolog of SEQ ID NO 1701 in the 10/412,699 US patent application
  misc_feature: The sequence is a functional homolog of SEQ ID NO 1955 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO. 273 in the 11/188,298 US application
  misc_feature: The sequence is a functional homolog of SEQ ID NO. 361 in the 11/188,298 US application
  misc_feature: The sequence is a functional homolog of SEQ ID NO. 359 in the 11/188,298 US application
  misc_feature: The sequence is a functional homolog of SEQ ID NO. 518 in the 11/188,298 US application
  misc_feature: The sequence is a functional homolog of SEQ ID NO. 420 in the 11/188,298 US application
  misc_feature: The sequence is a functional homolog of SEQ ID NO. 377 in the 11/188,298 US application
MGRGKIEIKRIENSTNRQVTVSKRRAGLVKKAREIGVLCDAEVGVVIFSSGGKLHDYCSPRTSLSRILEKYQTNSGKILWDEKHKILSAEIDRIKKENDNMQIQLRHLKGEDLNSLQPRELIAIEEGLQNGQTNMREKQMDHWRMRKRNGKMLEDENRMLSFRMHQQAVDLSGGMRELEIGYHQVQHDREFTSQMPFTFRVQPNHPNLQEDE

SEQ ID NO: 3425 - DNA, 1110 bp, Sorghum bicolor
  misc_feature: Ceres ANNOT ID no. 6031337
  misc_feature: Encodes the peptide sequence at SEQ ID NO 3426
atggtcagcgggaggcccgggaatggtgaattggatgcatggttcaagagcctcatggtgacctctagcagcgagagggggcaggctggaagtggtggcccagcgccaacattatcaggatggaaagaccttccgatggagctcctggtcaggataatatcgactgttggagatgataggatagtcattgtggcatctggtgtttgcacaggctggcgtgacgctctgggatggggggtcactaatctttcccttacatggtgcaaacagagcatgaataatttaatgatatctcttgcacacaagtttacaaagttgcaagttctcactcttcggcaaaacaaacctcagcttgaagacagtgctgtagagtctgttgccaattactgtcatgatctgcgtgagttagacctcagcagaagcttcagacttagtgaccgctccttgtatgcattggcccatggatgcccgcggcttacaagactgaacattagtggatgttccaatttcagtgatactgccttgatttaccttacctgccactgtaaacacctgaagtgcctgaacttgtgtggatgtgggaaggctgctactgacagagctttgcaggctattgctcagaactgtgggcagctgcaatctttgaacctaggctggtgtgatgatgttacagataagggtgtgaccagcttagcgtcaggatgtcctgatctcagagctgtagacttgtgtggttgtgttcttataacagatgagagtgtggttgctcttgccaacggatgtccgcacctgcgctcgttgggcctctacttctgccagaacatcacggaccgtgccatgtactccctcgcaaacagccgcgtgaagagcaagtgtgggaggtgggatgcagtgaaagacgggcttgcgaacctcaacatcagccagtgcaccgccctgacgcccccagcggtgcaggccgtctgcgactcgttcccggcgctgcacacctgccccgagaggcactccctcatcatcagtggctgcctcagcctcacgtcagtccactgcgcctgcgccctccacccacaccgtgccgcgagagcgctgatggccaaccatgcgtactaa

SEQ ID NO: 3426 - protein, 369 aa, Sorghum bicolor
  misc_feature: Ceres ANNOT ID no. 6031337
  misc_feature (1)..(369): NCBI GI: 53981728 NCBI Desc: unknow protein [oryza sativa (japonica cultivar-group)]
  misc_feature (37)..(363): NCBI GI: 21554029 NCBI Desc: f-box protein atfbl5 [arabidopsis thaliana]
  misc_feature (83)..(287): NCBI GI: 48146359 NCBI Desc: fbxl2 [homo sapiens]
  misc_feature (83)..(287): NCBI GI: 6063090 NCBI Desc: f-box protein fbl2 [homo sapiens]
  misc_feature (83)..(287): NCBI GI: 16306582 NCBI Desc: f-box and leucine-rich repeat protein 2 [homo sapiens]
MVSGRPGNGELDAWFKSLMVTSSSERGQAGSGGPAPTLSGWKDLPMELLVRIISTVGDDRIVIVASGVCTGWRDALGWGVTNLSLTWCKQSMNNLMISLAHKFTKLQVLTLRQNKPQLEDSAVESVANYCHDLRELDLSRSFRLSDRSLYALAHGCPRLTRLNISGCSNFSDTALIYLTCHCKHLKCLNLCGCGKAATDRALQAIAQNCGQLQSLNLGWCDDVTDKGVTSLASGCPDLRAVDLCGCVLITDESVVALANGCPHLRSLGLYFCQNITDRAMYSLANSRVKSKCGRWDAVKDGLANLNISQCTALTPPAVQAVCDSFPALHTCPERHSLIISGCLSLTSVHCACALHPHRAARALMANHAY

SEQ ID NO: 3427 - DNA, 1335 bp, Sorghum bicolor
  misc_feature: Ceres ANNOT ID no. 6031342
  misc_feature: Encodes the peptide sequence at SEQ ID NO 3428
  misc_feature: Up-regulated in shoot tissues in response to methyl jasmonate treatment
  misc_feature: Up-regulated in shoot tissues in response to salicylic acid treatment
atggcgcaaactagcttgcctcctggttttcgtttccacccaactgatgttgagctcgtttcctactacttgaagaggaagattatgggaaagaaacttattgtagacgctatatcagaggttgatctctacaagtttcctccctgggatctccctgataagtcctcccttcgaagcaaagatcttgaatggttcttcttttgtcctcgtgacaagaagtatcctaatgggtctaggacaaaccgtgccacaccaaatggttactggaagactagtggaaaggatagaaacattatgcttaactctcgcactgttggaatgaagaaaacattgatatttcatgaaggcaaggcccctaagggtgacagaactgattgggtgatgtatgaatacaaaatggaagatgaggatttggtttcttctggtttctcaaaggatgcttatgtactctgcaaaattttcaagaaaagtggcctgggtccaaggataggggagcaatatggggctccgtttaatgaagccgaatgggataatcctgaagctgaatcttctatgtttcctttgatggcctcttcagaagtagtgaacccaatagagggaccacgcgcccagcctgctgcccctgctggtgctcttcaggaaccacctctacataattcatctgctacttgtgctggagaggaatcatcatttgattatgccactgcaaatacttgtgctgatgacataacttttggctatactgttgctagctctgctatccaagatatacctgctcagatgtcaggagatggtgtggtttctgtgaacaacatatctaatgaggccaatgatatgtacagtcctcatgactgtgatggttttctattggaggagctgtctagatttctgaatgattctcctggagagtgctctggtcttcctccgatgtctgaagctgaggctcatgcttttgaagtcagctcttttggcctctacaatgaattatcagggcttgttgggttaggaggcgtggataacaacagcaatgtggaaactacagattaccagctgccacctgacagagaactgtctgctgatgattacatggaactaactgatctccttgctcctgatccaagcttccccactgaatttcctgctgaggacagtcaatatatgcagtatcctcttgctcatttcaatggacattatgatgtccctacaatgtcaggtcctttggaaccaacaatgcctagcattttcgatgcttttcctccttccaataatggagtcctcgccacagatgtggtagccaactacatggacccaaccatgcagttccctttctcatga

SEQ ID NO: 3428 - protein, 444 aa, Sorghum bicolor
  misc_feature: Ceres ANNOT ID no. 6031342
  misc_feature (6)..(134): Pfam Id: NAM Pfam Desc: No apical meristem (NAM) protein
  misc_feature (1)..(444): NCBI GI: 53981732 NCBI Desc: unknow protein [oryza sativa (japonica cultivar-group)]
  misc_feature (6)..(351): NCBI GI: 21105732 NCBI Desc: nam-like protein 2 [petunia x hybrida]
  misc_feature (6)..(242): NCBI GI: 21105746 NCBI Desc: nam-like protein 9 [petunia x hybrida]
  misc_feature (7)..(334): NCBI GI: 21105742 NCBI Desc: nam-like protein 7 [petunia x hybrida]
  misc_feature (1)..(180): NCBI GI: 7716952 NCBI Desc: nac1 [medicago truncatula]
  misc_feature: The sequence is a functional homolog of SEQ ID NO 108 in the 10/666,642US patent application
  misc_feature: The sequence is a functional homolog of SEQ ID NO 1402 in the 10/666,642US patent application
  misc_feature: The sequence is a functional homolog of SEQ ID NO 1438 in the 10/666,642US patent application
  misc_feature: The sequence is a functional homolog of SEQ ID NO 1452 in the 10/666,642US patent application
  misc_feature: The sequence is a functional homolog of SEQ ID NO 158 in the 10/225,066US patent application
  misc_feature: The sequence is a functional homolog of SEQ ID NO 1816 in the 11/479,226US patent application
  misc_feature: The sequence is a functional homolog of SEQ ID NO 2016 in the 10/374,780US patent application
  misc_feature: The sequence is a functional homolog of SEQ ID NO 208 in the 10/666,642US patent application
  misc_feature: The sequence is a functional homolog of SEQ ID NO 2100 in the 10/374,780US patent application
  misc_feature: The sequence is a functional homolog of SEQ ID NO 2112 in the 10/374,780US patent application
  misc_feature: The sequence is a functional homolog of SEQ ID NO 226 in the 10/666,642US patent application
  misc_feature: The sequence is a functional homolog of SEQ ID NO 242 in the 10/714,887US patent application
  misc_feature: The sequence is a functional homolog of SEQ ID NO 242 in the 11/435,388US patent application
  misc_feature: The sequence is a functional homolog of SEQ ID NO 262 in the 10/714,887US patent application
  misc_feature: The sequence is a functional homolog of SEQ ID NO 262 in the 11/435,388US patent application
  misc_feature: The sequence is a functional homolog of SEQ ID NO 2626 in the 10/374,780US patent application
  misc_feature: The sequence is a functional homolog of SEQ ID NO 270 in the 10/714,887US patent application
  misc_feature: The sequence is a functional homolog of SEQ ID NO 270 in the 11/435,388US patent application
  misc_feature: The sequence is a functional homolog of SEQ ID NO 280 in the 10/374,780US patent application
  misc_feature: The sequence is a functional homolog of SEQ ID NO 306 in the 10/225,066US patent application
  misc_feature: The sequence is a functional homolog of SEQ ID NO 322 in the 10/412,699US patent application
  misc_feature: The sequence is a functional homolog of SEQ ID NO 332 in the 10/412,699US patent application
  misc_feature: The sequence is a functional homolog of SEQ ID NO 58 in the 10/666,642US patent application
  misc_feature: The sequence is a functional homolog of SEQ ID NO 582 in the 10/666,642US patent application
  misc_feature: The sequence is a functional homolog of SEQ ID NO 68 in the 10/225,068US patent application
  misc_feature: The sequence is a functional homolog of SEQ ID NO 78 in the 10/286,264US patent application
  misc_feature: Useful for making plants with modulated growth and phenotype characteristics
  misc_feature: The sequence is a functional homolog of SEQ ID NO 78 in the 20030093837 US patent application
  misc_feature: The sequence is a functional homolog of SEQ ID NO 332 in the 20040045049 US patent application
  misc_feature: The sequence is a functional homolog of SEQ ID NO 68 in the 20050120408 US patent application
  misc_feature: The sequence is a functional homolog of SEQ ID NO 306 in the 20050160493 US patent application
  misc_feature: The sequence is a functional homolog of SEQ ID NO 270 in the 20060015972 US patent application
  misc_feature: The sequence is a functional homolog of SEQ ID NO 2112 in the 20060162006 US patent application
  misc_feature: The sequence is a functional homolog of SEQ ID NO 58 in the 20070033671 US patent application
  misc_feature: The sequence is a functional homolog of SEQ ID NO 582 in the 20070033671 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 476 in the 10/666,642 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 853 in the 10/374,780 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 344 in the 10/666,642 US patent application
  misc_feature: Useful for biocontainment applications
  misc_feature: Functional homolog of the protein sequence given in SEQ ID NO 13623
  misc_feature: Useful for making plants with modulated oxidative stress sensitivity
  misc_feature: Functional homolog of the protein sequence given in SEQ ID NO 13621
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 890 in the 10/374,780 US patent application
  misc_feature: Up-regulated in shoot tissues in response to methyl jasmonate treatment
  misc_feature: Up-regulated in shoot tissues in response to salicylic acid treatment
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MAQTSLPPGFRFHPTDVELVSYYLKRKIMGKKLIVDAISEVDLYKFPPWDLPDKSSLRSKDLEWFFFCPRDKKYPNGSRTNRATPNGYWKTSGKDRNIMLNSRTVGMKKTLIFHEGKAPKGDRTDWVMYEYKMEDEDLVSSGFSKDAYVLCKIFKKSGLGPRIGEQYGAPFNEAEWDNPEAESSMFPLMASSEVVNPIEGPRAQPAAPAGALQEPPLHNSSATCAGEESSFDYATANTCADDITFGYTVASSAIQDIPAQMSGDGVVSVNNISNEANDMYSPHDCDGFLLEELSRFLNDSPGECSGLPPMSEAEAHAFEVSSFGLYNELSGLVGLGGVDNNSNVETTDYQLPPDRELSADDYMELTDLLAPDPSFPTEFPAEDSQYMQYPLAHFNGHYDVPTMSGPLEPTMPSIFDAFPPSNNGVLATDVVANYMDPTMQFPFS

SEQ ID NO: 3429 - DNA, 1797 bp, Sorghum bicolor
  misc_feature: Ceres ANNOT ID no. 6031345
  misc_feature: Encodes the peptide sequence at SEQ ID NO 3430
atgtccaagaagctcggcaagctaccgccgccggcggcggcgcatgaggaggcgagagaagagctgtttgcttcatgctcttttgccgacctcggcctccaccctaccctctgtgcccaccttcaagataagatgagtttcgaagcacccacgcgaattcaagctcaggcaattccagtcgccatttcgggacagctagtgaaggctgcaactggcactgggaaaactctcgcataccttgcacccattgtgcaccttctccagatgagggagcctcgtgtggatagaactcatggaacctttgcattggtacttgtgccaacacgagagctatgcttacaggtttacgggattgcacagcagctggttcatcgttttcactggattgtccctgggtatatcatgggtggggagaacagagcaaaagagaaagcaagactgcggaaaggaatatcaattctcattgctacccctgggcgccttcttgaccatttacagcatactgcttcatttgtctattcaaatctgcagtggatagtttttgatgaagctgacagcattcttgaacttggttttggaaaagcagttgaggatattctagagcacttgggttcaaggaatggcgcccctggccaaattaaaagcaaaggggagcatatccgaaggcaaaaccttctcttatccgcaactcttaatgagaaggtgaatcggttggcaaaaattagtttgagaaacccagtgatgatcggccttgatgatcaaaacaagccttcggggaaatcaaacaatgtagggaacaatcatacttctctattatctgatgatgaggaggatgaaatgatgggaaagcagaatgatttagtggaacatgcggttgatgatttcaagcttcctgcacaattggttcaaagatatgttaaagtttcatgtggttcgaggcttgtggttcttcttacgattctcaaatctctatttgaaagacaagtctctcagaaggttgttgttttcttctcaacctgtgactctgtagatttccaccatacagtactcagccagctcaagtggagctctgacccacatcttgatattgataagaagcaaaattttcttagctgtaaagtgttccgtttgcatggcaacatggagcaagatgatcgcaagaagtcatttttgggttttggttctgagaaatcagcaattcttgtatctaccgatattgctgctaggggcttggactttccaaaagtcaagtacatcatacaatacgattctccaggagaagcttctgaatacgttcacagggttggaagaactgcaagaattggtgaaaagggtgaggctctcctctttctgcaacctattgaacttgactacttgaaagatctggagctacacggtgtatcactgacagaatacccctttcaaagggttttggatagtttccctgtaaatgggcagaaaccccacaaaaggaagctaatatccttagacatgcatccttggataatgtctctgcagagatcacttgaggcttttgttgcagctgaggatgcaacaaagaagcttgccagggatgccttctgctcctgggttcgtgcctacactgcccaccgaggtgaactgaagaaaattttcatggtgaagaagctccacctgggccatgtagcgaggagcttcgggctgaaggagcagccgtcgctggttggaaggtcacatcagatgcagcttaagaagaggaagaaagagcagaagcgtgagcggcctgccaagaggaggaagcttccctctaagaagtga

SEQ ID NO: 3430 - protein, 598 aa, Sorghum bicolor
  misc_feature: Ceres ANNOT ID no. 6031345
  misc_feature (51)..(238): Pfam Id: DEAD Pfam Desc: DEAD/DEAH box helicase
  misc_feature (366)..(442): Pfam Id: Helicase_C Pfam Desc: Helicase conserved C-terminal domain
  misc_feature (47)..(233): Pfam Id: ResIII Pfam Desc: Type III restriction enzyme, res subunit
  misc_feature (1)..(598): NCBI GI: 115461681 NCBI Desc: os05g0110500 [oryza sativa (japonica cultivar-group)]
  misc_feature (1)..(598): NCBI GI: 143361335 NCBI Desc: dead-box atp-dependent rna helicase 17
  misc_feature (16)..(261): NCBI GI: 39645219 NCBI Desc: ddx31 protein [homo sapiens]
  misc_feature (16)..(261): NCBI GI: 119608412 NCBI Desc: dead (asp-glu-ala-asp) box polypeptide 31, isoform cra_a [homo sapiens]
  misc_feature (16)..(261): NCBI GI: 17505907 NCBI Desc: dead (asp-glu-ala-asp) box polypeptide 31 isoform 1 [homo sapiens]
MSKKLGKLPPPAAAHEEAREELFASCSFADLGLHPTLCAHLQDKMSFEAPTRIQAQAIPVAISGQLVKAATGTGKTLAYLAPIVHLLQMREPRVDRTHGTFALVLVPTRELCLQVYGIAQQLVHRFHWIVPGYIMGGENRAKEKARLRKGISILIATPGRLLDHLQHTASFVYSNLQWIVFDEADSILELGFGKAVEDILEHLGSRNGAPGQIKSKGEHIRRQNLLLSATLNEKVNRLAKISLRNPVMIGLDDQNKPSGKSNNVGNNHTSLLSDDEEDEMMGKQNDLVEHAVDDFKLPAQLVQRYVKVSCGSRLVVLLTILKSLFERQVSQKVVVFFSTCDSVDFHHTVLSQLKWSSDPHLDIDKKQNFLSCKVFRLHGNMEQDDRKKSFLGFGSEKSAILVSTDIAARGLDFPKVKYIIQYDSPGEASEYVHRVGRTARIGEKGEALLFLQPIELDYLKDLELHGVSLTEYPFQRVLDSFPVNGQKPHKRKLISLDMHPWIMSLQRSLEAFVAAEDATKKLARDAFCSWVRAYTAHRGELKKIFMVKKLHLGHVARSFGLKEQPSLVGRSHQMQLKKRKKEQKRERPAKRRKLPSKK

SEQ ID NO: 3431 - DNA, 1896 bp, Sorghum bicolor
  misc_feature: Ceres ANNOT ID no. 6031349
  misc_feature: Encodes the peptide sequence at SEQ ID NO 3432
atgggcccactggagccgcgctaccgtccagccggcgcccctgaggacacaactaagagaagggcctccaaaagcaaaagtttcaaagatgttgaaaattttgaagttattgtccttgaaaagagctgtggttgcaagttcaaatctttgaggatcttgctcatagctatcatttctgcaacagttcttacgcttgtgactccaaccttatacgagcaccaattgcagtcagcctcccggtatgtagatgtcggttggatgtgggacaaaacaagttctgatccaagatatgtatcatctgttgatgttcggtgggaggatgtatataaagcacttggaaatctaagaagtggtaatcaaaatctcaaagttggactattgaattttaatagcactgagtatggctcttggacacaattgctctcagacagccatgtttccattataagacttgagcatgccaaggacagcattacttggcaaacactgtatcctgaatggatcgatgaggaggaagaaacagagataccctcttgcccatcacttccagagcctgatgtacgaagagatgtacgctttgatgttattgctgtaaagcttccttgtacccatgtggcaggttggtcaagagatgttgcacggctccatttgcagctctcagcagcaaaattggctgtgacatcttcgaagcgcaaccacaaggtccatgttctttttgtaactgagtgctttccaatcccgaatctcttcccttgcaagaaccttgtgagacatgaaggcaatgcttggctatatagccctgactcaaaagcattaagggaaaagctcaggcttccagtcggatcctgtgagcttgctgttccactcaaagcaaaatcgagacttttctcagtagatcgacgaagagaagcatatgcaacaatactgcattcagcgagtgaatatgtctgtggtgctatcacagcagctcaaagcattcgtcaagcaggatcaaccagggacctagtcatccttgttgatgagaccataagcgatcaccaccggagaggcttggaagctgcagggtggaaggtcagaataatccaaagaatcaggaatccgaaagcagagcgtgatgcatacaacgagtggaactacagcaagttcaggctgtggcagctgactgactacgacaagatcatcttcatagatgcagacctcctcatcctgaggaatgttgacttcctgtttgcaatgccagagatcacagcaactggcaacaatgcaacactcttcaactccggtgtcatggtcatagagccttccaactgcacattccagctgctgatggaccatatcaacgagataacttcatacaatggcggggaccagggatacctgaatgagatattcacctggtggcaccgcatccccaagcacatgaactttctgaagcacttctgggagggcgacagccaggccatgaaggcgaagaagactcagctgtttggcgcagacccaccaatcctctatgttctccactaccttggcctgaagccatggttgtgcttcaaagactatgactgcaactggaacaacgccggaatgcgtgaatttgcaagcgacgtcgcacatgcccgatggtggaaggtgcacgacaagatgccccggaagctccagtcctactgcctgctgaggtcacggcagaaggccagcctggagtgggaccggaggcaggctgagaaggccaactctgaagatggccattggcgccgcaacatcacggacaccaggctgaagacatgctttgagaagttctgcttctgggagagcatgctctggcattggggcgagaacaataacaggacgaagagcatccccatggcagtgaagacggcgagcttggcaaggtcatga

SEQ ID NO: 3432 - protein, 631 aa, Sorghum bicolor
  misc_feature: Ceres ANNOT ID no. 6031349
  misc_feature (306)..(518): Pfam Id: Glyco_transf_8 Pfam Desc: Glycosyl transferase family 8
  misc_feature (1)..(631): NCBI GI: 56784626 NCBI Desc: glycogenin-like protein [oryza sativa (japonica cultivar-group)]
  misc_feature (2)..(628): NCBI GI: 60657592 NCBI Desc: secondary cell wall-related glycosyltransferase family 8 [populus tremula x populus tremuloides]
  misc_feature (5)..(629): NCBI GI: 60657590 NCBI Desc: secondary cell wall-related glycosyltransferase family 8 [populus tremula x populus tremuloides]
  misc_feature (275)..(626): NCBI GI: 115464005 NCBI Desc: os05g0426400 [oryza sativa (japonica cultivar-group)]
  misc_feature (193)..(595): NCBI GI: 46389857 NCBI Desc: lycogenin glucosyltransferase (glycogenin)-like protein [oryza sativa (japonica cultivar-group)]
  misc_feature: Useful for making plants with altered cell wall content and/or composition
  misc_feature: Functional homolog of the protein sequence encoded by LOCUS at1g77130
  misc_feature: GREAT-hit functional homolog of the protein sequence encoded by LOCUS at3g18660
  misc_feature: Useful for making plants with altered carbohydrate content
  misc_feature: Functional homolog of the protein sequence given in SEQ ID NO 13653
  misc_feature: Useful for making plants with altered cell wall content and/or composition
  misc_feature: Functional homolog of the protein sequence given in SEQ ID NO 13654
MGPLEPRYRPAGAPEDTTKRRASKSKSFKDVENFEVIVLEKSCGCKFKSLRILLIAIISATVLTLVTPTLYEHQLQSASRYVDVGWMWDKTSSDPRYVSSVDVRWEDVYKALGNLRSGNQNLKVGLLNFNSTEYGSWTQLLSDSHVSIIRLEHAKDSITWQTLYPEWIDEEEETEIPSCPSLPEPDVRRDVRFDVIAVKLPCTHVAGWSRDVARLHLQLSAAKLAVTSSKRNHKVHVLFVTECFPIPNLFPCKNLVRHEGNAWLYSPDSKALREKLRLPVGSCELAVPLKAKSRLFSVDRRREAYATILHSASEYVCGAITAAQSIRQAGSTRDLVILVDETISDHHRRGLEAAGWKVRIIQRIRNPKAERDAYNEWNYSKFRLWQLTDYDKIIFIDADLLILRNVDFLFAMPEITATGNNATLFNSGVMVIEPSNCTFQLLMDHINEITSYNGGDQGYLNEIFTWWHRIPKHMNFLKHFWEGDSQAMKAKKTQLFGADPPILYVLHYLGLKPWLCFKDYDCNWNNAGMREFASDVAHARWWKVHDKMPRKLQSYCLLRSRQKASLEWDRRQAEKANSEDGHWRRNITDTRLKTCFEKFCFWESMLWHWGENNNRTKSIPMAVKTASLARS

SEQ ID NO: 3433 - DNA, 573 bp, Sorghum bicolor
  misc_feature: Ceres ANNOT ID no. 6031377
  misc_feature: Encodes the peptide sequence at SEQ ID NO 3434
atggcgaggaacccgggctgcaccgtcttcataggtaacttggacgacagggttcctgagagggttctgtacgaaattcttattcaggtaggtcgtgttgtagacctgcacatacctcgtgacaaggaaactagccgaccaaaaggttatgcttttgctgagtatgaaacagaggagattgcccagtatgctgttaagctattttctggccttgttcgacttcaaaataaaacacttagatttgcgatctctgggcaagataaaccatcatcaaatggcaatatccctgtaactcctaggttaaactctgtgccacagccaaagcatcctcaacatatgaggtctagtgatactcctttgccacagcatacagcaacgaatggcaggagtactgggtatggtatctcaccaaatcattcatatgacgcacactctcaagcaccatcaagtgggttaccgaatagaggactaagcaacggtacgtatgaatatagtagacgtgtatttggttctgtcctgaatgatgttagccgtcaagctaccagggaagctattccatatccgtcctactag

SEQ ID NO: 3434 - protein, 190 aa, Sorghum bicolor
  misc_feature: Ceres ANNOT ID no. 6031377
  misc_feature (9)..(81): Pfam Id: RRM_1 Pfam Desc: RNA recognition motif. (a.k.a. RRM, RBD, or RNP domain)
  misc_feature (1)..(190): NCBI GI: 115464015 NCBI Desc: os05g0427300 [oryza sativa (japonica cultivar-group)]
  misc_feature (1)..(190): NCBI GI: 56784854 NCBI Desc: galactosyltransferase-like protein [oryza sativa (japonica cultivar-group)]
  misc_feature (1)..(190): NCBI GI: 86156022 NCBI Desc: rna recognition motif-containing protein [vitis pseudoreticulata]
  misc_feature (8)..(91): NCBI GI: 115398490 NCBI Desc: spliceosome-associated protein 49 [aspergillus terreus nih2624]
  misc_feature (3)..(88): NCBI GI: 89290252 NCBI Desc: splicing factor 3b subunit 4 [tetrahymena thermophila sb210]
  misc_feature: The sequence is a functional homolog of SEQ ID NO. 339 in the 11/188,298 US application
MARNPGCTVFIGNLDDRVPERVLYEILIQVGRVVDLHIPRDKETSRPKGYAFAEYETEEIAQYAVKLFSGLVRLQNKTLRFAISGQDKPSSNGNIPVTPRLNSVPQPKHPQHMRSSDTPLPQHTATNGRSTGYGISPNHSYDAHSQAPSSGLPNRGLSNGTYEYSRRVFGSVLNDVSRQATREAIPYPSY

SEQ ID NO: 3435 - DNA, 2514 bp, Sorghum bicolor
  misc_feature: Ceres ANNOT ID no. 6031402
  misc_feature: Encodes the peptide sequence at SEQ ID NO 3436
atgaagaacaactcgagctttcagagcacgggcagcgccggcggcggcggcggctccggcacgggcgagagatccggctctgggtccttgagcctccggtacctgtccaagatcatcctcccgccgctcggcgggccgcccggccaaagccagtcccatggcgggtccgacaagtgggtcatctcgccgctcgactctagatacaggtggtgggatacgttgatggtggtcctggtggcgtactcggcgtgggtgtacctgttcgaggtcgccttcatgaacgcatcccccaagggcgggctggaggtggcggatatcgtcgtcgacctcttcttcgccgtcgacatcgtgctcaccttcttcgtcgcctacatcgaccccaggacccagctcctcatccgcgacaggaagaagataactttcaggtacctgtcgacgttcttcatcatggacgtggcatcgacggtcccgttccaggcccttgcctacttcatcaccggcgaggtcagggagaatggcgcgtacagtgtactgggtctcctacgcctatggcgtctccgtagggttaatcagttcttcaccaggctcgagaaggacatccgcttcagctacttctggatccgctgcgcgcgcctcgtcgcggtgaccctgttcgtggtccactccgccggttgcctgtactacctgatcgccgaccggtacccgcacccagagaagacgtggatcggcgatgtgatccccaacttccggcaggtcagcgtgtggatccgctacatcacctccgtctactggtccatcaccaccatgaccaccgtcggctacggcgacctgcacgccaggaacaccgtcgagatgatcttcaacatcttctacatgctcttcaacctcggtctcaccgcctacctcatcggcaacatgaccaacctcgtcgtcgagggcacccaccgcaccatggagtttaggaacagcatcagggccgcgacgagcttcgtgggccggaaccacctgccgccgcggctgaagcagcagatcctggcctacatgtgcctcaagttcagggcggagagcctgaaccagcagcagctcatggaccagctacccaagtccatctgcaagagcatctgcgatcacctcttcgtgccggtcgtcaaggacgtctacctcttcaatggggtctcgagagaaatgctcctgtccctggtcaccaagatgaaaccggagtacattccgcccagggaggatgtgatcgtgcagaacgaggctccggacgacgtgtacgtcgtcgtctccggcgaggtagaggtcatactgttcaatggcatcaacgagcgggtggaggcgacgctggggacgcgagacatcttcggcgaggtgagcgctctgagcgaccgggcgcaggccttcacgttccggacgaggacgctgagccagctgctgcggctgaagcaggcgacgcttaaggaagccatgcagagcaggcccgaggacaatgtcgtcgtcatcaagaacttcctcaagcatcaggtggagatgcatggcatggaagtcgaggacttgctgggagacaacactggcgagcacgacaacgacgcgaatgtgctgacggctgccatgatgggaaacagcggcttactcgaggacctcctcagggcagggaaggacgctgacgtcggtgacgccacgggcagaacagcactgcacatcgcggcggccaaggtgtacgaggactgcgtgctggtgctgctcaagcacgcgtgcaacgtgaacatcgaggacgcgcagggcaacacggcgatgtggaacgccattgcggcagggcaccacaggatcttcaacatcctgtaccagttctcgcgcgcgtccaacccgcacgccggcggagacgtcttgtgcctcgccgcgcgccgcggtgacctcggcatgctccgggagctcctcaagctcggcctggacgtggactcggaggaccacgacggcgccaccgcgctgcgcgtcgcgatggccgagggacacgccgatgtggcgaggttcctgatcatgaatggggccagcgtggacaaggcgagcctcgacgacgatggctccggctctggcacggcgcggcgaacaatgtcgtcgaccgagctgcgcgagctgttgcagaagcgggagctcggccactcgataaccatcgttgactcgccagcggtgatcccggacagattacagagcacaggctcgaaccagcaacgctggcctcgggtgagcatatataatggccaccctttcctcagaaaccgcagctatgaagctggcaagctgatcaatctgcctggcaccatggaagaattcatagccaccgtcggtgagaaattgaaagttgatgcggagaaggtgctgatcgtgaatgacgaaggagctgagatcgactccatcgacgtgattcgagacaacgacaagctgttcgtggtcaccggagaagatatgaggcagctggcatcaatggactccatgtcttcatcactgtgtttgtag

SEQ ID NO: 3436 - protein, 837 aa, Sorghum bicolor
  misc_feature: Ceres ANNOT ID no. 6031402
  misc_feature (104)..(306): Pfam Id: Ion_trans Pfam Desc: Ion transport protein
  misc_feature (561)..(593): Pfam Id: Ank Pfam Desc: Ankyrin repeat
  misc_feature (658)..(690): Pfam Id: Ank Pfam Desc: Ankyrin repeat
  misc_feature (215)..(312): Pfam Id: Ion_trans_2 Pfam Desc: Ion channel
  misc_feature (406)..(495): Pfam Id: cNMP_binding Pfam Desc: Cyclic nucleotide-binding domain
  misc_feature (2)..(832): NCBI GI: 5830781 NCBI Desc: potassium channel protein zmk2 [zea mays]
  misc_feature (6)..(833): NCBI GI: 93138733 NCBI Desc: inwardly rectifying potassium channel akt2 [hordeum vulgare]
  misc_feature (30)..(829): NCBI GI: 9955730 NCBI Desc: potassium channel 2 [populus tremula x populus tremuloides]
  misc_feature (25)..(817): NCBI GI: 2293112 NCBI Desc: potassium channel [vicia faba]
  misc_feature (27)..(817): NCBI GI: 4323296 NCBI Desc: pulvinus inward-rectifying channel for potassium spick1 [samanea saman]
  misc_feature: The sequence is a functional homolog of SEQ ID NO 1838 in the 10/374,780US patent application
  misc_feature: Useful for making plants with modulated growth and phenotype characteristics
  misc_feature: The sequence is a functional homolog of SEQ ID NO 1838 in the 20060162006 US patent application
  misc_feature: The sequence is a functional homolog of SEQ ID NO. 503 in the 11/188,298 US application
MKNNSSFQSTGSAGGGGGSGTGERSGSGSLSLRYLSKIILPPLGGPPGQSQSHGGSDKWVISPLDSRYRWWDTLMVVLVAYSAWVYLFEVAFMNASPKGGLEVADIVVDLFFAVDIVLTFFVAYIDPRTQLLIRDRKKITFRYLSTFFIMDVASTVPFQALAYFITGEVRENGAYSVLGLLRLWRLRRVNQFFTRLEKDIRFSYFWIRCARLVAVTLFVVHSAGCLYYLIADRYPHPEKTWIGDVIPNFRQVSVWIRYITSVYWSITTMTTVGYGDLHARNTVEMIFNIFYMLFNLGLTAYLIGNMTNLVVEGTHRTMEFRNSIRAATSFVGRNHLPPRLKQQILAYMCLKFRAESLNQQQLMDQLPKSICKSICDHLFVPVVKDVYLFNGVSREMLLSLVTKMKPEYIPPREDVIVQNEAPDDVYVVVSGEVEVILFNGINERVEATLGTRDIFGEVSALSDRAQAFTFRTRTLSQLLRLKQATLKEAMQSRPEDNVVVIKNFLKHQVEMHGMEVEDLLGDNTGEHDNDANVLTAAMMGNSGLLEDLLRAGKDADVGDATGRTALHIAAAKVYEDCVLVLLKHACNVNIEDAQGNTAMWNAIAAGHHRIFNILYQFSRASNPHAGGDVLCLAARRGDLGMLRELLKLGLDVDSEDHDGATALRVAMAEGHADVARFLIMNGASVDKASLDDDGSGSGTARRTMSSTELRELLQKRELGHSITIVDSPAVIPDRLQSTGSNQQRWPRVSIYNGHPFLRNRSYEAGKLINLPGTMEEFIATVGEKLKVDAEKVLIVNDEGAEIDSIDVIRDNDKLFVVTGEDMRQLASMDSMSSSLCL

SEQ ID NO: 3437 - DNA, 1476 bp, Sorghum bicolor
  misc_feature: Ceres ANNOT ID no. 6031412
  misc_feature: Encodes the peptide sequence at SEQ ID NO 3438
atgcacaggctctccctcaccgtcattgacgccaccgccgccatgccctttgcgctccggctcggcggttccccagcggtccgcctcgccgccgcgcgccgcgcgggcccgcggcccctggcgtggctgcgcttcggcagcggggccggggcgcggaggctctgctccgccgaggccgccaggcggggtggcggtggcgaggatgcggaggcggaggcggagggtcggaggggaggcgggagccgcgtgccgtcggagaggaggatgaggggcggggggaacgcggccgccgccgcggtggggacgagcatcgagctgctggcgattcccggtgtggggccgcgcaaccttaggaagctcgtggacaatggcttcgagggcgtcgcgcagctcaagcagctctacagggacaagttctttggcaagtctagtgggcagatggttgaattcttacagtgttctgttggcattgtacataagaatcatgctgagagtataacctcgttcattaaagagagtgttgatgaggagctgaaagatacagattcatctaaacccactcagaagaagaggctgaccttttgtgtggaagggaatatcagcgttgggaaaaccactttcctccaaaggatagctaatgagacaattgaactgcgtgatcttgtagagatagttcctgagcctattgataagtggcaagatgttggccctgatcacttcaatatattggatgccttctatgctgagccacataggtatgcatacactttccaaaactatgtgtttgtgacaagggtcatgcaagaaagggaatctcaagctggaattaaacctctcagactgatggaaagaagtgtattcgtccgtgctgttcacgaagctaattggatgaatgagatggagatcagcatctatgattcttggtttgatccagttgtgtcatcactcccaggtctcatcccagatggatttatctatttaagagctagcccagatacttgccacaaaagaatgatgcataggagaagatcagaggaaggtggtgttacacttgattacttgcaaggtttgcatgagaagcatgagagctggttgcttccttcgaaaggatcgggtcctggtgtattatcggtcagtcaactgcccatgcatatggagggctccttgcctccggaaatacgggatcgtgtattttacttggaaggaaatcacatgcactctagcatccagaaggttcctgctctcatcttggattgtgaacctgacattgatttcagcagagacatagaagctaaacgacaatatgctaggcaagttgcagagttctttgaatttgtgaagaaaaagcaggagcaagctccatcggagcaaacaagcaatgacaaggaccgcatgaacccacaggtattgcttcctaacagctatccaatgaatctggatttcagaagagccatgtcttcatacctctcaacttag

SEQ ID NO: 3438 - protein, 491 aa, Sorghum bicolor
  misc_feature: Ceres ANNOT ID no. 6031412
  misc_feature (257)..(398): Pfam Id: dNK Pfam Desc: Deoxynucleoside kinase
  misc_feature (1)..(434): NCBI GI: 115441353 NCBI Desc: os01g0874100 [oryza sativa (japonica cultivar-group)]
  misc_feature (147)..(474): NCBI GI: 33325043 NCBI Desc: dck/dgk-like deoxyribonucleoside kinase [lycopersicon esculentum]
  misc_feature (165)..(369): NCBI GI: 89309760 NCBI Desc: deoxynucleoside kinase family protein [tetrahymena thermophila sb210]
  misc_feature (183)..(366): NCBI GI: 88191978 NCBI Desc: chain d, crystal structure of human deoxycytidine kinase in complex with deoxycytidine
  misc_feature (183)..(406): NCBI GI: 33303983 NCBI Desc: thymidine kinase 2, mitochondrial [synthetic construct]
MHRLSLTVIDATAAMPFALRLGGSPAVRLAAARRAGPRPLAWLRFGSGAGARRLCSAEAARRGGGGEDAEAEAEGRRGGGSRVPSERRMRGGGNAAAAAVGTSIELLAIPGVGPRNLRKLVDNGFEGVAQLKQLYRDKFFGKSSGQMVEFLQCSVGIVHKNHAESITSFIKESVDEELKDTDSSKPTQKKRLTFCVEGNISVGKTTFLQRIANETIELRDLVEIVPEPIDKWQDVGPDHFNILDAFYAEPHRYAYTFQNYVFVTRVMQERESQAGIKPLRLMERSVFVRAVHEANWMNEMEISIYDSWFDPVVSSLPGLIPDGFIYLRASPDTCHKRMMHRRRSEEGGVTLDYLQGLHEKHESWLLPSKGSGPGVLSVSQLPMHMEGSLPPEIRDRVFYLEGNHMHSSIQKVPALILDCEPDIDFSRDIEAKRQYARQVAEFFEFVKKKQEQAPSEQTSNDKDRMNPQVLLPNSYPMNLDFRRAMSSYLST

SEQ ID NO: 3439 - DNA, 1008 bp, Sorghum bicolor
  misc_feature: Ceres ANNOT ID no. 6031419
  misc_feature: Encodes the peptide sequence at SEQ ID NO 3440
atggccggacgcactacggagggggctcgctgcagcggggagacgacggtgtgcgtgacgggcgccggcggctacatcgcctcgtggctcgtcaagctcctcctctcccgcggctacaccgtgcacgccaccgtccgcgacccgggtgatcccaagaacgcccacctggggcggctggaaggggcctcggagaacctccggctgttcaaggccaacgtgctcgaccagaacgcgctggctgccgcagtctccgggtgccggggggtcttccatcttgcctgtccggtgcccacggataaggttcttgatccggaggcttgctcaaataataatattcagaaagttattgtggtttcgtccaccgccgctgttcatttcaacccaaattggcctcaacacatacccaaagacgaggagtgctggtcggacataaacttttgcaaaatgaatgaggactggtatatggttgccaaggttattgctgaaaagacagccttggaatatgcagagaaaaatggactgaatgttgttacagtttgccctactatggctttaggaccgctcctacggcctatggtcaatgtcagccatgaattcctgctatacattattaaaggaggtcctactgtgatgaggaacattccctggcacatagttgatgtccgtgatgtggctgatgctttgcttctcgtatacgagaaagagaaatcagcaaggagatacatctgcgcgccaaattacatcagtgcgatagatctggtgaacatgctgaagaaggctcatcctaattacaattacgtaaactgcggcaatgatttggttcctaactctatagttacgccaataatgtcggagaaactgaagaatttgggctggaaaccaaggaagacgctacataaaacattgatggatagtgttgaatgctatgagaagatggggcttctgcaagatgttgagggatgcccttgccgtcttcctcacctttttcatatggctatagaaaaatga

SEQ ID NO: 3440 - protein, 335 aa, Sorghum bicolor
  misc_feature: Ceres ANNOT ID no. 6031419
  misc_feature (17)..(244): Pfam Id: Epimerase Pfam Desc: NAD dependent epimerase/dehydratase family
  misc_feature (19)..(228): Pfam Id: NAD_binding_4 Pfam Desc: Male sterility protein
  misc_feature (18)..(282): Pfam Id: 3Beta_HSD Pfam Desc: 3-beta hydroxysteroid dehydrogenase/isomerase family
  misc_feature (6)..(307): NCBI GI: 104162062 NCBI Desc: cinnamoyl coa reductase [picea abies]
  misc_feature (16)..(315): NCBI GI: 9964087 NCBI Desc: cinnamoyl coa reductase [lolium perenne]
  misc_feature (16)..(315): NCBI GI: 25140432 NCBI Desc: cinnamoyl coa reductase [hordeum vulgare]
  misc_feature (16)..(315): NCBI GI: 3341511 NCBI Desc: cinnamoyl-coa reductase [saccharum officinarum]
  misc_feature (16)..(315): NCBI GI: 17978551 NCBI Desc: cinnamoyl-coa reductase [lolium perenne]
  misc_feature: Useful for making plants with altered cell wall content and/or composition
  misc_feature: Functional homolog of the protein sequence encoded by LOCUS at1g76470
  misc_feature: Useful for making plants with altered carbohydrate content
  misc_feature: Functional homolog of the protein sequence given in SEQ ID NO 13693
MAGRTTEGARCSGETTVCVTGAGGYIASWLVKLLLSRGYTVHATVRDPGDPKNAHLGRLEGASENLRLFKANVLDQNALAAAVSGCRGVFHLACPVPTDKVLDPEACSNNNIQKVIVVSSTAAVHFNPNWPQHIPKDEECWSDINFCKMNEDWYMVAKVIAEKTALEYAEKNGLNVVTVCPTMALGPLLRPMVNVSHEFLLYIIKGGPTVMRNIPWHIVDVRDVADALLLVYEKEKSARRYICAPNYISAIDLVNMLKKAHPNYNYVNCGNDLVPNSIVTPIMSEKLKNLGWKPRKTLHKTLMDSVECYEKMGLLQDVEGCPCRLPHLFHMAIEK

SEQ ID NO: 3441 - DNA, 372 bp, Sorghum bicolor
  misc_feature: Ceres ANNOT ID no. 6031429
  misc_feature: Encodes the peptide sequence at SEQ ID NO 3442
atggacactgttgctccacatgtactcatagttgatgacacctttgttgatcgccttgtggcatctcgagtcttaaagaattgtaacattcaagtgacaattgtggagggcccaaagcaagccttggaatttctagatgtggagaatgatgtaaatctaattctaactgattattgtatgcctggtatgacggggtatgatcttctgctggaggtgaaggaatcaccaaagctaaagcatatccctgtggtgatcatgtccagtgacaacatccctgaaaggatgcaaaagtgcttggatgcaggggccaaggagtatatcataaagcctatcaaagcagttgatgtgccccgtattttgagctacatttga

SEQ ID NO: 3442 - protein, 123 aa, Sorghum bicolor
  misc_feature: Ceres ANNOT ID no. 6031429
  misc_feature (6)..(121): Pfam Id: Response_reg Pfam Desc: Response regulator receiver domain
  misc_feature (5)..(123): NCBI GI: 87116398 NCBI Desc: typea response regulator 12 [oryza sativa (japonica cultivar-group)]
  misc_feature (5)..(123): NCBI GI: 71273489 NCBI Desc: type a response regulator 8 [oryza sativa (indica cultivar-group)]
  misc_feature (5)..(123): NCBI GI: 87116400 NCBI Desc: typea response regulator 13 [oryza sativa (japonica cultivar-group)]
  misc_feature (1)..(123): NCBI GI: 94966174 NCBI Desc: response regulator [zea mays]
  misc_feature (1)..(123): NCBI GI: 94966176 NCBI Desc: response regulator [zea mays]
  misc_feature: The sequence is a functional homolog of SEQ ID NO 932 in the 10/666,642US patent application
  misc_feature: Useful for making plants with altered Lignin content
  misc_feature: Useful for making plants with altered carotene content
  misc_feature: Useful for making plants with altered terpenoid content
  misc_feature: Useful for making plants with modulated growth and phenotype characteristics
  misc_feature: Functional homolog of the protein sequence given in SEQ ID NO 13463
  misc_feature: The sequence is a functional homolog of SEQ ID NO 932 in the 20070033671 US patent application
  misc_feature: The sequence is a functional homolog of SEQ ID NO 932 in the 10/666,642 US patent application
  misc_feature: The sequence is a functional homolog of SEQ ID NO. 378 in the 11/188,298 US application
MDTVAPHVLIVDDTFVDRLVASRVLKNCNIQVTIVEGPKQALEFLDVENDVNLILTDYCMPGMTGYDLLLEVKESPKLKHIPVVIMSSDNIPERMQKCLDAGAKEYIIKPIKAVDVPRILSYI

SEQ ID NO: 3443 - DNA, 990 bp, Sorghum bicolor
  misc_feature: Ceres ANNOT ID no. 6031434
  misc_feature: Encodes the peptide sequence at SEQ ID NO 3444
  misc_feature: Up-regulated in shoot tissues in response to aminocyclopropane carboxylic treatment
  misc_feature: Up-regulated in root tissues in response to salicylic acid treatment
atggtgagctcaaacaagggcaaagtatgtgtaactggggcttcaggctttattgcctcttggcttatcaaacggctgctcgagtctggatatcatgtggtagggactgtcagagacccaggaaatcaccaaaaaacagcacacctttggaaattacctggtgccaaagagaggctgcaaattgtgcgagctgatctgttggaagaagggagctttgacaatgctgtcatggactgtgatggcgtcttccacactgcatcccctgtgctcgctaaatctgattctagtagcaaggaggaaacgcttgttccagcagtaaacggtactctgaatgtgctaagatcgtgcaagaagaacccatttctgaaaagggttgttcttacgtcttcatcatctgcagtgaggattagggatgatgatcagcctaatatctcactggatgaaacaacatggagctctgtgccactctgtgaaaagatgcagctatggtatgccctagcgaaggtatttgcagagaaagcggcatgggaattcgccaaggagaacaacatcgaccttgtgactgtcctcccatcatttgtgatcgggcccagtttatcccatgaactatgtgttaccgcttcagatgtcctaggcttattccaaggtgacacggcaaggttcagttcttacggaagaatgggatacgttcacatcgacgatgttgccagcagccatatcctggtgtacgagaccccccatgccaccgggagatacctgtgcagctccgtggtgctggacaacgacgagctggtctccttgctcgcgaagcgatacccagtattccccataccccggagactgaacagcccttacggcaagcagtcgtaccagctgaacacgtcgaagctgcaggggctgggcttcaagttcaggggagtgcaggagatgttcgacgactgtgtccagtcgctcaaagaccagggccacctgctggagtgccccctgtga

SEQ ID NO: 3444 - protein, 329 aa, Sorghum bicolor
  misc_feature: Ceres ANNOT ID no. 6031434
  misc_feature (9)..(255): Pfam Id: Epimerase Pfam Desc: NAD dependent epimerase/dehydratase family
  misc_feature (11)..(268): Pfam Id: NAD_binding_4 Pfam Desc: Male sterility protein
  misc_feature (10)..(279): Pfam Id: 3Beta_HSD Pfam Desc: 3-beta hydroxysteroid dehydrogenase/isomerase family
  misc_feature (7)..(141): Pfam Id: adh_short Pfam Desc: short chain dehydrogenase
  misc_feature (1)..(329): NCBI GI: 14030554 NCBI Desc: dihydro-flavanoid reductase-like protein [zea mays]
  misc_feature (1)..(329): NCBI GI: 32352170 NCBI Desc: dihydroflavonol reductase [oryza sativa (japonica cultivar-group)]
  misc_feature (1)..(329): NCBI GI: 115479903 NCBI Desc: os09g0493500 [oryza sativa (japonica cultivar-group)]
  misc_feature (8)..(328): NCBI GI: 92872163 NCBI Desc: dihydro-flavanoid reductase-like protein [medicago truncatula]
  misc_feature (6)..(324): NCBI GI: 105830365 NCBI Desc: at4g35420 [arabidopsis thaliana]
  misc_feature: Up-regulated in shoot tissues in response to aminocyclopropane carboxylic treatment
  misc_feature: Up-regulated in root tissues in response to salicylic acid treatment
MVSSNKGKVCVTGASGFIASWLIKRLLESGYHVVGTVRDPGNHQKTAHLWKLPGAKERLQIVRADLLEEGSFDNAVMDCDGVFHTASPVLAKSDSSSKEETLVPAVNGTLNVLRSCKKNPFLKRVVLTSSSSAVRIRDDDQPNISLDETTWSSVPLCEKMQLWYALAKVFAEKAAWEFAKENNIDLVTVLPSFVIGPSLSHELCVTASDVLGLFQGDTARFSSYGRMGYVHIDDVASSHILVYETPHATGRYLCSSVVLDNDELVSLLAKRYPVFPIPRRLNSPYGKQSYQLNTSKLQGLGFKFRGVQEMFDDCVQSLKDQGHLLECPL

SEQ ID NO: 3445 - DNA, 2106 bp, Sorghum bicolor
  misc_feature: Ceres ANNOT ID no. 6031440
  misc_feature: Encodes the peptide sequence at SEQ ID NO 3446
atggagaccccgccgccgcgccggtggccgccgggcttccgcttcagccccaccgacgaggagcttgttctctacttcctcaagcgccggatcgtctccggccgcccctctccctacgtcgccgacgtcgaagtgtacaagtcacacccttcccacctccccgagaggtcggcgctgcagacgggggacaggcagtggttcttcttcagccggatggaccgcaagtaccccaacggctcgcgcgccagccgcaccactggcgacggatactggaaggccacggggaaggaccgcttcatctgcggcggcggccgggcggtgggcaacaagaagacgctggtgtaccaccacggccgggccccgcgcggggagcgcacggactgggtcatgcacgagtataccctactcgccgacgcgctcccgccggccgcgcaggggagggagtcctacgcgctgtacaagctcttccagaagagcggggccgggcccaagaacggcgaacagtacggtgctccctttagggaggaggattggttggatgacgacgatgagggagtgactgcggatgctgccgctaattctgttcctaacaccaataatccaccatgtacagtggaggagcatgcaattactgaccgtgagcttccaattgaggatcttgatgaactcctgtcaaattttggaaatgatcaggagtttagtgaagcacagcctacttcttcccatggtcaaggtcagggttggctcagtgaggggggtgacaaggctgaggttgtggatgcttccattagcaatggtgctgtggttgtagcagagaacacctgcactgatctccctcttggggatattgagcagcttctgatgcaaatatctgatgatcagcaaaacgctgaattgttctcggatttatcaacatcagttccagaactgcagttccagtgcgaagatcgtcaggcttggcatgatgctgacgggggacatgaagtttgtgctggggatcctactgccagcagtggtgctgttgtaacagcagaatgtattgacacagaacttccacttggggatcttgaagggcttctgctgcaaatagccaacgaccaggacatggttgaaccccaatcagatctctctgcaccgattccacatcataatttcaatcaggctggcattggggatttacatgaatctcatggtgctccggttggtaatctttcttgtatagttcaggaaagtgcattttgtgaaccacggactgagccgagtagtcaatttccacagtctaatgtaaccaatttgccatttagcggagaaacaaattcttctgaagggaccagtgtggcacattctgtgtcaggtttgatcagttaccacagtcaggatgctgatgaggagttccttgaaatcaatgatttctttgatctggatgatgtaggtcagaatgcagattgtacgacaactgagtacttgatctctgcaacaaatgggatgtttgacaatttggaatactgtgatgctccttcatttctgcctgggccatttgacacagttggattggtagctgaaaatcaattttttgatattggtaacagtggaattcagaaccagagatatcaatatacaacagaagtaaggacacataatcaggctgctcttaatgtgcggagccatatgaagcatgatcatgtagtcttatcctcgcatgcatcagcaaatgaggtaaataaccagagctccacagcttcacaatcatggttcaatgcggctctatcagccttgttggactctgtacctagtagtccagcattagctgctgaaatcgaaaatactgttatcaacagaacactccagcgcatctctagcttccgatcacagcaaactgcaggtgaagaaaacacttttatcaacagaacacttcagcacatctctagcttcaagtcacagcaagcaacaagggaagaaccaggcaccccaagtattcaggttaccagaggcagcaggctgatgctcatctctctactggttatacttgcttctatcatatggacttttacttctggctctgccctcaatttttgcaaaggtttttggaaatcctcttctacgtga

SEQ ID NO: 3446 - protein, 701 aa, Sorghum bicolor
  misc_feature: Ceres ANNOT ID no. 6031440
  misc_feature (9)..(136): Pfam Id: NAM Pfam Desc: No apical meristem (NAM) protein
  misc_feature (1)..(701): NCBI GI: 115479907 NCBI Desc: os09g0493700 [oryza sativa (japonica cultivar-group)]
  misc_feature (11)..(316): NCBI GI: 21618244 NCBI Desc: nam-like protein [arabidopsis thaliana]
  misc_feature (11)..(316): NCBI GI: 18399166 NCBI Desc: no apical meristem (nam) family protein [arabidopsis thaliana]
  misc_feature (9)..(232): NCBI GI: 21105742 NCBI Desc: nam-like protein 7 [petunia x hybrida]
  misc_feature (9)..(202): NCBI GI: 21105740 NCBI Desc: nam-like protein 6 [petunia x hybrida]
  misc_feature: The sequence is a functional homolog of SEQ ID NO 2168 in the 10/374,780US patent application
  misc_feature: The sequence is a functional homolog of SEQ ID NO 226 in the 10/714,887US patent application
  misc_feature: The sequence is a functional homolog of SEQ ID NO 226 in the 11/435,388US patent application
  misc_feature: The sequence is a functional homolog of SEQ ID NO 24 in the 10/225,068US patent application
  misc_feature: The sequence is a functional homolog of SEQ ID NO 240 in the 10/225,068US patent application
  misc_feature: The sequence is a functional homolog of SEQ ID NO 368 in the 10/374,780US patent application
  misc_feature: The sequence is a functional homolog of SEQ ID NO 370 in the 10/666,642US patent application
  misc_feature: The sequence is a functional homolog of SEQ ID NO 52 in the 10/374,780US patent application
  misc_feature: The sequence is a functional homolog of SEQ ID NO 94 in the 10/225,068US patent application
  misc_feature: Useful for making plants with modulated growth and phenotype characteristics
  misc_feature: The sequence is a functional homolog of SEQ ID NO 24 in the 20050120408 US patent application
  misc_feature: The sequence is a functional homolog of SEQ ID NO 240 in the 20050120408 US patent application
  misc_feature: The sequence is a functional homolog of SEQ ID NO 2168 in the 20060162006 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
METPPPRRWPPGFRFSPTDEELVLYFLKRRIVSGRPSPYVADVEVYKSHPSHLPERSALQTGDRQWFFFSRMDRKYPNGSRASRTTGDGYWKATGKDRFICGGGRAVGNKKTLVYHHGRAPRGERTDWVMHEYTLLADALPPAAQGRESYALYKLFQKSGAGPKNGEQYGAPFREEDWLDDDDEGVTADAAANSVPNTNNPPCTVEEHAITDRELPIEDLDELLSNFGNDQEFSEAQPTSSHGQGQGWLSEGGDKAEVVDASISNGAVVVAENTCTDLPLGDIEQLLMQISDDQQNAELFSDLSTSVPELQFQCEDRQAWHDADGGHEVCAGDPTASSGAVVTAECIDTELPLGDLEGLLLQIANDQDMVEPQSDLSAPIPHHNFNQAGIGDLHESHGAPVGNLSCIVQESAFCEPRTEPSSQFPQSNVTNLPFSGETNSSEGTSVAHSVSGLISYHSQDADEEFLEINDFFDLDDVGQNADCTTTEYLISATNGMFDNLEYCDAPSFLPGPFDTVGLVAENQFFDIGNSGIQNQRYQYTTEVRTHNQAALNVRSHMKHDHVVLSSHASANEVNNQSSTASQSWFNAALSALLDSVPSSPALAAEIENTVINRTLQRISSFRSQQTAGEENTFINRTLQHISSFKSQQATREEPGTPSIQVTRGSRLMLISLLVILASIIWTFTSGSALNFCKGFWKSSST

SEQ ID NO: 3447 - DNA, 1167 bp, Sorghum bicolor
  misc_feature: Ceres ANNOT ID no. 6031442
  misc_feature: Encodes the peptide sequence at SEQ ID NO 3448
atggtaagggacacggcatactacgacgtgttggaagtgagcccgacggccaccgaggccgagatcaagaaggcgtactacgtcaaggcgaggcaggtccatccggacaagaaccccaatgatccgttcgcggcggcgaggttccaggaattgggggaggcataccaagtgcttagtgatcccacacagcgtgaagcttatgactcatatgggagatctggtatttcaagggaagcgataattgatcctgcagcaatttttgcaatgctgttcggtagcgagctttttgaggactacattggccagctggcgatggcatccatggcttcacttgatgattttaatgaagatatcgatgcaagaaggtttcaagagcaaatgcgagttgtacaaaaagaaagggaggagaaacttgcagaattactgaaagataggttgcacctatatcttcaaggaaacaaagaggaatttatccagtatgctgaagctgaggttactagactctctaacgccgcatatggtgttgatatgctgagcactattggttatgtgtattcaagacaagctgctaaggagcttggaaagaaagctaaatatcttggtgttccgtttattgctgaatggttcagaaacaaaggacattctattaaatcccaactgacagctgcaacatgtgcaatagcacttatgcagctgcaggaagacttgagaaagcatctcagtgctgagtgccactacagcgaagaggaactggaggcttacatgctggagcataggagtgttatggtggattcgttatggaagcttaatgttgctgatatagaggcaaccctgtcacatgtgcttcaagacagcactgccaggaaagaggaactacgagctcgagctaaaggattgaaaactttaggcaaaatattccagcaagttaagcttagcactaccgagggagatccagcagcaatgaataatacaataaataacttggatgagaatgatggtagttcaccggagtcatctccaagatctcccagggatcaaatgttccatgcaaatccaccttattcccagagtccatacgtggaggcccctcagttcggcggttatttttccttcgacttcccaatgcctatcgctccacctggtgcgcagagggaccccattccgtga

SEQ ID NO: 3448 - protein, 388 aa, Sorghum bicolor
  misc_feature: Ceres ANNOT ID no. 6031442
  misc_feature (6)..(68): Pfam Id: DnaJ Pfam Desc: DnaJ domain
  misc_feature (1)..(388): NCBI GI: 115479909 NCBI Desc: os09g0493800 [oryza sativa (japonica cultivar-group)]
  misc_feature (1)..(388): NCBI GI: 42407725 NCBI Desc: dnaj protein family-like [oryza sativa (japonica cultivar-group)]
  misc_feature (1)..(384): NCBI GI: 57340266 NCBI Desc: dnaj-like protein [brassica juncea]
  misc_feature (1)..(388): NCBI GI: 2230757 NCBI Desc: dnaj-like protein [arabidopsis thaliana]
  misc_feature (1)..(344): NCBI GI: 30699227 NCBI Desc: dnaj heat shock n-terminal domain-containing protein [arabidopsis thaliana]
MVRDTAYYDVLEVSPTATEAEIKKAYYVKARQVHPDKNPNDPFAAARFQELGEAYQVLSDPTQREAYDSYGRSGISREAIIDPAAIFAMLFGSELFEDYIGQLAMASMASLDDFNEDIDARRFQEQMRVVQKEREEKLAELLKDRLHLYLQGNKEEFIQYAEAEVTRLSNAAYGVDMLSTIGYVYSRQAAKELGKKAKYLGVPFIAEWFRNKGHSIKSQLTAATCAIALMQLQEDLRKHLSAECHYSEEELEAYMLEHRSVMVDSLWKLNVADIEATLSHVLQDSTARKEELRARAKGLKTLGKIFQQVKLSTTEGDPAAMNNTINNLDENDGSSPESSPRSPRDQMFHANPPYSQSPYVEAPQFGGYFSFDFPMPIAPPGAQRDPIP

SEQ ID NO: 3449 - DNA, 927 bp, Sorghum bicolor
  misc_feature: Ceres ANNOT ID no. 6031444
  misc_feature: Encodes the peptide sequence at SEQ ID NO 3450
atggaaagttctaaatctcctcaatcatcgaagaacagccagattacggtaccttctgatagtaatggcccccgatttgacaatgacgggtttgcttcagaaactgcatcaaatcaaatggtcgttttcaactctgaagcaggagataaagagcaagatgaaccgggagaaaaccgtttgcagaagtcagtcataacaagggggatatctccatctattggagcattcactgtccaatgtgctaaatgttttaaatggaggcttatcccaacgaaagagaagtatgaagaaattcgtgaacgtattatacaggaaccttttgtatgtaaaagagcttgtgaatggaaacctggtgtaacatgcaatgatccagaagatatatctcaggatggtagcaggctttgggctattgacaaacccaatattgcacaaccccctcgtggatgggaaaggcagattaggataagaggtgaagggggtaccaaatttgctgatgtatactatacctctccaactggaaggaaacttaggtctctggttgaaattgataggttcctccaagagaatccggagtatgttgcacagggtgtaactttagctcagttttcgttccagatacctagacctctgcggcaggactatgttaaaaagaaaccgaagttgataaatccaagtgatgaagcaagtacaattacttctaagtcttttcaaccagaagaagtgaaccccatagcctgggcagttcctacagcacatgagggtgatgccagtgaagaagcttctctcgctgacgagacacttccatcagaagtagtgctaacccggaagagaaaagcagaaagctcttcgtcagtagagccaaaccatctctctgatgaacttgaaccaaagttggcggatgctcagaacggggagacgtctaactga

SEQ ID NO: 3450 - protein, 308 aa, Sorghum bicolor
  misc_feature: Ceres ANNOT ID no. 6031444
  misc_feature (75)..(128): Pfam Id: zf-CW Pfam Desc: CW-type Zinc Finger
  misc_feature (135)..(212): Pfam Id: MBD Pfam Desc: Methyl-CpG binding domain
  misc_feature (1)..(307): NCBI GI: 115479913 NCBI Desc: os09g0494300 [oryza sativa (japonica cultivar-group)]
  misc_feature (1)..(307): NCBI GI: 134285526 NCBI Desc: mbd2 [triticum aestivum]
  misc_feature (3)..(271): NCBI GI: 115469778 NCBI Desc: os06g0702100 [oryza sativa (japonica cultivar-group)]
  misc_feature (3)..(169): NCBI GI: 53792746 NCBI Desc: methyl-binding domain protein-like [oryza sativa (japonica cultivar-group)]
  misc_feature (34)..(167): NCBI GI: 3047090 NCBI Desc: t26d22.18 gene product [arabidopsis thaliana]
  misc_feature: The plant flowers significantly late compared to wild-type.
  misc_feature: The plant is abnormally large.
  misc_feature: Useful for making plants with altered alkaloid content
  misc_feature: Useful for making plants with altered terpenoid content
  misc_feature: Useful for making plants with modulated biomass
  misc_feature: Useful for making plants with modulated flowering time
  misc_feature: GREAT-hit functional homolog of the protein sequence given in SEQ ID NO 13053
  misc_feature: GREAT-hit functional homolog of the protein sequence given in SEQ ID NO 13054
  misc_feature: GREAT-hit functional homolog of the protein sequence given in SEQ ID NO 13172
  misc_feature: Useful for making plants with altered terpenoid content
  misc_feature: Functional homolog of the protein sequence given in SEQ ID NO 13054
  misc_feature: Useful for making plants with altered alkaloid content
  misc_feature: Functional homolog of the protein sequence given in SEQ ID NO 13172
MESSKSPQSSKNSQITVPSDSNGPRFDNDGFASETASNQMVVFNSEAGDKEQDEPGENRLQKSVITRGISPSIGAFTVQCAKCFKWRLIPTKEKYEEIRERIIQEPFVCKRACEWKPGVTCNDPEDISQDGSRLWAIDKPNIAQPPRGWERQIRIRGEGGTKFADVYYTSPTGRKLRSLVEIDRFLQENPEYVAQGVTLAQFSFQIPRPLRQDYVKKKPKLINPSDEASTITSKSFQPEEVNPIAWAVPTAHEGDASEEASLADETLPSEVVLTRKRKAESSSSVEPNHLSDELEPKLADAQNGETSN

SEQ ID NO: 3451 - DNA, 1071 bp, Sorghum bicolor
  misc_feature: Ceres ANNOT ID no. 6031454
  misc_feature: Encodes the peptide sequence at SEQ ID NO 3452
atggcgaggtctcccctgcttctcgtgctgctggctgccgtctgggcatgcggcgcggcggccctggcgcgtgccgacccgatgctggagaggttcgagcagtggatgggcaggcatggccggctgtacgccgacgccggggagaagcagaggcggctcgaggtgtaccggaggaacgttgcgctggtcgagacgttcaactccatgagcaacggcgggtacaggctggccgacaacaagttcgccgacctgacgaacgaggagttcagggccaagatgctgggcttcggacggccgccgcctcacggcagagccaccgggcacaccacgacgccaggcaccgtggcttgtattggcagtggactgggccgacgttattctgatgaactgccgaaaagcgtggattggcgagagaaaggagctgtggcgccggtgaagaaccagggggagtgtggctcttgctgggcgttctccgccgtggcggccatcgagggcatcaaccagatcaagaacgggaagctggtgtccctgtcggagcaggagctggtggactgcgacaccaaggccatcggctgcgccggcggatacatgagctgggcctttgagttcgtcatgaataacagtggcctcaccaccgaacggaactacccttaccaagggatgaacggcgcctgccagacgccgaagctgaaggagagcgcggtgagcatctccgggtacgtgaacgtgacggccagcagcgagccggacctcctgcgggccgccgcagcgcagccggtgtccgtggccgtggacgccggcagcttcgtgtggcagctctacggcggcggggtgttcacggggccctgcaccgccgacctgaaccacggcgtcacggtggtcgggtacggggagacccagcgggacacggacggcgacggtaccggcgtgcccgggcagaagtactggatcgtcaagaactcgtgggggcccgagtggggcgacgccggctacatcctcatgcagcgcgaggccagcgtcgcgtccggcctctgcggcatcgctctgctcccgagctacccggtcatgtga

SEQ ID NO: 3452 - protein, 356 aa, Sorghum bicolor
  misc_feature: Ceres ANNOT ID no. 6031454
  misc_feature (130)..(355): Pfam Id: Peptidase_C1 Pfam Desc: Papain family cysteine protease
  misc_feature (32)..(89): Pfam Id: Inhibitor_I29 Pfam Desc: Cathepsin propeptide inhibitor domain (I29)
  misc_feature (1)..(356): NCBI GI: 115479933 NCBI Desc: os09g0497500 [oryza sativa (japonica cultivar-group)]
  misc_feature (7)..(354): NCBI GI: 24285904 NCBI Desc: cysteine proteinase precursor [ipomoea batatas]
  misc_feature (1)..(354): NCBI GI: 13491750 NCBI Desc: cysteine protease [ipomoea batatas]
  misc_feature (4)..(354): NCBI GI: 50355613 NCBI Desc: cysteine protease [daucus carota]
  misc_feature (4)..(354): NCBI GI: 144905108 NCBI Desc: cysteine proteinase [lotus japonicus]
MARSPLLLVLLAAVWACGAAALARADPMLERFEQWMGRHGRLYADAGEKQRRLEVYRRNVALVETFNSMSNGGYRLADNKFADLTNEEFRAKMLGFGRPPPHGRATGHTTTPGTVACIGSGLGRRYSDELPKSVDWREKGAVAPVKNQGECGSCWAFSAVAAIEGINQIKNGKLVSLSEQELVDCDTKAIGCAGGYMSWAFEFVMNNSGLTTERNYPYQGMNGACQTPKLKESAVSISGYVNVTASSEPDLLRAAAAQPVSVAVDAGSFVWQLYGGGVFTGPCTADLNHGVTVVGYGETQRDTDGDGTGVPGQKYWIVKNSWGPEWGDAGYILMQREASVASGLCGIALLPSYPVM

SEQ ID NO: 3453 - DNA, 450 bp, Sorghum bicolor
  misc_feature: Ceres ANNOT ID no. 6031506
  misc_feature: Encodes the peptide sequence at SEQ ID NO 3454
atggcgaagccgcagcttcttctctgcttcctagtcgccgccgccgcgacgctgctcgtcgccacggccaagaaatccggggacgtgacggaactccagatcggcgtcaagtacaagccggaatcttgcagcattcaagctcacaaaggtgacaaggttaaagttcactaccgtggaaaacttactgatggaacagtttttgattcaagctatgaaagaggtgaccctattgaatttgatttgggcactggacaagtgatcaaaggatgggatcagggtctcctaggaatgtgcgttggtgaaaagcggaagttgaagattccatcaaagcttggctatgggcctcaaggctcgccacctactattcctggtggagcaaccctaatatttgacacggagcttgtcgctgtcaatggagaaccagccaaccaatctgacaacgagctttag

SEQ ID NO: 3454 - protein, 149 aa, Sorghum bicolor
  misc_feature: Ceres ANNOT ID no. 6031506
  misc_feature (41)..(135): Pfam Id: FKBP_C Pfam Desc: FKBP-type peptidyl-prolyl cis-trans isomerase
  misc_feature (18)..(149): NCBI GI: 2129622 NCBI Desc: probable peptidylprolyl isomerase (ec 5.2.1.8) fkbp15-1 - arabidopsis thaliana
  misc_feature (18)..(149): NCBI GI: 22136164 NCBI Desc: immunophilin [arabidopsis thaliana]
  misc_feature (18)..(149): NCBI GI: 21593622 NCBI Desc: immunophilin (fkbp15-1) [arabidopsis thaliana]
  misc_feature (10)..(142): NCBI GI: 1272408 NCBI Desc: immunophilin
  misc_feature (6)..(144): NCBI GI: 23396588 NCBI Desc: fk506-binding protein 2 precursor (peptidyl-prolyl cis-trans isomerase) (ppiase) (rotamase) (15 kda fkbp) (fkbp-15)
  misc_feature (18)..(149): SWISSPROT Homolog: EC 5.2.1.8 FK506-binding protein 2-1 precursor
MAKPQLLLCFLVAAAATLLVATAKKSGDVTELQIGVKYKPESCSIQAHKGDKVKVHYRGKLTDGTVFDSSYERGDPIEFDLGTGQVIKGWDQGLLGMCVGEKRKLKIPSKLGYGPQGSPPTIPGGATLIFDTELVAVNGEPANQSDNEL

SEQ ID NO: 3455 - DNA, 774 bp, Sorghum bicolor
  misc_feature: Ceres ANNOT ID no. 6031511
  misc_feature: Encodes the peptide sequence at SEQ ID NO 3456
atggccgccaacttctggacgtcgtcgcactgcaagcagctactggaccccgatgatgtggacctggtgccggcggcggaccgggagcggggcatcacgccagaggagttccgcctcatcaagatccatatgtcgttccatatctggaggctggcacaacaggttaaagttaggcaaagagttatagctacagcagtcacttacttcaggcgtgtgtatacaaggaagagcatgtcagactatgatcctcgtttggttgcacctacttgtttgtatttggcatctaaggtggaggagagcacagtgcaagctcggcttcttgtcttttacataaaaaagatgtgtggttccgatgacaagtatcggtttgaaattaaggatattcttgaaatggaaatgaagctcctcgaagctcttgactattatttggttgttttccatccataccgtcctctcttacagttattgcaagatgctggcataacagatctgacacaatttgcctggggccttgttaacgatacatacaagatggaccttatcctcatataccctccctacatgattgcactggcctgcatatacatagcaagtgttctaaaagataaggacaccacagcatggtttgaagagctccgtgttgacatgaacatagttaagaatatctctatggaaatattagacttctatgacacctacaagattgatcctcaaaggggcattcctgaggataagataagctccgtgatgaacaagttgccggcgaaggcttga

SEQ ID NO: 3456 - protein, 257 aa, Sorghum bicolor
  misc_feature: Ceres ANNOT ID no. 6031511
  misc_feature (4)..(144): Pfam Id: Cyclin_N Pfam Desc: Cyclin, N-terminal domain
  misc_feature (1)..(257): NCBI GI: 3334144 NCBI Desc: g1/s-specific cyclin c-type
  misc_feature (1)..(257): NCBI GI: 1695698 NCBI Desc: c-type cyclin [oryza sativa (japonica cultivar-group)]
  misc_feature (1)..(256): NCBI GI: 10177354 NCBI Desc: cyclin c-like protein [arabidopsis thaliana]
  misc_feature (1)..(253): NCBI GI: 21554107 NCBI Desc: cyclin c-like protein [arabidopsis thaliana]
  misc_feature (1)..(256): NCBI GI: 42568400 NCBI Desc: cyclin family protein [arabidopsis thaliana]
  misc_feature: The plant produces a reduced number of seeds.
  misc_feature: Useful for biocontainment applications
  misc_feature: Functional homolog of the protein sequence given in SEQ ID NO 12984
  misc_feature: Useful for biocontainment applications
  misc_feature: Functional homolog of the protein sequence given in SEQ ID NO 12984
MAANFWTSSHCKQLLDPDDVDLVPAADRERGITPEEFRLIKIHMSFHIWRLAQQVKVRQRVIATAVTYFRRVYTRKSMSDYDPRLVAPTCLYLASKVEESTVQARLLVFYIKKMCGSDDKYRFEIKDILEMEMKLLEALDYYLVVFHPYRPLLQLLQDAGITDLTQFAWGLVNDTYKMDLILIYPPYMIALACIYIASVLKDKDTTAWFEELRVDMNIVKNISMEILDFYDTYKIDPQRGIPEDKISSVMNKLPAKA

SEQ ID NO: 3457 - DNA, 1050 bp, Sorghum bicolor
  misc_feature: Ceres ANNOT ID no. 6031524
  misc_feature: Encodes the peptide sequence at SEQ ID NO 3458
atgagaggtttcttggattcccgaggtttcttaagtttcttgcttggagctgcagccgccgcggcctgcatcgtactgctacagccgtctgctctgtgcccgttcgacggcctcacgccggcagatcgtcaagaactggcaatcttgagcaatacaactcatgctgcaggtccctgctccaagaagcttcacatggctgctacttcaccggacgacgtgaggcttctgggtctcctgaggagagccagcatggacgacgacaataccatcataatgaccttcacgaacaaggcgtggacggcgccggggtcgctcatggacctcttcctcgagagcttccgcgtaggcgtgaggacggagccgctcctgaagcacctggtcatcgtcgccgtcgacggcaaggcgtacgcgcggtgcacgcaggtgcacccgttctgctaccacctccgcgccaggggcgccggcgtcgacgactacgcgtcggagcagtcgttcatgtcgaagagctacctggacctgatgtggcgccggaaccggttccaggcgcgggtgctgcagctcggctacagcttcgtcttcacggacatggacatcctctggctgcggaacccgctgctgcgcgtgcccgtcggcgccgacctcgccatgtccgccgactacttctacggcgacaacccgtacgacctgaacaagacggccaacggagggttcgtgtacgccaaggcgagcgccaggacggcggcgttctacgacggctggtacgaggcgcggagggagcacccggggaagaacgagcaggacgtgttcgatcaggcgaagcacgcgctggcggcgcggcacggcgtccgggtgcagttcgtggacacggcctaccttagcggcttctgcgagctccgcaaggacttccacgtggtgtgcacggtccacggcaactgcctcttcgggctcaaggacaagctccagaagctcacccaggtgttggacgagtggaagcagttcagggccgacgccgcgcggatgggcagcaacaccaccgcgctcacggactga

SEQ ID NO: 3458 - protein, 349 aa, Sorghum bicolor
  misc_feature: Ceres ANNOT ID no. 6031524
  misc_feature (75)..(339): NCBI GI: 42407980 NCBI Desc: regulatory protein-like [oryza sativa (japonica cultivar-group)]
  misc_feature (13)..(333): NCBI GI: 21536907 NCBI Desc: regulatory protein [arabidopsis thaliana]
  misc_feature (43)..(335): NCBI GI: 23306127 NCBI Desc: putataive insb from escherichia coli [oryza sativa (japonica cultivar-group)]
  misc_feature (72)..(333): NCBI GI: 116309821 NCBI Desc: h0307d04.3 [oryza sativa (indica cultivar-group)]
  misc_feature (72)..(333): NCBI GI: 38344278 NCBI Desc: osjnba0013k16.10 [oryza sativa (japonica cultivar-group)]
  misc_feature: Useful for making plants with altered carbohydrate content
  misc_feature: Functional homolog of the protein sequence given in SEQ ID NO 13836
MRGFLDSRGFLSFLLGAAAAAACIVLLQPSALCPFDGLTPADRQELAILSNTTHAAGPCSKKLHMAATSPDDVRLLGLLRRASMDDDNTIIMTFTNKAWTAPGSLMDLFLESFRVGVRTEPLLKHLVIVAVDGKAYARCTQVHPFCYHLRARGAGVDDYASEQSFMSKSYLDLMWRRNRFQARVLQLGYSFVFTDMDILWLRNPLLRVPVGADLAMSADYFYGDNPYDLNKTANGGFVYAKASARTAAFYDGWYEARREHPGKNEQDVFDQAKHALAARHGVRVQFVDTAYLSGFCELRKDFHVVCTVHGNCLFGLKDKLQKLTQVLDEWKQFRADAARMGSNTTALTD

SEQ ID NO: 3459 - DNA, 1473 bp, Sorghum bicolor
  misc_feature: Ceres ANNOT ID no. 6031526
  misc_feature: Encodes the peptide sequence at SEQ ID NO 3460
atgccggagaaggcggtggacgacgtcatggaggccgcggtgggggcccacttcagcggcctccgcctcgaggcgctgcgcctctccacctccgccccctcttccccttcctcctcccccgccgccgcggcgcacgcgcactccaacggcgccgtctacgcaaacggcaccgccgagctcccctcccctgccgctgcccggcagccgttcgtcatcggggtttctggagggacggcgtcggggaagacgacggtgtgcgacatgattatccagcagctgcacgaccaccgcgtcgtgctcgttaaccaggattcattctaccgtggcctaactgctgaagagtctgcacatgcacaagactacaattttgatcaccctgatgcatttgatacagaacaacttcttgaatgcatgggacaactgaaacgtgctcaacctgtaaatgttcctatatatgatttcaagaagcatcgtcggtgttctgacagctttaggaaggttaatgcatcagatgtcattattttggagggcattttagtcttccatgatcagagagttcgcaatctgatggacatgaaaatttttgtagacacagatgctgatattaggcttgctcgacgaatcaggcgtgatacagttgaaagaggaagagatattagctcagtgcttgaccagtatgggaggtttgtgaagccagcattcgatgattttgttttgccttcaaagaagtacgctgacgtgatcattcctcgaggaggtgataaccatgtagcagttgatctgattgttcaacatatccgtaccaaacttggtcagcatgacttgtgcaaaatctatccgaatgttcatgttgttcaatcaacttttcagatccgaggaatgcatactcttattcgtgatagggaaattactacacctgactttgtcttttattcagatcgattgatccgtttggtagtggagcatggtcttggacatttgccatttacagaaaagcaggttattactccaacaggatctgtttatatgggagttgacttctgtaagaagctctgtggagtgtctattgtgcgaagtggtgagagtatggagaacgccctgcgtgcttgttgtaaaggaataaaaattggtaaaattctaattcatcgtgttggagacaatgggcagcagcttgtttatcacaaactgcccatggatattgctgaacgacatgttctacttctggatccagtgcttggtacaggcaactcagtggcccaagcaattgaccttcttataagaaaaggtgttcctgagggtcggatcattttcctcaatctcatctcggctcctgaagggattcagtgtatttgcaagcgatttccttcactgaagattgtaacgtctgaaatcgattatggtctgaacgaggaattcagggtgataccaggactgggagaatatggtgaccgctacttcggcacagacaattga

SEQ ID NO: 3460 - protein, 490 aa, Sorghum bicolor
  misc_feature: Ceres ANNOT ID no. 6031526
  misc_feature (71)..(258): Pfam Id: PRK Pfam Desc: Phosphoribulokinase / Uridine kinase family
  misc_feature (1)..(490): NCBI GI: 115480023 NCBI Desc: os09g0505800 [oryza sativa (japonica cultivar-group)]
  misc_feature (37)..(490): NCBI GI: 92874915 NCBI Desc: phosphoribosyltransferase; aaa atpase; phosphoribulokinase/uridine kinase [medicago truncatula]
  misc_feature (42)..(490): NCBI GI: 110737140 NCBI Desc: uracil phosphoribosyl transferase like protein [arabidopsis thaliana]
  misc_feature (88)..(490): NCBI GI: 30687242 NCBI Desc: uracil phosphoribosyltransferase / ump pyrophosphorylase (upt1) [arabidopsis thaliana]
  misc_feature (199)..(485): NCBI GI: 8778490 NCBI Desc: f20n2.19 [arabidopsis thaliana]
  misc_feature (294)..(490): SWISSPROT Homolog: EC 2.4.2.9 Uracil phosphoribosyltransferase
  misc_feature (68)..(267): SWISSPROT Homolog: EC 2.7.1.48 Uridine-cytidine kinase 2
  misc_feature: The sequence is a functional homolog of SEQ ID NO. 532 in the 11/188,298 US application
MPEKAVDDVMEAAVGAHFSGLRLEALRLSTSAPSSPSSSPAAAAHAHSNGAVYANGTAELPSPAAARQPFVIGVSGGTASGKTTVCDMIIQQLHDHRVVLVNQDSFYRGLTAEESAHAQDYNFDHPDAFDTEQLLECMGQLKRAQPVNVPIYDFKKHRRCSDSFRKVNASDVIILEGILVFHDQRVRNLMDMKIFVDTDADIRLARRIRRDTVERGRDISSVLDQYGRFVKPAFDDFVLPSKKYADVIIPRGGDNHVAVDLIVQHIRTKLGQHDLCKIYPNVHVVQSTFQIRGMHTLIRDREITTPDFVFYSDRLIRLVVEHGLGHLPFTEKQVITPTGSVYMGVDFCKKLCGVSIVRSGESMENALRACCKGIKIGKILIHRVGDNGQQLVYHKLPMDIAERHVLLLDPVLGTGNSVAQAIDLLIRKGVPEGRIIFLNLISAPEGIQCICKRFPSLKIVTSEIDYGLNEEFRVIPGLGEYGDRYFGTDN

SEQ ID NO: 3461 - DNA, 630 bp, Sorghum bicolor
  misc_feature: Ceres ANNOT ID no. 6031527
  misc_feature: Encodes the peptide sequence at SEQ ID NO 3462
atggcggcggcgaagatagcgccgtcgatgctctcgtcggacttcgccaacctcgcctcggaggctgagcgcatggtccgcctaggcgccgactggttacatatggacatcatgagcttgaggaaacataccaaagcatatttggactgccatcttatggtcacaaacccttcagattacgtagaaccatttggaaaggctggcgcttctggattcacattccatatagaagttgctagagacaactggcaagatctcatccaaagcattaaatcaaagggtatgcggcctggtgtatcattgaggccaggtacaccagtggaggaagtttttccactggtggaagcagaaaatccggtagaattggttcttgtgatgacagtcgagcctggttttggtggtcagaaatttatgccagaaatgatggataaggtgcgcacattgagaaagaagtacccttcccttgacatagaggttgatggtggtctaggcccttcaaccatagacgtggccgcatctgctggggccaattgcatcgtcgctggaagctctatatttggcgccgcggacccaggagccgtcatatctgtgctgaggaagagcgttgagggctctcagaacaaaaactga

SEQ ID NO: 3462 - protein, 209 aa, Sorghum bicolor
  misc_feature: Ceres ANNOT ID no. 6031527
  misc_feature (5)..(189): Pfam Id: Ribul_P_3_epim Pfam Desc: Ribulose-phosphate 3 epimerase family
  misc_feature (2)..(209): NCBI GI: 60390595 NCBI Desc: ribulose-phosphate 3-epimerase, cytoplasmic isoform (ribulose-5-phosphate-epimerase) (cyt-rpease) (rpecyt) (pentose-5-phosphate 3-epimerase) (ppe)
  misc_feature (37)..(205): NCBI GI: 126140114 NCBI Desc: d-ribulose-5-phosphate 3- epimerase [pichia stipitis cbs 6054]
  misc_feature (6)..(202): NCBI GI: 60470330 NCBI Desc: ribulose phosphate 3-epimerase [dictyostelium discoideum]
  misc_feature (36)..(202): NCBI GI: 6322341 NCBI Desc: d-ribulose-5-phosphate 3-epimerase [saccharomyces cerevisiae]
  misc_feature (46)..(202): NCBI GI: 51701877 NCBI Desc: ribulose-phosphate 3-epimerase (pentose-5-phosphate 3-epimerase) (ppe) (rpe)
  misc_feature (2)..(209): SWISSPROT Homolog: EC 5.1.3.1 Ribulose-phosphate 3-epimerase, cytoplasmic isoform
  misc_feature: The sequence is a functional homolog of SEQ ID NO. 534 in the 11/188,298 US application
MAAAKIAPSMLSSDFANLASEAERMVRLGADWLHMDIMSLRKHTKAYLDCHLMVTNPSDYVEPFGKAGASGFTFHIEVARDNWQDLIQSIKSKGMRPGVSLRPGTPVEEVFPLVEAENPVELVLVMTVEPGFGGQKFMPEMMDKVRTLRKKYPSLDIEVDGGLGPSTIDVAASAGANCIVAGSSIFGAADPGAVISVLRKSVEGSQNKN

SEQ ID NO: 3463 - DNA, 666 bp, Sorghum bicolor
  misc_feature: Ceres ANNOT ID no. 6031528
  misc_feature: Encodes the peptide sequence at SEQ ID NO 3464
  misc_feature: Down-regulated in root tissues in response to methyl jasmonate treatment
atgtcgaggcgcggcgactgggtctacgagaacaacggcgggacctgcgtggccatcgccggcgccgattactgtgtcgtcgccgcggacacccgcctctctgtaggatacagcatcctcacgcgcgaccactccaagatctgcgacctggctgacaaatgtgtactggcatcttctggctttcaaggtgacattaaggctctgcacaagaacctagctgccagagaattgctataccaacaccagcataataaaaggatgagctgccctgccatggcacagctcctctccaatacactgtactacaagcgcttcttcccatattacgccttcaatgtgctcggtgggcttgacagcgaggggaaaggatgcgttttcacctatgatgcagtaggttcctatgagagaaccggttacagcgctcagggaacaggatctactttgatgatgccagtcctggacaatcaactaaaatcaccaagtcctctattactccctgccagggatgctgtcacaccattgtcagagtcagaggccatcgatctagttaaggatgtgtttgcatctgcaactgagagagacatctacactggagacaagttggaaattgttgtcattaacaaagccgggactaagcgtgagtacatcgagctgaggaaggactaa

SEQ ID NO: 3464 - protein, 221 aa, Sorghum bicolor
  misc_feature: Ceres ANNOT ID no. 6031528
  misc_feature (10)..(206): Pfam Id: Proteasome Pfam Desc: Proteasome A-type and B-type
  misc_feature (1)..(221): NCBI GI: 17380182 NCBI Desc: proteasome subunit beta type 1 (20s proteasome alpha subunit f) (20s proteasome subunit beta-6)
  misc_feature (3)..(221): NCBI GI: 3608485 NCBI Desc: proteasome beta subunit [petunia x hybrida]
  misc_feature (3)..(221): NCBI GI: 140057540 NCBI Desc: peptidase t1a, proteasome beta-subunit [medicago truncatula]
  misc_feature (3)..(221): NCBI GI: 92875602 NCBI Desc: peptidase t1a, proteasome beta-subunit [medicago truncatula]
  misc_feature (3)..(221): NCBI GI: 21554745 NCBI Desc: proteasome component c5 [arabidopsis thaliana]
  misc_feature (1)..(221): SWISSPROT Homolog: EC 3.4.25.1 Proteasome subunit beta type 1
  misc_feature: Down-regulated in root tissues in response to methyl jasmonate treatment
  misc_feature: The sequence is a functional homolog of SEQ ID NO. 409 in the 11/188,298 US application
MSRRGDWVYENNGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGGLDSEGKGCVFTYDAVGSYERTGYSAQGTGSTLMMPVLDNQLKSPSPLLLPARDAVTPLSESEAIDLVKDVFASATERDIYTGDKLEIVVINKAGTKREYIELRKD

SEQ ID NO: 3465 - DNA, 1263 bp, Sorghum bicolor
  misc_feature: Ceres ANNOT ID no. 6031543
  misc_feature: Encodes the peptide sequence at SEQ ID NO 3466
atgccggggctcacgacgatgctggcactgccatgggcatcatcaccaccggtgccgccgccggtgaagaagaagctttgcttcagcaccagcagcagcagcaagaggacggcgagcgcgacgataccgctggtcaacaagaagcactccgcttcgtcggcacacctcctcctcagccgcggccgtgccctaatggcagcgacggtaacggcacccgccttttctgacgatgaccagcgaaaggagctgctgctgcggcacctgggggaggacggcgggtgggtggaggagcagatgctgtcgctgctcacccccgtggacgaggcatggcagcccgccgatctcctgcccaccttcgctgccgccaccgccgaggagcatcggacccaggtggcggagctccaggcccgcgcggccggcgtgcccgacgagctcctcgtgtgcctcgtgggcaacatgatcacggaggaaggcctgcccgcgtacatgaccatggggaaccgggcgggtggcggcgccggcatcgtagacgccaccggctgcgacgaccacggctgggctcgctggctgcgcggctggaccgccgaggagaaccgccacggcgacgtgctcaaccggtacctctacctgtgcggccgcgtggacatgcgccaggtggagacgacggtgcaccacctcctccgccgtggcatgagcatgctggagccctcctgcccctaccacggcttcatctacggcgccttccaggagcgcgccaccttcgtctcccacgcccacacgggcaagcgcgcggcgctccacggggacgcctgcctcgccaagctctgcggggtcatcgccgccgacgagaagcgccacgaggtcgcctacacgagggtcgtcgccaggtccttggagggcgacccggacggcgtggtgcgggcgctcgcggccgtgatgcgagccaaggtcaccatgcccggcgagcgcatgacagacggacgcgacgacaacctcttcgatcacttctcagcggtggcgcagcgcgcgggggtgtacacggcggcggactacggcgacatggtggagcacttcgtgcgcaggtggaaggtggcggagctcgaggggctgtccggcgaggggcggcgcgcgcaagactacgtgtgcgggctgccgcgtaagatccgcaggatggaggagctggcccacgaccgcgcggcccaaaaggaggcccaatccgtcaatatcagctgggtgttcgacaggcccgttcgtctgcactga

SEQ ID NO: 3466 - protein, 420 aa, Sorghum bicolor
  misc_feature: Ceres ANNOT ID no. 6031543
  misc_feature (78)..(417): Pfam Id: FA_desaturase_2 Pfam Desc: Fatty acid desaturase
  misc_feature (13)..(417): NCBI GI: 115475221 NCBI Desc: os08g0199400 [oryza sativa (japonica cultivar-group)]
  misc_feature (93)..(419): NCBI GI: 2290400 NCBI Desc: stearoyl-acp desaturase [helianthus annuus]
  misc_feature (94)..(419): NCBI GI: 951427 NCBI Desc: stearoyl-acyl-carrier protein desaturase
  misc_feature (94)..(419): NCBI GI: 21093 NCBI Desc: acyl-[acyl-carrier protein] desatu; stearol-acyl-carrier protein desaturase [ricinus communis]
  misc_feature (94)..(419): NCBI GI: 31615850 NCBI Desc: chain f, the crystal structure of the one-iron form of the di-iron center in stearoyl acyl carrier protein desaturase from ricinus communis (castor bean).
  misc_feature (94)..(419): SWISSPROT Homolog: EC 1.14.19.2 Acyl-[acyl-carrier-protein] desaturase, chloroplast precursor
  misc_feature: The sequence is a functional homolog of SEQ ID NO. 338 in the 11/188,298 US application
MPGLTTMLALPWASSPPVPPPVKKKLCFSTSSSSKRTASATIPLVNKKHSASSAHLLLSRGRALMAATVTAPAFSDDDQRKELLLRHLGEDGGWVEEQMLSLLTPVDEAWQPADLLPTFAAATAEEHRTQVAELQARAAGVPDELLVCLVGNMITEEGLPAYMTMGNRAGGGAGIVDATGCDDHGWARWLRGWTAEENRHGDVLNRYLYLCGRVDMRQVETTVHHLLRRGMSMLEPSCPYHGFIYGAFQERATFVSHAHTGKRAALHGDACLAKLCGVIAADEKRHEVAYTRVVARSLEGDPDGVVRALAAVMRAKVTMPGERMTDGRDDNLFDHFSAVAQRAGVYTAADYGDMVEHFVRRWKVAELEGLSGEGRRAQDYVCGLPRKIRRMEELAHDRAAQKEAQSVNISWVFDRPVRLH

SEQ ID NO: 3467 - DNA, 405 bp, Sorghum bicolor
  misc_feature: Ceres ANNOT ID no. 6031547
  misc_feature: Encodes the peptide sequence at SEQ ID NO 3468
atgccagagaaaggaaggaagccggcggggctcatcatgaagacgctggaccggtgccgcagcgcgcggaggagcaagccggcgccggcgccagaggggtgcttcacggtgtgcgtcggcgcggggcggcagcgcttcatggtccggacggagtgcgtgaaccacccgctgtttcgggcgctgctggaggaggccgaggacgtgttcgggtacgcggccgccggcccgctcgcgctgccgtgcgacgccgacgccttcgtgcgggtgctggagcagatcgaggaggaggacgcggctggccaggcggcggcgacgaccgtggcgaggtgcggccttgtcaggggccactccgcgtacggccggctgctcgtccccgcccggcctctcctcgtcggccggtcctag

SEQ ID NO: 3468 - protein, 134 aa, Sorghum bicolor
  misc_feature: Ceres ANNOT ID no. 6031547
  misc_feature (9)..(94): Pfam Id: Auxin_inducible Pfam Desc: Auxin responsive protein
  misc_feature (21)..(132): NCBI GI: 38454136 NCBI Desc: at4g34750 [arabidopsis thaliana]
  misc_feature (18)..(101): NCBI GI: 38346068 NCBI Desc: osjnba0084k01.8 [oryza sativa (japonica cultivar-group)]
  misc_feature (17)..(107): NCBI GI: 51090658 NCBI Desc: auxin-induced protein-like [oryza sativa (japonica cultivar-group)]
  misc_feature (12)..(130): NCBI GI: 92870682 NCBI Desc: auxin responsive saur protein [medicago truncatula]
  misc_feature (30)..(104): NCBI GI: 115482888 NCBI Desc: os10g0510500 [oryza sativa (japonica cultivar-group)]
  misc_feature: The sequence is a functional homolog of SEQ ID NO. 402 in the 11/188,298 US application
  misc_feature: The sequence is a functional homolog of SEQ ID NO. 505 in the 11/188,298 US application
  misc_feature: The sequence is a functional homolog of SEQ ID NO. 443 in the 11/188,298 US application
MPEKGRKPAGLIMKTLDRCRSARRSKPAPAPEGCFTVCVGAGRQRFMVRTECVNHPLFRALLEEAEDVFGYAAAGPLALPCDADAFVRVLEQIEEEDAAGQAAATTVARCGLVRGHSAYGRLLVPARPLLVGRS

SEQ ID NO: 3469 - DNA, 405 bp, Sorghum bicolor
  misc_feature: Ceres ANNOT ID no. 6031550
  misc_feature: Encodes the peptide sequence at SEQ ID NO 3470
atgccggagaaaggaaggaagccggcggggctcatcatgaagacgctggaccggtgccgcagcgcgcggaggagcaagccggcgccggcgccggaggggtgcttcacggtgtgcgtcggcgcggggcggcagcgcttcatggtccggacggagtgcgtgaaccacccgctgttccgggcgctgctggaggaggccgaggaggtgttcgggtacgcggccgccggcccgctcgcgctgccgtgcgacgccgacgccttcgtgcgggtgctggagcagatcgaggaggaggacgcggctggccaggcggcggcgacgaccgtggcgaggtgcggccttgtcaggggccactccgcgtacggccggctgctcgtccccgcccggcctctcctcgtcggccggtcctag

SEQ ID NO: 3470 - protein, 134 aa, Sorghum bicolor
  misc_feature: Ceres ANNOT ID no. 6031550
  misc_feature (9)..(94): Pfam Id: Auxin_inducible Pfam Desc: Auxin responsive protein
  misc_feature (21)..(132): NCBI GI: 38454136 NCBI Desc: at4g34750 [arabidopsis thaliana]
  misc_feature (18)..(101): NCBI GI: 38346068 NCBI Desc: osjnba0084k01.8 [oryza sativa (japonica cultivar-group)]
  misc_feature (17)..(107): NCBI GI: 51090658 NCBI Desc: auxin-induced protein-like [oryza sativa (japonica cultivar-group)]
  misc_feature (12)..(130): NCBI GI: 92870682 NCBI Desc: auxin responsive saur protein [medicago truncatula]
  misc_feature (30)..(104): NCBI GI: 115482888 NCBI Desc: os10g0510500 [oryza sativa (japonica cultivar-group)]
  misc_feature: The sequence is a functional homolog of SEQ ID NO. 402 in the 11/188,298 US application
  misc_feature: The sequence is a functional homolog of SEQ ID NO. 505 in the 11/188,298 US application
  misc_feature: The sequence is a functional homolog of SEQ ID NO. 443 in the 11/188,298 US application
MPEKGRKPAGLIMKTLDRCRSARRSKPAPAPEGCFTVCVGAGRQRFMVRTECVNHPLFRALLEEAEEVFGYAAAGPLALPCDADAFVRVLEQIEEEDAAGQAAATTVARCGLVRGHSAYGRLLVPARPLLVGRS

SEQ ID NO: 3471 - DNA, 1128 bp, Sorghum bicolor
  misc_feature: Ceres ANNOT ID no. 6031561
  misc_feature: Encodes the peptide sequence at SEQ ID NO 3472
atgctgggcgccgcgaggaggcagcttggatccggtcccatgctgggacaggttttgcgaaggctccgcccagcggcggcggcggctgaggtggcgaggggctactccgccgcggcgaaggagatgaatgtccgtgatgcgttgaactctgcactggatgaagagatgtctgctgatccttcagtttttctgatgggagaagaggttggagagtatcaaggtgcatacaagatttctaagggcttgcttgacaaatatggtcctgatagggttcttgacacacctatcacagaggctggctttactggcattggtgttggtgcagcttatcatggtcttcggcctattatagaatttatgacatttaatttctcgatgcaggctattgatcatatcatcaattcagctgccaagtcaaactatatgtcagctggtcagatatctgttcctattgtttttagaggaccaaacggagctgctgctggagttggtgctcaacactcacagtgttatgcagcttggtatgcacatgtaccaggacttaaggttctcacaccatactcttcagaagatgcccgaggcttgctcaaagctgctattagggatcctgatcctgttatttttctggaaaatgaattgctttatggagaatctttcccagtttctgctgaagtgcttgattctagtttttgcctaccgattgggaaagctaagatagaacgtgaaggtaaagatgttaccattactacctactccaagatggttggctatgctctccaggctgcagagatactgtccaaggaaggaatcagtgctgaggtgatcaaccttcgatcgattagaccacttgacagggctgctattaatgcatctgtcaggaaaaccaaccgattggtgactgttgaagaagggttcccccaacatgggattggtgccgagatatgcatgtctgttgtagaagaaagcttcgagtaccttgatgcaccagttgagaggattgctggagctgatgtacctatgccttatgctgccaaccttgagagaatggctgttccacaggtcgatgacattgtgcgggccgcaaagcgggcctgctacagggcagtaccaatggcagcagctgcctga

SEQ ID NO: 3472 - protein, 375 aa, Sorghum bicolor
  misc_feature: Ceres ANNOT ID no. 6031561
  misc_feature (40)..(218): Pfam Id: Transket_pyr Pfam Desc: Transketolase, pyrimidine binding domain
  misc_feature (235)..(357): Pfam Id: Transketolase_C Pfam Desc: Transketolase, C-terminal domain
  misc_feature (1)..(375): NCBI GI: 3851001 NCBI Desc: pyruvate dehydrogenase e1 beta subunit isoform 2 [zea mays]
  misc_feature (1)..(375): NCBI GI: 3851003 NCBI Desc: pyruvate dehydrogenase e1 beta subunit isoform 3 [zea mays]
  misc_feature (1)..(375): NCBI GI: 115480067 NCBI Desc: os09g0509200 [oryza sativa (japonica cultivar-group)]
  misc_feature (1)..(375): NCBI GI: 3850999 NCBI Desc: pyruvate dehydrogenase e1 beta subunit isoform 1 [zea mays]
  misc_feature (1)..(368): NCBI GI: 23507745 NCBI Desc: at5g50850/k16e14_1 [arabidopsis thaliana]
  misc_feature (1)..(368): SWISSPROT Homolog: EC 1.2.4.1 Pyruvate dehydrogenase E1 component subunit beta, mitochondrial precursor
MLGAARRQLGSGPMLGQVLRRLRPAAAAAEVARGYSAAAKEMNVRDALNSALDEEMSADPSVFLMGEEVGEYQGAYKISKGLLDKYGPDRVLDTPITEAGFTGIGVGAAYHGLRPIIEFMTFNFSMQAIDHIINSAAKSNYMSAGQISVPIVFRGPNGAAAGVGAQHSQCYAAWYAHVPGLKVLTPYSSEDARGLLKAAIRDPDPVIFLENELLYGESFPVSAEVLDSSFCLPIGKAKIEREGKDVTITTYSKMVGYALQAAEILSKEGISAEVINLRSIRPLDRAAINASVRKTNRLVTVEEGFPQHGIGAEICMSVVEESFEYLDAPVERIAGADVPMPYAANLERMAVPQVDDIVRAAKRACYRAVPMAAAA

SEQ ID NO: 3473 - DNA, 846 bp, Sorghum bicolor
  misc_feature: Ceres ANNOT ID no. 6031574
  misc_feature: Encodes the peptide sequence at SEQ ID NO 3474
atggcaagcttcccacacttcacgcagatggagcatggcctagccggtgcctccgcccatggcacgccgagcttcttattctgccatggcgcagccacggcagattcagcctcgctggagacctcatctggtgttctcgacacctccccacaaggcactgcttctgacgacaagaagcccaggaagcccagggaagatagtgccagcttcagctctgctcactccaaggactcaaactcaaaggaaagcaccaaaaagaagggaggaaaaagagacagaagcagcaaggaggtagatgaggaggagcccaaggggtacatacatgtcagggcaaggagagggcaagccacagacagccacagccttgcagagagggtgaggagggagagaatcagtgagaggatgagggtgctgcaggccctggtccctggctgtgataaggtcactggtaaagccctcattttggatgagatcatcaattatgtgcagtccttgcagaaccaagttgagttcctttccatgaggattgcttcactgagccctgtgctgtatggttttggcatggacactgatgctttcagtgaccatactcaaaaaatcgaaggaatgctccaccatgaggctcttggaatgcctagctctgtcctgaacagacctccatctgaaactcacatggacacgcacaactccacctcctccccatcctacgaggtccacggcgatggcggcaccagcatctctttccctcaggacaatggcagctacatggtgcaaacagtaggtgagccaaggcaagagctgttcaatcaagtggtgttcagtaaccacatgtgctctttccagtag

SEQ ID NO: 3474 - protein, 281 aa, Sorghum bicolor
  misc_feature: Ceres ANNOT ID no. 6031574
  misc_feature (116)..(166): Pfam Id: HLH Pfam Desc: Helix-loop-helix DNA-binding domain
  misc_feature (135)..(281): NCBI GI: 45736094 NCBI Desc: bhlh transcription factor-like protein [oryza sativa (japonica cultivar-group)]
  misc_feature (32)..(247): NCBI GI: 5923912 NCBI Desc: bhlh transcription factor gbof-1 [tulipa gesneriana]
  misc_feature (38)..(245): NCBI GI: 50726625 NCBI Desc: ta1 protein-like [oryza sativa (japonica cultivar-group)]
  misc_feature (49)..(214): NCBI GI: 57834129 NCBI Desc: osjnba0038p21.14 [oryza sativa (japonica cultivar-group)]
  misc_feature (49)..(214): NCBI GI: 115457864 NCBI Desc: os04g0350700 [oryza sativa (japonica cultivar-group)]
  misc_feature: The sequence is a functional homolog of SEQ ID NO 1929 in the 10/374,780US patent application
  misc_feature: The sequence is a functional homolog of SEQ ID NO 1930 in the 10/374,780US patent application
  misc_feature: The sequence is a functional homolog of SEQ ID NO 198 in the 10/714,887US patent application
  misc_feature: The sequence is a functional homolog of SEQ ID NO 198 in the 11/435,388US patent application
  misc_feature: Useful for making plants with modulated growth and phenotype characteristics
  misc_feature: The sequence is a functional homolog of SEQ ID NO 198 in the 20060015972 US patent application
  misc_feature: The sequence is a functional homolog of SEQ ID NO 1929 in the 20060162006 US patent application
  misc_feature: The sequence is a functional homolog of SEQ ID NO 1930 in the 20060162006 US patent application
MASFPHFTQMEHGLAGASAHGTPSFLFCHGAATADSASLETSSGVLDTSPQGTASDDKKPRKPREDSASFSSAHSKDSNSKESTKKKGGKRDRSSKEVDEEEPKGYIHVRARRGQATDSHSLAERVRRERISERMRVLQALVPGCDKVTGKALILDEIINYVQSLQNQVEFLSMRIASLSPVLYGFGMDTDAFSDHTQKIEGMLHHEALGMPSSVLNRPPSETHMDTHNSTSSPSYEVHGDGGTSISFPQDNGSYMVQTVGEPRQELFNQVVFSNHMCSFQ

SEQ ID NO: 3475 - DNA, 2463 bp, Sorghum bicolor
  misc_feature: Ceres ANNOT ID no. 6031575
  misc_feature: Encodes the peptide sequence at SEQ ID NO 3476
atgtttttcagcaggctcgatgactcgcccatgttcaggaagcagatgcaatcgcttgaagaaggagctgatttgctaagagagagatgtttaaagtttcacaaaggttgtcgaaaatacacggaaggactaggcgaagcatatgatggagatattgcattcgcaagttcacttgaaacatttggagggggtcataatgatccaatcagtgttgcatttggaggccctgtaatgaccaaatttacaattgctttgagagaaattggaacatacaaggaagtattgcgctcccaggttgagcatatgctaaatgacaagctgctccagtttgtggaaattgatttacatgaaatgaaggatgctaggaaacgttttgacaaggctacccttctttacgaccaggcacgtgaaaagtatttgtccttgaagaaaggtacaaggactgacgtagcagctgcagtagaggatgtgactgcactttcaaatatcgaggctaagaaaaggtttgaatttttggaggctgttagtgggacaatggatgctcatcttcgttatttcaaacaaggatatgaactactacatcagatggaaccgtatatcaatcaagttcttgcatttgcacaacaatcaagagaaaggtctaactatgagcaggctgctcttcttgagaggatgcaagatttcaaacggcaaattgatcgtgaaagtcggtggtcaccaaatggaatgaatgattcccctaatggtgatggtatacaaacaattggtagaagttcgcataagatgattgaggaagcaatgcaatcagcttcaaagggcaaggttcagaccattcggcaaggctatctctctaagagatcttcaaacttgagaggtgattggaaaaggaggttctttgtcctcgacagtcgaggaatgttatactattatcgcaagcagaacagtaggccatctagtggttataaccaaaggactagcattccctcagaacatggttctgggttgctcagcagatggttctcttctcattatcatggaggcgtgcatgatgagaaatcggttgcacgccatactgtaaacttgctaacatcgaccattaaagttgatgcagaccaatcagatctgcggttctgcttcagaataatttctcccacaaagaactatacattgcaggcagagagtgcaatggatcagatggattggattgaaaaaattactggcgtcattgcttctttgctgagctcccagtcccctgaacgacgtcttctattgagtcctaagggcagcagccatcatcgaactgccagctcaagcagttcattcagtagctcaacagaacttgaacattcaataaatgaagattgtatgctggaaaagaactcagggagtggttatttcgagcattctgcaagagttgcacagcatcatcgaacaagcatgatgaaacctgacaagccaattgacttgcttaggaaggtggctggcaataatagctgtgctgattgtggtgcttcagagcctgattgggcatccctgaaccttggagttcttttatgcatagagtgttctggggtacacagaaatatgggtgtgcatatatctaaggtaagatccctgacgcttgatgtcagggtttgggagccatctgtaatcaatctctttcagtcaataggcaacacgtttgccaatactgtctgggaagaaatgttaccttcatcaacctgtgttgaccatggtgatatttcaaggcctgatggattagaaaacatgtcacatcgctttgcacccagcaagcctaaacaatctgattctatcgcagtgaaggagaagtttattcatgccaagtatgctgaaaaggattttgtgcggaaacataatgtggatgagattcaacttgcagaacagatgtgggacaatgtaagttcaaacaacaagaagggtgtgtacagtttgattgtggggtcaaatgccgatgtaaatttttcttacggtcatacatcatttaattcggctttgactctgggaaaagctctccttctacaagagcaatcaacttctccatctaatggaagttctagatgttttgatctcaatccacttgagaagggttctaccggggattctgtttctcctgccagcacaagtgcccgtatagatggattggatgattacgttgaaggattatctttgcttcatctagcatgtcgtgttgcggacctgggcatggttgaactactcttgcagtatggtgcaaatgtaaattctacagattcaagagggcggacaccacttcatcacagcatcatgaaagggagacatgtgtacgccaagctactgctttccaggggtgctgattctcaagccgtggaccgagatggtagaacagcattaaagtatgcaatcgacagcggaaccatagaggatgaagagatccttgttttgttagaggacccaagtagataa

SEQ ID NO: 3476 - protein, 820 aa, Sorghum bicolor
  misc_feature: Ceres ANNOT ID no. 6031575
  misc_feature (484)..(629): Pfam Id: ArfGap Pfam Desc: Putative GTPase activating protein for Arf
  misc_feature (277)..(410): Pfam Id: PH Pfam Desc: PH domain
  misc_feature (726)..(758): Pfam Id: Ank Pfam Desc: Ankyrin repeat
  misc_feature (759)..(791): Pfam Id: Ank Pfam Desc: Ankyrin repeat
  misc_feature (1)..(820): NCBI GI: 115480083 NCBI Desc: os09g0510700 [oryza sativa (japonica cultivar-group)]
  misc_feature (1)..(817): NCBI GI: 79512687 NCBI Desc: van3 (vascular network defective 3) [arabidopsis thaliana]
  misc_feature (111)..(820): NCBI GI: 15240398 NCBI Desc: arf gtpase-activating domain-containing protein [arabidopsis thaliana]
  misc_feature (157)..(820): NCBI GI: 115477541 NCBI Desc: os08g0537600 [oryza sativa (japonica cultivar-group)]
  misc_feature (19)..(451): NCBI GI: 10176916 NCBI Desc: gcn4-complementing protein homolog [arabidopsis thaliana]
  misc_feature: The sequence is a functional homolog of SEQ ID NO 1839 in the 10/374,780US patent application
  misc_feature: Useful for making plants with modulated growth and phenotype characteristics
  misc_feature: The sequence is a functional homolog of SEQ ID NO 1839 in the 20060162006 US patent application
  misc_feature: The sequence is a functional homolog of SEQ ID NO. 425 in the 11/188,298 US application
MFFSRLDDSPMFRKQMQSLEEGADLLRERCLKFHKGCRKYTEGLGEAYDGDIAFASSLETFGGGHNDPISVAFGGPVMTKFTIALREIGTYKEVLRSQVEHMLNDKLLQFVEIDLHEMKDARKRFDKATLLYDQAREKYLSLKKGTRTDVAAAVEDVTALSNIEAKKRFEFLEAVSGTMDAHLRYFKQGYELLHQMEPYINQVLAFAQQSRERSNYEQAALLERMQDFKRQIDRESRWSPNGMNDSPNGDGIQTIGRSSHKMIEEAMQSASKGKVQTIRQGYLSKRSSNLRGDWKRRFFVLDSRGMLYYYRKQNSRPSSGYNQRTSIPSEHGSGLLSRWFSSHYHGGVHDEKSVARHTVNLLTSTIKVDADQSDLRFCFRIISPTKNYTLQAESAMDQMDWIEKITGVIASLLSSQSPERRLLLSPKGSSHHRTASSSSSFSSSTELEHSINEDCMLEKNSGSGYFEHSARVAQHHRTSMMKPDKPIDLLRKVAGNNSCADCGASEPDWASLNLGVLLCIECSGVHRNMGVHISKVRSLTLDVRVWEPSVINLFQSIGNTFANTVWEEMLPSSTCVDHGDISRPDGLENMSHRFAPSKPKQSDSIAVKEKFIHAKYAEKDFVRKHNVDEIQLAEQMWDNVSSNNKKGVYSLIVGSNADVNFSYGHTSFNSALTLGKALLLQEQSTSPSNGSSRCFDLNPLEKGSTGDSVSPASTSARIDGLDDYVEGLSLLHLACRVADLGMVELLLQYGANVNSTDSRGRTPLHHSIMKGRHVYAKLLLSRGADSQAVDRDGRTALKYAIDSGTIEDEEILVLLEDPSR

SEQ ID NO: 3477 - DNA, 663 bp, Sorghum bicolor
  misc_feature: Ceres ANNOT ID no. 6031592
  misc_feature: Encodes the peptide sequence at SEQ ID NO 3478
atggcagcagcagccgccactgttcgccgtggctccgccagcagcagcgcctccgtctcccacgccatcgtcctcgccgtcgtcgtcgtcgcctgctcgtcgtttcctcctaccagcaccgccgccaaggcggcaccgtgctcgagccagaccttctcgggcaccggcggggagcagcaatcctacgcgtcgtgcgcggacctgccgcgcctcggggccacgctgcactacaactacacggccgccaccaacaccgtggccgtcgcgttccgggcgccgcagggcaagggcgccgacgggtgggtggcgtgggggatcaacccgagcggccgcagcggcatggtcggcacgcaggccgtggtcgcgttccagagctccaacggcagcctcgtcgcgtacccgacggtgctcgacagctacgcgccgtccatggcgcccgcggcgcccggggacctggcgttcccggtgtcgggcgtggcggccgagtacgcggacgggaaggagatggtggtgtacgcgacgctggcgctgccggccgggaaggggagcaagttcaccaacgtgtggcagcagggggctgcggtggtcaacgacgtgccggcggtgcaccccaccaccggggacaacatcctttccaccgccaccatcgatttcagcgcttga

SEQ ID NO: 3478 - protein, 220 aa, Sorghum bicolor
  misc_feature: Ceres ANNOT ID no. 6031592
  misc_feature (22)..(217): NCBI GI: 115479971 NCBI Desc: os09g0500900 [oryza sativa (japonica cultivar-group)]
  misc_feature (9)..(210): NCBI GI: 115479973 NCBI Desc: os09g0501100 [oryza sativa (japonica cultivar-group)]
  misc_feature (21)..(216): NCBI GI: 115477383 NCBI Desc: os08g0524400 [oryza sativa (japonica cultivar-group)]
  misc_feature (15)..(219): NCBI GI: 30680258 NCBI Desc: auxin-responsive protein / auxin-induced protein (air12) [arabidopsis thaliana]
  misc_feature (39)..(217): NCBI GI: 27363428 NCBI Desc: at4g17280/dl4675c [arabidopsis thaliana]
  misc_feature: Useful for making plants with modulated phosphate use efficiency
  misc_feature: Functional homolog of the protein sequence given in SEQ ID NO 13277
MAAAAATVRRGSASSSASVSHAIVLAVVVVACSSFPPTSTAAKAAPCSSQTFSGTGGEQQSYASCADLPRLGATLHYNYTAATNTVAVAFRAPQGKGADGWVAWGINPSGRSGMVGTQAVVAFQSSNGSLVAYPTVLDSYAPSMAPAAPGDLAFPVSGVAAEYADGKEMVVYATLALPAGKGSKFTNVWQQGAAVVNDVPAVHPTTGDNILSTATIDFSA

SEQ ID NO: 3479 - DNA, 1179 bp, Sorghum bicolor
  misc_feature: Ceres ANNOT ID no. 6031626
  misc_feature: Encodes the peptide sequence at SEQ ID NO 3480
atgaacaaggacaaggctccgatgccgggagatggcggccccagcgacggcttgccgccgcagtccacgcgccgtgccggggcgccgccctcgtcgtcaaccccaccaccggagtacgacatcagccgcatgccggacttcccaacccggagcaccggccaccggcgtgcgcactccgagatcctgggcctccccgacgacctcgacctcagcgctcccggaggcggcgacggaccatcgctgtcggacgagaacgacgaggagctcttctccatgttccttgatgtggacaagctgaactcatcgtgcggggcgtcgtcggaggccgaggctgagtcctcgtccgccgcgggtggcggcggtgagggggctgagctgggccacgcgcccaggccaaggcatcagcatagccagtccatggatgagtccatgtcgatcaaggcggaacagctggtgggggcgccggggatggaaggcatgtcgtctgcagaggccaagaaagcagtgtctgcggcaaaacttgctgagcttgctcttgttgacccaaagagggctaaaaggatttgggctaatagacaatctgctgcaagatcgaaggaaaggaagatgcgatatattgctgaacttgagcgcaaggtgcaaaccttgcaaacagaagccacaacattgtcggctcagctagcattgctgcagagagacaccactggactaacaactgagaatagtgagctgaaggttcgcctgcagaccatggaacagcaagtccacttacaagatgctttgaatgacacactgaaagcagaggtccagcggctgaaggtggcaacaggacaggtggccaatggtggtggagggatgatgaactttggtgccatgccacgctcgtttggaggcaaccagcagatgttccacaacaaccaagcgatgcaatccatgctggcaacgcaccagctgcagcagctccagctccactcccagcctcagcagcagtcgcaacattctcagcaccagcaccagcaccagcaactgcattcgattcaggcgcagcaacagcagcagcaactgcactcgctgcaggcgcagcagctccagcaggtggcgagagacctcaagatgaaagcgcatctggccggccaaggccagtggggcgatgggaagtctgggagcagtggcagctaa

SEQ ID NO: 3480 - protein, 392 aa, Sorghum bicolor
  misc_feature: Ceres ANNOT ID no. 6031626
  misc_feature (181)..(242): Pfam Id: bZIP_1 Pfam Desc: bZIP transcription factor
  misc_feature (179)..(233): Pfam Id: bZIP_2 Pfam Desc: Basic region leucine zipper
  misc_feature (1)..(392): NCBI GI: 68565720 NCBI Desc: transcription factor rf2a
  misc_feature (1)..(392): NCBI GI: 50726244 NCBI Desc: transcription activator rf2a-like [oryza sativa (japonica cultivar-group)]
  misc_feature (1)..(392): NCBI GI: 115480153 NCBI Desc: os09g0516200 [oryza sativa (japonica cultivar-group)]
  misc_feature (1)..(392): NCBI GI: 2253278 NCBI Desc: rf2a [oryza sativa]
  misc_feature (39)..(365): NCBI GI: 79593542 NCBI Desc: dna binding / transcription factor [arabidopsis thaliana]
  misc_feature: The sequence is a functional homolog of SEQ ID NO 1046 in the 10/225,066US patent application
  misc_feature: The sequence is a functional homolog of SEQ ID NO 2358 in the 10/374,780US patent application
  misc_feature: The sequence is a functional homolog of SEQ ID NO 2388 in the 10/374,780US patent application
  misc_feature: The sequence is a functional homolog of SEQ ID NO 34 in the 10/225,066US patent application
  misc_feature: The sequence is a functional homolog of SEQ ID NO 358 in the 10/412,699US patent application
  misc_feature: The sequence is a functional homolog of SEQ ID NO 412 in the 10/412,699US patent application
  misc_feature: The sequence is a functional homolog of SEQ ID NO 835 in the 11/479,226US patent application
  misc_feature: Useful for making plants with modulated growth and phenotype characteristics
  misc_feature: The sequence is a functional homolog of SEQ ID NO 358 in the 20040045049 US patent application
  misc_feature: The sequence is a functional homolog of SEQ ID NO 412 in the 20040045049 US patent application
  misc_feature: The sequence is a functional homolog of SEQ ID NO. 337 in the 11/188,298 US application
MNKDKAPMPGDGGPSDGLPPQSTRRAGAPPSSSTPPPEYDISRMPDFPTRSTGHRRAHSEILGLPDDLDLSAPGGGDGPSLSDENDEELFSMFLDVDKLNSSCGASSEAEAESSSAAGGGGEGAELGHAPRPRHQHSQSMDESMSIKAEQLVGAPGMEGMSSAEAKKAVSAAKLAELALVDPKRAKRIWANRQSAARSKERKMRYIAELERKVQTLQTEATTLSAQLALLQRDTTGLTTENSELKVRLQTMEQQVHLQDALNDTLKAEVQRLKVATGQVANGGGGMMNFGAMPRSFGGNQQMFHNNQAMQSMLATHQLQQLQLHSQPQQQSQHSQHQHQHQQLHSIQAQQQQQQLHSLQAQQLQQVARDLKMKAHLAGQGQWGDGKSGSSGS

SEQ ID NO: 3481 - DNA, 1716 bp, Sorghum bicolor
  misc_feature: Ceres ANNOT ID no. 6031628
  misc_feature: Encodes the peptide sequence at SEQ ID NO 3482
atggcgaccgccgagcccggcccgcccccgccgaagcccgcctgcgccgtcacgttcggtcgctgcaccctcctcggccgctacctggccgcggcgctcgctgcctccggccgctggtcagccgtcgccatcctcgacccctcctcccccacctcgccgtccccggcgcccggcccgtctgcctcccacctcgtctaccaccacgacgtcgacctctcggaccacgagcgcctcgtctccgcgctcgccggcgccgcggctgtcttccatgtggacgccaccaccgcggccgcctccgggagcgacgggtccttcctctccctgcaccgcttcgccgtcgagggcacgaggcggctcctcgcggcctgccgctccgccggcgtggagaggttggtgtacaccggctcggccgacgtggtcgcttctgttgcccgcgatgtgatcaacgccgacgaggactccgcgccctaccctgacaagtttggaaatgcggtgagcgagctgagggcgcaggtagagatgatggtgctcggtgcggacggggtggacgggatgaggacatgcgtgctgcgaccgagcaatctcttcggtccgggcgattccagcttggtgaggtttgttgctggatatgcaaggtctcccttgggcaagtttgtaataggcagtggcagtaacatgtctgattttacctatgtggaaaatgtggcccatgccaatatttgtgctgagcaagccttgtcttcgaatgcagcttccgtagctggcaagccattttttgttacgaatgatgaacctatggaaacatgggagtttatgaattgcattatggaagccatgggttgtcagaggcccaggattaatcttcctgccaagatgttaacgtctgcagccttggtttccaaaatgattcatcacaggcttggttttcaaatgctttccacccctcttctccattcagatacaatatacttcttgtcatgcactagaacctttaacacttcaagagccagaagattacttggataccacccgattgtaacattggaggatggaattatgagaactgttgggtcatttacagaactatcagataatttggggttgtcaagaaaacaaggctcctgcggatcatcgaaggtagataagctgctaggaagtggaacagctgctgatattcttctttggagggatgaaaagagaaccttttcatttgtcacagtattgtttctggttttctactggttcctgctttcagacagaacttttgtttcatcggctgccaaatttcttctagtgctctcccttggtctctttatccatggtttgctgccttcagaagtgtttggttttacagttgagaaggttacacctgagcattttgaagtatcacacttagcattgaggaattcacttatgtctctggcttctgcatggaatgggagcattcataaactaagggttctagcagaaggtgaaaactggagcttacttttgaaggtatttgcatttctgtacagcatcaaactaatgctgagctttcagttcagaattctgatgggtcttgtattggcatccatgttcattgtcttcattgtctatgaacaatgcgaggaagaaattgacagtttggtggcaattgcttcagtcaaaatcaactggctaatagatagagtagttggaaatttgccagcctctttgaaggcgtatatagcctag

SEQ ID NO: 3482 - protein, 571 aa, Sorghum bicolor
  misc_feature: Ceres ANNOT ID no. 6031628
  misc_feature (16)..(290): Pfam Id: 3Beta_HSD Pfam Desc: 3-beta hydroxysteroid dehydrogenase/isomerase family
  misc_feature (16)..(254): Pfam Id: Epimerase Pfam Desc: NAD dependent epimerase/dehydratase family
  misc_feature (389)..(569): Pfam Id: Reticulon Pfam Desc: Reticulon
  misc_feature (1)..(571): NCBI GI: 50726248 NCBI Desc: 3-beta-hydroxysteroid dehydrogenase-like [oryza sativa (japonica cultivar-group)]
  misc_feature (15)..(544): NCBI GI: 42569340 NCBI Desc: 3-beta hydroxysteroid dehydrogenase/isomerase family protein [arabidopsis thaliana]
  misc_feature (113)..(544): NCBI GI: 79323109 NCBI Desc: 3-beta-hydroxy-delta5-steroid dehydrogenase [arabidopsis thaliana]
  misc_feature (15)..(381): NCBI GI: 63034416 NCBI Desc: 4alpha-carboxysterol-c3-dehydrogenase/c4-decarboxylase isoform 1-1 [arabidopsis thaliana]
  misc_feature (15)..(381): NCBI GI: 18401656 NCBI Desc: 3-beta hydroxysteroid dehydrogenase/isomerase family protein [arabidopsis thaliana]
MATAEPGPPPPKPACAVTFGRCTLLGRYLAAALAASGRWSAVAILDPSSPTSPSPAPGPSASHLVYHHDVDLSDHERLVSALAGAAAVFHVDATTAAASGSDGSFLSLHRFAVEGTRRLLAACRSAGVERLVYTGSADVVASVARDVINADEDSAPYPDKFGNAVSELRAQVEMMVLGADGVDGMRTCVLRPSNLFGPGDSSLVRFVAGYARSPLGKFVIGSGSNMSDFTYVENVAHANICAEQALSSNAASVAGKPFFVTNDEPMETWEFMNCIMEAMGCQRPRINLPAKMLTSAALVSKMIHHRLGFQMLSTPLLHSDTIYFLSCTRTFNTSRARRLLGYHPIVTLEDGIMRTVGSFTELSDNLGLSRKQGSCGSSKVDKLLGSGTAADILLWRDEKRTFSFVTVLFLVFYWFLLSDRTFVSSAAKFLLVLSLGLFIHGLLPSEVFGFTVEKVTPEHFEVSHLALRNSLMSLASAWNGSIHKLRVLAEGENWSLLLKVFAFLYSIKLMLSFQFRILMGLVLASMFIVFIVYEQCEEEIDSLVAIASVKINWLIDRVVGNLPASLKAYIA

SEQ ID NO: 3483 - DNA, 1011 bp, Sorghum bicolor
  misc_feature: Ceres ANNOT ID no. 6031629
  misc_feature: Encodes the peptide sequence at SEQ ID NO 3484
atgaggatgctgtcgaaggcgtgctcgatcgtggcctcctccctcccgcgctgctcctcctccgccgcccccacgatgagggggcagccgtccttgctgccaagcgtgcggaagcaatggcccgggaagccactgctgtatggaatcggcaccctcttggtcatgccactgaggacactgtatggagtgggtcgtgtttttggcgcagggcggttcctctgcaacatgaccagcgtctcttcgtcgctgcaaattgagcttgtaccatgccttcgagacaactatgcatatatcctgcatgatgttgatactggaacagttggagttgtggatccttctgaggctatgcctattatcaatgcattggaaaagaggaaccagaacttgacttatatactgaacacccatcatcactatgatcatactggtggaaacttggaattgaaggcaaaatatggtgcaaaggtaattggttctgagaaagataaggacagaatacctggtattgacatcacccttaaggagggtgacacatggatgtttgctggccatcaagttcttgtactggaaactcctgggcatacatcaggtcatgtgtgctattatttcgctggttctggagctatatttacaggtgacaccttgttcaatctatcatgcggaaagcttttcgaagggactccacagcagatgtattcctcactccagaaaattacagctctacctgatgatacaaaagtatactgtgggcatgaatataccttgagtaattcaaagtttgccttgagtgtagaaccaggaaataaagcattgcaggaatatgctgcaaatgcagctgagttgcgtaataagaatatacccacggtgccaacaacaattggaagggagaaggaatgcaatcctttcttgcggacctccaatccagaaattaagagcacactgtccattccagatcatttcgatgaagatcgggtgcttgaagttgtccgtcgagcaaaagataacttctga

SEQ ID NO: 3484 - protein, 336 aa, Sorghum bicolor
  misc_feature: Ceres ANNOT ID no. 6031629
  misc_feature (93)..(251): Pfam Id: Lactamase_B Pfam Desc: Metallo-beta-lactamase superfamily
  misc_feature (1)..(336): NCBI GI: 50726249 NCBI Desc: glyoxalase ii [oryza sativa (japonica cultivar-group)]
  misc_feature (1)..(336): NCBI GI: 16209608 NCBI Desc: glyoxalase ii [oryza sativa]
  misc_feature (1)..(336): NCBI GI: 21070362 NCBI Desc: glyoxalase ii [pennisetum glaucum]
  misc_feature (3)..(336): NCBI GI: 28143946 NCBI Desc: glyoxalase ii [brassica juncea]
  misc_feature (10)..(336): NCBI GI: 8810475 NCBI Desc: contains similarity to glyoxalase ii isozyme from arabidopsis thaliana gbu90927 and is a member of the metallo-beta-lactamase seperfamily pf00753. ests gbav519053,
  misc_feature (10)..(336): NCBI GI: 8810475 (continued) gbav535897, gbav535667, gbav556046, gbbe039169, gbav525509 come from this gene
  misc_feature (1)..(336): SWISSPROT Homolog: EC 3.1.2.6 Hydroxyacylglutathione hydrolase 1, mitochondrial precursor
MRMLSKACSIVASSLPRCSSSAAPTMRGQPSLLPSVRKQWPGKPLLYGIGTLLVMPLRTLYGVGRVFGAGRFLCNMTSVSSSLQIELVPCLRDNYAYILHDVDTGTVGVVDPSEAMPIINALEKRNQNLTYILNTHHHYDHTGGNLELKAKYGAKVIGSEKDKDRIPGIDITLKEGDTWMFAGHQVLVLETPGHTSGHVCYYFAGSGAIFTGDTLFNLSCGKLFEGTPQQMYSSLQKITALPDDTKVYCGHEYTLSNSKFALSVEPGNKALQEYAANAAELRNKNIPTVPTTIGREKECNPFLRTSNPEIKSTLSIPDHFDEDRVLEVVRRAKDNF

SEQ ID NO: 3485 - DNA, 1752 bp, Sorghum bicolor
  misc_feature: Ceres ANNOT ID no. 6031631
  misc_feature: Encodes the peptide sequence at SEQ ID NO 3486
  misc_feature: Up-regulated in shoot tissues in response to salicylic acid treatment
atggcgccgcaggccgcggggtcggccccggcggtggcggcgctcgggttcctcctcccgacctgctgggagatcgaggtcacgtgcgccgccgcgatgatcctcgtcgcgctctacgctgcctacgagctcctcaacccgcgcccctcgcaggcggcagcggcgggcgacgccgacgagctcctcgtgcgggggctggacggcgccgacaagctcgaattgttggctgcaaaaaatttgatggcggcgaacttaaatgggacatctgacccgtatgcattgatcacttgtggcgcagagaagcgtttcagttctatggttcctggctcaagaaacccaatgtggggagaggaattcaatttttttgttgatagtcttcctgtaaagataaatgtcaagatatatgactgggacattgtatggaaaagcacaatccttggttctgttactgttcctgttgagtctgaggcaccgagtggaccagtttggcatacacttgacagcacatcaggccaggtgtgtcttcatattaaagtaatcaaggttcatgaaagttcctccagggctctaaacagctcagctgaggctggcgctcgtagaaggatttccttggataagcaaggtcctactgtagttcatcaaaagccaggtcctttgcagacaatttttgaactacctccggacgaggttgttgaccacagttattcatgtgcacttgagaggtcatttttgtatcatggacgcatgtatgtctcttcatggcatatttgctttcattcaaatgtcttttcaaagcaaatcaaggttgtgattcctttgagagatattgacgagataaggagaagtcagcatgcagttattaatccagctattacaatatttcttcgaatgggagctggaggatttggtgttcctccattaggatgtccagatggaagagtcaggtacaaatttgcatcgttttggaacagaaaccatacatttagatcattgcagcgagctgtgaagaacttccaaatgatgatagaggctgagaaacaggaacgtgctcagtctgcattacgtgcacacagtagttcaagaaaaactagcaagcaggagataaatgtcccagaagattgtgctgcattaacagggcagttacaaccttttgttaaagaagaagttttggtccctgtattcaatggaacatttccatgtacagcagaacagttctttagtattcttttgagtgatgattcaaattacataacagagtatcgaacagatcggaaggataaagatataaatctgggccaatggcacattgcagatgagtatgatggccaggtgagggaacttaattgtaaatcaatatgccatagtccaatgtgccctccttattcagcgatgacagagtggcagcatatagttctttcagctgacaaaatggatctggtatttgagacagtacagcaagttcatgatgttccatttggttccttcttcgaggtgcattgtaggtggtctgtgaaaactatcagttctagctcgtgcagtctcaacatcagtgctggtgcgcatttcaagaaatggtgcataatgcagtctaagataaagagtggtgctgtagatgagttgaagaaagaagtcaaggaaatgttagactttgcacaggggtatatgctcaaagttaggtctcctgaccaagagaacagtaatctcgctcaacaagacaacatggcgccggatgcgcctcctgatttagagtga

SEQ ID NO: 3486 - protein, 583 aa, Sorghum bicolor
  misc_feature: Ceres ANNOT ID no. 6031631
  misc_feature (217)..(283): Pfam Id: GRAM Pfam Desc: GRAM domain
  misc_feature (70)..(150): Pfam Id: C2 Pfam Desc: C2 domain
  misc_feature (52)..(575): NCBI GI: 50726252 NCBI Desc: c2 domain-containing protein-like [oryza sativa (japonica cultivar-group)]
  misc_feature (13)..(565): NCBI GI: 140070025 NCBI Desc: c2; gram [medicago truncatula]
  misc_feature (74)..(351): NCBI GI: 116310301 NCBI Desc: osigba0106g07.15 [oryza sativa (indica cultivar-group)]
  misc_feature (74)..(351): NCBI GI: 38344486 NCBI Desc: osjnba0022h21.21 [oryza sativa (japonica cultivar-group)]
  misc_feature (74)..(329): NCBI GI: 51814441 NCBI Desc: no pollen; osnop [oryza sativa (japonica cultivar-group)]
  misc_feature: Up-regulated in shoot tissues in response to salicylic acid treatment
MAPQAAGSAPAVAALGFLLPTCWEIEVTCAAAMILVALYAAYELLNPRPSQAAAAGDADELLVRGLDGADKLELLAAKNLMAANLNGTSDPYALITCGAEKRFSSMVPGSRNPMWGEEFNFFVDSLPVKINVKIYDWDIVWKSTILGSVTVPVESEAPSGPVWHTLDSTSGQVCLHIKVIKVHESSSRALNSSAEAGARRRISLDKQGPTVVHQKPGPLQTIFELPPDEVVDHSYSCALERSFLYHGRMYVSSWHICFHSNVFSKQIKVVIPLRDIDEIRRSQHAVINPAITIFLRMGAGGFGVPPLGCPDGRVRYKFASFWNRNHTFRSLQRAVKNFQMMIEAEKQERAQSALRAHSSSRKTSKQEINVPEDCAALTGQLQPFVKEEVLVPVFNGTFPCTAEQFFSILLSDDSNYITEYRTDRKDKDINLGQWHIADEYDGQVRELNCKSICHSPMCPPYSAMTEWQHIVLSADKMDLVFETVQQVHDVPFGSFFEVHCRWSVKTISSSSCSLNISAGAHFKKWCIMQSKIKSGAVDELKKEVKEMLDFAQGYMLKVRSPDQENSNLAQQDNMAPDAPPDLE

SEQ ID NO: 3487 - DNA, 2331 bp, Sorghum bicolor
  misc_feature: Ceres ANNOT ID no. 6031653
  misc_feature: Encodes the peptide sequence at SEQ ID NO 3488
atgctggcgcaggtgctgctcgtgcatctgctcctcctcctcctcctcgccgccacgtcctcagccgaccaccaccgccgccattactggggcagaagggcgctgcacgagccgctgttccctttggagagcacgcccgcgctgccgccgccgccgccgcccgcgccgttcttcccgttcttgccaggcgccgcggcgccgccgacggtgacgccggatgtcggctccgcctccaccccggcggacaccgccggcccgggtgacgcgtcgtcgtcctcctcgtcgtcgccgcaccccacggcgccggccaacatctcgtccttggccgcgctgcccgtctcctcccacaccacgccgctccggtccttcctctcctcccaccgcctcctcaccgtcctcgtcctggtcgtcgccgttgctgcggccgtgctctccgccgcgctcgtttacatcctcgcccgccgccaacgtcgtcactctcccaaggaggaacctgcggtgtacacaaagccctcctcgcttgcaccggccaaccctgtgctctacgatggtggcgaccagcatggccggggctcgacggccaccgtctccagcaccagctcgccggagctcaggccgatgccgcctttgccccggcagttccagcagacgcggatgaactttccgtcatgttcaaaatccgttcctgacaccggaacaggaggtaagcgaggatcagagggtgctcctcctccgcggccgccgcctcctcctccaccgccgcctccaatgccaccggtgaaagacaagggcggcgccacagcagcagcatctgctcctccggcgccgccgccacctctgccccgagccggtaacggcagcggctggttgccccggcggcactccgagcgccaagcgaccacggtcatcagggcctcggcgagcgcagttcacccagaagagtctccagggcgcgcgccgtcagagaaacaaacggactcggacgcggacgcggctgctctgccgaagctgaagccgttgcactgggataaggtgcgcgcgagctctggccgaccgacggtgtgggatcagctgaaggcgagctctttccgagtgaacgaagagatgattgagacattattcgtctcaaattcgacatggagatcgtccaagagtggaaccaaggggccaaattccagtttgtgcagccaggagaacaaggtcctcgacccgaagaaatcacagaacattgcgataatgctaagggcgctcaatgcgaccaaggaagaagtgtgcaaggcactcttagatgggcaggcagagagccttggaactgagctcttggagatgctgctgaagatggcgcctagcagggaagaggagatcaagttgaaagaatacagggaggatgctgtgtctaagcttggccctgctgagagcttcctcaaggcggtgctcgcgattccatttgctttcaagagagtggaagcgatgctgtacatcaccaactttgatttagaggttgactacctcaagacctcctacaaaactcttgaggcagcatgtgaagagcttcagggcagcaggttgttccacaaaatattagacgcagtcctgaagaccggtaaccgcatgaacactggcacgaaccgtggaaacgcccatgccttcaagctggatgcactcctcaagttagttgatgtgaagggtgccgatggcaagacgactctcctacacttcgtcatcgaagaaatcatcaagtctgaaggagctaacattttagccaccggccaaacatctgaccaggcgagtgcccttgcagatgagctgcaatgcaagaaggtaggcctgaaaattgtggcaagccttggcggtgagctcaacagtgtcaagaaggcggcagcaatggactccgacgcgctggccagctgcgtctccaaactctcctccggcgtcagcaagatcagcgaggtcctgcacttaaaccagcagcttctcggttctgatgacagctgcaagaggttccgtgcctcaattggcgagttcctgcaaaaggccgaggccgagatcgccggggtgcaggctcaggagggccgcgccctcgccctcgtcagggagacgaccgaattcttccatggcgactcggccaaagaggaaggccacccgctgaggatcttcatggtggtgcgcgacttcctcacagccctcgatcacgtctgcaaggacgttgtgaagatgaacgagcgggcggcggccggtgggtcatcgcggcgggtggggaacatgcacgttcctgcggtgtttaactcggtgcggtccaccagttcgtcggaggagagctcgtcgccctag

SEQ ID NO: 3488 - protein, 776 aa, Sorghum bicolor
  misc_feature: Ceres ANNOT ID no. 6031653
  misc_feature (328)..(730): Pfam Id: FH2 Pfam Desc: Formin Homology 2 Domain
  misc_feature (1)..(775): NCBI GI: 50726257 NCBI Desc: diaphanous protein-like [oryza sativa (japonica cultivar-group)]
  misc_feature (212)..(776): NCBI GI: 6691125 NCBI Desc: fh protein nfh2 [nicotiana tabacum]
  misc_feature (246)..(775): NCBI GI: 110741802 NCBI Desc: formin-like protein ahf1 [arabidopsis thaliana]
  misc_feature (271)..(776): NCBI GI: 124361016 NCBI Desc: actin-binding fh2 [medicago truncatula]
  misc_feature (226)..(776): NCBI GI: 92866950 NCBI Desc: actin-binding fh2 [medicago truncatula]
MLAQVLLVHLLLLLLLAATSSADHHRRHYWGRRALHEPLFPLESTPALPPPPPPAPFFPFLPGAAAPPTVTPDVGSASTPADTAGPGDASSSSSSSPHPTAPANISSLAALPVSSHTTPLRSFLSSHRLLTVLVLVVAVAAAVLSAALVYILARRQRRHSPKEEPAVYTKPSSLAPANPVLYDGGDQHGRGSTATVSSTSSPELRPMPPLPRQFQQTRMNFPSCSKSVPDTGTGGKRGSEGAPPPRPPPPPPPPPPMPPVKDKGGATAAASAPPAPPPPLPRAGNGSGWLPRRHSERQATTVIRASASAVHPEESPGRAPSEKQTDSDADAAALPKLKPLHWDKVRASSGRPTVWDQLKASSFRVNEEMIETLFVSNSTWRSSKSGTKGPNSSLCSQENKVLDPKKSQNIAIMLRALNATKEEVCKALLDGQAESLGTELLEMLLKMAPSREEEIKLKEYREDAVSKLGPAESFLKAVLAIPFAFKRVEAMLYITNFDLEVDYLKTSYKTLEAACEELQGSRLFHKILDAVLKTGNRMNTGTNRGNAHAFKLDALLKLVDVKGADGKTTLLHFVIEEIIKSEGANILATGQTSDQASALADELQCKKVGLKIVASLGGELNSVKKAAAMDSDALASCVSKLSSGVSKISEVLHLNQQLLGSDDSCKRFRASIGEFLQKAEAEIAGVQAQEGRALALVRETTEFFHGDSAKEEGHPLRIFMVVRDFLTALDHVCKDVVKMNERAAAGGSSRRVGNMHVPAVFNSVRSTSSSEESSSP

SEQ ID NO: 3489 - DNA, 1689 bp, Sorghum bicolor
  misc_feature: Ceres ANNOT ID no. 6031662
  misc_feature: Encodes the peptide sequence at SEQ ID NO 3490
  misc_feature: Up-regulated in shoot tissues in response to methyl jasmonate treatment
  misc_feature: Up-regulated in shoot tissues in response to salicylic acid treatment
atggacaagcaatccagcacccggcatggcaccctagagaaattgaagagcttccgggggatagagaagcagagaagcttcaagttcttgtccatggagaagcagcagagcttcaaaaggaacaaggacagccctgggaagcggggtgacaccgagctccaccttgcggcgagagctggcagtgttgcacatgtccagaggatccttgcggagtgtgatccagagctggtggtggagttagctgctcgccagaatcaggacggtgagactgcgttgtatgtgtctgctgagaaggggcatgttgaggttgtgtgtgagattttgaaggcttctgatgtgcagtcagccggactcaaggccagtaacagcttcgatgcattccatattgcggcaaagcagggccatttggatgtcttgaaggagctgttacaggcctttccctcattagcaatgacaacaaattctgtaaatgccacagctttggacactgctgcaactcagggccacattgacattgttaatcttctgctagaaacagatgcaagccttgctaggattgcaagaaataatggcaagacagttttgcattcagcagcgagaatgggccatgtggaggtggtcactgcactgttaaataaggatccagggattggtttcagaacagataagaagggacaaacagctctacacatggcttcaaaaggccaaaatgcagaaattctgctcgagttgttgaagcctgatgtctcagttatccatgtagaagacggcaaggggaatagaccattgcatgttgcaactcgaaagggaaacaccattatggttcagaccctaatatcagttgaggggattgaaatcaatgcggttaatagagctggagagactgcttttgctattgcagagaaacaaggtaatgaagagctcattaacatcctgagagaggttggtggagaaactgcaaaagagcaagtaaatcctcctaatccagcaaagcagcttaagcagacagtcagcgatatcaggcatgatgttcaatcacagatcaagcaaacacgccagaccaaaatgcaattccaaaaaatcaagaagagaattcaaaagctccacattggtgggctaaacaacgccattaactccaacactgttgttgcagtgcttattgccaccgttgcctttgccgccattttccaactccctggtaattttctggaggatataactcaagcaccttatccagacatgaccttggggcaagcattgatagccagtgatccagcctttataatcttcttggtttttgacgctttggctctctttatctcgcttgctgttgtagtagtccagacatctctaattgttgttgagcagaaggccaagaagaagatggtctttgtgataaacaagttgatgtggcttgcatgcctctgcatctcggcagccttcatagcactaacctacgttgtcgtgggtcgagatgatgagtggctggcttggtgcacaatggcaatcggcactgttatcatggtggccactctcggttccatgtgctattgcattgttgctcacaggatggaagagaagagcatgaggaagatcaggaggacctccacaagccagtcattttccatatcaattgactcggaaacggagctgatgaacagtgagtacaagaagatgtatgccctttag

SEQ ID NO: 3490 - protein, 562 aa, Sorghum bicolor
  misc_feature: Ceres ANNOT ID no. 6031662
  misc_feature (190)..(222): Pfam Id: Ank Pfam Desc: Ankyrin repeat
  misc_feature (258)..(291): Pfam Id: Ank Pfam Desc: Ankyrin repeat
  misc_feature (37)..(562): NCBI GI: 42407837 NCBI Desc: ankyrin-like protein [oryza sativa (japonica cultivar-group)]
  misc_feature (1)..(562): NCBI GI: 4887754 NCBI Desc: ankyrin-like protein [arabidopsis thaliana]
  misc_feature (39)..(562): NCBI GI: 92897646 NCBI Desc: ankyrin [medicago truncatula]
  misc_feature (39)..(562): NCBI GI: 8439897 NCBI Desc: it contains ank repeat pf00023. est gbai996003 comes from this gene. [arabidopsis thaliana]
  misc_feature (42)..(562): NCBI GI: 8777346 NCBI Desc: ankyrin-like protein [arabidopsis thaliana]
  misc_feature: The sequence is a functional homolog of SEQ ID NO 340 in the 10/666,642US patent application
  misc_feature: Useful for making plants with modulated growth and phenotype characteristics
  misc_feature: The sequence is a functional homolog of SEQ ID NO 340 in the 20070033671 US patent application
  misc_feature: Up-regulated in shoot tissues in response to methyl jasmonate treatment
  misc_feature: Up-regulated in shoot tissues in response to salicylic acid treatment
MDKQSSTRHGTLEKLKSFRGIEKQRSFKFLSMEKQQSFKRNKDSPGKRGDTELHLAARAGSVAHVQRILAECDPELVVELAARQNQDGETALYVSAEKGHVEVVCEILKASDVQSAGLKASNSFDAFHIAAKQGHLDVLKELLQAFPSLAMTTNSVNATALDTAATQGHIDIVNLLLETDASLARIARNNGKTVLHSAARMGHVEVVTALLNKDPGIGFRTDKKGQTALHMASKGQNAEILLELLKPDVSVIHVEDGKGNRPLHVATRKGNTIMVQTLISVEGIEINAVNRAGETAFAIAEKQGNEELINILREVGGETAKEQVNPPNPAKQLKQTVSDIRHDVQSQIKQTRQTKMQFQKIKKRIQKLHIGGLNNAINSNTVVAVLIATVAFAAIFQLPGNFLEDITQAPYPDMTLGQALIASDPAFIIFLVFDALALFISLAVVVVQTSLIVVEQKAKKKMVFVINKLMWLACLCISAAFIALTYVVVGRDDEWLAWCTMAIGTVIMVATLGSMCYCIVAHRMEEKSMRKIRRTSTSQSFSISIDSETELMNSEYKKMYAL

SEQ ID NO: 3491 - DNA, 831 bp, Sorghum bicolor
  misc_feature: Ceres ANNOT ID no. 6031671
  misc_feature: Encodes the peptide sequence at SEQ ID NO 3492
atggacaagcttacttccccgtcctccccgcgacccgcctcgttctccttttccgagccgtcatgcacgattctcgaactaccttcctgcgaagtcccggagcagtggctgctcgatgacgatgtccttgtgggcaagaacgagaacgatggtattggcgcctgcctgtgggagatgccggcggcggacggcggcgtgctctcccctgactctgagctcgccaagctgctcccgagcctctcagcgccggctccgcagcgccaggcgaagcggcggggccggaagccagggccgcggccggggccgggcgccggggcagccgccggtcacgtggagtccgagcggcagcgccgcgagaagctgaaccggcggttctgcgacctccgcgccgccgtgcccaccgtgtcgcgcatggacaaggcctccctcctcgcggacgccgcgcggtacattgccgagctccgcgcccgcgtggcgcagctcgagtccgaggcgaggcacgctgccgtggcgaggtgggaggggatcagcgccgacggcggcggccacggcgaccaagccgcggccgtcgtcgacggtgagctgtacgtgcgggaggtgggccgggacacggccgttgtgcgcgtgacgagcggcgcgagccacgcgcccgcgctgctgatgggtgcgctccggtcgctggagctgcaggtacagcacgcgtgcgtgagccgcgcgcacggcgtcaccacgcaggatgttgtcgtcgacgtgccccccgctgccaccgcgctgcaggacgacgaaggtctacgcatggcgctgctccagaggctgcaggccggcgactag

SEQ ID NO: 3492 - protein, 276 aa, Sorghum bicolor
  misc_feature: Ceres ANNOT ID no. 6031671
  misc_feature (106)..(155): Pfam Id: HLH Pfam Desc: Helix-loop-helix DNA-binding domain
  misc_feature (1)..(276): NCBI GI: 42407849 NCBI Desc: phaseolin g-box binding protein pg1-like [oryza sativa (japonica cultivar-group)]
  misc_feature (61)..(164): NCBI GI: 68342448 NCBI Desc: basic helix-loop-helix transcription factor protein [rheum australe]
  misc_feature (84)..(272): NCBI GI: 45477841 NCBI Desc: myc protein [oryza sativa]
  misc_feature (62)..(251): NCBI GI: 1142619 NCBI Desc: phaseolin g-box binding protein pg1
  misc_feature (45)..(272): NCBI GI: 9758512 NCBI Desc: bhlh protein-like [arabidopsis thaliana]
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 18 in the 10/412,699US patent application
  misc_feature: The sequence is a functional homolog of SEQ ID NO 184 in the 10/412,699US patent application
  misc_feature: The sequence is a functional homolog of SEQ ID NO 2 in the 10/374,780US patent application
  misc_feature: The sequence is a functional homolog of SEQ ID NO 397 in the 11/479,226US patent application
  misc_feature: The sequence is a functional homolog of SEQ ID NO 46 in the 10/374,780US patent application
  misc_feature: The sequence is a functional homolog of SEQ ID NO 464 in the 11/435,388US patent application
  misc_feature: The sequence is a functional homolog of SEQ ID NO 590 in the 11/435,388US patent application
  misc_feature: The sequence is a functional homolog of SEQ ID NO 6 in the 10/225,068US patent application
  misc_feature: The sequence is a functional homolog of SEQ ID NO 955 in the 10/374,780US patent application
  misc_feature: Useful for making plants with modulated growth and phenotype characteristics
  misc_feature: The sequence is a functional homolog of SEQ ID NO 12 in the 20040045049 US patent application
  misc_feature: The sequence is a functional homolog of SEQ ID NO 18 in the 20040045049 US patent application
  misc_feature: The sequence is a functional homolog of SEQ ID NO 184 in the 20040045049 US patent application
  misc_feature: The sequence is a functional homolog of SEQ ID NO 955 in the 20060162006 US patent application
  misc_feature: The sequence is a functional homolog of SEQ ID NO. 414 in the 11/188,298 US application
  misc_feature: The sequence is a functional homolog of SEQ ID NO. 483 in the 11/188,298 US application
MDKLTSPSSPRPASFSFSEPSCTILELPSCEVPEQWLLDDDVLVGKNENDGIGACLWEMPAADGGVLSPDSELAKLLPSLSAPAPQRQAKRRGRKPGPRPGPGAGAAAGHVESERQRREKLNRRFCDLRAAVPTVSRMDKASLLADAARYIAELRARVAQLESEARHAAVARWEGISADGGGHGDQAAAVVDGELYVREVGRDTAVVRVTSGASHAPALLMGALRSLELQVQHACVSRAHGVTTQDVVVDVPPAATALQDDEGLRMALLQRLQAGD

SEQ ID NO: 3493 - DNA, 891 bp, Sorghum bicolor
  misc_feature: Ceres ANNOT ID no. 6031672
  misc_feature: Encodes the peptide sequence at SEQ ID NO 3494
atggacgacctgctctccccatgctcctccttctccccaccgtcgccaccgtccttcttctcccacgccggccaccacccagtcatcgagttcacctcctgtgacgtcccggagcaatggctactcgacgacgtcttcgtggccaagaacgagggcgacgacgacgtggacgacctatggccagtgggaagctcgctctcccaggactctgagctcaccgagcagccgcttcctcctcagccaccgccgccgcagcagcaggcggagctgagcgtcgtcaaggctccggcgcagcagcagcgcccagggaagcggcgggggcggaagcccgggccccgcccggacggccccaccgtcagccacgtggaggccgagcgtcagcgccgggagaagctgaaccgccggttctgcgacctccgcgccgccgtccccaccgtgtcgcgcatggacaaggcctccctgctcgcggacgccgccgcctacatcgcggagctgcgcgcccgtatcgcgcggctggaggccgagtccaggcgggcccccgcggcgaggtgggagcccgtcgtagctgcctgcggcgctcatgaggcgggaccgggagccggcggcggcgccgacgaggtggtggaggtgcggatgctggggccggacgcggccgcggtgcgcgcgacgagcgcggccccgcacgcgcccgcgcgcctgatgagcgcgctgcgggctctggagctgcacgtgcggcacgcctgcgtaacccgcgtgaacggcatgacggttcaggacgtcgtggttgacgtggcaaccccgttgcaggacgacgacgacgacgacggccgcctccgtgccgcgctgctccagatgatgcaggacagtgcggctacgtacgtacctaactag

SEQ ID NO: 3494 - protein, 296 aa, Sorghum bicolor
  misc_feature: Ceres ANNOT ID no. 6031672
  misc_feature (117)..(166): Pfam Id: HLH Pfam Desc: Helix-loop-helix DNA-binding domain
  misc_feature (55)..(287): NCBI GI: 42407849 NCBI Desc: phaseolin g-box binding protein pg1-like [oryza sativa (japonica cultivar-group)]
  misc_feature (89)..(283): NCBI GI: 2943789 NCBI Desc: rd22bp1 [arabidopsis thaliana]
  misc_feature (89)..(283): NCBI GI: 27764972 NCBI Desc: at1g32640/f6n18_4 [arabidopsis thaliana]
  misc_feature (89)..(283): NCBI GI: 1465368 NCBI Desc: bhlh protein [arabidopsis thaliana]
  misc_feature (86)..(282): NCBI GI: 45477841 NCBI Desc: myc protein [oryza sativa]
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 2 in the 10/374,780US patent application
  misc_feature: The sequence is a functional homolog of SEQ ID NO 464 in the 11/435,388US patent application
  misc_feature: The sequence is a functional homolog of SEQ ID NO 955 in the 10/374,780US patent application
  misc_feature: Useful for making plants with modulated growth and phenotype characteristics
  misc_feature: The sequence is a functional homolog of SEQ ID NO 12 in the 20040045049 US patent application
  misc_feature: The sequence is a functional homolog of SEQ ID NO 955 in the 20060162006 US patent application
MDDLLSPCSSFSPPSPPSFFSHAGHHPVIEFTSCDVPEQWLLDDVFVAKNEGDDDVDDLWPVGSSLSQDSELTEQPLPPQPPPPQQQAELSVVKAPAQQQRPGKRRGRKPGPRPDGPTVSHVEAERQRREKLNRRFCDLRAAVPTVSRMDKASLLADAAAYIAELRARIARLEAESRRAPAARWEPVVAACGAHEAGPGAGGGADEVVEVRMLGPDAAAVRATSAAPHAPARLMSALRALELHVRHACVTRVNGMTVQDVVVDVATPLQDDDDDDGRLRAALLQMMQDSAATYVPN

SEQ ID NO: 3495 - DNA, 1245 bp, Sorghum bicolor
  misc_feature: Ceres ANNOT ID no. 6031683
  misc_feature: Encodes the peptide sequence at SEQ ID NO 3496
atgcgcctcgctgccgtcgccaggacgaccaggatggcagccgaggagatgaggcgggcctcggcctccgcggcggtcgcggccacgacggaggcggcgccggcgccggcgcaagcggggtccaggtgggcgcgggtgtggccgagcgcgctccggtggatccccacctccacggatcgcatcatcgccgcggagaagcggctcctctcgatagtcaaaactgggtatgtccaggaacaagtcaacattggctcagctccacctgggtcaaaagtaagatggtttaggtcagcgagtgatgaaccaaggttcattaatactgtaacatttgatggcaaggagaacgcccccaccctggttatggtccatggctatggagcttcacaggggttcttctttcgaaactttgacgcccttgcaagtcgttttagggtgattgccattgatcagcttggctggggtggttcaagcagacctgacttcacatgtaaaagtaccgaagaaactgaggcatggttcatagattcttttgaggagtggcgcaaggccaagaacctcagtaattttatattgcttggtcactcctttggaggatatgttgcggcaaagtatgccctaaagcaccctgaacacattcagcacttagttttggttggtcctgctggcttctcgtcagaaacagaccatagctctgagtggttaaccaagtttcgagcaacatggaaaggcatgctagtgaatcatctttgggagtccaattttactccccaaagagttattagaggattgggcccttggggtccaggtctagtacaaagatataccagtgccaggtttggtacacgttcaactggtgatatactaacagatcaagaatcaacattgttgacagattatatttaccataccttagctgccaaagctagtggagagctgtgcttgaaatatatattttccttcggggcatttgcaaggaaacctcttctgcagtgcgcatccgattggaaagtgccgactactttcatatatggtcaggaagattggatgaactaccaaggggctcagcaagcacggaaggacatgaaagttccttgtgaaataatcagggtgccacagagtggacattttgtgtttatagacaacccttcagggttccactcggctgtcttctacgcgtgccgtaatcttttatcccaaaatggggaggagggcttcacatttcctggtggcctaatatctgcatga

SEQ ID NO: 3496 - protein, 414 aa, Sorghum bicolor
  misc_feature: Ceres ANNOT ID no. 6031683
  misc_feature (143)..(391): Pfam Id: Abhydrolase_1 Pfam Desc: alpha/beta hydrolase fold
  misc_feature (12)..(330): NCBI GI: 115480207 NCBI Desc: os09g0520200 [oryza sativa (japonica cultivar-group)]
  misc_feature (69)..(362): NCBI GI: 52076159 NCBI Desc: cgi-58 protein -like [oryza sativa (japonica cultivar-group)]
  misc_feature (1)..(330): NCBI GI: 42573017 NCBI Desc: hydrolase, alpha/beta fold family protein [arabidopsis thaliana]
  misc_feature (53)..(393): NCBI GI: 62859767 NCBI Desc: abhd4 [xenopus tropicalis]
  misc_feature (53)..(396): NCBI GI: 47058978 NCBI Desc: cgi-58-like protein [rattus norvegicus]
MRLAAVARTTRMAAEEMRRASASAAVAATTEAAPAPAQAGSRWARVWPSALRWIPTSTDRIIAAEKRLLSIVKTGYVQEQVNIGSAPPGSKVRWFRSASDEPRFINTVTFDGKENAPTLVMVHGYGASQGFFFRNFDALASRFRVIAIDQLGWGGSSRPDFTCKSTEETEAWFIDSFEEWRKAKNLSNFILLGHSFGGYVAAKYALKHPEHIQHLVLVGPAGFSSETDHSSEWLTKFRATWKGMLVNHLWESNFTPQRVIRGLGPWGPGLVQRYTSARFGTRSTGDILTDQESTLLTDYIYHTLAAKASGELCLKYIFSFGAFARKPLLQCASDWKVPTTFIYGQEDWMNYQGAQQARKDMKVPCEIIRVPQSGHFVFIDNPSGFHSAVFYACRNLLSQNGEEGFTFPGGLISA

SEQ ID NO: 3497 - DNA, 1227 bp, Sorghum bicolor
  misc_feature: Ceres ANNOT ID no. 6031688
  misc_feature: Encodes the peptide sequence at SEQ ID NO 3498
atggcccccgccgcagccgtcctgaagcgggcccacctcgctggcgtccactcgttggccctccgccgccggcagccggggccgccggaccgcgtctcggtgccttctctggcgatcccgtcgccgcgcgtttcttggcagcagggatctggagtggttgctaagaggcgcttctgggcgagtgcgagtggttccttggcgaaagataacactggggaggacgcggcatcgccttctcagctacagggagtggaggagagtaaagtagatttgttgaagattttgaagagtgctaactccattattccccatatagtgctggggagcacaattctcgcggtggtgtaccctccttcttttacatggttcactaccaggtattatgcaccagcgttggggttcttgatgtttgctgttggtgtaaactcaagtgttaaggattttattgaagcaataaaaaggccagacgctattgttgcgggctatatcggacagtttgtcatcaagcctttgttgggattcctttttggtactcttgcggtcgcagttctaaatcttccaaccggtctaggtgctggtatcatgttggtttcatgcgtgagcggagcacagctttcaaactatgcaactttcctgacggatccacatatggctcctctcagcattgttatgacatcattgtcaacagctactgcagtttttgtcaccccaacattatcttactttcttattgggcagaaattacctgtagatgtcaaagggatgatgtccagcattgttcaaatagttgttgctccaattgctgctggattgcttctgaatagattccttccaaggctctgtgcagctatccagccatttctccctccgttatcagtgtttgtcactgctctgtgtgttggctcaccattggcaataaatatcaaggctgttttgtcgccatttggattagccatagtgctgctcctttttgcattccacacctcatcttttgtagctggttatcatcttgctggtacttggtttcacaagtcagacgatgtaaaggcactacaaaggacaatatcttttgagacaggaatgcaaagtagcctccttgctcttgctttagcaaacaaattcttcccagatccactagtgggtgtgcctccagccatatcggttgtgttgatgtccttaatgggatttgctcttgtcatggtgtggtccaagaaaacagaagcctaa

SEQ ID NO: 3498 - protein, 408 aa, Sorghum bicolor
  misc_feature: Ceres ANNOT ID no. 6031688
  misc_feature (129)..(314): Pfam Id: SBF Pfam Desc: Sodium Bile acid symporter family
  misc_feature (77)..(407): NCBI GI: 42572883 NCBI Desc: bile acid:sodium symporter family protein [arabidopsis thaliana]
  misc_feature (135)..(407): NCBI GI: 20453271 NCBI Desc: at3g20560/k10d20_9 [arabidopsis thaliana]
  misc_feature (96)..(402): NCBI GI: 47848126 NCBI Desc: bile acid:sodium symporter-like [oryza sativa (japonica cultivar-group)]
  misc_feature (93)..(402): NCBI GI: 30683305 NCBI Desc: bile acid:sodium symporter family protein [arabidopsis thaliana]
  misc_feature (93)..(405): NCBI GI: 55295966 NCBI Desc: na(+) dependent transporter-like [oryza sativa (japonica cultivar-group)]
MAPAAAVLKRAHLAGVHSLALRRRQPGPPDRVSVPSLAIPSPRVSWQQGSGVVAKRRFWASASGSLAKDNTGEDAASPSQLQGVEESKVDLLKILKSANSIIPHIVLGSTILAVVYPPSFTWFTTRYYAPALGFLMFAVGVNSSVKDFIEAIKRPDAIVAGYIGQFVIKPLLGFLFGTLAVAVLNLPTGLGAGIMLVSCVSGAQLSNYATFLTDPHMAPLSIVMTSLSTATAVFVTPTLSYFLIGQKLPVDVKGMMSSIVQIVVAPIAAGLLLNRFLPRLCAAIQPFLPPLSVFVTALCVGSPLAINIKAVLSPFGLAIVLLLFAFHTSSFVAGYHLAGTWFHKSDDVKALQRTISFETGMQSSLLALALANKFFPDPLVGVPPAISVVLMSLMGFALVMVWSKKTEA

SEQ ID NO: 3499 - DNA, 1413 bp, Sorghum bicolor
  misc_feature: Ceres ANNOT ID no. 6031698
  misc_feature: Encodes the peptide sequence at SEQ ID NO 3500
atggaccgcaaggatgtcgggatcctcgccatggacatctacttcccgccctcctgcgtgcagcaggaagcacttgaggcccatgatggggcgagcaaagggaagtacaccattgggctcgggcaagattgcatggccttttgcagcgaggtggaagatgtcatctcaatgagtttgacggttgtcaattccctgctgaaaaagtacaagattgatcccaagttaatcggtcgcttggaggtcggaagtgaaacagttatagacaaaagtaaatccatcaaaacttggctgatgcagatttttgaggaaagtggtaatactgacattgaaggcgttgactccagcaatgcatgttatggtgggacagcagccctactgaattgtgtgaattgggtcgaaagtaactcctgggatggccgttatggtcttgtcgtttgcacggatagcgcggtttatgcggaagggccagctcgtccaacaggaggtgctgctgctatagcaatgctcattggtcctaatgctccaatttccttcgagagcaaatatagagcttctcacatggctcatgtttacgatttctacaagcctgatcttgcaagtgaatatccggttgttgatggtaaattatcccaaacatgctacctgatggctctagactcatgctacagacagttctgcaacaagtatgagaagatcgcgggtaaacaattctcaatttctgatgcagaatattttgtgttccattctccatacaacaagctcgtgcagaagagtttcgctcgactttactacaatgacttcatgcgcaactgcagctctgttgatgatgacgctaaagagaagctccagtctttttcaaatttgactggtgaagagagctaccagagtcgcgacttggaaaaggcctcacaacaagttgcaaagcacctctatgacatcaaagttcagccatcgactctgcttccgaaacaaattggtaacatgtatactgcatccctttatgctgcattggcatctgtgctatataacaagcatgatagtctgaatggacacagaattgtgatgttctcttacggcagtggcttgacatccactatgttttcattgaggctgaacaatggtcagcatccattcagtctatcaaacattgcttcagttcttgatgtcaccgagaagcttcagtcaagacatgagaccttgcctgaaaaattcgttgagacactgaagctgatggaacacagatacggcgcaaaggacttcgagacgagcagagacaccagcctgctgcagccaggcacattctacctcaccaaggtcgactccatgtacaggaggttctattcccagaagctggccgaggaaacaggcggcggcaaaaccaagtgctgcaacggcttcgcaaatggccactag

SEQ ID NO: 3500 - protein, 470 aa, Sorghum bicolor
  misc_feature: Ceres ANNOT ID no. 6031698
  misc_feature (176)..(450): Pfam Id: HMG_CoA_synt_C Pfam Desc: Hydroxymethylglutaryl-coenzyme A synthase C terminal
  misc_feature (2)..(175): Pfam Id: HMG_CoA_synt_N Pfam Desc: Hydroxymethylglutaryl-coenzyme A synthase N terminal
  misc_feature (4)..(470): NCBI GI: 42795470 NCBI Desc: hmg-coa synthase 2 [hevea brasiliensis]
  misc_feature (4)..(470): NCBI GI: 16417956 NCBI Desc: hydroxymethylglutaryl coenzyme a synthase [hevea brasiliensis]
  misc_feature (4)..(470): NCBI GI: 14916100 NCBI Desc: hydroxymethylglutaryl coenzyme a synthase [hevea brasiliensis]
  misc_feature (4)..(450): NCBI GI: 7799986 NCBI Desc: hmg-coa synthase [brassica juncea]
  misc_feature (4)..(450): NCBI GI: 112490560 NCBI Desc: chain a, enzyme in complex with hmg-coa and covalently bound to hmg- coa
  misc_feature (4)..(450): SWISSPROT Homolog: EC 2.3.3.10 Hydroxymethylglutaryl-CoA synthase
  misc_feature: Useful for making plants with modulated nitrogen use efficiency
  misc_feature: GREAT-hit functional homolog of the protein sequence given in SEQ ID NO 13003
  misc_feature: Useful for making plants with modulated nitrogen use efficiency
  misc_feature: Functional homolog of the protein sequence given in SEQ ID NO 13003
MDRKDVGILAMDIYFPPSCVQQEALEAHDGASKGKYTIGLGQDCMAFCSEVEDVISMSLTVVNSLLKKYKIDPKLIGRLEVGSETVIDKSKSIKTWLMQIFEESGNTDIEGVDSSNACYGGTAALLNCVNWVESNSWDGRYGLVVCTDSAVYAEGPARPTGGAAAIAMLIGPNAPISFESKYRASHMAHVYDFYKPDLASEYPVVDGKLSQTCYLMALDSCYRQFCNKYEKIAGKQFSISDAEYFVFHSPYNKLVQKSFARLYYNDFMRNCSSVDDDAKEKLQSFSNLTGEESYQSRDLEKASQQVAKHLYDIKVQPSTLLPKQIGNMYTASLYAALASVLYNKHDSLNGHRIVMFSYGSGLTSTMFSLRLNNGQHPFSLSNIASVLDVTEKLQSRHETLPEKFVETLKLMEHRYGAKDFETSRDTSLLQPGTFYLTKVDSMYRRFYSQKLAEETGGGKTKCCNGFANGH

SEQ ID NO: 3501 - DNA, 822 bp, Sorghum bicolor
  misc_feature: Ceres ANNOT ID no. 6031704
  misc_feature: Encodes the peptide sequence at SEQ ID NO 3502
atgggccggctccagcagcaccagcacgcgacctgctcgtcctccacctccacctcggcgtcgtcgacatcctcgtccgagcagaccatcaaggcggtggtctggtccccgtcgtcctcgtcttccccgcagccgcccaagaagcgccccgcggggcgcaccaagttccgggagacgcggcacccggtgtaccgcggcgtgcggcgccggggcgccgcgggacggtgggtgtgcgaggtgcgcgtacccgggaagcgtggcgcgcggctgtggctcgggacctacctcgccgccgagtccgcggcgcgcgcgcacgacgccgccatgctcgccctgggccgcggcggcgccgcggggtgcctcaacttcccggactccgcgtggctgctcgccgtgcctcccccgtccgcgatctcgggcctggacgacgcacgccgggcggcgctcgaggccgtcgcggagttccagcgccgcttcggggcagcagcagccggggggtgtgggtccgtcgacgaagcgacctcgggcgtgtctgctcccccattgtcgacgtcgtcgctgccgggcatttcctccggctcgccggcaccggcgccggagcttcagcaggtgcctgtgaaggcaggtgaaacagcgacggcgttggacggcgacgtgttcgagcccgccgactggttcggggacatggacatggaattggatgtgtactacgccagcctcgcggaagggttgctcgtggagccgccaccggcgccggcggctgcctgggatcatggcgactgctgtgacgccggagctgacgtcgcgctctggagctactag

SEQ ID NO: 3502 - protein, 273 aa, Sorghum bicolor
  misc_feature: Ceres ANNOT ID no. 6031704
  misc_feature (62)..(115): Pfam Id: AP2 Pfam Desc: AP2 domain
  misc_feature (8)..(273): NCBI GI: 25991254 NCBI Desc: dreb-like protein [zea mays]
  misc_feature (19)..(273): NCBI GI: 115480235 NCBI Desc: os09g0522100 [oryza sativa (japonica cultivar-group)]
  misc_feature (17)..(273): NCBI GI: 63098600 NCBI Desc: crt/dre binding factor 3 [triticum monococcum]
  misc_feature (17)..(182): NCBI GI: 117653909 NCBI Desc: cbf3d-b19 [triticum aestivum]
  misc_feature (4)..(273): NCBI GI: 63098614 NCBI Desc: crt/dre binding factor 1c [triticum monococcum]
  misc_feature: The sequence is a functional homolog of SEQ ID NO 1228 in the 10/374,780US patent application
  misc_feature: The sequence is a functional homolog of SEQ ID NO 1230 in the 10/374,780US patent application
  misc_feature: The sequence is a functional homolog of SEQ ID NO 1244 in the 10/374,780US patent application
  misc_feature: The sequence is a functional homolog of SEQ ID NO 1247 in the 10/374,780US patent application
  misc_feature: The sequence is a functional homolog of SEQ ID NO 1314 in the 11/479,226US patent application
  misc_feature: The sequence is a functional homolog of SEQ ID NO 16 in the 10/225,068US patent application
  misc_feature: The sequence is a functional homolog of SEQ ID NO 186 in the 10/374,780US patent application
  misc_feature: The sequence is a functional homolog of SEQ ID NO 190 in the 11/375,241US patent application
  misc_feature: The sequence is a functional homolog of SEQ ID NO 516 in the 11/435,388US patent application
  misc_feature: The sequence is a functional homolog of SEQ ID NO 566 in the 10/225,066US patent application
  misc_feature: The sequence is a functional homolog of SEQ ID NO 616 in the 10/412,699US patent application
  misc_feature: The sequence is a functional homolog of SEQ ID NO 698 in the 11/435,388US patent application
  misc_feature: The sequence is a functional homolog of SEQ ID NO 722 in the 11/435,388US patent application
  misc_feature: The sequence is a functional homolog of SEQ ID NO 724 in the 11/435,388US patent application
  misc_feature: The sequence is a functional homolog of SEQ ID NO 744 in the 11/435,388US patent application
  misc_feature: The sequence is a functional homolog of SEQ ID NO 746 in the 11/435,388US patent application
  misc_feature: The sequence is a functional homolog of SEQ ID NO 752 in the 11/435,388US patent application
  misc_feature: The sequence is a functional homolog of SEQ ID NO 776 in the 11/435,388US patent application
  misc_feature: The sequence is a functional homolog of SEQ ID NO 778 in the 11/435,388US patent application
  misc_feature: The sequence is a functional homolog of SEQ ID NO 780 in the 11/435,388US patent application
  misc_feature: Useful for making plants with modulated growth and phenotype characteristics
  misc_feature: The sequence is a functional homolog of SEQ ID NO 616 in the 20040045049 US patent application
  misc_feature: The sequence is a functional homolog of SEQ ID NO 1228 in the 20060162006 US patent application
  misc_feature: The sequence is a functional homolog of SEQ ID NO 1230 in the 20060162006 US patent application
  misc_feature: The sequence is a functional homolog of SEQ ID NO 1244 in the 20060162006 US patent application
  misc_feature: The sequence is a functional homolog of SEQ ID NO 1247 in the 20060162006 US patent application
  misc_feature: The sequence is a functional homolog of SEQ ID NO 698 in the 20060272060 US patent application
  misc_feature: The sequence is a functional homolog of SEQ ID NO 752 in the 20060272060 US patent application
  misc_feature: The sequence is a functional homolog of SEQ ID NO 776 in the 20060272060 US patent application
  misc_feature: The sequence is a functional homolog of SEQ ID NO 778 in the 20060272060 US patent application
  misc_feature: The sequence is a functional homolog of SEQ ID NO 780 in the 20060272060 US patent application
  misc_feature: The sequence is a functional homolog of SEQ ID NO 752 in the 11/435,388 US patent application
  misc_feature: The sequence is a functional homolog of SEQ ID NO 1247 in the 10/374,780 US patent application
  misc_feature: The sequence is a functional homolog of SEQ ID NO 746 in the 11/435,388 US patent application
  misc_feature: The sequence is a functional homolog of SEQ ID NO 1244 in the 10/374,780 US patent application
  misc_feature: The sequence is a functional homolog of SEQ ID NO 744 in the 11/435,388 US patent application
MGRLQQHQHATCSSSTSTSASSTSSSEQTIKAVVWSPSSSSSPQPPKKRPAGRTKFRETRHPVYRGVRRRGAAGRWVCEVRVPGKRGARLWLGTYLAAESAARAHDAAMLALGRGGAAGCLNFPDSAWLLAVPPPSAISGLDDARRAALEAVAEFQRRFGAAAAGGCGSVDEATSGVSAPPLSTSSLPGISSGSPAPAPELQQVPVKAGETATALDGDVFEPADWFGDMDMELDVYYASLAEGLLVEPPPAPAAAWDHGDCCDAGADVALWSY

SEQ ID NO: 3503 - DNA, 735 bp, Sorghum bicolor
  misc_feature: Ceres ANNOT ID no. 6031710
  misc_feature: Encodes the peptide sequence at SEQ ID NO 3504
atgtgcccgatcaagaaggagacgacgagcgccgagtccggctcgccgccgtgcagctcgccctcgtcctcctccgcctcggtgatggtgatggagcgccaccaccagacgacagtgtggacgtcgccgccgaagcgccccgcggggcgcaccaagttccgggagacgaggcacccggtgttccgcggcgtccggaggcggggcaacgccgggcggtgggtctgcgaggtgcgcgtccccgggaggcgcggctgcaggctgtggctcggcaccttcgacaccgcggacgccgcggcgcgcgcgcacgacgccgccgtgctcgccatcgccggcgcgggccgcgcctgcctcaacttcgccgactcggcctggctcctcgcggttccggactcgtacgccagcctcgctgaggttcgccacgcggtcgcggaggccgtcgaggaatttcagcgccgcggagaggcggttgaggtcgaggaggaggaggaggaggacgcgcgctcggccacagcgtcctcgacgtcgtcgtccccggccagcgatgacgacggcggcgaggagtcgtcttcggccaccgaggactcgccgccgttcgaaatggacatgttcagtgacatgagctgggacctgtactatgcgagcttggcgcaggcgatgctcgtggagccaccgcccacagtcaccaccgccttctgcgacgacggcgtcgccgaagtgccactctggagctactag

SEQ ID NO: 3504 - protein, 244 aa, Sorghum bicolor
  misc_feature: Ceres ANNOT ID no. 6031710
  misc_feature (59)..(112): Pfam Id: AP2 Pfam Desc: AP2 domain
  misc_feature (1)..(244): NCBI GI: 60593391 NCBI Desc: sbcbf6 [sorghum bicolor]
  misc_feature (1)..(244): NCBI GI: 52075594 NCBI Desc: dre-binding protein 1a [oryza sativa (japonica cultivar-group)]
  misc_feature (1)..(244): NCBI GI: 22594969 NCBI Desc: dre-binding protein 1a [oryza sativa]
  misc_feature (1)..(244): NCBI GI: 33321848 NCBI Desc: apetala2 domain-containing cbf1-like protein [oryza sativa]
  misc_feature (1)..(244): NCBI GI: 33637698 NCBI Desc: transcription factor rcbf3 [oryza sativa]
  misc_feature: The sequence is a functional homolog of SEQ ID NO 1225 in the 10/374,780US patent application
  misc_feature: The sequence is a functional homolog of SEQ ID NO 1230 in the 10/374,780US patent application
  misc_feature: The sequence is a functional homolog of SEQ ID NO 1248 in the 10/374,780US patent application
  misc_feature: The sequence is a functional homolog of SEQ ID NO 1314 in the 11/479,226US patent application
  misc_feature: The sequence is a functional homolog of SEQ ID NO 16 in the 10/225,068US patent application
  misc_feature: The sequence is a functional homolog of SEQ ID NO 186 in the 10/374,780US patent application
  misc_feature: The sequence is a functional homolog of SEQ ID NO 190 in the 11/375,241US patent application
  misc_feature: The sequence is a functional homolog of SEQ ID NO 516 in the 11/435,388US patent application
  misc_feature: The sequence is a functional homolog of SEQ ID NO 566 in the 10/225,066US patent application
  misc_feature: The sequence is a functional homolog of SEQ ID NO 616 in the 10/412,699US patent application
  misc_feature: The sequence is a functional homolog of SEQ ID NO 698 in the 11/435,388US patent application
  misc_feature: The sequence is a functional homolog of SEQ ID NO 724 in the 11/435,388US patent application
  misc_feature: The sequence is a functional homolog of SEQ ID NO 776 in the 11/435,388US patent application
  misc_feature: The sequence is a functional homolog of SEQ ID NO 778 in the 11/435,388US patent application
  misc_feature: The sequence is a functional homolog of SEQ ID NO 780 in the 11/435,388US patent application
  misc_feature: Useful for making plants with modulated growth and phenotype characteristics
  misc_feature: The sequence is a functional homolog of SEQ ID NO 616 in the 20040045049 US patent application
  misc_feature: The sequence is a functional homolog of SEQ ID NO 1225 in the 20060162006 US patent application
  misc_feature: The sequence is a functional homolog of SEQ ID NO 1230 in the 20060162006 US patent application
  misc_feature: The sequence is a functional homolog of SEQ ID NO 1248 in the 20060162006 US patent application
  misc_feature: The sequence is a functional homolog of SEQ ID NO 698 in the 20060272060 US patent application
  misc_feature: The sequence is a functional homolog of SEQ ID NO 776 in the 20060272060 US patent application
  misc_feature: The sequence is a functional homolog of SEQ ID NO 778 in the 20060272060 US patent application
  misc_feature: The sequence is a functional homolog of SEQ ID NO 780 in the 20060272060 US patent application
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 2 in US patent 7253000
  misc_feature: The sequence is a functional homolog of SEQ ID NO 1248 in the 10/374,780 US patent application
MCPIKKETTSAESGSPPCSSPSSSSASVMVMERHHQTTVWTSPPKRPAGRTKFRETRHPVFRGVRRRGNAGRWVCEVRVPGRRGCRLWLGTFDTADAAARAHDAAVLAIAGAGRACLNFADSAWLLAVPDSYASLAEVRHAVAEAVEEFQRRGEAVEVEEEEEEDARSATASSTSSSPASDDDGGEESSSATEDSPPFEMDMFSDMSWDLYYASLAQAMLVEPPPTVTTAFCDDGVAEVPLWSY

SEQ ID NO: 3505 - DNA, 999 bp, Sorghum bicolor
  misc_feature: Ceres ANNOT ID no. 6031716
  misc_feature: Encodes the peptide sequence at SEQ ID NO 3506
atgatgcgcgccaggcccaaaggtacattcgccgacgcgatgagggagagctcccctcctccggctccggcttcggcggcggcggcggcggcggtgaaagaggacgagtgggaggtgcgtccgggcgggatgctggtgcagaagcggagccccgacgcggacgcccccgccggggcgcccgtccccaccatccgcgtcaaggtcaagttcaacggcgtctaccacgagatctacatcaactcgcaggcctccttcggtgagctcaagaagttgctgtcggcgcggacggggctgcaccccgaggaccagaagctcgtgtacaaggacaaggagagggactccaaggcgttcctggacatggccggcgtcaaggaccgctccaagatggtgctgctcgaggaccccgccgcgcaggccaagcgcctcctcgagcagcgccgcaccgacaaggcggagcgagccgccaagtccatctcccgcatcagcctcgacgtcgacaagctcgccaccaaggtgtcggcgctggagaccatcgtcagcaagggcggcaaggtggtggatgccgacgtggtcaccctcaccgaggcgctcatgaacgagctggtcaagctggactccatcgccgccgagggcgaggtcaaggtgcagcggcgaatgcaggagaagcgggtgcagaagtacgtggagacgctggacgccatccgcgcgaagaacgcggcggcggcggcgcccaaggcgaacggcaacatgaacggccacgccaagccccgcgcgccgcacctcccgccgcgcccgccgcccgtgtcgcagcggcggaacttccagcagcagccctccccggcgccgcccacgcagagctgggagtcgttcgacctgctgtcgtcggtgccgtccacgtcctcggccgccgtgaccacaaccatggcggccgcgaccaccacctcgccggccggcgcctccccgtccccgatcccgcggttcgactgggagctcttctga

SEQ ID NO: 3506 - protein, 332 aa, Sorghum bicolor
  misc_feature: Ceres ANNOT ID no. 6031716
  misc_feature (157)..(235): Pfam Id: BAG Pfam Desc: BAG domain
  misc_feature (23)..(332): NCBI GI: 115477647 NCBI Desc: os08g0546100 [oryza sativa (japonica cultivar-group)]
  misc_feature (13)..(332): NCBI GI: 115466120 NCBI Desc: os06g0126500 [oryza sativa (japonica cultivar-group)]
  misc_feature (14)..(332): NCBI GI: 55296206 NCBI Desc: bag domain containing protein-like [oryza sativa (japonica cultivar-group)]
  misc_feature (36)..(332): NCBI GI: 92881534 NCBI Desc: ubiquitin; apoptosis regulator bcl-2 protein, bag [medicago truncatula]
  misc_feature (34)..(332): NCBI GI: 30697627 NCBI Desc: bag domain-containing protein [arabidopsis thaliana]
MMRARPKGTFADAMRESSPPPAPASAAAAAAVKEDEWEVRPGGMLVQKRSPDADAPAGAPVPTIRVKVKFNGVYHEIYINSQASFGELKKLLSARTGLHPEDQKLVYKDKERDSKAFLDMAGVKDRSKMVLLEDPAAQAKRLLEQRRTDKAERAAKSISRISLDVDKLATKVSALETIVSKGGKVVDADVVTLTEALMNELVKLDSIAAEGEVKVQRRMQEKRVQKYVETLDAIRAKNAAAAAPKANGNMNGHAKPRAPHLPPRPPPVSQRRNFQQQPSPAPPTQSWESFDLLSSVPSTSSAAVTTTMAAATTTSPAGASPSPIPRFDWELF

SEQ ID NO: 3507 - DNA, 528 bp, Sorghum bicolor
  misc_feature: Ceres ANNOT ID no. 6031720
  misc_feature: Encodes the peptide sequence at SEQ ID NO 3508
atggccactcacactacctattcagtccgcgtctcctcggagacccacaagattgaggcctgggtagtgtctgacgaagctctggccaggcaactgcaggaggaggagaacacgcatgacgctgctgccgacaccagagaattcgccggcaatgtgtccttggagttatcgtcaccggctgttgagtacaggcctacacagaatgcagctcaggttgcaagggaagacaatgtggacccagataatatgtcatacgagcaactacaagcattaggggaagcagtaggaactcagtccagagggttatctgatgagctgatagcttacttggagccatttaggaacaagtgcaccttcttctccaggaaaaagaacagcgaggaatgtgtgatctgcaaaacaacatataaaagccggcagaggatgataagactgccctgcagccactgttatcacgcagattgcataactcgctggcttaagatcaacaaggcatgcccaatctgcaacgaggaggtgtttggatga

SEQ ID NO: 3508 - protein, 175 aa, Sorghum bicolor
  misc_feature: Ceres ANNOT ID no. 6031720
  misc_feature (129)..(169): Pfam Id: zf-C3HC4 Pfam Desc: Zinc finger, C3HC4 type (RING finger)
  misc_feature (10)..(175): NCBI GI: 115460008 NCBI Desc: os04g0571200 [oryza sativa (japonica cultivar-group)]
  misc_feature (19)..(175): NCBI GI: 116310277 NCBI Desc: osigba0111l12.9 [oryza sativa (indica cultivar-group)]
  misc_feature (12)..(175): NCBI GI: 6983871 NCBI Desc: zinc finger protein-like [oryza sativa (japonica cultivar-group)]
  misc_feature (12)..(175): NCBI GI: 29170198 NCBI Desc: zinc finger protein [oryza sativa (indica cultivar-group)]
  misc_feature (24)..(173): NCBI GI: 140068969 NCBI Desc: zinc finger, ring-type [medicago truncatula]
  misc_feature: Useful for making plants with altered terpenoid content
  misc_feature: Functional homolog of the protein sequence given in SEQ ID NO 13837
  misc_feature: The sequence is a functional homolog of SEQ ID NO. 271 in the 11/188,298 US application
  misc_feature: The sequence is a functional homolog of SEQ ID NO. 329 in the 11/188,298 US application
  misc_feature: The sequence is a functional homolog of SEQ ID NO. 350 in the 11/188,298 US application
MATHTTYSVRVSSETHKIEAWVVSDEALARQLQEEENTHDAAADTREFAGNVSLELSSPAVEYRPTQNAAQVAREDNVDPDNMSYEQLQALGEAVGTQSRGLSDELIAYLEPFRNKCTFFSRKKNSEECVICKTTYKSRQRMIRLPCSHCYHADCITRWLKINKACPICNEEVFG

SEQ ID NO: 3509 - DNA, 354 bp, Sorghum bicolor
  misc_feature: Ceres ANNOT ID no. 6031721
  misc_feature: Encodes the peptide sequence at SEQ ID NO 3510
atggcgatggccgccggcttcggcaaggtgaaggtgcagccgcgcgggccggccgcggcgctgtccctgctgctgctgctgctcctggtgctggcagcggggctgctgggcggtggcgccgaggcgcagcagacgacgtgcgcggggcagctgaacgggctggctccctgcctgcgctacagcgtgccgccgttgccggggcaggcgccgccggcgcccgggcccgagtgctgctccgcgctgggggccgtgtccagggactgcgcctgcggcacgttcggcatcatcaacagcctgcccgccaagtgcggcctcgcgccagtcagatgccgtaagacctcgatcgatctctag

SEQ ID NO: 3510 - protein, 117 aa, Sorghum bicolor
  misc_feature: Ceres ANNOT ID no. 6031721
  misc_feature (47)..(110): Pfam Id: Tryp_alpha_amyl Pfam Desc: Protease inhibitor/seed storage/LTP family
  misc_feature (4)..(111): NCBI GI: 3378527 NCBI Desc: anther specific protein [zea mays]
  misc_feature (27)..(111): NCBI GI: 52077308 NCBI Desc: yy1 protein precursor [oryza sativa (japonica cultivar-group)]
  misc_feature (27)..(111): NCBI GI: 2645168 NCBI Desc: yy1 protein [oryza sativa]
  misc_feature (20)..(110): NCBI GI: 6689676 NCBI Desc: ltp-like protein; anther specific protein [zea mays]
  misc_feature (26)..(110): NCBI GI: 1628471 NCBI Desc: men-8 [silene latifolia]
MAMAAGFGKVKVQPRGPAAALSLLLLLLLVLAAGLLGGGAEAQQTTCAGQLNGLAPCLRYSVPPLPGQAPPAPGPECCSALGAVSRDCACGTFGIINSLPAKCGLAPVRCRKTSIDL

SEQ ID NO: 3511 - DNA, 1668 bp, Sorghum bicolor
  misc_feature: Ceres ANNOT ID no. 6031722
  misc_feature: Encodes the peptide sequence at SEQ ID NO 3512
  misc_feature: Up-regulated in shoot tissues in response to salicylic acid treatment
  misc_feature: Down-regulated in shoot tissues in response to salicylic acid treatment
atggcaaggccaccgcaggaggcgatcgataccttcatcagcatcacgggggcggacgaggccgtcgccgtacgcaagctcgaggaacatggtggtgaccttaatcgagcaataaattcacatttcaatgatggagatagcatatcgaatggaatcagtcaaaacaccatgcctgctagtcatgatgatatgatggacctggatggaccacttgataatacatttcaaagacctttgttcccagagaattcccatgacccttttgcgctaatggatccaaattttcagcgccagttttttgacagagttggctccactgatggtgtcagtcatggaccgctggtttcgcaccctagagaggcgagagagattcctattgaagttaaagatagtgatcctcaaacaggtccatctggacaggctcctgttattgaggatgttactggaaatgagtctttaaatggccctgaagttcctgaaactatcataattgatgaggaggatggaggattgttatccgcaccatctgctccacatgccagtattcctagcattacatcttctgtgccaactgctcctccattggttcatgttaatgactatgatgatgacatagaagaggaaatgattagggcagcaattgaagcttcaaagaaggattctgaagcactggcaaatatagtagagcaaggaggagaccagcatcaagagggagtgaacttggaggaacattcttctgataaagcaggcatgggaaccacagatggaatagtcgagaggcaaggaccagcttcaggaaaggctggaacgtctaggcaaccaatagatgaagagggcttccaagaggagactgaagatgtagaggaacaaccgttagttagacgccgttctcggcgtgtcccttctgagaacaccgaactagcacaaatagtgcacccaggtgctagccctgttcggaacgatcgccagtataacaatggagatgatttcccatctgagtggggcggcatttcttctgaggaacatgatgaagctgtcatgcttgaggctgcaatgtttggtggagttcctgaaggaccaacatatcctttctccatgccttctcacagaagctctacttattatcccccaatagctcattctccatcaccagcattaactgaacagcggttattacgagagcagcaggatgatgagtaccttgcatcgctacaagctgatcaagaaaaggagttaaaggccttacaggaggctgagctccgtcgcctagaagaaactgctgcgagagaagctgctcttgagaaacagaagcaagaggaggaggaaaggcgtaaaaagcaacttgaggaagaggagctagagtccagtctcgcttccaagcaagcatcattaccatcagaaccgcctccagatgcagagggtgccgtgacagttgtagtccgcatgcctgatggtagtcgacaggggcgtcgctttctcaaaactgataaacttcagttcctatttgatttcttagacattgggaggacttgcaagccagggacctacagattggtgaggacatacccaaggcgtacatttaccgacagtgagggcgacgtatcgttcagtgatctcggcctaacaagcaagcaggaagccctgtttctagaacagatcacggcgtag

SEQ ID NO: 3512 - protein, 555 aa, Sorghum bicolor
  misc_feature: Ceres ANNOT ID no. 6031722
  misc_feature (470)..(552): Pfam Id: UBX Pfam Desc: UBX domain
  misc_feature (1)..(456): NCBI GI: 13160609 NCBI Desc: ara4-interacting protein [arabidopsis thaliana]
  misc_feature (181)..(551): NCBI GI: 42570051 NCBI Desc: ubx domain-containing protein [arabidopsis thaliana]
  misc_feature (1)..(158): NCBI GI: 4325337 NCBI Desc: f15p23.3 gene product [arabidopsis thaliana]
  misc_feature (388)..(554): NCBI GI: 50603676 NCBI Desc: mgc82418 protein [xenopus laevis]
  misc_feature (388)..(554): NCBI GI: 34784061 NCBI Desc: loc402870 protein [danio rerio]
  misc_feature: Up-regulated in shoot tissues in response to salicylic acid treatment
  misc_feature: Down-regulated in shoot tissues in response to salicylic acid treatment
MARPPQEAIDTFISITGADEAVAVRKLEEHGGDLNRAINSHFNDGDSISNGISQNTMPASHDDMMDLDGPLDNTFQRPLFPENSHDPFALMDPNFQRQFFDRVGSTDGVSHGPLVSHPREAREIPIEVKDSDPQTGPSGQAPVIEDVTGNESLNGPEVPETIIIDEEDGGLLSAPSAPHASIPSITSSVPTAPPLVHVNDYDDDIEEEMIRAAIEASKKDSEALANIVEQGGDQHQEGVNLEEHSSDKAGMGTTDGIVERQGPASGKAGTSRQPIDEEGFQEETEDVEEQPLVRRRSRRVPSENTELAQIVHPGASPVRNDRQYNNGDDFPSEWGGISSEEHDEAVMLEAAMFGGVPEGPTYPFSMPSHRSSTYYPPIAHSPSPALTEQRLLREQQDDEYLASLQADQEKELKALQEAELRRLEETAAREAALEKQKQEEEERRKKQLEEEELESSLASKQASLPSEPPPDAEGAVTVVVRMPDGSRQGRRFLKTDKLQFLFDFLDIGRTCKPGTYRLVRTYPRRTFTDSEGDVSFSDLGLTSKQEALFLEQITA

SEQ ID NO: 3513 - DNA, 2670 bp, Sorghum bicolor
  misc_feature: Ceres ANNOT ID no. 6031728
  misc_feature: Encodes the peptide sequence at SEQ ID NO 3514
atggcgtggtggtgcatcggtgggggccatttgactctcgcgctcgcctgcgtgtgcgatccgctcttgatgagcttcggcggcatgttcgatggcgccgccggctccggcgtcttctcctacgacgctacggggggaggcggcacgggcatgcacaaccccagccgccttatccccgccccgcctctaccgaaacccggcggattcggcgccaccggcctctccctcggcctgcaaacgaacatggaaggggggcaactggccgacttgagtcgtatgggcttgattggcagcggcgggagcgcgagcggaggcgacggcgactcgctgggccgcgcccggggggaggacgagaacgacagccggtcaggcagcgacaacgtcgacggcgcctccggtgacgagctcgacccggacaacagtaacccgcgcaagaagaagaagcgataccatcgccacacaccgcagcaaatccaagaactcgaagctgtgttcaaggagtgcccccatcccgacgagaagcaaaggatggagctcagcaagcggctcaacctagagagccgccaggtcaagttctggttccagaatcgccgcacgcagatgaagacgcagatcgagcggcacgagaacgcgctgctgaggcaggagaacgacaagctgcgggcggagaacatgacgatccgggaggccatgcgcaaccccatctgcaccaactgcggcggcgcggccgtgctcggcgaggtgtcgctggaggagcagcacctccgcatagagaacgcgcggctcaaggacgagctggaccgcgtctgcgccctcgccggcaagttcctcggccgcccaatctcctccggcagctccatgtccctgcaagggtgctccggcctcgagctcggcgtcggcaccaacggcggcttcgggctcggccccctcggcgcgtccgcgctgcagcccctccccgacctaatgggcgccggcggcctgcccggccccgtgggttcggcggcggccatgcgcctgcccgtgggcatcggcgccctcgacggcgcgatgcacggggcggccgacggcatcgaccgcaccgtcctcctcgagctggggctcgccgcaatggaggagctcatgaaagtggcgcagatggacgagccgctctggctccgcagcccggacggcggcggcggcctggagacgctcaacttcgacgagtaccaccgagcgttcgcccgggtgttcggcccgagccccgccggctacgtctccgaggctacccgcgaggctggcatcgccataatcagcagcgtggacctcgtagacagcctcatggacgcggctcggtggtcggagatgttcccgtgcatcgtggcgagggcgagcacgacggacatcatctctagcggcatgggcggcacgcgcagcgggtcaatccagctggtgctgtcgccgctggtgccgatccgcgaggtggtcttccttcggttctgcaagcagcacgccgaggggctgtgggccgtggtcgacgtctcggtggacgccatcctccgacccgacggcggcggcaaccaccaccaccaccacgcgcacaacggcggcgccgccgggtacatgggctgccgcctgctccccaccggctgcatcgtgcaggacatgaataacggctactccaaggtcacgtgggttgttcacgcggagtacgacgaggccgtcgtgcaccagctctaccgcccgctgctccaatccggccaggcccttggcgcgcgccgctggctcgcctcgctccagcgccagtgccagtacctcgccatcctctgctccaactctctccctgcccgcgaccacgccgcgatcacgccggtggggcggaggagcatgctgaagctggcgcagcggatgacggacaacttctgcgcgggcgtgtgcgcgtcggcggcgcagaagtggcggcgcctggacgagtggcgcggcgtcggtgagggaggaggaggaagcagcgccgggaacggcggcggcggcgccgcgggcgagggggaggagaaggtgcgcatgatggcgcggcagagcgtgggggcgcccggggagccccccggcgtggtgctgagcgccaccacgtcggtgcggctgccggtcacgtccccgcagcgcgtgttcgactacctccgcgacgagcagcgccgcggcgagtgggacatcctggccaacggtgaggccatgcaggagatggaccacatcgccaagggccagcaccacggcaacgccgtctccctcctccgcccaaatgcaacaagtggcaaccaaaacaacatgctcatcttacaggagacctgcacagacccatccggctctctggtggtgtacgctccggtggacgtgcagtccatgcatgtcgtcatgaacggtggcgactccgcatacgtctctctcctcccctccgggtttgccatccttccggacggccattgccagtcgtcaaaccccgcccaaggttcaccaaactgcagcggcggcggcaacagcagcaccggcggttctctggtcacggtggcattccagatcctggtgaacaacctgcccaccgcgaagctcaccgtggagtcggtggagaccgtcagcaacctgctctcctgcaccatccagaagatcaagtctgcgctccaggccagcattgtcacgccctaa

SEQ ID NO: 3514 - protein, 889 aa, Sorghum bicolor
  misc_feature: Ceres ANNOT ID no. 6031728
  misc_feature (364)..(597): Pfam Id: START Pfam Desc: START domain
  misc_feature (147)..(203): Pfam Id: Homeobox Pfam Desc: Homeobox domain
  misc_feature (24)..(889): NCBI GI: 8920423 NCBI Desc: ocl3 protein [zea mays]
  misc_feature (45)..(656): NCBI GI: 50253214 NCBI Desc: gl2-type homeobox genes [oryza sativa (japonica cultivar-group)]
  misc_feature (64)..(656): NCBI GI: 31339103 NCBI Desc: gl2-type homeodomain protein [oryza sativa (japonica cultivar-group)]
  misc_feature (355)..(648): NCBI GI: 30678721 NCBI Desc: anthocyaninless2 (anl2) [arabidopsis thaliana]
  misc_feature (45)..(656): NCBI GI: 67966273 NCBI Desc: homeobox protein ocl1 [zea mays]
  misc_feature: The sequence is a functional homolog of SEQ ID NO 130 in the 10/666,642US patent application
  misc_feature: The sequence is a functional homolog of SEQ ID NO 92 in the 10/666,642US patent application
  misc_feature: Useful for making plants with modulated growth and phenotype characteristics
  misc_feature: The sequence is a functional homolog of SEQ ID NO 130 in the 20070033671 US patent application
  misc_feature: The sequence is a functional homolog of SEQ ID NO 92 in the 20070033671 US patent application
MAWWCIGGGHLTLALACVCDPLLMSFGGMFDGAAGSGVFSYDATGGGGTGMHNPSRLIPAPPLPKPGGFGATGLSLGLQTNMEGGQLADLSRMGLIGSGGSASGGDGDSLGRARGEDENDSRSGSDNVDGASGDELDPDNSNPRKKKKRYHRHTPQQIQELEAVFKECPHPDEKQRMELSKRLNLESRQVKFWFQNRRTQMKTQIERHENALLRQENDKLRAENMTIREAMRNPICTNCGGAAVLGEVSLEEQHLRIENARLKDELDRVCALAGKFLGRPISSGSSMSLQGCSGLELGVGTNGGFGLGPLGASALQPLPDLMGAGGLPGPVGSAAAMRLPVGIGALDGAMHGAADGIDRTVLLELGLAAMEELMKVAQMDEPLWLRSPDGGGGLETLNFDEYHRAFARVFGPSPAGYVSEATREAGIAIISSVDLVDSLMDAARWSEMFPCIVARASTTDIISSGMGGTRSGSIQLVLSPLVPIREVVFLRFCKQHAEGLWAVVDVSVDAILRPDGGGNHHHHHAHNGGAAGYMGCRLLPTGCIVQDMNNGYSKVTWVVHAEYDEAVVHQLYRPLLQSGQALGARRWLASLQRQCQYLAILCSNSLPARDHAAITPVGRRSMLKLAQRMTDNFCAGVCASAAQKWRRLDEWRGVGEGGGGSSAGNGGGGAAGEGEEKVRMMARQSVGAPGEPPGVVLSATTSVRLPVTSPQRVFDYLRDEQRRGEWDILANGEAMQEMDHIAKGQHHGNAVSLLRPNATSGNQNNMLILQETCTDPSGSLVVYAPVDVQSMHVVMNGGDSAYVSLLPSGFAILPDGHCQSSNPAQGSPNCSGGGNSSTGGSLVTVAFQILVNNLPTAKLTVESVETVSNLLSCTIQKIKSALQASIVTP

SEQ ID NO: 3515 - DNA, 687 bp, Sorghum bicolor
  misc_feature: Ceres ANNOT ID no. 6031736
  misc_feature: Encodes the peptide sequence at SEQ ID NO 3516
atgatcacaatgcttgcagctagttctgtagtgaacagcaaccttgcttgctcatcaaggatatcatcctgttcggatttcacatctggccattcatggcgtcccatagaggctgtgaaactccatcgtcgtgctgtgagctcaatacgtataagttgtgctgctactaaacctgcaaagactcctgctgaagaagaatggaaagttaagcggcaacttctagcggaaaagcgggtacgcagtgttgatgtgaaggaagcactgcgccttcaaaaggaaaacaactttgtaattcttgatgtcaggccagaagcagagtttaaagaggctcatccacctggtgccatcaatgtacaaatatacagattaatcaaggaatggacagcatgggatattgcaaggcgtgcggcgtttgcgttttttggcatatttgctggaacagaagagaatcctgaattcatacagagtgttgatgtgaaggttgggaaaaatgcgaagataattgtggcatgttctacaggagggacactgaagccaacgcaaaatttccctgatgggaagcaatctcggtccttgatagctgcgtacctgttggtcctgaatggatacagcaatgtgtaccatctggaaggagggctttacacatggttcaaagaagggctacctgctgttgaaggagaagaatga

SEQ ID NO: 3516 - protein, 228 aa, Sorghum bicolor
  misc_feature: Ceres ANNOT ID no. 6031736
  misc_feature (84)..(219): Pfam Id: Rhodanese Pfam Desc: Rhodanese-like domain
  misc_feature (48)..(228): NCBI GI: 20334878 NCBI Desc: at4g27700/t29a15_190 [arabidopsis thaliana]
  misc_feature (73)..(127): NCBI GI: 114330671 NCBI Desc: rhodanese domain protein [nitrosomonas eutropha c71]
  misc_feature (189)..(224): NCBI GI: 106891892 NCBI Desc: rhodanese-like [roseiflexus sp. rs-1]
  misc_feature (145)..(222): NCBI GI: 23507795 NCBI Desc: at5g66040/k2a18_11 [arabidopsis thaliana]
  misc_feature (157)..(225): NCBI GI: 48477891 NCBI Desc: rhodanese-related sulfurtransferases [picrophilus torridus dsm 9790]
MITMLAASSVVNSNLACSSRISSCSDFTSGHSWRPIEAVKLHRRAVSSIRISCAATKPAKTPAEEEWKVKRQLLAEKRVRSVDVKEALRLQKENNFVILDVRPEAEFKEAHPPGAINVQIYRLIKEWTAWDIARRAAFAFFGIFAGTEENPEFIQSVDVKVGKNAKIIVACSTGGTLKPTQNFPDGKQSRSLIAAYLLVLNGYSNVYHLEGGLYTWFKEGLPAVEGEE

SEQ ID NO: 3517 - DNA, 759 bp, Sorghum bicolor
  misc_feature: Ceres ANNOT ID no. 6031738
  misc_feature: Encodes the peptide sequence at SEQ ID NO 3518
atgaggaggaggcctgggatcgctggcttgcagaatgcggcggctactcgcgaccaattccggctggtcggggagaatgtggccaaggtcaggaccgatgtcatgaaggagcagcttgcgacgttccggtcacagctcgaggaatttgctcgcaagcataagagtgacatccgtaaaaacccggtatttagacagcagtttcatgagatgtgcgcaaaagttggagtagatccattggcatccaataaaggagtctgggcagaacttctagggattggtgacttctactatgaacttggagttcagatagttgacatatgcattgcaaccagatcgcataatggtggcctgattgatttattggatctccgcaaactgcttggtcagaagagaaaagctaccctggaatcattatctgaagatgactgtttacgtgctataagcaagctaaaagtccttggcagtggttttgaagtaatttctgtcgggaggaggaagcttgtgcgttcggttcctaccgaattaaataaagaccacagtgggatacttgggctagctcaggctgagggctatgtcacggtagaacaagtcgaaagggaattctcatggtctactgggcgtgcaattgatgctcttgaaactttgctgaaggaggggcttgctatgatcgatgatggccatagggacggcaaacgaagatattggttcccatgcgttactgtcagctccgacacagctgctgttgaagccaagtcatga

SEQ ID NO: 3518 - protein, 252 aa, Sorghum bicolor
  misc_feature: Ceres ANNOT ID no. 6031738
  misc_feature (5)..(224): Pfam Id: EAP30 Pfam Desc: EAP30
  misc_feature (1)..(245): NCBI GI: 56461758 NCBI Desc: at4g27040 [arabidopsis thaliana]
  misc_feature (149)..(250): NCBI GI: 115480301 NCBI Desc: os09g0529700 [oryza sativa (japonica cultivar-group)]
  misc_feature (70)..(245): NCBI GI: 7269557 NCBI Desc: snf8 like protein [arabidopsis thaliana]
  misc_feature (2)..(251): NCBI GI: 73919325 NCBI Desc: vacuolar sorting protein snf8 (ell-associated protein of 30 kda)
  misc_feature (2)..(251): NCBI GI: 119615105 NCBI Desc: snf8, escrt-ii complex subunit, homolog (s. cerevisiae), isoform cra_b [homo sapiens]
MRRRPGIAGLQNAAATRDQFRLVGENVAKVRTDVMKEQLATFRSQLEEFARKHKSDIRKNPVFRQQFHEMCAKVGVDPLASNKGVWAELLGIGDFYYELGVQIVDICIATRSHNGGLIDLLDLRKLLGQKRKATLESLSEDDCLRAISKLKVLGSGFEVISVGRRKLVRSVPTELNKDHSGILGLAQAEGYVTVEQVEREFSWSTGRAIDALETLLKEGLAMIDDGHRDGKRRYWFPCVTVSSDTAAVEAKS

SEQ ID NO: 3519 - DNA, 636 bp, Sorghum bicolor
  misc_feature: Ceres ANNOT ID no. 6031762
  misc_feature: Encodes the peptide sequence at SEQ ID NO 3520
atgcggacgatctgcgatgtgtgcgagagcgcaccggcggtgctcttctgtgcggccgacgaggcagcgctctgtcggtcctgcgacgagaaggtacacatgtgtaacaagcttgctagtcggcatgtgagagttggacttgcagaccctaataaacttgcccgttgtgatatatgtgaaaattcacctgctttcttctactgtgagatagatggcacctcactttgcctgagctgtgatatgactgttcatgttggtggcaaacgaacccatggaagatacctgctcctaaggcaaagggttgaatttccaggagataaaccaggccatatggatgacgtgcctatggaaaccgtgcctatggaaaccaaagatcctgaaaaccagagagaccagaagaaggcgcccaaggagcaaatggcaaaccaccataatggcgatcacccagcctgtgatggcaattgcgatgaccagggcaacattgattcgaaaatgatcgatcttaatatgcggccagttcgtactcatgggcaaggatcaaattcccagactcagggggtagatcttagtgtgaacaaccatgactctccaggggtggtgccaactagcaattctgaaagagacgccagcaagtaa

SEQ ID NO: 3520 - protein, 211 aa, Sorghum bicolor
  misc_feature: Ceres ANNOT ID no. 6031762
  misc_feature (1)..(47): Pfam Id: zf-B_box Pfam Desc: B-box zinc finger
  misc_feature (51)..(96): Pfam Id: zf-B_box Pfam Desc: B-box zinc finger
  misc_feature (1)..(108): NCBI GI: 22329245 NCBI Desc: zinc finger (b-box type) family protein [arabidopsis thaliana]
  misc_feature (34)..(108): NCBI GI: 38603920 NCBI Desc: at4g38960 [arabidopsis thaliana]
  misc_feature (1)..(129): NCBI GI: 78173056 NCBI Desc: salt-tolerance protein [glycine max]
  misc_feature (1)..(130): NCBI GI: 4836873 NCBI Desc: highly similar to rice zinc finger protein [arabidopsis thaliana]
  misc_feature (1)..(137): NCBI GI: 38346228 NCBI Desc: oj990528_30.8 [oryza sativa (japonica cultivar-group)]
  misc_feature: The plant flowers significantly late compared to wild-type.
  misc_feature: The sequence is a functional homolog of SEQ ID NO 1023 in the 10/666,642US patent application
  misc_feature: The sequence is a functional homolog of SEQ ID NO 1024 in the 10/666,642US patent application
  misc_feature: The sequence is a functional homolog of SEQ ID NO 1300 in the 11/479,226US patent application
  misc_feature: The sequence is a functional homolog of SEQ ID NO 16 in the 10/412,699US patent application
  misc_feature: The sequence is a functional homolog of SEQ ID NO 1645 in the 10/374,780US patent application
  misc_feature: The sequence is a functional homolog of SEQ ID NO 1646 in the 10/374,780US patent application
  misc_feature: The sequence is a functional homolog of SEQ ID NO 1671 in the 10/412,699US patent application
  misc_feature: The sequence is a functional homolog of SEQ ID NO 1672 in the 10/412,699US patent application
  misc_feature: The sequence is a functional homolog of SEQ ID NO 36 in the 10/666,642US patent application
  misc_feature: The sequence is a functional homolog of SEQ ID NO 60 in the 10/412,699US patent application
  misc_feature: The sequence is a functional homolog of SEQ ID NO 602 in the 10/412,699US patent application
  misc_feature: Useful for making plants with altered Lignin content
  misc_feature: Useful for making plants with altered alkaloid content
  misc_feature: Useful for making plants with modulated flowering time
  misc_feature: Useful for making plants with modulated growth and phenotype characteristics
  misc_feature: Functional homolog of the protein sequence given in SEQ ID NO 13305
  misc_feature: The sequence is a functional homolog of SEQ ID NO 16 in the 20040045049 US patent application
  misc_feature: The sequence is a functional homolog of SEQ ID NO 1671 in the 20040045049 US patent application
  misc_feature: The sequence is a functional homolog of SEQ ID NO 1672 in the 20040045049 US patent application
  misc_feature: The sequence is a functional homolog of SEQ ID NO 60 in the 20040045049 US patent application
  misc_feature: The sequence is a functional homolog of SEQ ID NO 602 in the 20040045049 US patent application
  misc_feature: The sequence is a functional homolog of SEQ ID NO 1300 in the 11/479,226 US patent application
  misc_feature: The sequence is a functional homolog of SEQ ID NO 602 in the 10/412,699 US patent application
  misc_feature: Useful for making plants with altered alkaloid content
  misc_feature: Useful for making plants with altered lignin content
  misc_feature: Useful for making plants with modulated flowering time
  misc_feature: Functional homolog of the protein sequence given in SEQ ID NO 13305
  misc_feature: The sequence is a functional homolog of SEQ ID NO. 370 in the 11/188,298 US application
MRTICDVCESAPAVLFCAADEAALCRSCDEKVHMCNKLASRHVRVGLADPNKLARCDICENSPAFFYCEIDGTSLCLSCDMTVHVGGKRTHGRYLLLRQRVEFPGDKPGHMDDVPMETVPMETKDPENQRDQKKAPKEQMANHHNGDHPACDGNCDDQGNIDSKMIDLNMRPVRTHGQGSNSQTQGVDLSVNNHDSPGVVPTSNSERDASK

SEQ ID NO: 3521 - DNA, 1572 bp, Sorghum bicolor
  misc_feature: Ceres ANNOT ID no. 6031764
  misc_feature: Encodes the peptide sequence at SEQ ID NO 3522
atggcgccttgctctgctcctcgctcatctcccgtccaccatttgtgtgtgcacatcctactagcgtccttgctcgcggcgcggtggctcgtgccatcctgctcggcttcctccttcttccgcgtcccttggcccgccgggcgcgggcggcacgactaccgtgacgcgctggccaagtccatcctcttcttcgagggccagcgctcggggcggctgccgccgggccagcgcgcgtcgtggcgcggggactccggcgtgtcggacggcgccgcggccggggtcgacctggagggcgggtactacgacgccggcgacaacgtcaagttcggcttccccatggcgttcaccaccaccatgctggcctggagcgtcatcgagttcggcgactccatgccgcgcgacgagcgccgccacgccgccgccgccgtccgctgggccaccgactacctcctcaagacgctcgcccaccccggcgtcatcttcctgcaggtaggcgatccgtggaaggatcacgactgctgggagaggccggaggacatggacacggaccgcacggtgtacaacgtcagcgcggggcggccgggctcggacatcgcgggggagacggcggcggcattggcggccgcgtccatggtgttccgagatgccgacccggagtacgccgagacgctgctcacgagcgcgagaaaggcgttcgagttcgcggacacgtacaagggcgcgtacagcgacgacccagacctcagggcagggggctgcccgttctactgcgacttcaatggctaccaggatgagctgctgtggggagcagcatggctaaggagagcctccgaggatgacacattcctccaatacattcagaacaatggcaagacccttggtgcagaagacagcagtaacgagttcgggtgggacaacaagcatgccggcctcaacgtccttgtttccaaggagttcatagaaggcgacgcgctatctttgcagtcctacaaggagtttgcagacagcttcatatgcacgctcattccagagtcgtcttcaccacatatcacgtacacacctgggggcatgatctacaagcctggaggcagcaacatgcagcatgtcacctccatctccttcttgctcctaacttacgccaagtacctctccaagtcctctcatactgtcaactgtggagacgtttcagttggccctctaactcttcagctgcaagccaaaaaacaggttgattacttgttaggagataatccaatgaagatgtcgtatatgatcgggtacggtgaccggtaccctcagcggatccatcaccgggcatcgtcattgccctcgatcaaggaccatcctcaacagatggtgtgcaaagaaggcacgccatacttcaattcatctagcgcgaaccctaacccgttgatcggcgcagtggtcggcggcccgggggaggatgatgcttatgaggatgaccgtgcagatttcaggaaatctgaacccaccacctacatcaatgctccattggtaggagtgcttgcatactttgttggcaatcctaatcctggccataccagacattga

SEQ ID NO: 3522 - protein, 523 aa, Sorghum bicolor
  misc_feature: Ceres ANNOT ID no. 6031764
  misc_feature (52)..(510): Pfam Id: Glyco_hydro_9 Pfam Desc: Glycosyl hydrolase family 9
  misc_feature (1)..(523): NCBI GI: 75254313 NCBI Desc: endoglucanase 23 precursor (endo-1,4-beta glucanase 23) (osglu12)
  misc_feature (46)..(502): NCBI GI: 85376225 NCBI Desc: endo-1,4-beta-glucanase precursor [glycine max]
  misc_feature (48)..(515): NCBI GI: 33341254 NCBI Desc: endo-1,4-beta-glucanase isoform 07 [fragaria x ananassa]
  misc_feature (48)..(515): NCBI GI: 33341256 NCBI Desc: endo-1,4-beta-glucanase isoform 08 [fragaria x ananassa]
  misc_feature (48)..(515): NCBI GI: 4972234 NCBI Desc: endo-beta-1,4-glucanase [fragaria x ananassa]
  misc_feature (1)..(523): SWISSPROT Homolog: EC 3.2.1.4 Endoglucanase 23 precursor
  misc_feature: Useful for making plants with altered cell wall content and/or composition
  misc_feature: Functional homolog of the protein sequence encoded by LOCUS at4g38990
  misc_feature: Functional homolog of the protein sequence encoded by LOCUS at4g39000
  misc_feature: GREAT-hit functional homolog of the protein sequence encoded by LOCUS at4g39010
  misc_feature: Useful for making plants with altered cell wall content and/or composition
  misc_feature: Functional homolog of the protein sequence given in SEQ ID NO 13840
  misc_feature: Useful for making plants with altered carbohydrate content
  misc_feature: Functional homolog of the protein sequence given in SEQ ID NO 13691
  misc_feature: Useful for biocontainment applications
  misc_feature: Useful for making plants with modulated nitrogen use efficiency
  misc_feature: Functional homolog of the protein sequence given in SEQ ID NO 13445
MAPCSAPRSSPVHHLCVHILLASLLAARWLVPSCSASSFFRVPWPAGRGRHDYRDALAKSILFFEGQRSGRLPPGQRASWRGDSGVSDGAAAGVDLEGGYYDAGDNVKFGFPMAFTTTMLAWSVIEFGDSMPRDERRHAAAAVRWATDYLLKTLAHPGVIFLQVGDPWKDHDCWERPEDMDTDRTVYNVSAGRPGSDIAGETAAALAAASMVFRDADPEYAETLLTSARKAFEFADTYKGAYSDDPDLRAGGCPFYCDFNGYQDELLWGAAWLRRASEDDTFLQYIQNNGKTLGAEDSSNEFGWDNKHAGLNVLVSKEFIEGDALSLQSYKEFADSFICTLIPESSSPHITYTPGGMIYKPGGSNMQHVTSISFLLLTYAKYLSKSSHTVNCGDVSVGPLTLQLQAKKQVDYLLGDNPMKMSYMIGYGDRYPQRIHHRASSLPSIKDHPQQMVCKEGTPYFNSSSANPNPLIGAVVGGPGEDDAYEDDRADFRKSEPTTYINAPLVGVLAYFVGNPNPGHTRH

SEQ ID NO: 3523 - DNA, 2052 bp, Sorghum bicolor
  misc_feature: Ceres ANNOT ID no. 6031783
  misc_feature: Encodes the peptide sequence at SEQ ID NO 3524
atgccgactccgaagcagcggctcccctactccacctccggcgggggcggaggaggagggaggcgcgccgcctcgagctccgccgcgctgcctcccgtggtggtcctcgtgttcctcttcgtggtcgcgccttcgctcttcttcgtcgcgcgcaatggcggtcgcggccacgtccacgtagcctccgatcccaagggcaagaatgtcgatcaggaagcagcagcaatgaagaacctcaaatctattttgcctaaggaggtgtttgatgctataactgctagtcaacaagaatcaggcactttgagtcttgattttttcaggaatcatgcatctccctcttggaaaactgatgatctagtcaccgagaagagcatggatgttgatgacaaggctaaagctgaaaacagtttgccagaacatgatctaccaacaaatagatcacccaaagatccagacgaacatcaagttgataaagcagcaaaagtagctcgaaggaaacttagggagaaaaggcgtgagaagagaactatggatttggttcataaagatgatgaagcacgtgctaagctggagaatgccgctattgagcgatcaaaagctgtcgattctgctgtgcttggaaaatacagcatatggcgaaaagagaatgagaacgagaattcagactctacagttaggctgatgagggaccaagttattatggctcgtgtctattctgtgcttgctaaatcaaagaacaagaacgatctatatcaaaaactgcagacccgaatcaaggaaagccagcgggctgttggagaggcatctgctgatgctgacctgcatcacagcgcacctgagaaaatcagagcaatgggtcaagttttatcaaaggcgagagaagaactttatgattgtatggcaatcactcagagactaagggctatgcttcagtcagcagatgaacaggtcaggagcttgaagaagcagagtacatttcttagccagttggctgcaaagacaattccaaacagcattcactgcttgtctatgcgtctgacaattgattactatctcctcccccttgaggaatggaaattcccaaggagtgaaaatttagaaaacccaaatctctatcactatgcacttttctcagataatgtcttggcagcctctgttgttgtgaactcgaccatcatgaatgctaaggaaccagagaaacatgttttccatcttgtgactgacaagttaaactttggagccatgaacatgtggtttctgctgaacccacctggcaaggccaccatccatgttgagaatgtggacgaatttaagtggttgaactcatcatactgtcctgtgctgcggcaacttgagtctgctgccatgaaagagtactatttcaaagctgatcgtcccaccacactgtcagcaggttcttcgaacctaaagtatcggaaccccaagtacctctctatgctgaaccacttgaggttctatctcccagaggtctatccaaagttggataaaatactcttcctcgacgatgacatagttgtgcagaaagatttgacagggttgtgggatgttgatcttaatggaaaggtcaatggtgctgtggaaacctgtggggagagtttccaccgttttgacaagtatcttaatttttcaaatccacacattgctcggaactttgatccaaatgcatgtggctgggcttatgggatgaacatctttgatttgagggagtggaagaagaaagatattactgggatctaccacaaatggcaaaatctgaatgaagacagagctctttggaagcttgggacacttccgcctggcctcttgaccttctacaagttgacgcacccactggacaagtcatggcatgttcttggattaggatacaacccaagcatagaccgttcagagatagacagtgctgctgtggttcattacaatgggaacatgaagccatggttggagctagcaatgaccaagtaccgaccatattggaccaagtatatcaagtatgatcacccttacatccgtgggtgcaacttgagtgagtag

SEQ ID NO: 3524 - protein, 683 aa, Sorghum bicolor
  misc_feature: Ceres ANNOT ID no. 6031783
  misc_feature (341)..(657): Pfam Id: Glyco_transf_8 Pfam Desc: Glycosyl transferase family 8
  misc_feature (6)..(683): NCBI GI: 52077221 NCBI Desc: glycosyl transferase family 8 protein-like [oryza sativa (japonica cultivar-group)]
  misc_feature (93)..(683): NCBI GI: 7271113 NCBI Desc: 68 kda protein [cicer arietinum]
  misc_feature (202)..(661): NCBI GI: 115480325 NCBI Desc: os09g0531800 [oryza sativa (japonica cultivar-group)]
  misc_feature (16)..(620): NCBI GI: 23308453 NCBI Desc: at3g61130/t20k12_30 [arabidopsis thaliana]
  misc_feature (115)..(683): NCBI GI: 30691875 NCBI Desc: glycosyl transferase family 8 protein [arabidopsis thaliana]
  misc_feature: Useful for making plants with altered cell wall content and/or composition
  misc_feature: Functional homolog of the protein sequence encoded by LOCUS at2g46480
  misc_feature: GREAT-hit functional homolog of the protein sequence encoded by LOCUS at3g61130
  misc_feature: Useful for making plants with altered cell wall content and/or composition
  misc_feature: Functional homolog of the protein sequence given in SEQ ID NO 13838
  misc_feature: Useful for making plants with altered carbohydrate content
  misc_feature: Functional homolog of the protein sequence given in SEQ ID NO 13787
MPTPKQRLPYSTSGGGGGGGRRAASSSAALPPVVVLVFLFVVAPSLFFVARNGGRGHVHVASDPKGKNVDQEAAAMKNLKSILPKEVFDAITASQQESGTLSLDFFRNHASPSWKTDDLVTEKSMDVDDKAKAENSLPEHDLPTNRSPKDPDEHQVDKAAKVARRKLREKRREKRTMDLVHKDDEARAKLENAAIERSKAVDSAVLGKYSIWRKENENENSDSTVRLMRDQVIMARVYSVLAKSKNKNDLYQKLQTRIKESQRAVGEASADADLHHSAPEKIRAMGQVLSKAREELYDCMAITQRLRAMLQSADEQVRSLKKQSTFLSQLAAKTIPNSIHCLSMRLTIDYYLLPLEEWKFPRSENLENPNLYHYALFSDNVLAASVVVNSTIMNAKEPEKHVFHLVTDKLNFGAMNMWFLLNPPGKATIHVENVDEFKWLNSSYCPVLRQLESAAMKEYYFKADRPTTLSAGSSNLKYRNPKYLSMLNHLRFYLPEVYPKLDKILFLDDDIVVQKDLTGLWDVDLNGKVNGAVETCGESFHRFDKYLNFSNPHIARNFDPNACGWAYGMNIFDLREWKKKDITGIYHKWQNLNEDRALWKLGTLPPGLLTFYKLTHPLDKSWHVLGLGYNPSIDRSEIDSAAVVHYNGNMKPWLELAMTKYRPYWTKYIKYDHPYIRGCNLSE

SEQ ID NO: 3525 - DNA, 2124 bp, Sorghum bicolor
  misc_feature: Ceres ANNOT ID no. 6031789
  misc_feature: Encodes the peptide sequence at SEQ ID NO 3526
  misc_feature: Down-regulated in shoot tissues in response to salicylic acid treatment
atggctctgttcgcgctccggctcgggccgcttctcccagccccgccccaccgccgtcggatcctgcggaaccgacgatgccagggccggatcgtcgcctccaatgccgccaaccccgtgagggacggtggcgcggccgcggtggtgtggtttaagcatgacctccgcatcgacgatcacccgggcctcgccgctgccgtgtcggagccgcggcgccccgtcgtgccgctctacgtcttcgaccgacgcatcctcgccggctattcagataaaatgctggaactactgctatttgctctgaaagatcttaagatggcgttgaaatctcaagattctgatttgctcataggcctgggaaatgctgaagatgtggtgctgaaacttgtaaatgaggtacaagcaggtctaatttttacagaagaagaagttgaatatagagtgcgtgatgttctggccaatgttgaatcatctttatctaatgggtcattctcatggggaagccctcccaagatagtgtcttggagtgccccattgtatgactataagaatttggcagcagtatcgacatcacatgatgaatttctaaagaaaaaattaccattggccacacctcttgctgcggcaactttgcctgctctaaatttggagttagacacaggttctctacccactctggaagaattaaaatgtttcctgaaagacatagcaccagaggataattgggctcctctcaagagcatgtctgcgatatctattcttaaaaagacaatcagtcaaaggaagatcaaaagtaatgctacattaagcaccagcaatggagaaaacatagaggatatcaccatggattctggtgcatcaagaaagaggattataaactcaatgtttgcatcagaaaattcactggaagttaggggtggaacagatattactttggatgctttggctgcttacctaaaatacctggaaggcacagggaatgctagttggcaagagctgcatgataaagtgcgcttagctgaaaccagatatggtgcttcattctacgtcttatttggtcctgcaattcagcttggagtcatatctaggaggaaagcttacacggagactattcaatatgaaaaagatcgcaatgcaggttttctatcaccatttgggtactcaacacctacagtgacggcagcagttgatgctatatgttcgatggagtggtattggctcttggcatcaaaatcccaagtatgcgtcgaggggaaatatcctacaagaatttggagatggaagggttatcttgtacagtacacctttcttggcaacgaaggtccagctgttcttcttgtgcatggttttggagctttcctggagcattttcgtgacaatatagacaagattgctgatatgggccaccgagtttgggcaattactcttgttggctttgggaaatcagagaaaccaaatgccaactattcagaacttttctggtcagaactactgagagacttcattgtcgatattgtgagggagcctgttcatcttcttggcaactctattggaggttatatctgtgcaattgctgctggtttatggccttctcttgcaaaatctctggttcttttaaactcagctggttcagttattccaaattactccttcgtcccactgagtgaagaaagacgaacatcatcatggctttccaggttgcaggcacagcttcttttgctcttcttgagggcaagagcagaaggcattcttaaagaatattatcctacaagaaccgaacgggtggacaagccacttctagaccagattgtaagagcgtcatatgatcctggtgctgcaacagtccttgagagtgtattcaactttaatctttcaattcctcttaactttttatttgattcttttggaggaaagatattggttatccagggtatgaaagatccccttacaaaatctgaggcgtttgttaccatgctccgagagcattgcagcaaggttcaaatcagagagttgaatgcagggcatgctccacatgatgaagttccagatgaagtaaatgccatactatgtaaatgggtggaacagatggaagttaagccagccctagagaagaccaaggcaatatag

SEQ ID NO: 3526 - protein, 707 aa, Sorghum bicolor
  misc_feature: Ceres ANNOT ID no. 6031789
  misc_feature (468)..(690): Pfam Id: Abhydrolase_1 Pfam Desc: alpha/beta hydrolase fold
  misc_feature (45)..(215): Pfam Id: DNA_photolyase Pfam Desc: DNA photolyase
  misc_feature (1)..(694): NCBI GI: 52077228 NCBI Desc: deoxyribodipyrimidine photolyase family protein-like [oryza sativa (japonica cultivar-group)]
  misc_feature (424)..(691): NCBI GI: 67925245 NCBI Desc: alpha/beta hydrolase fold [crocosphaera watsonii wh 8501]
  misc_feature (420)..(692): NCBI GI: 113475883 NCBI Desc: alpha/beta hydrolase fold [trichodesmium erythraeum ims101]
  misc_feature (424)..(692): NCBI GI: 119492673 NCBI Desc: alpha/beta hydrolase fold protein [lyngbya sp. pcc 8106]
  misc_feature (424)..(693): NCBI GI: 86605207 NCBI Desc: hydrolase, alpha/beta fold family [cyanobacteria bacterium yellowstone a-prime]
  misc_feature: Useful for making plants with modulated light quality response
  misc_feature: Functional homolog of the protein sequence given in SEQ ID NO 13431
  misc_feature: Down-regulated in shoot tissues in response to salicylic acid treatment
MALFALRLGPLLPAPPHRRRILRNRRCQGRIVASNAANPVRDGGAAAVVWFKHDLRIDDHPGLAAAVSEPRRPVVPLYVFDRRILAGYSDKMLELLLFALKDLKMALKSQDSDLLIGLGNAEDVVLKLVNEVQAGLIFTEEEVEYRVRDVLANVESSLSNGSFSWGSPPKIVSWSAPLYDYKNLAAVSTSHDEFLKKKLPLATPLAAATLPALNLELDTGSLPTLEELKCFLKDIAPEDNWAPLKSMSAISILKKTISQRKIKSNATLSTSNGENIEDITMDSGASRKRIINSMFASENSLEVRGGTDITLDALAAYLKYLEGTGNASWQELHDKVRLAETRYGASFYVLFGPAIQLGVISRRKAYTETIQYEKDRNAGFLSPFGYSTPTVTAAVDAICSMEWYWLLASKSQVCVEGKYPTRIWRWKGYLVQYTFLGNEGPAVLLVHGFGAFLEHFRDNIDKIADMGHRVWAITLVGFGKSEKPNANYSELFWSELLRDFIVDIVREPVHLLGNSIGGYICAIAAGLWPSLAKSLVLLNSAGSVIPNYSFVPLSEERRTSSWLSRLQAQLLLLFLRARAEGILKEYYPTRTERVDKPLLDQIVRASYDPGAATVLESVFNFNLSIPLNFLFDSFGGKILVIQGMKDPLTKSEAFVTMLREHCSKVQIRELNAGHAPHDEVPDEVNAILCKWVEQMEVKPALEKTKAI

SEQ ID NO: 3527 - DNA, 3123 bp, Sorghum bicolor
  misc_feature: Ceres ANNOT ID no. 6031792
  misc_feature: Encodes the peptide sequence at SEQ ID NO 3528
atggtgagtgcgttcttgccctctctctttctctctcgcacgccccggctgtcgtccgacatccggaaatggttcatgaaggcgcatggcaagaacgcggcgccctctggagctgccgccacgaagccctcgggagcggcggcggccgagaagaagaagcccgtgctcagcattcctgagaagaagtcggcgccgcctgcattgggatccagtttcggtcaatgtgttacttgcagcaacaatagggccatagggaatttccctgttggtcaatgtgttacttgcagcaacaatagggccatagggaatttccctgtggcgtcctgtgatcatgatcctcctgctagaaggaagacaagtaagtactttgggtcaaaagcagaaaaggactcagatgttgaaatggcagacgcctctgcgggaaacagtgctgacaagagcgcggctaaaagaaaacttcagaaatgcaacaatgaactcaaggaggacaacaagcctttgccggcaaagaaaatatctaaggatgaagaagatgacgatgacgactttgtggcacctccgaagaagaaaactccagtgaagccaccgccttcaaaaaaggctaaagttgaatctaatgctcaagttgatgatgctgaggatgaggacaggatggatgaagatgccaagaccccctcaaaaggagctggaagaggaaggggaaggggaggaagaggaggagcaggagctgctcctgggggcagaggtagaggaggaggtgggagaggttttatgaattttggagagaggaaagatcctcctcacaaaggagaaaaggaggtcccagagggtgcccctgattgtttatctggtctgacatttgtcataagtggtacccttgacagtcttgaacgtgaggaagcagctgatctaattaagcgttatggtggccgtgtgactggctctattagtaaaaagacgagctacttactggctgacgaagaccttggtggagttaaatctaacaaagcaaaagatctgggtgtcccattcttgactgaagatggtttatttgatttgatccgaaaatcaaaacctgcaaaagctcctgtagacaaacaacaaagcaacaacagctttgaaaagcttcagaaatcacagacaaagagctctccagctaaagttgaaaaacgagccgaagcaagtgctgtgggcaaaagtattgcttcaaatagtaatgctgcaagtgcctccgctgacaaacaaaagcccaagaatgttgaccgtggttctatgcaatggacagaaaaatatcgtccaaaagttccaaatgacatagttggcaatcaatcaatggtcaaacaacttcatgattggttgaaaagttgggatgcactatttcttcattctggccaaaagggtaagggaaagaaacaagctgacagtgcagccaaaaaggctgtgttgctgagtggacctcctggtattggtaagaccacaactgctaaagttgttagtcagatgcttggattgcaggccattgaggtaaatgcgagtgatagccgtggtaaggcagactccaagattgagaagggtgttggggggagtacatcaaattctatcaaagagcttatcagcaacgcgactctgaattatggtgacaaccggtcaaaacatcccaaagctgtactaatcatggatgaagttgacggtatgtctgctggagatagaggtggtgttgctgatcttattgctagcatcaagatatccaagatccctattatctgcatttgtaatgaccgttatagccagaaattgaagagtcttgttaattactgcctgatgctcaacttcagaaaaccaacgaaacaacagatgggtaaaagattgatggaaattgccaaaaaggaaggtattcaagctcaagagaatgcaatggaagagcttgctgaaagagtgcacggtgatattcgcatggcactcaatcatttgcagtatatgagcctctcccaatcagtggtcaaatatgatgatataagggagcggcttaatagcagttcaaaggatgaagatatttctccttttactgctgttgacaaactttttggtttcaatggtgggaggttaaggatggatgagagaattgattttggcatgagcgatcctgatttagttcccttgatcatccaggaaaattatatcaattatcggcctaacaccctcgggaaggatgaaagtggagttaaaagaatgaatgctctagcccgggctgctgaatctatagcggacggtgatcttgttaatgtacaaataagaagatatcgacagtggcagttgtcgcaagctgcttgttttgcttcatctatagtacctgccgcttggatgcatgggaacagagaagtccttgaaggtgagcggaactttaataggtttggtggatggttgggtaaatactcgactactaacaaaaacagaaggctactggaagatgttcacagtcatattcttgcctcccagcaagcaaacttggacagggaggcattgaggttggattatcttactcttatcttgagagagctgactgatccactgaaaaaaatgccaaaggatgaagccgttcaaaaggtggtagagtttatggatacatactctttaagccaggaagactttgacacgattgtggaagtatccaaatttaagggtcatccaagtcccatggatgggattcaacctgctgttaaaagtgccttgacaaaggcatacaaacaaggaagtagttctcgtgttgttcgagcagcagatctaatcaatattccaggcatgaaaaagcctttaaagaaacgagtggcggcaatcttggagccactagaagagagcgtgcctgaagaaaatggactcgcatcagctgaagatgacgaagatgattcttctgatactgaaaataatgatgaacttgtgcctgccgattctacgccgaagctggacctgcaaagtgacaagaagaaaggaattcaagtccagcttgacctgaagagcaatgggaatggctctagtgggaagaaggcgcctgccgccagatcaagagcgactgggtccagtgggaaggccgctgcgggaggctcggctgggaagaggaagaggtaa

SEQ ID NO: 3528 - protein, 1040 aa, Sorghum bicolor
  misc_feature: Ceres ANNOT ID no. 6031792
  misc_feature (754)..(916): Pfam Id: RFC1 Pfam Desc: Replication factor RFC1 C terminal domain
  misc_feature (277)..(354): Pfam Id: BRCT Pfam Desc: BRCA1 C Terminus (BRCT) domain
  misc_feature (480)..(663): Pfam Id: AAA Pfam Desc: ATPase family associated with various cellular activities(AAA)
  misc_feature (17)..(1040): NCBI GI: 30314655 NCBI Desc: replication factor c 110 kda subunit [oryza sativa (japonica cultivar-group)]
  misc_feature (149)..(1040): NCBI GI: 13374860 NCBI Desc: replication factor c large subunit-like protein [arabidopsis thaliana]
  misc_feature (498)..(1040): NCBI GI: 22095163 NCBI Desc: replication factor c large subunit [triticum sp.]
  misc_feature (255)..(934): NCBI GI: 460932 NCBI Desc: isre-binding protein
  misc_feature (255)..(934): NCBI GI: 54887426 NCBI Desc: replication factor c 1 [mus musculus]
MVSAFLPSLFLSRTPRLSSDIRKWFMKAHGKNAAPSGAAATKPSGAAAAEKKKPVLSIPEKKSAPPALGSSFGQCVTCSNNRAIGNFPVGQCVTCSNNRAIGNFPVASCDHDPPARRKTSKYFGSKAEKDSDVEMADASAGNSADKSAAKRKLQKCNNELKEDNKPLPAKKISKDEEDDDDDFVAPPKKKTPVKPPPSKKAKVESNAQVDDAEDEDRMDEDAKTPSKGAGRGRGRGGRGGAGAAPGGRGRGGGGRGFMNFGERKDPPHKGEKEVPEGAPDCLSGLTFVISGTLDSLEREEAADLIKRYGGRVTGSISKKTSYLLADEDLGGVKSNKAKDLGVPFLTEDGLFDLIRKSKPAKAPVDKQQSNNSFEKLQKSQTKSSPAKVEKRAEASAVGKSIASNSNAASASADKQKPKNVDRGSMQWTEKYRPKVPNDIVGNQSMVKQLHDWLKSWDALFLHSGQKGKGKKQADSAAKKAVLLSGPPGIGKTTTAKVVSQMLGLQAIEVNASDSRGKADSKIEKGVGGSTSNSIKELISNATLNYGDNRSKHPKAVLIMDEVDGMSAGDRGGVADLIASIKISKIPIICICNDRYSQKLKSLVNYCLMLNFRKPTKQQMGKRLMEIAKKEGIQAQENAMEELAERVHGDIRMALNHLQYMSLSQSVVKYDDIRERLNSSSKDEDISPFTAVDKLFGFNGGRLRMDERIDFGMSDPDLVPLIIQENYINYRPNTLGKDESGVKRMNALARAAESIADGDLVNVQIRRYRQWQLSQAACFASSIVPAAWMHGNREVLEGERNFNRFGGWLGKYSTTNKNRRLLEDVHSHILASQQANLDREALRLDYLTLILRELTDPLKKMPKDEAVQKVVEFMDTYSLSQEDFDTIVEVSKFKGHPSPMDGIQPAVKSALTKAYKQGSSSRVVRAADLINIPGMKKPLKKRVAAILEPLEESVPEENGLASAEDDEDDSSDTENNDELVPADSTPKLDLQSDKKKGIQVQLDLKSNGNGSSGKKAPAARSRATGSSGKAAAGGSAGKRKR

SEQ ID NO: 3529 - DNA, 2709 bp, Sorghum bicolor
  misc_feature: Ceres ANNOT ID no. 6031793
  misc_feature: Encodes the peptide sequence at SEQ ID NO 3530
atggcggccaataatagtgacccaatcccggatcagctgggggaaggaggggcgggcgtgaagcacgaaacaggggaggaggtgggggaggagacgtcttcttccgcggcgcaggcgaccgcgacgacgatgctgccccggtcgagctcgcggccgcagctggacctcagcggcgccgcgatccacgggacgctggaggaccgcaaccctaccatcctgcttcccaaccaatccgacgacatctcccacctcgcccttgacatcggcggatctcttataaaactggtatacttctcgcgacatgctgagctttccactgaagataagcgcaagatatccacaaagagaaaacttgggatgtttaatggtggcaggagaagctacccgattcttggagggaggctccactttgtcaaattcgagactgggaagctaaatgaatgtttggatttcatttcttccaaacaactacatcgtggtggaattgattcaccttcgtggcgctcgggagctcagcctgatgacattgtaattaaggcaacaggtggtggagcatacaagtatgcagatgtcttcaaggaaagattgggagtcagccttgaaaaggaagatgaaatggactgtcttgtggctggagcaaactttttgcttaaggctatacgtcatgaagcttttacacacatggatggtcagaagcgatatgttcagattgatcagaatgacttgtttcccttccttcttgttaatatcggatctggtgttagtataatcaaggttgacgggcatggggaatttcagcgagtaagtgggacaaatgttggtggtggtacgtactggggattggggaagctaatgacaaagtgcaagagttttgatgagttgctagagttgagccagcgtggagacaacagcaccatggacatgcttataggagacatatatggtggtctggactactccaagattggtctttcagcatctacaatcgcctctagttttggaaagataatttcagaaaacaaagagctatcagattatagacctgaggatatatcgctctccttgttacggatgatttcatacaacattggccagatttcctatctaaacgcacttcgttatggactcaagaggatattttttggtggattcttcatccgtgggcatgcctacaccatggatacaatttcttttgcagtgcatttctggtcaaaaggagaggcacaagctatgtttctgcgccatgagggcttcctaggagctcttggagcatttatgagttatgagaagcatggtcttgatgacttaagggcacatcatttggttgaacgcttcccaatgggtgctccatatgttggtggaaagattcacgggccacctcttggagatctcaatgagaagatatcatggatggagaagtttgtgcagaagggtactcagattactgcccctgtacctatgggggttccagctacgacaggtatgggaggctttgaaaggccgacttctaagggtgacattttgcggtcagatgcaagtgcagcgctcaatgttggtgttctccatctcgtacccacattggatgtgtttccattgttagaggatccaaagacgtatgaaccaaacacaattgatcttgaccaggatgagttcaagtactggttcaagattttgtcagatcatttgccggaccttgtggacaaggcagttgctagtgaaggcgggactgatgatgccaagaggcggggagatgcatttgcgcatgccttttctgctcatctggcaagattgatggaggagccagctgcttatggaaagtttggtttggtcaacctgttggagttgagagaagaatgtctgagagaatttcagtttgttgatgcatatattagcatcaagcaaagggaaaatgaagcttcactggctgttttaccagatcttctgatggaacttgacagtatgaatgaggaagctaggctgcttgctctaattgaaggtgtccttgctgcaaatatatttgattggggatctcgagcttgtgtagaactttatcacaagggaactataatagaaatctatcgcatgagtcgcaagaagatgcaacgtccttggcggattgatgactttgatatgttcaaaaagagaatgctgactgatagaaaggaccaaccatacaaaagagcactgctttttgttgataactcaggtgctgatgtggtccttggaatgcttcctttagctcgggagcttttacgccgtggaacagaggtagttcttgttgcaaattcgttgccagctttgaatgatgttactgctaatgaacttccagaaattatagctgaagcctcaaagcactgtagtatccttcggaaagctgcagaagctggtgggttgatagttgatgcaatggctggcatccaagatgatctcaaggatgagccagtgtcagtgccactaatggttgttgagaatggatgcggcagtccatgtattgatttccggcaggttagctcagagcttgctgctgctgcaaaggatgcagatttgttaattttggagggcatgggacggtcactgcataccaacctcaatgcccattttaagtgtgatgctctaaagcttgctatggtcaagaataagcgattggcagagaagctcttcaatggaaatatatacgactgcatttgtaaatttgaaccagttttttaa

SEQ ID NO: 3530 - protein, 902 aa, Sorghum bicolor
  misc_feature: Ceres ANNOT ID no. 6031793
  misc_feature (82)..(429): Pfam Id: Fumble Pfam Desc: Fumble
  misc_feature (148)..(901): NCBI GI: 115480345 NCBI Desc: os09g0533100 [oryza sativa (japonica cultivar-group)]
  misc_feature (7)..(900): NCBI GI: 30689295 NCBI Desc: eukaryotic pantothenate kinase family protein [arabidopsis thaliana]
  misc_feature (7)..(784): NCBI GI: 79326098 NCBI Desc: atp binding / pantothenate kinase [arabidopsis thaliana]
  misc_feature (25)..(717): NCBI GI: 140043833 NCBI Desc: eukaryotic pantothenate kinase [medicago truncatula]
  misc_feature (57)..(426): NCBI GI: 62898824 NCBI Desc: pantothenate kinase 4 variant [homo sapiens]
  misc_feature (37)..(900): SWISSPROT Homolog: EC 2.7.1.33 Pantothenate kinase 2
MAANNSDPIPDQLGEGGAGVKHETGEEVGEETSSSAAQATATTMLPRSSSRPQLDLSGAAIHGTLEDRNPTILLPNQSDDISHLALDIGGSLIKLVYFSRHAELSTEDKRKISTKRKLGMFNGGRRSYPILGGRLHFVKFETGKLNECLDFISSKQLHRGGIDSPSWRSGAQPDDIVIKATGGGAYKYADVFKERLGVSLEKEDEMDCLVAGANFLLKAIRHEAFTHMDGQKRYVQIDQNDLFPFLLVNIGSGVSIIKVDGHGEFQRVSGTNVGGGTYWGLGKLMTKCKSFDELLELSQRGDNSTMDMLIGDIYGGLDYSKIGLSASTIASSFGKIISENKELSDYRPEDISLSLLRMISYNIGQISYLNALRYGLKRIFFGGFFIRGHAYTMDTISFAVHFWSKGEAQAMFLRHEGFLGALGAFMSYEKHGLDDLRAHHLVERFPMGAPYVGGKIHGPPLGDLNEKISWMEKFVQKGTQITAPVPMGVPATTGMGGFERPTSKGDILRSDASAALNVGVLHLVPTLDVFPLLEDPKTYEPNTIDLDQDEFKYWFKILSDHLPDLVDKAVASEGGTDDAKRRGDAFAHAFSAHLARLMEEPAAYGKFGLVNLLELREECLREFQFVDAYISIKQRENEASLAVLPDLLMELDSMNEEARLLALIEGVLAANIFDWGSRACVELYHKGTIIEIYRMSRKKMQRPWRIDDFDMFKKRMLTDRKDQPYKRALLFVDNSGADVVLGMLPLARELLRRGTEVVLVANSLPALNDVTANELPEIIAEASKHCSILRKAAEAGGLIVDAMAGIQDDLKDEPVSVPLMVVENGCGSPCIDFRQVSSELAAAAKDADLLILEGMGRSLHTNLNAHFKCDALKLAMVKNKRLAEKLFNGNIYDCICKFEPVF

SEQ ID NO: 3531 - DNA, 1200 bp, Sorghum bicolor
  misc_feature: Ceres ANNOT ID no. 6031797
  misc_feature: Encodes the peptide sequence at SEQ ID NO 3532
atgggcggcggcggcggcggcggcctcggacgccggcggcacttcgcctacctgccgctgctgctgccgcttctcctgctcgccgtggccggtgccgccgcggggaaggagaaggagaagggcgcgttcggtaagctgcggttccggcgggagagcggaacgttcaaggtggtgcaggtggcggacatgcactacgcggacggccggagcacggcctgcgaggacgtgctcccgtcccaggtggccggctgcaccgacctcaacaccaccgccttcctctaccgcgtcttccgcgccgaggagcccgacctcgtcgtcttcacaggtgataacatctatggtgccaattcaactgatgcagccaagtctatggatgcagcaattgccccagccattgacatgaaacttccttgggctgctgtgattgggaaccatgaccaagaaggtacactgtcacgtgaaggtgtaatgcgtcatcttgtcggcatgaaaaacagcctttcaagcttcaatccggaaggaattgaaattgatggttacggaaattacaatttggaagtttctggagttgaaggaacacccatggatgaaaaatcagtgctcaacctgtatttcctagacagtggtgactattctactgtaccatcaatcaatggttatggttggatcaaggcttcgcagcaagtctggttccaacaaacatcttcaagtctacaggcaaagtatatgaatgagaacccgaaacagaaggaaccagcacctggccttgtgttcttccacattccactaccagagttcagcagttttacggcagccaatttcacaggagtaaagcaggagggtatcagctcagcatcaattaactctgggttctttgcctccatggtggaggctggagatgtaagggctgcctttgtgggacatgatcacattaatgacttctgcgggaagctcaatggtattcaactctgctatgctggtggatttggttaccatgcttatggaaaggctgggtggtcaaggagagcaagggtggtgtctgtgcaactcgagaaaacagacaacggtgaatggcgaggagtcaagtccatcaagacatggaagaggcttgatgataaacatcttagcacaattgactctgaggtcctctggaacagaggctctaatgggaggcgcaggaaaaatcctggtggtagttaa

SEQ ID NO: 3532 - protein, 399 aa, Sorghum bicolor
  misc_feature: Ceres ANNOT ID no. 6031797
  misc_feature (55)..(312): Pfam Id: Metallophos Pfam Desc: Calcineurin-like phosphoesterase
  misc_feature (8)..(398): NCBI GI: 50725793 NCBI Desc: pts protein-like [oryza sativa (japonica cultivar-group)]
  misc_feature (18)..(388): NCBI GI: 115469740 NCBI Desc: os06g0699200 [oryza sativa (japonica cultivar-group)]
  misc_feature (96)..(388): NCBI GI: 53791873 NCBI Desc: calcineurin-like phosphoesterase-like [oryza sativa (japonica cultivar-group)]
  misc_feature (51)..(388): NCBI GI: 6323393 NCBI Desc: dcr2p [saccharomyces cerevisiae]
  misc_feature (95)..(358): NCBI GI: 82745454 NCBI Desc: phosphohydrolase, icc family [clostridium beijerincki ncimb 8052]
MGGGGGGGLGRRRHFAYLPLLLPLLLLAVAGAAAGKEKEKGAFGKLRFRRESGTFKVVQVADMHYADGRSTACEDVLPSQVAGCTDLNTTAFLYRVFRAEEPDLVVFTGDNIYGANSTDAAKSMDAAIAPAIDMKLPWAAVIGNHDQEGTLSREGVMRHLVGMKNSLSSFNPEGIEIDGYGNYNLEVSGVEGTPMDEKSVLNLYFLDSGDYSTVPSINGYGWIKASQQVWFQQTSSSLQAKYMNENPKQKEPAPGLVFFHIPLPEFSSFTAANFTGVKQEGISSASINSGFFASMVEAGDVRAAFVGHDHINDFCGKLNGIQLCYAGGFGYHAYGKAGWSRRARVVSVQLEKTDNGEWRGVKSIKTWKRLDDKHLSTIDSEVLWNRGSNGRRRKNPGGS

SEQ ID NO: 3533 - DNA, 2640 bp, Sorghum bicolor
  misc_feature: Ceres ANNOT ID no. 6031799
  misc_feature: Encodes the peptide sequence at SEQ ID NO 3534
atggcggacgcgccggtggagctgccgagccggctcgccatactgcccttccgcaacaaggtgctgctccctggcgccatcgtgcggatccgctgcacaaaccccagtagtgtgaagttggtagagcaagagctctggcagaaggaagagaaaggcctgatcggggtacttcctgtgcgggactcggaggcaacagctgttggctctttgctgtctcctggtgaaggaggcagtaaggctggtggttctgctggagagtcgtcaaggcaggacacaaaaaatgggaaggatcccattcactggcacagcaagggagttgctgccagagctttacacctttccagaggggtggagaagccaagtggaagggttacatacattgttgttcttgaaggcctatgtaggttcaacgttcaggaactaagtgcaagaggaccataccatgttgcccgcgtttcacgccttgacatgacaaagattgaattggatcaggcagagcaggacccagatcttatcgctctttctaggcagtttaaagctactgccatggaactaatttctgttctagaacagaagcagaagacggttggtaggacaaaggtgcttcttgatacagttcctgtttacaggctagctgatatttttgttgctagctttgagataagttttgaggagcagctttcgatgctggattcagttgacttgaaagttagactttcaaaggcaactgaacttgtagacagacacctgcagtccatccttgtagctgagaaaataacgcagaaggttgaggggcagctatccaagtcacaaaaagaatttctactgcgccagcagatgagggccataaaagaagaacttggtgataacgatgatgatgaagatgatgtggctgcactggagagaaagatgcagaatgcaggaatgcccgctaatatttggaagcacgctcaaagggaaatgaggcgcctacgaaagatgcaacctcagcaacctggttatagtagctcccgagcctacttggaacttgttgctgaccttccttggcaaaaagttagtgaagaaagggagcttgaccttagagctgcaaaagagagccttgatcaggatcattatggactaacaaaagttaagcaaaggattattgagtatttggctgttcgtaagcttaaacctgatgccaggggtccagtgctgtgttttgttggaccacctggtgttgggaagacatctttggcctcctccatagcaaaggccctgaacagaaaattcataagaatctctcttggtggtgtaaaggatgaagctgatattaggggccaccgaaggacatacattggaagcatgccagggagacttattgatggactaaagagggtatctgtgagcaatccagtgatgcttctagatgaaattgacaagactggttctgatgtacgtggtgatccagcatcagcactactagaagttcttgaccctgagcagaacaaagcattcaacgatcactatttgaatgtgccgttcgacctgtcgaaagtcatatttgttgcaactgccaataggatgcaacctataccccctcctctgttagataggatggaagtcattgagctgccaggctacacacccgaagagaagttaaaaatagccatgaaacatctcataccaagggtactggagcagcatggcttgagtatgacaaatcttcagattcctgaggctatggtcaaactgatcatcgagaggtacacaagagaagctggtgtgcgcaatcttgagcggaacctagctgcgttggcccgtgcagctgctgttaaggttgcagagcaagttaaaactcttagacttggcaaggaaatacaaccaattactacaactcttcttgattcaaggcttgctgatggtggtgaagttgaaatggaagttattcctatggagcatgacatatcaaacacttacgaaaatccatctcctatgattgttgatgaggctatgctagagaaagtacttgggcctcctagatttgatgatagagaagctgcagatcgggtagcaagcccaggagtttcagttggtcttgtctggacttcggttggtggggaagttcagtttgtggaggctacagccatggtcggcaagggtgacttgcatttgactgggcagcttggtgatgttattaaggagtcagcgcagctagctctgacatgggtgagagcaagagctgctgacctcaatttgtcacctacttctgatatcaatttattggagagccgtgatattcacatacattttcctgctggtgctgtgccaaaggatgggccttctgcaggtgtgacattggtaacggctctggtgtcactttttagtaacagaaaagtcagagcagatactgctatgactggagagatgactctaaggggccttgtattaccagttggtggtgttaaggacaaggtacttgcggcacatcgctatggaatcaagagagtaattttacctgaaaggaacttgaaggacttatcagaggttccatcaccgattctctctggcatggagattctgcttgtgaagcgcatcgaggaagtactcgaccatgctttcgaaggaggatgcccacttagatcacgctccaagttatag

SEQ ID NO: 3534 - protein, 879 aa, Sorghum bicolor
  misc_feature: Ceres ANNOT ID no. 6031799
  misc_feature (660)..(869): Pfam Id: Lon_C Pfam Desc: Lon protease (S16) C-terminal proteolytic domain
  misc_feature (398)..(593): Pfam Id: AAA Pfam Desc: ATPase family associated with various cellular activities(AAA)
  misc_feature (398)..(541): Pfam Id: AAA_5 Pfam Desc: ATPase family associated with various cellular activities(AAA)
  misc_feature (398)..(535): Pfam Id: AAA_3 Pfam Desc: ATPase family associated with various cellular activities(AAA)
  misc_feature (1)..(879): NCBI GI: 1816586 NCBI Desc: lon1 protease [zea mays]
  misc_feature (1)..(879): NCBI GI: 14423366 NCBI Desc: lon protease [dichanthelium lanuginosum]
  misc_feature (1)..(879): NCBI GI: 115480351 NCBI Desc: os09g0533400 [oryza sativa (japonica cultivar-group)]
  misc_feature (1)..(879): NCBI GI: 27461708 NCBI Desc: lon protease [oryza sativa (indica cultivar-group)]
  misc_feature (1)..(879): NCBI GI: 42541823 NCBI Desc: lon1 protease [triticum aestivum]
  misc_feature: The sequence is a functional homolog of SEQ ID NO. 462 in the 11/188,298 US application
  misc_feature: The sequence is a functional homolog of SEQ ID NO. 471 in the 11/188,298 US application
MADAPVELPSRLAILPFRNKVLLPGAIVRIRCTNPSSVKLVEQELWQKEEKGLIGVLPVRDSEATAVGSLLSPGEGGSKAGGSAGESSRQDTKNGKDPIHWHSKGVAARALHLSRGVEKPSGRVTYIVVLEGLCRFNVQELSARGPYHVARVSRLDMTKIELDQAEQDPDLIALSRQFKATAMELISVLEQKQKTVGRTKVLLDTVPVYRLADIFVASFEISFEEQLSMLDSVDLKVRLSKATELVDRHLQSILVAEKITQKVEGQLSKSQKEFLLRQQMRAIKEELGDNDDDEDDVAALERKMQNAGMPANIWKHAQREMRRLRKMQPQQPGYSSSRAYLELVADLPWQKVSEERELDLRAAKESLDQDHYGLTKVKQRIIEYLAVRKLKPDARGPVLCFVGPPGVGKTSLASSIAKALNRKFIRISLGGVKDEADIRGHRRTYIGSMPGRLIDGLKRVSVSNPVMLLDEIDKTGSDVRGDPASALLEVLDPEQNKAFNDHYLNVPFDLSKVIFVATANRMQPIPPPLLDRMEVIELPGYTPEEKLKIAMKHLIPRVLEQHGLSMTNLQIPEAMVKLIIERYTREAGVRNLERNLAALARAAAVKVAEQVKTLRLGKEIQPITTTLLDSRLADGGEVEMEVIPMEHDISNTYENPSPMIVDEAMLEKVLGPPRFDDREAADRVASPGVSVGLVWTSVGGEVQFVEATAMVGKGDLHLTGQLGDVIKESAQLALTWVRARAADLNLSPTSDINLLESRDIHIHFPAGAVPKDGPSAGVTLVTALVSLFSNRKVRADTAMTGEMTLRGLVLPVGGVKDKVLAAHRYGIKRVILPERNLKDLSEVPSPILSGMEILLVKRIEEVLDHAFEGGCPLRSRSKL

SEQ ID NO: 3535 - DNA, 1578 bp, Sorghum bicolor
  misc_feature: Ceres ANNOT ID no. 6031804
  misc_feature: Encodes the peptide sequence at SEQ ID NO 3536
atggggaagtacacgcgggggtgctgcggctggctcatcgtcgcgctgattgcggcgctggtggccacggcggcgatgttcgccatcatgaagcgcaagcccggggggcgacacatcaagccgctcccggtgccgggcccccccggggccatcgactccaagtacggcgacgcgctcggggtcgcgctccagttcttccaggtccagaaggcggggaagcttgagaacaaccagatcccgtggcgtggggactcggcgctgaccgacgggaaggaagcggggctggatctttccaagggaatgtatgatgctggggatcatatgaagttcaccttcccgatggcattcacggcgacggtgctctcgtggtcggtgctggagtacggggatcagatgagcgcagcaaagcaactggaccctgccctcgatgcgctgaagtggattacagatttccttatcgctgcacatccgtctgacaatgtgttgtatattcaggttggtgatcctgatctggaccacaattgctgggaaaggccggaaacaatgactgagaagagacctctcacacagattaacaagaagtctcccggatcagatgttgctgctgaggcagcagcagccatggcagctgcttcaatggtcttcaaatccagagatactacgtattctgatgtgcttcttcaacatgcccagaagctatttacttttgccgatacttatagaggcctctcaagtgagagctatcccaagctccaagatttctataattccactagttatgttgatgaacttctgtgggcagcaagttggctctatcatgccacaggcgaccagacatatctcagttatgtaactgtacagaatgggaaaacttatgctgattggggaaggccaacatggttcagttgggatgacaaaaatccaggcacacaggttcttttgtccagactaaatttctttggctccaaacagatatctaatgctgaaaacgaggggttaaaatcgtatagagatactgcagaagctgtcatttgtggtctgattccagattcccctcaagccactgctagcagaactggaggagggttggtgtggataagcgggtggaattctctccagcatgcgaccaatgctgcattcctagctgttgtgtacagtgactacatgctctccacacggacagcggcagtgcagtgcagtggaaagtactacagccctaccgatatacgcaattttgctgcttcacaggctaattatatcttgggagacaatccaatgaagcttagctaccttgttggatatggaagcagctatccacagcaagtacatcacagaggagcgtcgatcccagcagatgcaaaaacaggctgcaaaggattccagtatctccattcatccgatccaaacccaaatgttgcagtgggtgccctggtgggtgggccattccagaatgacactttcgttgattctcgtgacaatgctgtacagacggagtccagcacctacaacagcggcaccctagtcggtctgctctctggtctcgtcaccacttcctccgtggtacagtcattcacctag

SEQ ID NO: 3536 - protein, 525 aa, Sorghum bicolor
  misc_feature: Ceres ANNOT ID no. 6031804
  misc_feature (54)..(512): Pfam Id: Glyco_hydro_9 Pfam Desc: Glycosyl hydrolase family 9
  misc_feature (1)..(525): NCBI GI: 75118825 NCBI Desc: endoglucanase 24 precursor (endo-1,4-beta glucanase 24)
  misc_feature (1)..(525): NCBI GI: 119507459 NCBI Desc: cellulase2 [pyrus communis]
  misc_feature (8)..(525): NCBI GI: 75252878 NCBI Desc: endoglucanase 18 (endo-1,4-beta glucanase 18)
  misc_feature (8)..(524): NCBI GI: 21360511 NCBI Desc: at1g19940/f6f9_1 [arabidopsis thaliana]
  misc_feature (71)..(524): NCBI GI: 92872472 NCBI Desc: glycoside transferase, six-hairpin, subgroup [medicago truncatula]
  misc_feature (1)..(525): SWISSPROT Homolog: EC 3.2.1.4 Endoglucanase 24 precursor
  misc_feature: Useful for making plants with altered cell wall content and/or composition
  misc_feature: Functional homolog of the protein sequence encoded by LOCUS at1g19940
  misc_feature: GREAT-hit functional homolog of the protein sequence encoded by LOCUS at1g75680
  misc_feature: Useful for making plants with altered cell wall content and/or composition
  misc_feature: Functional homolog of the protein sequence given in SEQ ID NO 13839
MGKYTRGCCGWLIVALIAALVATAAMFAIMKRKPGGRHIKPLPVPGPPGAIDSKYGDALGVALQFFQVQKAGKLENNQIPWRGDSALTDGKEAGLDLSKGMYDAGDHMKFTFPMAFTATVLSWSVLEYGDQMSAAKQLDPALDALKWITDFLIAAHPSDNVLYIQVGDPDLDHNCWERPETMTEKRPLTQINKKSPGSDVAAEAAAAMAAASMVFKSRDTTYSDVLLQHAQKLFTFADTYRGLSSESYPKLQDFYNSTSYVDELLWAASWLYHATGDQTYLSYVTVQNGKTYADWGRPTWFSWDDKNPGTQVLLSRLNFFGSKQISNAENEGLKSYRDTAEAVICGLIPDSPQATASRTGGGLVWISGWNSLQHATNAAFLAVVYSDYMLSTRTAAVQCSGKYYSPTDIRNFAASQANYILGDNPMKLSYLVGYGSSYPQQVHHRGASIPADAKTGCKGFQYLHSSDPNPNVAVGALVGGPFQNDTFVDSRDNAVQTESSTYNSGTLVGLLSGLVTTSSVVQSFT

SEQ ID NO: 3537 - DNA, 819 bp, Sorghum bicolor
  misc_feature: Ceres ANNOT ID no. 6031809
  misc_feature: Encodes the peptide sequence at SEQ ID NO 3538
atgaggggggcgaagcggccgctcggcgtggtgacgtcatgggtgcggcggcagccgcccaaggtgaaggccttcctagccgtcgtcaccggcatggccgcgctcgtctttatccgcttcatcgtccacgaccacgacaacctcttcgtcgccgccgaggctgcgcacgcgctcggcataggcgtcctcatctacaagctcaccaaggagaagacctgcgccggactatccctcaagtctcaggatttaactgcgttatttctagctgttagactgtactgcagctttgtcatggagtatgacatccatacgattctggacactgctacccttgtagccacactgtttgttatttatatgatacggttcaaactgaggtctacttatatggtggacaaggataactttgcattgtactatgtggtgctaccatgtgctggactggcactacttattcatccttcaacatcacataacattgtgaaccggatctcttgggcattctgtgtttatttggaagctgtttcagtgctgccacaattacggttgatgcaaaatactaagattgttgaaccgtttactgctcactatgtatttgcattgggggttgcaaggtttcttagctgcgcccactgggttctacaggttttggacacgcgtggccgtctgttgacagctctcggctatggtttgtggccatctatggtgcttttatcagaaatcgtgcagacattcatccttgcagatttctgctactactatgtgaagagtctggttggtgggcaactggtgctacggcttccctcaggggtggtgtaa

SEQ ID NO: 3538 - protein, 272 aa, Sorghum bicolor
  misc_feature: Ceres ANNOT ID no. 6031809
  misc_feature (47)..(258): Pfam Id: ER_lumen_recept Pfam Desc: ER lumen protein retaining receptor
  misc_feature (1)..(272): NCBI GI: 50725803 NCBI Desc: er lumen protein-retaining receptor-like [oryza sativa (japonica cultivar-group)]
  misc_feature (13)..(272): NCBI GI: 115480359 NCBI Desc: os09g0534200 [oryza sativa (japonica cultivar-group)]
  misc_feature (1)..(272): NCBI GI: 9369358 NCBI Desc: f10a5.5 [arabidopsis thaliana]
  misc_feature (1)..(271): NCBI GI: 140048069 NCBI Desc: er lumen protein retaining receptor [medicago truncatula]
  misc_feature (1)..(272): NCBI GI: 15223724 NCBI Desc: er lumen protein retaining receptor family protein [arabidopsis thaliana]
MRGAKRPLGVVTSWVRRQPPKVKAFLAVVTGMAALVFIRFIVHDHDNLFVAAEAAHALGIGVLIYKLTKEKTCAGLSLKSQDLTALFLAVRLYCSFVMEYDIHTILDTATLVATLFVIYMIRFKLRSTYMVDKDNFALYYVVLPCAGLALLIHPSTSHNIVNRISWAFCVYLEAVSVLPQLRLMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 3539 - DNA, 831 bp, Sorghum bicolor
  misc_feature: Ceres ANNOT ID no. 6031812
  misc_feature: Encodes the peptide sequence at SEQ ID NO 3540
atgcgggtgaagaagcgctcaaagaaccgcaaagcggtcaagttctacaccacctgcttcggcttccgcgagccgtacaaggtcctcattgacggtaccttcgtccaccacctcctcacccagcgcctcctcccggccgacgagactctccgagacctcctctcggcctccaggacgccagccctcttcacctccaagtgcatcaacgcagagctcaggcgactcggcaagtcacatgccgaatccttcgacaacgcgcagctgctcgccacaaccaagtgtgagcatgacaaggtggtcagtgccgtgaactgtgtcatgtcactgataggtgataaaaatcctgagcatttcttcgttgccacccaggatcctggtcttcgagaaaagttacgagagattcctggggttcctgtgatatatggtctgaagaactccttattcatagaacaaccctctgtgcagcaacgcaagtttgctcaattggatgaggagaagcgtctcaatatggatatatctgaatacaagaagttactgaaggctgcatcagaaggaaaaacagctgccagtgaaaatggaagtgacggagaacaacatgagaggcctatcagttctcttgtaaaaaatgctcttggtgttactgacaaaagcaagtttaaaaggaacaaagcaaagggtcctaacccactctcctgtaagaagaagaaaccaaagctccccacagttattcaaaaccaggtagctacagctgatggcgaggcgaagagaaagagggttcggaagcggaagaggggcaaaaaagataacaagcaattggagagtgcgaactag

SEQ ID NO: 3540 - protein, 276 aa, Sorghum bicolor
  misc_feature: Ceres ANNOT ID no. 6031812
  misc_feature (51)..(152): Pfam Id: Fcf1 Pfam Desc: Fcf1
  misc_feature (1)..(263): NCBI GI: 3766374 NCBI Desc: spcc18.12c [schizosaccharomyces pombe]
  misc_feature (1)..(246): NCBI GI: 119612366 NCBI Desc: chromosome 8 open reading frame 53, isoform cra_a [homo sapiens]
  misc_feature (1)..(240): NCBI GI: 48735080 NCBI Desc: mgc83220 protein [xenopus laevis]
  misc_feature (1)..(201): NCBI GI: 89268898 NCBI Desc: novel protein [xenopus tropicalis]
  misc_feature (1)..(245): NCBI GI: 116123022 NCBI Desc: ensangp00000006696 [anopheles gambiae str. pest]
MRVKKRSKNRKAVKFYTTCFGFREPYKVLIDGTFVHHLLTQRLLPADETLRDLLSASRTPALFTSKCINAELRRLGKSHAESFDNAQLLATTKCEHDKVVSAVNCVMSLIGDKNPEHFFVATQDPGLREKLREIPGVPVIYGLKNSLFIEQPSVQQRKFAQLDEEKRLNMDISEYKKLLKAASEGKTAASENGSDGEQHERPISSLVKNALGVTDKSKFKRNKAKGPNPLSCKKKKPKLPTVIQNQVATADGEAKRKRVRKRKRGKKDNKQLESAN

SEQ ID NO: 3541 - DNA, 975 bp, Sorghum bicolor
  misc_feature: Ceres ANNOT ID no. 6031813
  misc_feature: Encodes the peptide sequence at SEQ ID NO 3542
atggaaggttcgaaggggagcggaggtggcggggatggggccgggcccgaaaagcccagcgccgagtcgaaccctagcctgaatccgcccccacctaccgcggcggcgaccgaagccacggatgacggtggcgccgcggccgcggctgcggccgaggcggccaggcggcccttcacggccctcagccaggaggaggctgacctcgccctcgcccgcgtcctgcaggagcaggagcgggcgtacatgttgctccggatgaacgggggcggtggcgagggcagcgactacgggagctctgatgcagggagctacgagtacgacgaagagggagaggaggattacgaagaagaactggagcaccacctccgtgtccaccaccacgggcacccctcgggcgatggtgagggagagggagagggcgaggccgagggcgccgaggggagcgactacgacgaagagttcgaggaggacgaagaaggggagccggaagtagatcccgcagagtttgaggacgatgaggcttatgcgcgtgcgctgcaggatgctgaggagcgtgaggtcgccgcgcggcttatggctctcgctggtctcagcgattggcggacagtggatgtggagcatgaggaggaccatgtgaatgatccacaggaggcatggcaagaggttgatccagacgagtactcttatgaggagctagtcgcattgggtgaagtagttggcacagaaaacagaggtctctctgctgatacacttgcttctttaccttcagtaacatacaagatgcaagatgttcaggatggcaacacagagcaatgtgtgatttgccgcgtggaattggaggagggtgaatctttgattgcacttccctgcaagcacttataccatcctgaatgcataaaccagtggctgcaaataaataaggtatgccctatgtgcagtgcagaagtatcaacctcgggcaacaaggagccatga

SEQ ID NO: 3542 - protein, 324 aa, Sorghum bicolor
  misc_feature: Ceres ANNOT ID no. 6031813
  misc_feature (272)..(312): Pfam Id: zf-C3HC4 Pfam Desc: Zinc finger, C3HC4 type (RING finger)
  misc_feature (6)..(321): NCBI GI: 140068969 NCBI Desc: zinc finger, ring-type [medicago truncatula]
  misc_feature (217)..(321): NCBI GI: 92868552 NCBI Desc: zinc finger, ring-type; ringv [medicago truncatula]
  misc_feature (136)..(320): NCBI GI: 115460008 NCBI Desc: os04g0571200 [oryza sativa (japonica cultivar-group)]
  misc_feature (136)..(320): NCBI GI: 116310277 NCBI Desc: osigba0111l12.9 [oryza sativa (indica cultivar-group)]
  misc_feature (153)..(319): NCBI GI: 6522599 NCBI Desc: zinc-finger-like protein [arabidopsis thaliana]
  misc_feature: The sequence is a functional homolog of SEQ ID NO. 271 in the 11/188,298 US application
  misc_feature: The sequence is a functional homolog of SEQ ID NO. 329 in the 11/188,298 US application
MEGSKGSGGGGDGAGPEKPSAESNPSLNPPPPTAAATEATDDGGAAAAAAAEAARRPFTALSQEEADLALARVLQEQERAYMLLRMNGGGGEGSDYGSSDAGSYEYDEEGEEDYEEELEHHLRVHHHGHPSGDGEGEGEGEAEGAEGSDYDEEFEEDEEGEPEVDPAEFEDDEAYARALQDAEEREVAARLMALAGLSDWRTVDVEHEEDHVNDPQEAWQEVDPDEYSYEELVALGEVVGTENRGLSADTLASLPSVTYKMQDVQDGNTEQCVICRVELEEGESLIALPCKHLYHPECINQWLQINKVCPMCSAEVSTSGNKEP

SEQ ID NO: 3543 - DNA, 999 bp, Sorghum bicolor
  misc_feature: Ceres ANNOT ID no. 6031817
  misc_feature: Encodes the peptide sequence at SEQ ID NO 3544
atgtcggggttcggcgatgggtacgtggggacggcgcaggacgcggtgaagatccggcggctggagaagcagcgcgaggcggagcgccgcaagatcgaggagctcaagaacaagtccgcggacgggcagcccggcctcctccagttcggctccagcacctccgagattcttgagactgcatttaagaaggaaacagttggtctcgtcaccagggagcagtatgtcgagaagagggttaacattcgaaccaagatcgaggaggaagagaaagagaaacttcaaaagctgcaacaagaagaagaagaattgcaaatgcagaaaaggaaaaagaggagagtgaagggtgatccacgcttatctttttttgacgacattgagaatggaagtgatgaagatgattttgagaaacaagaaaccaagaaaaatggccctgtcaaacttggaaaggatccaactgtcgagacaagttttctacccgatagagaaagggaggcagaggaacaagcagaacgagaacgactgaagaagcagtggttgcgtgagcaggaattgatcaaaaatgaacctctttcaattacttacagttactgggatgggactgggcacaggagagttatccaggtccgtaaaggtgacagcattggagaattcctaagggccgttcaacagcagcttgcccctgaattccgtgaagtacggacaacttctgttgagaatctactttatgtgaaggaagatcttatcatccctcatcaacacagcttttatgaattaattatcaacaaagcgaggggcaagagtggaccgcttttccattttgacgttcatgaggatgttcgtaccattgccgatgcaacaaaagaaaaggatgagtctcatgcggggaaggttgtagagaggcattggtacgagaaaaataagcatatattcccagcttcaagatgggagatctatgacccaacaaaaaagtgggaacgctacacaatccatggggattag

SEQ ID NO: 3544 - protein, 332 aa, Sorghum bicolor
  misc_feature: Ceres ANNOT ID no. 6031817
  misc_feature (108)..(330): Pfam Id: XAP5 Pfam Desc: XAP5 protein
  misc_feature (1)..(332): NCBI GI: 144923585 NCBI Desc: xap5 protein [medicago truncatula]
  misc_feature (162)..(332): NCBI GI: 144924448 NCBI Desc: xap5 protein [medicago truncatula]
  misc_feature (8)..(329): NCBI GI: 27371281 NCBI Desc: mg:db03h09-prov protein [xenopus laevis]
  misc_feature (8)..(329): NCBI GI: 48474706 NCBI Desc: xap-5 protein
  misc_feature (8)..(329): NCBI GI: 29436863 NCBI Desc: d0h6s2654e protein [mus musculus]
MSGFGDGYVGTAQDAVKIRRLEKQREAERRKIEELKNKSADGQPGLLQFGSSTSEILETAFKKETVGLVTREQYVEKRVNIRTKIEEEEKEKLQKLQQEEEELQMQKRKKRRVKGDPRLSFFDDIENGSDEDDFEKQETKKNGPVKLGKDPTVETSFLPDREREAEEQAERERLKKQWLREQELIKNEPLSITYSYWDGTGHRRVIQVRKGDSIGEFLRAVQQQLAPEFREVRTTSVENLLYVKEDLIIPHQHSFYELIINKARGKSGPLFHFDVHEDVRTIADATKEKDESHAGKVVERHWYEKNKHIFPASRWEIYDPTKKWERYTIHGD

SEQ ID NO: 3545 - DNA, 1857 bp, Sorghum bicolor
  misc_feature: Ceres ANNOT ID no. 6031821
  misc_feature: Encodes the peptide sequence at SEQ ID NO 3546
atggtgaagatagtgacgtacaacgtgaacgggctgcggccgcgggtggcgcagcacggctcgctccgccgcctcctcgacgccctcgacgccgacatcatctgcttccaggagaccaaattgtcaaggcaggacctatctgcggatgtcatcatggctgaaggatatgaggcctttgtttcatgcaatcgctcttcaaaaggccgtggagcatactctggtgttgcaacattttgccgagtaacatcatcattttccagccaggaggttgctttgccggtagcagctgaagaaggctttactggacttcaggactatgcaaaaaatagtgaaactgttggggatttcattattgcaatgcctgtcgaggaggagggtcttggtgaaatcacaagagaggacctcctaagggttgacaatgaggggcggtgcatcatcactgatcatggacactttgttcttttcaacatatatggcccagctgttgaagaagatgataaagagcgggttcgttttaagctactcttttataagatactgcagaaaagatgggaacatctattggctcttggaaagagagtctttgttgttggtgatttgaatattgctcctgcttctatagataggtgtgacgcgccacctggcttcgagaagcaaatgttccgagtatggatgagatccatgctgagagaacatggaggtcccttttttgatgcttttagatcaaaacaccctgaaaggacaggagcatatacttgttttaatcagaaaattggtgctgaagaatataactatggttctagaatcgaccacattctcatttccggttcctgtctccatcactgtgattctgtggagtaccataacattttttgttgccatgtagaagaatgtgagataatgaatcatttcaaaagagggaattctgaaaatttgtcaaagtggaaagggggaagaagtaataagctagaaggatctgatcatattccagtttatattttactgaaagaaatacctgaacttccagttcataatatcccaccatcagctgcaagatatcttccagaggtccgtggacggcaacaaagtattgtatcattcctcgataaagggaaaatttatgagctgcaaaatgctgcaaatttgattcagtccggagatatagtaggccatagctactgtagtgataacatggaaaatagaactatagccaaggaaggactgacaactggtataactcagtttgcaaaaggtggtaaccttcctagtttgatgcgcaaggggacagatctagatcaattgacaaatgaatgtataattggcatctctcatagcagccagagagcttcactgtctagcaccaagtttgtgccaaaaaagaaaattaagagcaacttatcatctcaaccaacaatcaagtcattttttcaacgaccagggtcaaagacagtaaatgccagtaccagtaccagtaccttagttactccagcagaaaaagtagaccttacaaatcaaacatgtgttccaaacgatgatagtctacatgaaaacatgcagtgcacaacttcagcagccgaagatcaggataatacaaatgcatcatcctgttcactttcagcagacaaatctaatggtgcagcattagagtggcagagaatacaacaaaagatgaagatgacactaccgcgttgcaaagggcatcgtgaaccatgcattccgaggtctgtgaagaagggtcctaatataggccgtttgttctatgtctgtgctcgtgctcagggacctgcatcaaatccagaagcaaattgtggccactttcagtgggcacctggaaagtctaaagagaaacgtcagtga

SEQ ID NO: 3546 - protein, 618 aa, Sorghum bicolor
  misc_feature: Ceres ANNOT ID no. 6031821
  misc_feature (2)..(335): Pfam Id: Exo_endo_phos Pfam Desc: Endonuclease/Exonuclease/phosphatase family
  misc_feature (562)..(612): Pfam Id: zf-GRF Pfam Desc: GRF zinc finger
  misc_feature (1)..(618): NCBI GI: 50726587 NCBI Desc: ap endonuclease 2-like [oryza sativa (japonica cultivar-group)]
  misc_feature (2)..(593): NCBI GI: 79610414 NCBI Desc: nuclease [arabidopsis thaliana]
  misc_feature (1)..(273): NCBI GI: 123993987 NCBI Desc: apex nuclease (apurinic/apyrimidinic endonuclease) 2 [synthetic construct]
  misc_feature (1)..(273): NCBI GI: 5410346 NCBI Desc: ape2 protein [homo sapiens]
  misc_feature (1)..(273): NCBI GI: 73921677 NCBI Desc: dna-(apurinic or apyrimidinic site) lyase 2 (apurinic-apyrimidinic endonuclease 2) (ap endonuclease 2) (apex nuclease 2)
MVKIVTYNVNGLRPRVAQHGSLRRLLDALDADIICFQETKLSRQDLSADVIMAEGYEAFVSCNRSSKGRGAYSGVATFCRVTSSFSSQEVALPVAAEEGFTGLQDYAKNSETVGDFIIAMPVEEEGLGEITREDLLRVDNEGRCIITDHGHFVLFNIYGPAVEEDDKERVRFKLLFYKILQKRWEHLLALGKRVFVVGDLNIAPASIDRCDAPPGFEKQMFRVWMRSMLREHGGPFFDAFRSKHPERTGAYTCFNQKIGAEEYNYGSRIDHILISGSCLHHCDSVEYHNIFCCHVEECEIMNHFKRGNSENLSKWKGGRSNKLEGSDHIPVYILLKEIPELPVHNIPPSAARYLPEVRGRQQSIVSFLDKGKIYELQNAANLIQSGDIVGHSYCSDNMENRTIAKEGLTTGITQFAKGGNLPSLMRKGTDLDQLTNECIIGISHSSQRASLSSTKFVPKKKIKSNLSSQPTIKSFFQRPGSKTVNASTSTSTLVTPAEKVDLTNQTCVPNDDSLHENMQCTTSAAEDQDNTNASSCSLSADKSNGAALEWQRIQQKMKMTLPRCKGHREPCIPRSVKKGPNIGRLFYVCARAQGPASNPEANCGHFQWAPGKSKEKRQ

SEQ ID NO: 3547 - DNA, 651 bp, Sorghum bicolor
  misc_feature: Ceres ANNOT ID no. 6031831
  misc_feature: Encodes the peptide sequence at SEQ ID NO 3548
atgctgcggaaggccgtcgtcgccttcatcgcttgcgccgccctgtacctcgccttctccgcctactcccggcgccagagcattgcagaggttcaattaccagcagttactcacagggtctacctagatgtagaaattgatggccaacacataggtagaattgttattggtctctatggggaggttgttccaaaaacagttgaaaactttagggccctttgtacaggtgaaaaaggtgtcgggtccaatggcaaacctcttcactataaaggaacaccattccatcgtattatccctggcttcatgattcagggtggtgacatagttagaggtgacgggaaaggaagtgagtctatatatggaggcatcttcccagatgagaatttcactgtgaaacatacacatccaggtgttgttgctatggcgaattctggacttgattccaacggatcccagttttacataactactatcaagacaagctggttggatggggagcatgttgtctttggcagggtgatccagggaatggataccgtgtacgccattgaagggggtgctgggacttacaatggcaagccgaggaagaaggcggtgatcactgactctggtgagatacccaaggagaaatggggtgatcaggaagcttag

SEQ ID NO: 3548 - protein, 216 aa, Sorghum bicolor
  misc_feature: Ceres ANNOT ID no. 6031831
  misc_feature (39)..(206): Pfam Id: Pro_isomerase Pfam Desc: Cyclophilin type peptidyl-prolyl cis-trans isomerase/CLD
  misc_feature (5)..(207): NCBI GI: 23197720 NCBI Desc: cyclophilin [arabidopsis thaliana]
  misc_feature (5)..(207): NCBI GI: 21554007 NCBI Desc: cyclophilin [arabidopsis thaliana]
  misc_feature (5)..(207): NCBI GI: 2443755 NCBI Desc: cyclophilin [arabidopsis thaliana]
  misc_feature (33)..(207): NCBI GI: 32401384 NCBI Desc: cyclophilin [triticum aestivum]
  misc_feature (15)..(206): NCBI GI: 47028327 NCBI Desc: cyclophilin [bigelowiella natans]
  misc_feature (5)..(207): SWISSPROT Homolog: EC 5.2.1.8 Peptidyl-prolyl cis-trans isomerase CYP19-4 precursor
MLRKAVVAFIACAALYLAFSAYSRRQSIAEVQLPAVTHRVYLDVEIDGQHIGRIVIGLYGEVVPKTVENFRALCTGEKGVGSNGKPLHYKGTPFHRIIPGFMIQGGDIVRGDGKGSESIYGGIFPDENFTVKHTHPGVVAMANSGLDSNGSQFYITTIKTSWLDGEHVVFGRVIQGMDTVYAIEGGAGTYNGKPRKKAVITDSGEIPKEKWGDQEA

SEQ ID NO: 3549 - DNA, 750 bp, Sorghum bicolor
  misc_feature: Ceres ANNOT ID no. 6031832
  misc_feature: Encodes the peptide sequence at SEQ ID NO 3550
atgggaggccgcagaacgatcgtgttgagcctaatccttggcttactggcagctgccaatgcggtgccctttgatttcttttaccttatcctcatgtggcctggagcatactgcgaggacagcgacaatggttgctgcgtgcccaagtacggctacccggcggaggatttcttcgtcgagttcttccaaaccttcgacgtgtccattaacaagcccatagtccgttgcaggaacggcagccccttcgatgctaaaaagctggacaagatcgagaacaacatcaaccactactggatcaggctcaagtgcccgccaaccgacggcgtgaacgcgtggaagagcgcctgggacaactacggcgtctgctcaggcctcaagcagctggactacttcaaggcggcgctcagcctcaggaagcaggccgacatcctcggcgccctcgccgaccagggcatcctgccggactacaagctgtacaacacggcgaggatcaaggcggcggtggccgcgaagctgggcgtcgagccgggcctgcagtgccgggacgggccgttcggcaagaagcagctgtaccaggtctacctctgcgtggacacggacgccaagaccttcatcaagtgccccaaactgccggcgacgctgagctgcccggcgtccgtcgtcttccacccgttctacacctggatgctcaactccaccgccaccttcgactccaagatcctgctccccactcagaccatgctgaactga

SEQ ID NO: 3550 - protein, 249 aa, Sorghum bicolor
  misc_feature: Ceres ANNOT ID no. 6031832
  misc_feature (24)..(213): Pfam Id: Ribonuclease_T2 Pfam Desc: Ribonuclease T2 family
  misc_feature (4)..(248): NCBI GI: 19068149 NCBI Desc: drought-induced s-like ribonuclease [oryza sativa]
  misc_feature (4)..(248): NCBI GI: 17105171 NCBI Desc: rnase s-like protein [oryza sativa]
  misc_feature (5)..(245): NCBI GI: 21954110 NCBI Desc: rnase s-like protein [hordeum vulgare]
  misc_feature (4)..(245): NCBI GI: 20271131 NCBI Desc: s-like rnase [triticum aestivum]
  misc_feature (1)..(235): NCBI GI: 7288255 NCBI Desc: rnase s-like protein precursor [hordeum vulgare]
MGGRRTIVLSLILGLLAAANAVPFDFFYLILMWPGAYCEDSDNGCCVPKYGYPAEDFFVEFFQTFDVSINKPIVRCRNGSPFDAKKLDKIENNINHYWIRLKCPPTDGVNAWKSAWDNYGVCSGLKQLDYFKAALSLRKQADILGALADQGILPDYKLYNTARIKAAVAAKLGVEPGLQCRDGPFGKKQLYQVYLCVDTDAKTFIKCPKLPATLSCPASVVFHPFYTWMLNSTATFDSKILLPTQTMLN

SEQ ID NO: 3551 - DNA, 1551 bp, Sorghum bicolor
  misc_feature: Ceres ANNOT ID no. 6031841
  misc_feature: Encodes the peptide sequence at SEQ ID NO 3552
  misc_feature: Down-regulated in shoot tissues in response to salicylic acid treatment
atgatgcagcagatgcagcaggagccgtggaacgccgccgccgtggggctcctccggccgaccaagtcggcgccctgctcgccaatcaagccggcggcggcggcggccatgctgcgaacccactccgactccttccacgtcgcgcacaaggtgcccgtcggcgacacgccgtacgtgcgagccaagcgcgtccagctggtggacaaggatccggagaaggcgatcgcgctgttctggagtgcgatcaatgccggcgaccgcgtcgacagcgcgctcaaggacatggccatcgtgatgaagcagcagaaccgcgccgaggaggccatcgaggccatcaagtcgctgcgcagccggtgctccgaccaggcgcaggagtccctcgacaacatcctcctcgatctctacaagagatgcgggcggctggacgaccagatctcgctgctcaagcacaagctgcagctgatccaccagggccacgccttcaacggcaagcggaccaaaacggctcgctctcagggccgcaagttccaggtcaccctcgagcaagaagccaccaggctccttggtaacctgggatgggcgctgatgcagaaggagaactacacggaggcggagggggcgtaccgtcgggcgctgcttatcgggccggacaacaacaagatgtgcaatctgggcatctgcctcatgaagcagggccgcgtgctcgaggccaaggatgtgctcaagcaggtacgccccgcggcggtcgacggtctgcgcggcgccgactcccacctcaaggcctacgagcgcgcgcaagagatgctgcgggacctcgagaccaagctcgtcggccgcccgcgcgctgaccagctcgacacgaactggctcttcgatgcactgctgctgggatcgtcctcgagcatctggcagccgcagccgtgcatcgaccacttgctgccacctccggctccggctccggcttcggctccagcaccagccccggcgccgcgcgaccgcttcgccgatgaaaacgccagtgtcagcaagaagctggcggcgctccaggcgaacatgcttaatgtggacgcgcagcccttctactctctgcgagtgccgccgcttgcagcgaagcctcataacacgctgcctcagcagcagccgcagcagaaaccacataacacgctgtctcagcagcagcagcagcagaagccagctcctgcccatgatcccttgggcaacctgaagaggacacggtccggcaattgcatggacaaggcaggagcagtggtggacaaggagcaggagcagagcatcgacgagaacagcggcaggaggaagtcgctctctgctgaggacagatggccagagctgcccgaccacagcgcgttcgacgaggccatcgtcgcggctgtcctgggcccagtgctcgacgacgaaccagcagctgctgaagggaacggccatggcaagctgccgacgagctgcgacacgagcccagcggtgaaggaaaagatcggcaagaggctgaggatcttccaggacatcacacagacagtgaacaatttctga

SEQ ID NO: 3552 - protein, 516 aa, Sorghum bicolor
  misc_feature: Ceres ANNOT ID no. 6031841
  misc_feature (185)..(218): Pfam Id: TPR_2 Pfam Desc: Tetratricopeptide repeat
  misc_feature (185)..(218): Pfam Id: TPR_1 Pfam Desc: Tetratricopeptide repeat
  misc_feature (44)..(273): NCBI GI: 7211988 NCBI Desc: strong similarity to the beta-9 tubulin gene (178 gene product) gbaf060248. [arabidopsis thaliana]
  misc_feature (148)..(365): NCBI GI: 3859114 NCBI Desc: ms5-like protein [arabidopsis thaliana]
  misc_feature (30)..(283): NCBI GI: 3859112 NCBI Desc: male sterility ms5 [arabidopsis thaliana]
  misc_feature (30)..(283): NCBI GI: 4028970 NCBI Desc: pollenless3 [arabidopsis thaliana]
  misc_feature (11)..(273): NCBI GI: 102139799 NCBI Desc: male sterility protein-related [musa acuminata]
  misc_feature: Useful for making plants with altered terpenoid content
  misc_feature: Functional homolog of the protein sequence given in SEQ ID NO 13067
  misc_feature: Down-regulated in shoot tissues in response to salicylic acid treatment
MMQQMQQEPWNAAAVGLLRPTKSAPCSPIKPAAAAAMLRTHSDSFHVAHKVPVGDTPYVRAKRVQLVDKDPEKAIALFWSAINAGDRVDSALKDMAIVMKQQNRAEEAIEAIKSLRSRCSDQAQESLDNILLDLYKRCGRLDDQISLLKHKLQLIHQGHAFNGKRTKTARSQGRKFQVTLEQEATRLLGNLGWALMQKENYTEAEGAYRRALLIGPDNNKMCNLGICLMKQGRVLEAKDVLKQVRPAAVDGLRGADSHLKAYERAQEMLRDLETKLVGRPRADQLDTNWLFDALLLGSSSSIWQPQPCIDHLLPPPAPAPASAPAPAPAPRDRFADENASVSKKLAALQANMLNVDAQPFYSLRVPPLAAKPHNTLPQQQPQQKPHNTLSQQQQQQKPAPAHDPLGNLKRTRSGNCMDKAGAVVDKEQEQSIDENSGRRKSLSAEDRWPELPDHSAFDEAIVAAVLGPVLDDEPAAAEGNGHGKLPTSCDTSPAVKEKIGKRLRIFQDITQTVNNF

SEQ ID NO: 3553 - DNA, 1317 bp, Sorghum bicolor
  misc_feature: Ceres ANNOT ID no. 6031845
  misc_feature: Encodes the peptide sequence at SEQ ID NO 3554
atggcggcctccgcgtcgtccctccttgcagccgccgcatcctcatcctgcgcggccatctctccccggctcccgcgtggagctccggccgccgcctccgtcccctcgccgtcgcgtcactcctgctatcccctccgcgcttcccctgcgaggcgccatcggagccgcttcgtagccagcgccgctcccacgatgcagcctccggcggagtccagggtctccacggtagtcgatgtcgacctcggcgaccgtagctatccgatctacatcggcgcaggcctcctcgacgagccggacctgctgcagaggcatgttcatggtaagagggttctggtggtgaccaacacgaccgtcgcgccgctttacctggagaaggtgacatgggcactcacccacaacaacccgaatgtttctgtggagagcgtgatcctgcccgacggcgaaaagtacaaagatatggacacgctgatgaaggtgtttgacaaggcagtcgaatccaggtttgaccgccgatgcacatttgtagcactgggtggtggcgtcattggggacatgtgtgggtttgcagctgctgcattcctccggggcgtcaatttcatacagataccaactactctgatggcccaggtggattcatctgttggtgggaaaaccgggattaaccacccactagggaagaacttgattggggcattctaccagccacaatgtgttctaattgacacagatacactgaacacattgcctgacagggagctagcttcaggcattgctgaggtagtaaagtatgggctcataagggatgcaccattctttgagtggcaagagaagaacatgctgaaattgttagcaagagaaccaaatgctttggcctatgctatcaagagatcatgtgaaaacaaagctgaagtggttgcacaagatgagaaggaaagtggtctacgagcaacactaaacctgggtcacacatttggccatgctatcgagactgggcttggatatggagcatggctccatggggaggctgtcgcagctggaacagttatggcagctgatatgtcttaccgcctggggtggatagatgagtccctaaaaaatcgtgtggttgacatactaaagcaagccaagcttcccatcgcacctccagaggccatgaccgtggagaagtttaaaaacatcatggctgttgataagaaggtagctgatggtctgttgagactcatcctcctgaaaggaccactagggtgctgtgtctttacgggggattatgaccggaatgcactcgatgaaacccttcatgcattctgcgacaactga

SEQ ID NO: 3554 - protein, 438 aa, Sorghum bicolor
  misc_feature: Ceres ANNOT ID no. 6031845
  misc_feature (90)..(401): Pfam Id: DHQ_synthase Pfam Desc: 3-dehydroquinate synthase
  misc_feature (1)..(435): NCBI GI: 21537014 NCBI Desc: 3-dehydroquinate synthase-like protein [arabidopsis thaliana]
  misc_feature (29)..(435): NCBI GI: 18654278 NCBI Desc: dehydroquinate synthase [lycopersicon esculentum]
  misc_feature (75)..(435): NCBI GI: 10177127 NCBI Desc: 3-dehydroquinate synthase-like protein [arabidopsis thaliana]
  misc_feature (30)..(434): NCBI GI: 119856383 NCBI Desc: 3-dehydroquinate synthase [pseudomonas putida w619]
  misc_feature (79)..(432): NCBI GI: 78486473 NCBI Desc: 3-dehydroquinate synthase [thiomicrospira crunogena xcl-2]
  misc_feature (79)..(432): SWISSPROT Homolog: EC 4.2.3.4 3-dehydroquinate synthase
MAASASSLLAAAASSSCAAISPRLPRGAPAAASVPSPSRHSCYPLRASPARRHRSRFVASAAPTMQPPAESRVSTVVDVDLGDRSYPIYIGAGLLDEPDLLQRHVHGKRVLVVTNTTVAPLYLEKVTWALTHNNPNVSVESVILPDGEKYKDMDTLMKVFDKAVESRFDRRCTFVALGGGVIGDMCGFAAAAFLRGVNFIQIPTTLMAQVDSSVGGKTGINHPLGKNLIGAFYQPQCVLIDTDTLNTLPDRELASGIAEVVKYGLIRDAPFFEWQEKNMLKLLAREPNALAYAIKRSCENKAEVVAQDEKESGLRATLNLGHTFGHAIETGLGYGAWLHGEAVAAGTVMAADMSYRLGWIDESLKNRVVDILKQAKLPIAPPEAMTVEKFKNIMAVDKKVADGLLRLILLKGPLGCCVFTGDYDRNALDETLHAFCDN

SEQ ID NO: 3555 - DNA, 1608 bp, Sorghum bicolor
  misc_feature: Ceres ANNOT ID no. 6031847
  misc_feature: Encodes the peptide sequence at SEQ ID NO 3556
atggtgatgaacttggacgagccgctcgacgcggcggccgccgagaagggcgaggcggcgctgcggcggctgagcgaggccgacccggcgctcttcctctccccctcagcagacctcgctgctgccgcccgagcagcctcacagcacatctattcctctctggcgccgctctccctcgctcagccgctgccgctccctaccctcctagcggaccccgccttcgacgccgagcagatttggtcccagatcgagctgctcgcccgcccgctcctcccccgcctgcgccgccagcttcgccatctcaagcagcaaccccccttgcaacggcctcctgtggagacgcctgctgttgccgagggtgagcagttggaggaggatggagaaagtagcgaatcagaggagttgaacaatgaggaggaggaggagttggaggggacagaggatgaggaggaaatgggcgaggaggaggaagaagcggagctggatgggagaggagggaatggggtggaggataagttcctgaagatagatgagttgacggagttcctggagaagggtgaggaagaggagtatggtggtggtgccaagcggagagagaagaaggcggcgaaaaactggatggttgagagtgatgctgaggatgacgatgaggatgaagacgaggaccaattggatttagaagattttgaggatgatgatgaggagggtgaagcaggcggtggagatattcggtataaagatttttttgagaagggacataacaagcaagttaagaagagagatggttccacaaagaaagttcaattcaaggatgatgaagcacatgaatctgaatttgatgacagtgagaatgatgatggaaatgttgaaccagagcaaggtctctcaactcatgaaaaggagcgtctgaagatgcgtgctaaaatagagcaaatggagaaagctagccttgaacccagcacatggaccatgcagggagaggttactgcttctaagaggcccaaaaacagtgccctagaagtggaccttgattttgagcacaatgtaagacctgctcctgtaatcacggaggaagtgacagcttcccttgaagaaatgataaagaaaagaatcacagagagtcattttgatgatgtcgagaaacctcttatgttgccatctaaagctccaaaggagcacaaggaagtggatgaaactaagagcaagaagggtcttgctgaactatatgaggatgattatgcgcaaaaggcaggcattgcacctgcccctctttctatttcagatgaactgaagaaagaggcaaatactttatttaagcggatatgtttgaaattggatgcgctatcacatttccactttgctccaaagccagtcattgaggatatgtctgtacaagcaaatgtgcctgctttagccatggaagagattgcacctgtagccgtttctgatgcggcaatgcttgctcctgaagagatctttgaaggaaaaggtgatgttaaggaagagggggaacttacacaggctgagcgcaagagaagaagagctaacaagaaaaggagatacgcagcatcccataaggagaggccagccaagttgcagaaagattaa

SEQ ID NO: 3556 - protein, 535 aa, Sorghum bicolor
  misc_feature: Ceres ANNOT ID no. 6031847
  misc_feature (20)..(535): Pfam Id: Mpp10 Pfam Desc: Mpp10 protein
  misc_feature (166)..(360): NCBI GI: 32400814 NCBI Desc: dna topoisomerase ii inhibitor [triticum aestivum]
  misc_feature (101)..(534): NCBI GI: 108883177 NCBI Desc: u3 small nucleolar ribonucleoprotein protein mpp10 [aedes aegypti]
  misc_feature (137)..(532): NCBI GI: 68303650 NCBI Desc: m-phase phosphoprotein 10 (u3 small nucleolar ribonucleoprotein) [mus musculus]
  misc_feature (137)..(532): NCBI GI: 29351667 NCBI Desc: mphosph10 protein [mus musculus]
  misc_feature (137)..(532): NCBI GI: 2230873 NCBI Desc: m phase phosphoprotein 10 [homo sapiens]
  misc_feature: Useful for making plants with modulated heat sensitivity
  misc_feature: Functional homolog of the protein sequence given in SEQ ID NO 13183
MVMNLDEPLDAAAAEKGEAALRRLSEADPALFLSPSADLAAAARAASQHIYSSLAPLSLAQPLPLPTLLADPAFDAEQIWSQIELLARPLLPRLRRQLRHLKQQPPLQRPPVETPAVAEGEQLEEDGESSESEELNNEEEEELEGTEDEEEMGEEEEEAELDGRGGNGVEDKFLKIDELTEFLEKGEEEEYGGGAKRREKKAAKNWMVESDAEDDDEDEDEDQLDLEDFEDDDEEGEAGGGDIRYKDFFEKGHNKQVKKRDGSTKKVQFKDDEAHESEFDDSENDDGNVEPEQGLSTHEKERLKMRAKIEQMEKASLEPSTWTMQGEVTASKRPKNSALEVDLDFEHNVRPAPVITEEVTASLEEMIKKRITESHFDDVEKPLMLPSKAPKEHKEVDETKSKKGLAELYEDDYAQKAGIAPAPLSISDELKKEANTLFKRICLKLDALSHFHFAPKPVIEDMSVQANVPALAMEEIAPVAVSDAAMLAPEEIFEGKGDVKEEGELTQAERKRRRANKKRRYAASHKERPAKLQKD

SEQ ID NO: 3557 - DNA, 1248 bp, Sorghum bicolor
  misc_feature: Ceres ANNOT ID no. 6031849
  misc_feature: Encodes the peptide sequence at SEQ ID NO 3558
atggcgaacgccgccgacgacctggacctcctgctctcgctgggcgaggccgtcccggagacccctcccgcctccccccgcgccgctgccgatggccccgtgtgcgacggcgccttcacaccaccaaggacggcgcgccccggcggcaccgacatgtccgttttccgcgacgtcgtcaaggattacctcgaggcaacccccgaaaccacatccccgcttgccaatcgccccaagcggcccaaggccaccgaaaccctcgtcgacaaatactccggcctccgcatcaagcacctcacgctctctccccttgagattagcaatcgcttcgccgacatccgatttgtgcgcatcaccgcgctaaagaactctgtgaggagcgacaggttctccggatgttgggcaaccgcgggcgtggtgctggacaagggcgtgccgcgggtgagtgccaaggggagcagctacagcatctggaagatgggcgctctggacgagaccgacgtatctctgttcctatttggggacgcgcacgttcactactccggtgctgctgtgggttcagtttttgctgtgttcaatggcaatgtccgcatggacaatgggggcaaagggttctctctgagtgttgcttcagtggggcaaatgttgaagatgggggttgcagcagactttggtctctgcaaaggcaagaggaaagacggggtggcatgcaccatggctataaataagagtacaggatcattctgcaaatttcattcgtcgaaaacatcacaaaagtacactactggcagagtagagcttaagggcggaaactttaaatttgcttccaaacttcgatccgaagggatttacatggtcaatccttcctcagaacgatccaatccaagaaattcattccaaccggtgaaagtaatgtcaattgatgggctaaaaagggctttaagcaatgcagatagagtaactaataagaaccagtctcagggtataaggtttctttcccatgttacagctaatacggacaatatggaaccaaaagccccaaccaacagctctaggaaccaacagaaatcgaaggtcagcttaaacaaaagtttgtcatcatctagcgccaaagccctgcccaaacagggattgcggaaaccccaacaggatgttaaaaggcgaaaggtgaacaatcctacagagaatatagttgaacttgatgcagtcagctcagacgatgatgagataaatatagtactgcgacgctga

SEQ ID NO: 3558 - protein, 415 aa, Sorghum bicolor
  misc_feature: Ceres ANNOT ID no. 6031849
  misc_feature (218)..(263): Pfam Id: zf-primase Pfam Desc: Primase zinc finger
  misc_feature (69)..(406): NCBI GI: 63101617 NCBI Desc: mcm10 protein [mus musculus]
  misc_feature (69)..(406): NCBI GI: 123232611 NCBI Desc: minichromosome maintenance deficient 10 (s. cerevisiae) [mus musculus]
  misc_feature (70)..(281): NCBI GI: 47125104 NCBI Desc: loc398196 protein [xenopus laevis]
  misc_feature (70)..(281): NCBI GI: 62858153 NCBI Desc: loc549663 [xenopus tropicalis]
  misc_feature (87)..(276): NCBI GI: 55958694 NCBI Desc: mcm10 minichromosome maintenance deficient 10 (s. cerevisiae) [homo sapiens]
MANAADDLDLLLSLGEAVPETPPASPRAAADGPVCDGAFTPPRTARPGGTDMSVFRDVVKDYLEATPETTSPLANRPKRPKATETLVDKYSGLRIKHLTLSPLEISNRFADIRFVRITALKNSVRSDRFSGCWATAGVVLDKGVPRVSAKGSSYSIWKMGALDETDVSLFLFGDAHVHYSGAAVGSVFAVFNGNVRMDNGGKGFSLSVASVGQMLKMGVAADFGLCKGKRKDGVACTMAINKSTGSFCKFHSSKTSQKYTTGRVELKGGNFKFASKLRSEGIYMVNPSSERSNPRNSFQPVKVMSIDGLKRALSNADRVTNKNQSQGIRFLSHVTANTDNMEPKAPTNSSRNQQKSKVSLNKSLSSSSAKALPKQGLRKPQQDVKRRKVNNPTENIVELDAVSSDDDEINIVLRR

SEQ ID NO: 3559 - DNA, 804 bp, Sorghum bicolor
  misc_feature: Ceres ANNOT ID no. 6031874
  misc_feature: Encodes the peptide sequence at SEQ ID NO 3560
atggaccggtaccagagagtggagaagccgagggaggaggcgcccattaaggaaaacgagatccgcatcaccacgcaggggaggatgcgcaactatatcacctacgccaccgccttgctccaggacaaaggttccgatgaggttgtattcaaggccatgggaagggctatcaataaaactgtcatgattgcagaattgatcaagaggaggattgttggtctccatcagaataccaccactggatctactgatattactgatatgtgggagccattggaggaaggcctacttccgcttgagacaacaagacatgtctctatgatcactataactctttcaaagaaggagctggacacatcgtctatcggatatcaatctccattgcctgctgatgaagtgaagcctttggttgaatatgataatgatgaagatgcacactcacctggtggccgaggaaggggtcgtggtggtcgaggccgtgggcggggcaggggtagaggaagaggtggacgtggaaatgggtacaacgactatgctgatgtcggttgggaagatgatcacgcccctgcatatatgggcaatggatatccccgtggaagaggtcgtggtttcaggggccgtggcaggagaggcggctacaatggccagcctgattaccaacaggatggaggctattatgaggaggcacctgttcatgctccagcccgaggtcgaggccgtggtcgtgggagaggcccatccagaggtagaggacgtggtggcaatgcaaacggggtgatgcatgctgctgcaccaggtgcataa

SEQ ID NO: 3560 - protein, 267 aa, Sorghum bicolor
  misc_feature: Ceres ANNOT ID no. 6031874
  misc_feature (17)..(87): Pfam Id: Alba Pfam Desc: Alba
  misc_feature (1)..(237): NCBI GI: 32526671 NCBI Desc: chloroplast nucleoid dna-binding protein -like protein [oryza sativa (japonica cultivar-group)]
  misc_feature (1)..(253): NCBI GI: 92873121 NCBI Desc: alba, dna binding [medicago truncatula]
  misc_feature (41)..(251): NCBI GI: 8778814 NCBI Desc: t4o12.22 [arabidopsis thaliana]
  misc_feature (7)..(252): NCBI GI: 23485324 NCBI Desc: arabidopsis thaliana at1g20220/t20h2_3-related [plasmodium yoelii yoelii]
  misc_feature (20)..(178): NCBI GI: 51261680 NCBI Desc: mgc84124 protein [xenopus laevis]
MDRYQRVEKPREEAPIKENEIRITTQGRMRNYITYATALLQDKGSDEVVFKAMGRAINKTVMIAELIKRRIVGLHQNTTTGSTDITDMWEPLEEGLLPLETTRHVSMITITLSKKELDTSSIGYQSPLPADEVKPLVEYDNDEDAHSPGGRGRGRGGRGRGRGRGRGRGGRGNGYNDYADVGWEDDHAPAYMGNGYPRGRGRGFRGRGRRGGYNGQPDYQQDGGYYEEAPVHAPARGRGRGRGRGPSRGRGRGGNANGVMHAAAPGA

SEQ ID NO: 3561 - DNA, 717 bp, Sorghum bicolor
  misc_feature: Ceres ANNOT ID no. 6031876
  misc_feature: Encodes the peptide sequence at SEQ ID NO 3562
atgccgaggcccgcgcgcgcgccgctgctccggcgcctgctcctcctggcggccgtcgcggcgtcctgctcctactacctcctcttcctgcaggcgcaggcctccgtcccgccgcggtacgacgggttcgcctacggcggcggcgccgcggcggcctggaaggacgccgtcctcgtcgaggcgtttctcgacccgctctgccccgacagccgcgactcctggcacccgctcaagctcgccatcgagcgatacgcgccgcgggtctcactcatcgtccaccccttcccgctaccataccacacatatgcattccatgcctgccgtgcgctttacatagctaacaagttgaattcatcatcaacatatccattgctggagctgttcttcaagaaccaggaaaagttctacaattctgccacatcatcgctctcaagcccttctgtagctgtagaaatgtcgaagatggctgcgcagactgttggtaattcagtatccgagttcctgtcaggcttcagtgacacgaagacagattcggcagcgagagtttctttcaagtatgggtgcacgaggggagtttatggcgcgccattcttctttgtgaatggtttccttcagcctgggggtggatcgcctatcgactacagcacatggatcggcatcctggacccccttgtttcccagaatggagaacgaattgagatgtttacttcgatgtaa

SEQ ID NO: 3562 - protein, 238 aa, Sorghum bicolor
  misc_feature: Ceres ANNOT ID no. 6031876
  misc_feature (58)..(219): Pfam Id: DSBA Pfam Desc: DSBA-like thioredoxin domain
  misc_feature (30)..(210): NCBI GI: 8778813 NCBI Desc: t4o12.23 [arabidopsis thaliana]
  misc_feature (36)..(202): NCBI GI: 126659892 NCBI Desc: glutathione reductase [cyanothece sp. ccy0110]
  misc_feature (55)..(208): NCBI GI: 133911653 NCBI Desc: dsba oxidoreductase [saccharopolyspora erythraea nrrl 2338]
  misc_feature (62)..(206): NCBI GI: 145221502 NCBI Desc: dsba oxidoreductase [mycobacterium gilvum pyr-gck]
  misc_feature (37)..(217): NCBI GI: 44981659 NCBI Desc: acr183cp [eremothecium gossypii]
MPRPARAPLLRRLLLLAAVAASCSYYLLFLQAQASVPPRYDGFAYGGGAAAAWKDAVLVEAFLDPLCPDSRDSWHPLKLAIERYAPRVSLIVHPFPLPYHTYAFHACRALYIANKLNSSSTYPLLELFFKNQEKFYNSATSSLSSPSVAVEMSKMAAQTVGNSVSEFLSGFSDTKTDSAARVSFKYGCTRGVYGAPFFFVNGFLQPGGGSPIDYSTWIGILDPLVSQNGERIEMFTSM

SEQ ID NO: 3563 - DNA, 1338 bp, Sorghum bicolor
  misc_feature: Ceres ANNOT ID no. 6031891
  misc_feature: Encodes the peptide sequence at SEQ ID NO 3564
atggaggtgaaggtgctgagctccaagctcgtcaaaccgtcgtaccctgcgggcgcgccgcggccggacaccacggagcacgtgccgtcgtcggtgttcgacaaggtcacttaccacatgcagatggccatcatctacgccttctctccgccgggtccgtccccgggcgacatcgagcgcggcctcgccgcggtgctgggcgcgtaccggctcttcgccggccaggtccgcccgggcccggacgatgatggcgcgccgggggtgctgctcaacgaccacggcgcccgcctcgtcgaggcgtccgtggacgcgcacctcgccgacatcgcccccacgaagccgtcgcccctcgtgctgcgcctgcacccggacctggagggcgacatccgggaggtggtgcaggtgcagctcacgcgcttcgcttgcggctcactcgccgtcgggttcaccgccaaccacgccgtggcggacggccacgccaccagcgacttcctcgtcgcctggggccgcgccgcgcgcgggctccccgtcggcccgtcgccgccggtccaccaccggggcctcttcccaccgcgccacccgccgttcgtcgagttcgcgcaccgcggcgtggagtactgcaggcccgcgccgtcgtcccaccctccggcggcggcccatggccacggccacggcgacgacacccagcagcacaacatcgtgatccacaaggcacacttcaccaaggacttcgtcgcggggatccgcgccaaggcgtccgaagggcgtggccgccccttcagccggttcgagacgatcctggcacacgtgtggcgcaccatgacgcgcgcgcgcgggctcggcaacccgctccagacctccaccatccgcatctccgtggacgggcggccgcgcctcgccgcgccgccgggctacttcggcaacctggtcctctgggcgttcccgcgcaccacggtggggaacctcgtcaaccggccgctcaagcacgcggcgcaggcgatccacgacgccgtggcgcgggcggacggcgcctacttccagtcgttcgtggacttcgcgagctccggcgcggtggagaaggaagggctggagacgacggccgtgctcaaggacgtgctgtgcccggacctggaggtggacagctggctgacgttcccgttctacgagctggacttcggcgccggcagcccgagctacttcatgccgtcctacttccccacggaagggatgctgttcctggtgccgtcctacctgggcgacggcagcgtggacgccttcgtgcctgtgttcgagcacaacctggaggcgttcaagcagttctgctactccatggagtag

SEQ ID NO: 3564 - protein, 445 aa, Sorghum bicolor
  misc_feature: Ceres ANNOT ID no. 6031891
  misc_feature (1)..(444): Pfam Id: Transferase Pfam Desc: Transferase family
  misc_feature (1)..(442): NCBI GI: 32488652 NCBI Desc: osjnba0087o24.2 [oryza sativa (japonica cultivar-group)]
  misc_feature (1)..(442): NCBI GI: 115461142 NCBI Desc: os04g0664600 [oryza sativa (japonica cultivar-group)]
  misc_feature (1)..(445): NCBI GI: 30025135 NCBI Desc: agmatine coumaroyltransferase [hordeum vulgare]
  misc_feature (152)..(445): NCBI GI: 32488651 NCBI Desc: osjnba0087o24.1 [oryza sativa (japonica cultivar-group)]
  misc_feature (1)..(445): NCBI GI: 115451197 NCBI Desc: os03g0185700 [oryza sativa (japonica cultivar-group)]
  misc_feature: Useful for making plants with altered Lignin content
  misc_feature: Useful for making plants with altered cell wall content and/or composition
  misc_feature: Functional homolog of the protein sequence given in SEQ ID NO 12900
MEVKVLSSKLVKPSYPAGAPRPDTTEHVPSSVFDKVTYHMQMAIIYAFSPPGPSPGDIERGLAAVLGAYRLFAGQVRPGPDDDGAPGVLLNDHGARLVEASVDAHLADIAPTKPSPLVLRLHPDLEGDIREVVQVQLTRFACGSLAVGFTANHAVADGHATSDFLVAWGRAARGLPVGPSPPVHHRGLFPPRHPPFVEFAHRGVEYCRPAPSSHPPAAAHGHGHGDDTQQHNIVIHKAHFTKDFVAGIRAKASEGRGRPFSRFETILAHVWRTMTRARGLGNPLQTSTIRISVDGRPRLAAPPGYFGNLVLWAFPRTTVGNLVNRPLKHAAQAIHDAVARADGAYFQSFVDFASSGAVEKEGLETTAVLKDVLCPDLEVDSWLTFPFYELDFGAGSPSYFMPSYFPTEGMLFLVPSYLGDGSVDAFVPVFEHNLEAFKQFCYSME

SEQ ID NO: 3565 - DNA, 945 bp, Sorghum bicolor
  misc_feature: Ceres ANNOT ID no. 6031905
  misc_feature: Encodes the peptide sequence at SEQ ID NO 3566
atggcgaccagctccaaacccgccgcgcccgtggaccccaagttcgtgctggcccacaagttccccgaggtgtccttcgactacgacgagagggatgtagcgctgtacgcgctcggggttggcgcctgcggcgatgacgccgtcgacgagaaggagctccacttcgtgtaccacagggacgggcagccaaacatcaaggtccttcctacttttgtttctttatttcccaacaagaacagcaatgggcttggatttgttgatgtgcctggccttaactttgatgcaagccttctactgcatggtcaacaatacatagagatctatagaccaatcccttcatatgccagtgttgtaaacagggttaaagtagctggtttgcacgacaaagggaaagcaactgttcttgagctcgaaactaccacaagcctcaaagagtctggagaaattttatgcatgaacaggagtactatctacttgcgtggtgctggagggttttcagactcttcgcgaccatactcatatgctacttatcctgctaatcaagtttctcgcatttctattcccaattcggcaccttctgcagtatatgatgaccaagcaaagcaatcccaggcattattatacaggctatctggggattacaatcctttgcattcagaccctgatattgcacagcttgctgggttcactcgtccaatcctgcacggtctctgcaccctaggattcgctgctcgggctgtcataaaatctttctgcaacggtgaaccgacggcagtgaagagcatcttcggccggttccttctgcacgtctaccccggggaaacgttatccactgaaatgtggcttgacggccagaaggtgcactaccaaacgaaggtcaaggagcggaaccgtgccgtgctctctggatatgtgttgctccaacacatcccgtcatcattgtaa

SEQ ID NO: 3566 - protein, 314 aa, Sorghum bicolor
  misc_feature: Ceres ANNOT ID no. 6031905
  misc_feature (183)..(305): Pfam Id: MaoC_dehydratas Pfam Desc: MaoC like domain
  misc_feature (2)..(314): NCBI GI: 115480479 NCBI Desc: os09g0544900 [oryza sativa (japonica cultivar-group)]
  misc_feature (1)..(314): NCBI GI: 20147245 NCBI Desc: at1g76150/t23e18_38 [arabidopsis thaliana]
  misc_feature (1)..(205): NCBI GI: 6573727 NCBI Desc: t23e18.9 [arabidopsis thaliana]
  misc_feature (17)..(305): NCBI GI: 62087444 NCBI Desc: hydroxysteroid (17-beta) dehydrogenase 4 variant [homo sapiens]
  misc_feature (17)..(305): NCBI GI: 4504505 NCBI Desc: hydroxysteroid (17-beta) dehydrogenase 4 [homo sapiens]
  misc_feature: The sequence is a functional homolog of SEQ ID NO 2 in US patent 7176349
MATSSKPAAPVDPKFVLAHKFPEVSFDYDERDVALYALGVGACGDDAVDEKELHFVYHRDGQPNIKVLPTFVSLFPNKNSNGLGFVDVPGLNFDASLLLHGQQYIEIYRPIPSYASVVNRVKVAGLHDKGKATVLELETTTSLKESGEILCMNRSTIYLRGAGGFSDSSRPYSYATYPANQVSRISIPNSAPSAVYDDQAKQSQALLYRLSGDYNPLHSDPDIAQLAGFTRPILHGLCTLGFAARAVIKSFCNGEPTAVKSIFGRFLLHVYPGETLSTEMWLDGQKVHYQTKVKERNRAVLSGYVLLQHIPSSL

SEQ ID NO: 3567 - DNA, 438 bp, Sorghum bicolor
  misc_feature: Ceres ANNOT ID no. 6031909
  misc_feature: Encodes the peptide sequence at SEQ ID NO 3568
atgataagttcaaagaggctagttcaactggcaaagaagtggcaacatatggcagcccttgggagaaggaggctaacaatgatcacgacgatcaaagatggcaacttatactgcacatcagccatagcgaacaagggtcactgtgtcgtctacacagctgatggtaagcgatttgaagtccctttggtgtatctcaatacaaatgtttttgtggagctcctgcggatgtctgaggatgagtttgggttcacaagtgaagacaggatcacagtgccttgtgaggccgaagtgatggagtacgtgatgtgcttgcttaggagaaagccctcacaagaagtggaaagggcagtccttagctctgttttgatgccatgcaactgcatgagtagcatgtttatggtttccaagggtcttgaccagtcactatctatattttag

SEQ ID NO: 3568 - protein, 145 aa, Sorghum bicolor
  misc_feature: Ceres ANNOT ID no. 6031909
  misc_feature (7)..(106): Pfam Id: Auxin_inducible Pfam Desc: Auxin responsive protein
  misc_feature (1)..(145): NCBI GI: 115480483 NCBI Desc: os09g0545300 [oryza sativa (japonica cultivar-group)]
  misc_feature (1)..(131): NCBI GI: 32187718 NCBI Desc: auxin induced protein [zea mays]
  misc_feature (1)..(96): NCBI GI: 115480493 NCBI Desc: os09g0546200 [oryza sativa (japonica cultivar-group)]
  misc_feature (1)..(140): NCBI GI: 20149052 NCBI Desc: auxin-induced saur-like protein [capsicum annuum]
  misc_feature (1)..(121): NCBI GI: 15241052 NCBI Desc: auxin-responsive family protein [arabidopsis thaliana]
  misc_feature: The sequence is a functional homolog of SEQ ID NO. 443 in the 11/188,298 US application
  misc_feature: The sequence is a functional homolog of SEQ ID NO. 402 in the 11/188,298 US application
  misc_feature: The sequence is a functional homolog of SEQ ID NO. 505 in the 11/188,298 US application
MISSKRLVQLAKKWQHMAALGRRRLTMITTIKDGNLYCTSAIANKGHCVVYTADGKRFEVPLVYLNTNVFVELLRMSEDEFGFTSEDRITVPCEAEVMEYVMCLLRRKPSQEVERAVLSSVLMPCNCMSSMFMVSKGLDQSLSIF

SEQ ID NO: 3569 - DNA, 426 bp, Sorghum bicolor
  misc_feature: Ceres ANNOT ID no. 6031911
  misc_feature: Encodes the peptide sequence at SEQ ID NO 3570
atgatcagcaccaagagaattgctcagctggccaagaagtggcagaggatggcagcacttcagaggaagcgcctcacctggcggacggcagcaaaggaagtcgacaagtgctgcacttccgtggcgagcaagggccactgcacagtgtacacagctgacggggcacggtttgaggtgccattggcgtgcctcgggacgacagtcttcgcggagctcctgcagatgtccaaggaggagttcggcttcacgggcggcgacggcaggatcacactgccctgtgatgccatggtcatggagtatgccctgtgcttgctgaggaggggcgcctctgtggagctggagaaggcattcctaagcaccatggcaatgtcgtgccactctgcaaaccacatggcaccctgtataagtagcagttcatccctgtag

SEQ ID NO: 3570 - protein, 141 aa, Sorghum bicolor
  misc_feature: Ceres ANNOT ID no. 6031911
  misc_feature (1)..(106): Pfam Id: Auxin_inducible Pfam Desc: Auxin responsive protein
  misc_feature (1)..(141): NCBI GI: 32187718 NCBI Desc: auxin induced protein [zea mays]
  misc_feature (1)..(141): NCBI GI: 115480483 NCBI Desc: os09g0545300 [oryza sativa (japonica cultivar-group)]
  misc_feature (1)..(95): NCBI GI: 115480493 NCBI Desc: os09g0546200 [oryza sativa (japonica cultivar-group)]
  misc_feature (1)..(129): NCBI GI: 20149052 NCBI Desc: auxin-induced saur-like protein [capsicum annuum]
  misc_feature (1)..(141): NCBI GI: 15241052 NCBI Desc: auxin-responsive family protein [arabidopsis thaliana]
  misc_feature: The sequence is a functional homolog of SEQ ID NO. 443 in the 11/188,298 US application
  misc_feature: The sequence is a functional homolog of SEQ ID NO. 402 in the 11/188,298 US application
  misc_feature: The sequence is a functional homolog of SEQ ID NO. 505 in the 11/188,298 US application
MISTKRIAQLAKKWQRMAALQRKRLTWRTAAKEVDKCCTSVASKGHCTVYTADGARFEVPLACLGTTVFAELLQMSKEEFGFTGGDGRITLPCDAMVMEYALCLLRRGASVELEKAFLSTMAMSCHSANHMAPCISSSSSL

SEQ ID NO: 3571 - DNA, 414 bp, Sorghum bicolor
  misc_feature: Ceres ANNOT ID no. 6031914
  misc_feature: Encodes the peptide sequence at SEQ ID NO 3572
atgatcagcaccaagaggatcgctcagctggccaagaagtggcagaggatggcagcgcttgggaggaagcgcctcacggcagcagcaaaggaagtcgacaagtgctgcacttccgtggcgagcaagggccactgcgcagtgtacacagctgacggggcacggtttgaggtgcccttggcgtgcctcgggacaacagtcttcacggagctcctgcagatgtccaaggaggagttcggcttcacgggcggcaatggcaagatcacactgccctgtgatgccatggtcatggagtatgccttgtgcttgctgaagaggggcgcctctgtggagctggagaaggcattcctaagcaccatggcagtgtcgtgtcactctgcaaaccaagtggcgccatatgtggcagcctgctgttag

SEQ ID NO: 3572 - protein, 137 aa, Sorghum bicolor
  misc_feature: Ceres ANNOT ID no. 6031914
  misc_feature (1)..(104): Pfam Id: Auxin_inducible Pfam Desc: Auxin responsive protein
  misc_feature (1)..(135): NCBI GI: 32187718 NCBI Desc: auxin induced protein [zea mays]
  misc_feature (1)..(124): NCBI GI: 115480483 NCBI Desc: os09g0545300 [oryza sativa (japonica cultivar-group)]
  misc_feature (1)..(93): NCBI GI: 115480493 NCBI Desc: os09g0546200 [oryza sativa (japonica cultivar-group)]
  misc_feature (1)..(127): NCBI GI: 20149052 NCBI Desc: auxin-induced saur-like protein [capsicum annuum]
  misc_feature (1)..(123): NCBI GI: 15241052 NCBI Desc: auxin-responsive family protein [arabidopsis thaliana]
  misc_feature: The sequence is a functional homolog of SEQ ID NO. 443 in the 11/188,298 US application
  misc_feature: The sequence is a functional homolog of SEQ ID NO. 505 in the 11/188,298 US application
  misc_feature: The sequence is a functional homolog of SEQ ID NO. 402 in the 11/188,298 US application
MISTKRIAQLAKKWQRMAALGRKRLTAAAKEVDKCCTSVASKGHCAVYTADGARFEVPLACLGTTVFTELLQMSKEEFGFTGGNGKITLPCDAMVMEYALCLLKRGASVELEKAFLSTMAVSCHSANQVAPYVAACC

SEQ ID NO: 3573 - DNA, 444 bp, Sorghum bicolor
  misc_feature: Ceres ANNOT ID no. 6031918
  misc_feature: Encodes the peptide sequence at SEQ ID NO 3574
atggtcagcgccaagagacttgctcaaatggcaaagaagtggcaaagaatggcggccatggcaaggaggcggatcgcatcggcgccgaccaaaggaaccaccgagggatcatcaccgtgcagcacttcgccggtggccggcaaaggccactgcgtggtgtactcggcagacggcaggcgattcgaggtcccgctggcgtacctcgacaccgccatctttggcgtgctcctcagcatgtcgcaggaggagttcgggtttgccagcgacgatggcaggatcatggtgccgtgtgatgccgccgtcatggagtacgtgatgtgtttgcttaggagagatgcatcggaagaggtggtgagggcgttcctcagctccatggtgaggccttgccactgtggaaatggcttggtgcaatccatgggagttagccagcaagctgtgttctag

SEQ ID NO: 3574 - protein, 147 aa, Sorghum bicolor
  misc_feature: Ceres ANNOT ID no. 6031918
  misc_feature (10)..(110): Pfam Id: Auxin_inducible Pfam Desc: Auxin responsive protein
  misc_feature (1)..(144): NCBI GI: 32187718 NCBI Desc: auxin induced protein [zea mays]
  misc_feature (1)..(147): NCBI GI: 115480483 NCBI Desc: os09g0545300 [oryza sativa (japonica cultivar-group)]
  misc_feature (1)..(99): NCBI GI: 115480493 NCBI Desc: os09g0546200 [oryza sativa (japonica cultivar-group)]
  misc_feature (1)..(144): NCBI GI: 20149052 NCBI Desc: auxin-induced saur-like protein [capsicum annuum]
  misc_feature (1)..(144): NCBI GI: 15241052 NCBI Desc: auxin-responsive family protein [arabidopsis thaliana]
  misc_feature: The sequence is a functional homolog of SEQ ID NO. 443 in the 11/188,298 US application
  misc_feature: The sequence is a functional homolog of SEQ ID NO. 402 in the 11/188,298 US application
  misc_feature: The sequence is a functional homolog of SEQ ID NO. 505 in the 11/188,298 US application
MVSAKRLAQMAKKWQRMAAMARRRIASAPTKGTTEGSSPCSTSPVAGKGHCVVYSADGRRFEVPLAYLDTAIFGVLLSMSQEEFGFASDDGRIMVPCDAAVMEYVMCLLRRDASEEVVRAFLSSMVRPCHCGNGLVQSMGVSQQAVF

SEQ ID NO: 3575 - DNA, 441 bp, Sorghum bicolor
  misc_feature: Ceres ANNOT ID no. 6031919
  misc_feature: Encodes the peptide sequence at SEQ ID NO 3576
atggtcagcgccaagagacttgttcaaatggccaagaagtggcagaggatggctgccatggctaggaggcggatcgcactgacgccggcgaaaggaaccaccgaggtatcgtcgtgcagcacttcgtcggtggctggaaagggccactgcgtggtgtactcggcagacggaaggcggttcgaagtcccgctggcgtacctcggcaccgccatcttcggcgtgctcctgagcatgtcgcaagaggagttcgggttcgccggtggcgacggcaggatcatggtgccctgtgacgccaccatcatggagtacgtgatgtgtttgcttagaagagatgcatcggaagaggtggtgagggcgttcctaagctccatggtgaagccttgccactgtggaaatggcttggcgcaatccatgggagttagccagcaagttgtgttctag

SEQ ID NO: 3576 - protein, 146 aa, Sorghum bicolor
  misc_feature: Ceres ANNOT ID no. 6031919
  misc_feature (1)..(109): Pfam Id: Auxin_inducible Pfam Desc: Auxin responsive protein
  misc_feature (1)..(144): NCBI GI: 32187718 NCBI Desc: auxin induced protein [zea mays]
  misc_feature (1)..(144): NCBI GI: 115480483 NCBI Desc: os09g0545300 [oryza sativa (japonica cultivar-group)]
  misc_feature (1)..(98): NCBI GI: 115480493 NCBI Desc: os09g0546200 [oryza sativa (japonica cultivar-group)]
  misc_feature (1)..(144): NCBI GI: 20149052 NCBI Desc: auxin-induced saur-like protein [capsicum annuum]
  misc_feature (1)..(145): NCBI GI: 15241052 NCBI Desc: auxin-responsive family protein [arabidopsis thaliana]
  misc_feature: The sequence is a functional homolog of SEQ ID NO. 443 in the 11/188,298 US application
  misc_feature: The sequence is a functional homolog of SEQ ID NO. 402 in the 11/188,298 US application
  misc_feature: The sequence is a functional homolog of SEQ ID NO. 505 in the 11/188,298 US application
MVSAKRLVQMAKKWQRMAAMARRRIALTPAKGTTEVSSCSTSSVAGKGHCVVYSADGRRFEVPLAYLGTAIFGVLLSMSQEEFGFAGGDGRIMVPCDATIMEYVMCLLRRDASEEVVRAFLSSMVKPCHCGNGLAQSMGVSQQVVF

SEQ ID NO: 3577 - DNA, 435 bp, Sorghum bicolor
  misc_feature: Ceres ANNOT ID no. 6031922
  misc_feature: Encodes the peptide sequence at SEQ ID NO 3578
atgattagtgccaagagacttgtgcaaatggcaagaaagtggcaaaggatagccgcccttacgaggaagagggtcatgccgataccagcaaaagaaagcgaaggatcgtgcagcacttcgacttcggttgctggcaaaggacacttcgttgtgtactcggtcgacgggcagcggtttgaggtcccgctgttgtaccttggcacggtggtcttcggcgagctcctagtgctgtcgcaagaagagtttgggttcgcgagcaacgacggcaagatcactctgccctgtgacgccatggtgatggagtatgtgatgtgtttgcttagaagagatgcccctgaagaggttgtgagagccttcttgagctccatggccaggccatgtcacaccgtcagcggcgtggcaacatggaaccagcggctagctgtttgtgtataa

SEQ ID NO: 3578 - protein, 144 aa, Sorghum bicolor
  misc_feature: Ceres ANNOT ID no. 6031922
  misc_feature (22)..(108): Pfam Id: Auxin_inducible Pfam Desc: Auxin responsive protein
  misc_feature (1)..(136): NCBI GI: 32187718 NCBI Desc: auxin induced protein [zea mays]
  misc_feature (1)..(134): NCBI GI: 115480483 NCBI Desc: os09g0545300 [oryza sativa (japonica cultivar-group)]
  misc_feature (1)..(113): NCBI GI: 115480493 NCBI Desc: os09g0546200 [oryza sativa (japonica cultivar-group)]
  misc_feature (1)..(143): NCBI GI: 20149052 NCBI Desc: auxin-induced saur-like protein [capsicum annuum]
  misc_feature (1)..(124): NCBI GI: 15241052 NCBI Desc: auxin-responsive family protein [arabidopsis thaliana]
  misc_feature: Useful for making plants with modulated cold sensitivity
  misc_feature: Functional homolog of the protein sequence given in SEQ ID NO 13354
  misc_feature: The sequence is a functional homolog of SEQ ID NO. 443 in the 11/188,298 US application
  misc_feature: The sequence is a functional homolog of SEQ ID NO. 402 in the 11/188,298 US application
  misc_feature: The sequence is a functional homolog of SEQ ID NO. 505 in the 11/188,298 US application
MISAKRLVQMARKWQRIAALTRKRVMPIPAKESEGSCSTSTSVAGKGHFVVYSVDGQRFEVPLLYLGTVVFGELLVLSQEEFGFASNDGKITLPCDAMVMEYVMCLLRRDAPEEVVRAFLSSMARPCHTVSGVATWNQRLAVCV

SEQ ID NO: 3579 - DNA, 432 bp, Sorghum bicolor
  misc_feature: Ceres ANNOT ID no. 6031925
  misc_feature: Encodes the peptide sequence at SEQ ID NO 3580
atgatcagcgccaagaggattgctcatcaggccaagaagtggcagaggatggctgcacaaggcaggaagcgcctcatctgggctgcagcagcaaaggaagccaacgagtgctgcagctccgtggcaagcaagggccactgcacggtgtacacggccgacggcgcacggttcgaggtgccgctggcgtgccttagcaccgtgttcttccgggagctcctgcaaatgtcacaggaagagttcgggttcacgggcggcgacgacaggatcacgctcccctgcgacgcggccgtcatggagtacgccatgtgtttgctcaggagaggcgcctctgccgagctagagcaggctttccttagcaccatggcgatgtcgtgccactatgtcagccgtgtggcgccgtgtgttgaagcaagccagcagattgctgtttag

SEQ ID NO: 3580 - protein, 143 aa, Sorghum bicolor
  misc_feature: Ceres ANNOT ID no. 6031925
  misc_feature (1)..(106): Pfam Id: Auxin_inducible Pfam Desc: Auxin responsive protein
  misc_feature (1)..(143): NCBI GI: 32187718 NCBI Desc: auxin induced protein [zea mays]
  misc_feature (1)..(143): NCBI GI: 115480483 NCBI Desc: os09g0545300 [oryza sativa (japonica cultivar-group)]
  misc_feature (1)..(95): NCBI GI: 115480493 NCBI Desc: os09g0546200 [oryza sativa (japonica cultivar-group)]
  misc_feature (1)..(143): NCBI GI: 20149052 NCBI Desc: auxin-induced saur-like protein [capsicum annuum]
  misc_feature (1)..(143): NCBI GI: 15241052 NCBI Desc: auxin-responsive family protein [arabidopsis thaliana]
  misc_feature: The sequence is a functional homolog of SEQ ID NO. 443 in the 11/188,298 US application
  misc_feature: The sequence is a functional homolog of SEQ ID NO. 505 in the 11/188,298 US application
  misc_feature: The sequence is a functional homolog of SEQ ID NO. 402 in the 11/188,298 US application
MISAKRIAHQAKKWQRMAAQGRKRLIWAAAAKEANECCSSVASKGHCTVYTADGARFEVPLACLSTVFFRELLQMSQEEFGFTGGDDRITLPCDAAVMEYAMCLLRRGASAELEQAFLSTMAMSCHYVSRVAPCVEASQQIAV

SEQ ID NO: 3581 - DNA, 2742 bp, Sorghum bicolor
  misc_feature: Ceres ANNOT ID no. 6031932
  misc_feature: Encodes the peptide sequence at SEQ ID NO 3582
atggggtgcggccagtccaagatggaggaggagtacgccgtgcgccactgccgggagcgctccgagctcctggcgctggccatccgccagcgctacatgctcgccgacgcgcaccacgcctacgccgagtcgctgcgctccgtcggcgccctgctgcacgacttcctccgcggggtccagtcgctgccgccgccgccgcccgagcccgcgctccgcctcccgcagcagcggaagggcgacggcctccccgccgcgtcgccgccgcccgcaatcgcgtcctcctcctccaccgccggggcgcctgtcgccaagcaggtccgcatcgcccccgacgacggccatatccacttctccgacgacgactccgattccgagggcgggcacatcaagttccacgacgacgaggagcccgacccggctcgccgccgcccggaggtcgtccgctccgccggggagcctggtccaccgccgccggagatgggaccaccgccctatgcctccgggtatgctccgccgccgtatggccctggatatggctacgggtacgccaatgggcctggtccgggtccgggtcctggtcctgattatgggggtattggcatgaacggcggcgctggcgcttatgaaccaggctatggtgtcatgggcagcggcggcggttacggccaaagctttggtggtggccctggctatgctgaccagggctacggtggcatgggcagtggtggcggcgctggcggctatgaccaaagctatggtggcataggtggatatggccagagcttctttaacatcaactacgcccgcagtcagccacctccaccgtcagtctcgcacgagcaccgcctgcaggccactaacgccagggtccactactattccggcaatggcgagcagcagccacccccgcgtggctacggtggtgggtactacccaccgcagagctcgagctcatacaatcagtatgcctacggtggttactatggaggtggttctgctcctgcaccaccagcagacatcccttcctcctcccgggagccagccgcaccaccaccacctccatctccgcccagggtgtccacctgggacttcctgaacccgtttgaaacttatgagagctactacgagcaaccaactgctacagcagctccatactctcccagcaggagttcaaaggatgtgcgcgaggaagaagggattccagacttggaggacgaagacatggaggtagtcaaggaagcttatggtgatgagaagcaccctgtgaagggttacatggggaacgggaaggcggccaaggaagagggtaggagcagtacgggagatgaactgccccgcaagtccaaggcgtctgaggccagcagtagtgggagcagcttggagcatgacgtgcatgtagtggagaagagtgttgtcggtgaacaagttcaacactcagaatcacggcagcatgttgccggtttaccacccacaggatcagagaagatatacattgatgacgctgaggtggtggtggagatcaagactcaattcgaccgtgcctctcaatcagccggtgaggtatccaagatgcttgaggttggaaagatgccttactaccagaagagttcaggtttcaaagtctcaatgatggtttgtggtataccgacaatggaggaggagtttctgcgttttgaagaggacaaggcgatgggatctggcaacctctcctcaacactacagaagttgtacatgtgggagaagaagcttcttgaggaagttaagactgaggagaggatgcgggtactgtatgacagaaaacgtgaggagctgaaaatgttagatgagaaaggtgcagaagctcataagcttgaggccactgaactttacatcaggaagctatcaactaagattagcatagctatccaggttgtaaacactatttcagaaaagattagtaagttgagggatgaagagttgtggccacaaacatgtgagctgattcaagggttgatgaagatgtggagcgttatgctagaatgtcatcagatacaattgcatgccatatcccaagctaaaaacatagactccatgatagacactgcaaagtttggtgagaaacatatggacttgatcaagcagttagagcttcagctattggattggattgcttgttttgttgcatgggttagcgctcaaaagagttatgttaaaactttaaatcagtggctgagaaatggtgttatctacgttcctgaggaaactgaggatggggcgcctcctttttctcctggaagattaggagggccaccgattttcgtcatatgtaataattgggctgccagtgtggacaggatatctgagaaagaagtagtcgaggcaatgcaggcctttgcatccaacatactgaacctctgggagaggcacaggtcagagcaaaaacagggtctgatggcgaataaaggtatggacagggatcttagggtgatggaaagagatgaacaatcaatgcgcaaggctctggaagaacaaaataagaagcttgtgctcatttcaaaccagggcagtgtatccttgtctgcacaagtgttacatgagcgaggccctggtgctgaagttggcagtttacaaacaagtctgagaaatatttttgaagcaatggagaacttcacttctgcatctgcaaatacatacaaggagctacatcttcgcgccgaagaagagaaagcccgagttgcacaggagagtggcagtgtttcctag

SEQ ID NO: 3582 - protein, 913 aa, Sorghum bicolor
  misc_feature: Ceres ANNOT ID no. 6031932
  misc_feature (1)..(913): NCBI GI: 115480511 NCBI Desc: os09g0547300 [oryza sativa (japonica cultivar-group)]
  misc_feature (8)..(913): NCBI GI: 52076014 NCBI Desc: bzip-related transcription factor -like [oryza sativa (japonica cultivar-group)]
  misc_feature (249)..(912): NCBI GI: 115477707 NCBI Desc: os08g0551200 [oryza sativa (japonica cultivar-group)]
  misc_feature (267)..(900): NCBI GI: 38345928 NCBI Desc: osjnbb0078d11.3 [oryza sativa (japonica cultivar-group)]
  misc_feature (267)..(900): NCBI GI: 116310157 NCBI Desc: h0211b05.8 [oryza sativa (indica cultivar-group)]
  misc_feature: The sequence is a functional homolog of SEQ ID NO 1522 in the 11/479,226US patent application
  misc_feature: The sequence is a functional homolog of SEQ ID NO 174 in the 10/666,642US patent application
  misc_feature: Useful for making plants with modulated growth and phenotype characteristics
  misc_feature: The sequence is a functional homolog of SEQ ID NO 1522 in the 20070022495 US patent application
MGCGQSKMEEEYAVRHCRERSELLALAIRQRYMLADAHHAYAESLRSVGALLHDFLRGVQSLPPPPPEPALRLPQQRKGDGLPAASPPPAIASSSSTAGAPVAKQVRIAPDDGHIHFSDDDSDSEGGHIKFHDDEEPDPARRRPEVVRSAGEPGPPPPEMGPPPYASGYAPPPYGPGYGYGYANGPGPGPGPGPDYGGIGMNGGAGAYEPGYGVMGSGGGYGQSFGGGPGYADQGYGGMGSGGGAGGYDQSYGGIGGYGQSFFNINYARSQPPPPSVSHEHRLQATNARVHYYSGNGEQQPPPRGYGGGYYPPQSSSSYNQYAYGGYYGGGSAPAPPADIPSSSREPAAPPPPPSPPRVSTWDFLNPFETYESYYEQPTATAAPYSPSRSSKDVREEEGIPDLEDEDMEVVKEAYGDEKHPVKGYMGNGKAAKEEGRSSTGDELPRKSKASEASSSGSSLEHDVHVVEKSVVGEQVQHSESRQHVAGLPPTGSEKIYIDDAEVVVEIKTQFDRASQSAGEVSKMLEVGKMPYYQKSSGFKVSMMVCGIPTMEEEFLRFEEDKAMGSGNLSSTLQKLYMWEKKLLEEVKTEERMRVLYDRKREELKMLDEKGAEAHKLEATELYIRKLSTKISIAIQVVNTISEKISKLRDEELWPQTCELIQGLMKMWSVMLECHQIQLHAISQAKNIDSMIDTAKFGEKHMDLIKQLELQLLDWIACFVAWVSAQKSYVKTLNQWLRNGVIYVPEETEDGAPPFSPGRLGGPPIFVICNNWAASVDRISEKEVVEAMQAFASNILNLWERHRSEQKQGLMANKGMDRDLRVMERDEQSMRKALEEQNKKLVLISNQGSVSLSAQVLHERGPGAEVGSLQTSLRNIFEAMENFTSASANTYKELHLRAEEEKARVAQESGSVS

SEQ ID NO: 3583 - DNA, 1563 bp, Sorghum bicolor
  misc_feature: Ceres ANNOT ID no. 6031942
  misc_feature: Encodes the peptide sequence at SEQ ID NO 3584
atggatagcaatagcaagcgggtgggaatcgtcggtgcaggcgtgagcggcctagcagcctgcaagcacgcgctcgacaaggggttcaggccagtggtgttcgaggctgacggaaccatcggcggagtgtgggcacacaccttggagtcgacgaggcttcaggcgccgacgaccgcgttccggttctccgacctggcgtggccggagagcgtgagagaggcgtacccaaaccaccgcagggtcatggagtacataaggtcgtatgcgtgtgcatttgacctcctcaagcacatcaggttcaacagccaggtgcttggtgtcgagtacctcggcgcagctgaggaagagatcatgagctgggagcagtggtctggcaatgggacagcattcggagcagtgaagggtggaggatggcgcctcaccgtccaggacttgaaagtcggtagcactgaggtttttatggtggattttctgatcctgtgcattggaagacacagtggaaccccaaacatcccagaatttccagggaatgggcctgagttgttcaaggggaaaatattgcactcactggactattcttacatggatgatgttgctcagtttgtgaagggcaagtgtgtgacgataattggctctggtaaatcagcatttgacattgccgcagaggttgctaaggtgaatggtgccacacagccatgcaccatcatatatagaacaaagcactggctggtccacaagtccagcatatggggagttgacctcagttacttctatctcaatcgcatctcacagcttctggttcataaacctggtgaaggatttttacgttatatgttggccactgcactctcccctttgagatgggcgatctctaaagtaattgaaacatactacaagtggagcattcctttacaaaagcatgggatggtccctgactacagcttctcctttgctatgtcctcatgcttgattgcaatgctgccagaaggtttctatgacagggtcgacaaaggcagcattattctcaagaaatctaaggcattcaacttttctagtgatggaatcatcctgcaagacagaaatgaaagcatcaaatgtgatattgtgattctggcaacaggattcagaggtgatcagaagcttagggacatcttcacagcaaattggtgcagaaacatagtagcaggatcaccggataccgcagctcctctatacagagaatgcatccatcccaggattcctcagttggctatagttggttacgctgagagccttactaacatatatgcctcagagaggatgagcaattgggtagcccattttctggctggtagcttccaattgccaagcataagatgtatggagaagagtgtagcagaatgggcagagtacaagaatctatacaacgggaaatattttcgcaggtcctgcataagctccactaacatctggttaaatgatctgttgtgccaagatatgggatgcaaccctaaaaggaagaaaggattcctagctgaatggttccagccatatggacctgcagattatgcaggtctttgctga

SEQ ID NO: 3584 - protein, 520 aa, Sorghum bicolor
  misc_feature: Ceres ANNOT ID no. 6031942
  misc_feature (5)..(511): Pfam Id: FMO-like Pfam Desc: Flavin-binding monooxygenase-like
  misc_feature (6)..(519): NCBI GI: 50725113 NCBI Desc: flavin containing monooxygenase 3 -like [oryza sativa (japonica cultivar-group)]
  misc_feature (1)..(519): NCBI GI: 115480525 NCBI Desc: os09g0548700 [oryza sativa (japonica cultivar-group)]
  misc_feature (6)..(519): NCBI GI: 116308895 NCBI Desc: h0515c11.3 [oryza sativa (indica cultivar-group)]
  misc_feature (6)..(519): NCBI GI: 116308896 NCBI Desc: h0515c11.4 [oryza sativa (indica cultivar-group)]
  misc_feature (190)..(519): NCBI GI: 115457346 NCBI Desc: os04g0223900 [oryza sativa (japonica cultivar-group)]
MDSNSKRVGIVGAGVSGLAACKHALDKGFRPVVFEADGTIGGVWAHTLESTRLQAPTTAFRFSDLAWPESVREAYPNHRRVMEYIRSYACAFDLLKHIRFNSQVLGVEYLGAAEEEIMSWEQWSGNGTAFGAVKGGGWRLTVQDLKVGSTEVFMVDFLILCIGRHSGTPNIPEFPGNGPELFKGKILHSLDYSYMDDVAQFVKGKCVTIIGSGKSAFDIAAEVAKVNGATQPCTIIYRTKHWLVHKSSIWGVDLSYFYLNRISQLLVHKPGEGFLRYMLATALSPLRWAISKVIETYYKWSIPLQKHGMVPDYSFSFAMSSCLIAMLPEGFYDRVDKGSIILKKSKAFNFSSDGIILQDRNESIKCDIVILATGFRGDQKLRDIFTANWCRNIVAGSPDTAAPLYRECIHPRIPQLAIVGYAESLTNIYASERMSNWVAHFLAGSFQLPSIRCMEKSVAEWAEYKNLYNGKYFRRSCISSTNIWLNDLLCQDMGCNPKRKKGFLAEWFQPYGPADYAGLC

SEQ ID NO: 3585 - DNA, 1743 bp, Sorghum bicolor
  misc_feature: Ceres ANNOT ID no. 6031954
  misc_feature: Encodes the peptide sequence at SEQ ID NO 3586
atgggcaagcagcagcaggcgccaccgtcgcggcggtccccggcgatgtcggcgcctccgccgccgaagcgccggaagaagaagggccggccgtccctgctcgacctccagaagcggagcctccgcctcgagcagcagctccaggagcagcagcagcagaagataaagccgcaggggcgaggacgcgccaaccgccggggcgccggctccgcggacgaggacgacgacgggcccgcctccggctccggccgccgcgagaagaagctgcgcctcgtcatgggcctccacgacggatcagccaagggagaaaagacgaggaaagcgacggatgggcgtgaagagccgtcagattccgggcccacaacacctttgccgaacaaaaagttgttgatcttcatcctcgacaggctacagaagaaggatacgtatggtgtattttcagagcctgttgatcctgaagagctacctgactatcatgacattataaagcatccaatggatttttcgacaatacgaaagaagctcgataagggggcctattccaacttggagcaatttgaggatgatgtgttcctgataagctccaatgcgatgtgctacaattcaccagatacaatatactatcgacaggcacggggtattcaagagatagcgaaaaaggattttgagaatcttaggcaagatagtgatgccagtgaaccagaaccggaaccagaacccgagccggagccagaactagaagaaccaaagccacagcctcgcaggggcagacctccaaacaagaacaatgccaaacagaaagttgggaagccaccagcagaacgtgctactgcagatttctctggtgcaacacttgctactgcagcaaatattggacgccatgcacaggcagattttgatctgtcacgaagagtaatagataaagcaatgattgcagatgtgttgagagcttcttttgccaatcaaaggaatcagcacaactggtctggcgagcggaaattcgaaagaattgaagattactcaggttatgggggtacatggtccgcaaaaatgggaaagaggccaattctgatggaagatagtcgccgaagcacatattatgacactcaaccatccagttcaatatatgagctgccggtatcgtcctcctacaatgggactaagaagctgctagtaccattacagcagtcctattcccgcagcctggcacgatttgctgcacaacttggtcctgtgggctgggaaattgcatcaaaacgaattgaacgaagccttgcacctggaacaaagtttggtcgtggctgggtaggagatggtgaaacaccaaactcatttcagccacctgtactagctgcattttcagaaacaatgacaccaccaagcagtatagcagcatcaggtgagcagccatctatgaacgccccccctgccacaggggcctgtgctggcaacgtaagccatccggcgggatctcaaccacatgctatgccatatgcttctaccagcacagcgcagaggatgaattctgaagcattagcaagccagcaatgtggatcagtaccacagatttcgataaaccgaggtgaacgtgctgttgagatgaagggcacccctaataatcttcacggacacccgggcatgcagcaaactgtgaatggtttcaatgccgttccaggaccgatgatgttcccacctgccgctcaactggtggtgaatcagatgcagacacatacggctgattga

SEQ ID NO: 3586 - protein, 580 aa, Sorghum bicolor
  misc_feature: Ceres ANNOT ID no. 6031954
  misc_feature (126)..(213): Pfam Id: Bromodomain Pfam Desc: Bromodomain
  misc_feature (102)..(528): NCBI GI: 15218005 NCBI Desc: dna-binding bromodomain-containing protein [arabidopsis thaliana]
  misc_feature (3)..(442): NCBI GI: 42572125 NCBI Desc: dna-binding bromodomain-containing protein [arabidopsis thaliana]
  misc_feature (3)..(442): NCBI GI: 42572127 NCBI Desc: dna-binding bromodomain-containing protein [arabidopsis thaliana]
  misc_feature (73)..(334): NCBI GI: 115450513 NCBI Desc: os03g0130800 [oryza sativa (japonica cultivar-group)]
  misc_feature (117)..(235): NCBI GI: 140046893 NCBI Desc: bromodomain [medicago truncatula]
MGKQQQAPPSRRSPAMSAPPPPKRRKKKGRPSLLDLQKRSLRLEQQLQEQQQQKIKPQGRGRANRRGAGSADEDDDGPASGSGRREKKLRLVMGLHDGSAKGEKTRKATDGREEPSDSGPTTPLPNKKLLIFILDRLQKKDTYGVFSEPVDPEELPDYHDIIKHPMDFSTIRKKLDKGAYSNLEQFEDDVFLISSNAMCYNSPDTIYYRQARGIQEIAKKDFENLRQDSDASEPEPEPEPEPEPELEEPKPQPRRGRPPNKNNAKQKVGKPPAERATADFSGATLATAANIGRHAQADFDLSRRVIDKAMIADVLRASFANQRNQHNWSGERKFERIEDYSGYGGTWSAKMGKRPILMEDSRRSTYYDTQPSSSIYELPVSSSYNGTKKLLVPLQQSYSRSLARFAAQLGPVGWEIASKRIERSLAPGTKFGRGWVGDGETPNSFQPPVLAAFSETMTPPSSIAASGEQPSMNAPPATGACAGNVSHPAGSQPHAMPYASTSTAQRMNSEALASQQCGSVPQISINRGERAVEMKGTPNNLHGHPGMQQTVNGFNAVPGPMMFPPAAQLVVNQMQTHTAD

SEQ ID NO: 3587 - DNA, 789 bp, Sorghum bicolor
  misc_feature: Ceres ANNOT ID no. 6031956
  misc_feature: Encodes the peptide sequence at SEQ ID NO 3588
atggccgcctccaccatgtcgatctcctccacggcgatggccggcacccccatcaaggtgggctccttcggcgagggccgcatcaccatgcgcaagaccgcggccaagcccaaggtggcggcgtccggcagtccctggtacgggcccgaccgcgtcaagtacctcggccccttctccggcgagcccccgagctacctcaccggcgagttccccggcgactacggctgggacaccgcggggctgtcggccgaccccgagaccttcgccaagaaccgcgagctggaggtgatccactcccgctgggccatgctgggcgcgctcggctgcgtcttccccgagctgctcgcccgcaacggcgtcaagttcggcgaggccgtctggttcaaggccggctcccagatcttcagcgagggcggcctggactacctgggcaaccccagcctgatccacgcgcagagcatcctcgccatctgggccgtccaggtcgtgctcatgggcgccgtcgagggctaccgcattgccggcgggccgctcggcgaggtcgtcgacccgctctacccaggcggcagcttcgaccccctcggcctggccgacgatcccgaggccttcgccgagctcaaggtgaaggagctcaagaacggccgcctcgccatgttctccatgttcggcttcttcgtccaggccatcgtcaccggcaagggcccgctcgagaacctcgctgaccacctggctgacccagtcaacaacaacgcctgggcctacgccaccaacttcgtccccggcaactaa

SEQ ID NO: 3588 - protein, 262 aa, Sorghum bicolor
  misc_feature: Ceres ANNOT ID no. 6031956
  misc_feature (61)..(229): Pfam Id: Chloroa_b-bind Pfam Desc: Chlorophyll A-B binding protein
  misc_feature (1)..(261): NCBI GI: 82654918 NCBI Desc: chlorophyll a-b binding protein 2, chloroplast precursor (lhcii type i cab-2) (lhcp)
  misc_feature (1)..(261): NCBI GI: 22355 NCBI Desc: light-harvesting chlorophyll a/b binding protein [zea mays]
  misc_feature (1)..(261): NCBI GI: 3293555 NCBI Desc: chlorophyll a/b binding protein [medicago sativa]
  misc_feature (1)..(261): NCBI GI: 133917261 NCBI Desc: major chlorophyll a/b binding protein lhcb1.2 [spinacia oleracea]
  misc_feature (1)..(261): NCBI GI: 3928140 NCBI Desc: chlorophyll a/b binding protein [cicer arietinum]
MAASTMSISSTAMAGTPIKVGSFGEGRITMRKTAAKPKVAASGSPWYGPDRVKYLGPFSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWAVQVVLMGAVEGYRIAGGPLGEVVDPLYPGGSFDPLGLADDPEAFAELKVKELKNGRLAMFSMFGFFVQAIVTGKGPLENLADHLADPVNNNAWAYATNFVPGN

SEQ ID NO: 3589 - DNA, 366 bp, Sorghum bicolor
  misc_feature: Ceres ANNOT ID no. 6031981
  misc_feature: Encodes the peptide sequence at SEQ ID NO 3590
atgaaggcgagggcgaagtccagcggcggcgactccaggctttcggtgaagaagggcaaggctcagaaggacccaaacaagcccaagaggcctccgagcgcggaggagttcaggaaggactacaaggagaagcaccccaatgtgaagcaagtctctgtgattggcaaggcttgtggtgacaagtggaagtccctgtctgatgctgagaaggctccctacgtctctaaggccgagaagctcaaggttgagtacaccaagaagatggacgcctacaacaacaagcagtctggaggccccacagcgtctggtgattctgacaagtccaagtctgaggtgaatgacgaggacgaggagggtgacgagtga

SEQ ID NO: 3590 - protein, 121 aa, Sorghum bicolor
  misc_feature: Ceres ANNOT ID no. 6031981
  misc_feature (28)..(92): Pfam Id: HMG_box Pfam Desc: HMG (high mobility group) box
  misc_feature (1)..(121): NCBI GI: 22135473 NCBI Desc: nucleasome/chromatin assembly factor d protein nfd101 [zea mays]
  misc_feature (1)..(121): NCBI GI: 17017392 NCBI Desc: hmg-like nucleosome/chromatin assembly factor d [zea mays]
  misc_feature (1)..(121): NCBI GI: 2196548 NCBI Desc: dna-binding protein [nicotiana tabacum]
  misc_feature (2)..(120): NCBI GI: 2894109 NCBI Desc: high mobility group protein [solanum tuberosum]
  misc_feature (2)..(120): NCBI GI: 729736 NCBI Desc: hmg1/2-like protein
  misc_feature: Useful for making plants with altered Lignin content
  misc_feature: Useful for making plants with altered alkaloid content
  misc_feature: Useful for making plants with altered terpenoid content
  misc_feature: Functional homolog of the protein sequence given in SEQ ID NO 12910
  misc_feature: GREAT-hit functional homolog of the protein sequence given in SEQ ID NO 13096
  misc_feature: Useful for making plants with altered lignin content
  misc_feature: Useful for making plants with altered terpenoid content
  misc_feature: Functional homolog of the protein sequence given in SEQ ID NO 13096
  misc_feature: Useful for making plants with altered alkaloid content
  misc_feature: Functional homolog of the protein sequence given in SEQ ID NO 12910
MKARAKSSGGDSRLSVKKGKAQKDPNKPKRPPSAEEFRKDYKEKHPNVKQVSVIGKACGDKWKSLSDAEKAPYVSKAEKLKVEYTKKMDAYNNKQSGGPTASGDSDKSKSEVNDEDEEGDE

SEQ ID NO: 3591 - DNA, 657 bp, Sorghum bicolor
  misc_feature: Ceres ANNOT ID no. 6031996
  misc_feature: Encodes the peptide sequence at SEQ ID NO 3592
atggcgccggctgatctcccaccaggctttaggttccatccaactgatgaggagcttgtgaactattacctcaagaggaaggtccatgggctaagcatcgagctcgacataatccctgaagtagacctctacaaatgtgagccttgggagctagcagagaaatcattcctgcctagtagagactccgagtggtatttctttgggccaagggataggaagtatccaaatggatgccgcacaaatcgcgcaacccaagcaggatactggaaatcaacaggcaaagatcggcgaatcaactaccagaacagatcaatcggcatgaagaagacattggtctactacaagggtcgagctcctcaggggctgaggaccaactgggtgatgcatgagtaccgcattgaggaaagcgaatgcgagaacaccatggggattcaggactcatatgcattgtgtcgtgtcttcaagaaaaatgtggcactcggagagttccagaagcaaaagcaaggcgagtgcagctcatcacaagctaatgaaaaacaagaacagtttacaagtgtcagggatgctggacagtcatctggttcaaatgagcatggtaaagacaacacatggatgcagttcatagctgatgatctatggtgcaacaaaacaaagtga

SEQ ID NO: 3592 - protein, 218 aa, Sorghum bicolor
  misc_feature: Ceres ANNOT ID no. 6031996
  misc_feature (6)..(134): Pfam Id: NAM Pfam Desc: No apical meristem (NAM) protein
  misc_feature (1)..(218): NCBI GI: 115480567 NCBI Desc: os09g0552900 [oryza sativa (japonica cultivar-group)]
  misc_feature (1)..(185): NCBI GI: 6227016 NCBI Desc: contains similarity to gbaf123310 nac domain protein nam gene from arabidopsis thaliana
  misc_feature (1)..(160): NCBI GI: 140067655 NCBI Desc: no apical meristem (nam) protein [medicago truncatula]
  misc_feature (1)..(168): NCBI GI: 15237939 NCBI Desc: no apical meristem (nam) family protein [arabidopsis thaliana]
  misc_feature (1)..(204): NCBI GI: 145651780 NCBI Desc: at3g03200 [arabidopsis thaliana]
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 612 in the 11/435,388 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 854 in the 11/435,388 US patent application
  misc_feature: Useful for making plants with altered alkaloid content
  misc_feature: Functional homolog of the protein sequence given in SEQ ID NO 13147
  misc_feature: Useful for making plants with altered lignin content
  misc_feature: Functional homolog of the protein sequence given in SEQ ID NO 13331
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 344 in the 10/666,642 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: Useful for biocontainment applications
  misc_feature: Functional homolog of the protein sequence given in SEQ ID NO 13684
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: Useful for making plants with altered cell wall content and/or composition
  misc_feature: Functional homolog of the protein sequence given in SEQ ID NO 13703
  misc_feature: The sequence is a functional homolog of SEQ ID NO 1729 in the 11/479,226 US patent application
  misc_feature: Useful for making plants with altered carbohydrate content
  misc_feature: Functional homolog of the protein sequence given in SEQ ID NO 13841
  misc_feature: Useful for making plants with modulated biomass
  misc_feature: Functional homolog of the protein sequence given in SEQ ID NO 12949
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 2168 in the 10/374,780 US patent application
  misc_feature: The sequence is a functional homolog of SEQ ID NO 370 in the 10/666,642 US patent application
  misc_feature: The sequence is a functional homolog of SEQ ID NO 854 in the 10/374,780 US patent application
  misc_feature: Useful for making plants with altered terpenoid content
  misc_feature: Functional homolog of the protein sequence given in SEQ ID NO 13140
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 240 in the 10/225,068 US patent application
  misc_feature: The sequence is a functional homolog of SEQ ID NO 368 in the 10/374,780 US patent application
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: The sequence is a functional homolog of SEQ ID NO 886 in the 10/412,699 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 1012 in the 11/435,388 US patent application
  misc_feature: The sequence is a functional homolog of SEQ ID NO 890 in the 10/374,780 US patent application
  misc_feature: Useful for making plants with modulated light quality sensitivity
  misc_feature: Functional homolog of the protein sequence given in SEQ ID NO 13618
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 851 in the 10/374,780 US patent application
  misc_feature: The sequence is a functional homolog of SEQ ID NO 1438 in the 10/666,642 US patent application
  misc_feature: The sequence is a functional homolog of SEQ ID NO 208 in the 10/666,642 US patent application
  misc_feature: The sequence is a functional homolog of SEQ ID NO 2100 in the 10/374,780 US patent application
  misc_feature: The sequence is a functional homolog of SEQ ID NO 270 in the 10/714,887 US patent application
  misc_feature: The sequence is a functional homolog of SEQ ID NO 270 in the 11/435,388 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MAPADLPPGFRFHPTDEELVNYYLKRKVHGLSIELDIIPEVDLYKCEPWELAEKSFLPSRDSEWYFFGPRDRKYPNGCRTNRATQAGYWKSTGKDRRINYQNRSIGMKKTLVYYKGRAPQGLRTNWVMHEYRIEESECENTMGIQDSYALCRVFKKNVALGEFQKQKQGECSSSQANEKQEQFTSVRDAGQSSGSNEHGKDNTWMQFIADDLWCNKTK

SEQ ID NO: 3593 - DNA, 1407 bp, Sorghum bicolor
  misc_feature: Ceres ANNOT ID no. 6032000
  misc_feature: Encodes the peptide sequence at SEQ ID NO 3594
  misc_feature: Up-regulated in root tissues in response to methyl jasmonate treatment
  misc_feature: Up-regulated in root tissues in response to salicylic acid treatment
atggccgctgccgccgctgccgcggtgtcggtcgacgagaagctcgacaagcttcgcgccgaggtcgccaagctcgaccagatcagcgagaacgagaagtccgggttcctcagcctcgtgtcacgctacctcagtggggaggcggagcagatcgagtggagcaagatccagaccccgactgatgaggtggtggtgccgtacgataccctcgcgtcgcctcccgaagatctcgaggagacgaagaagctgctggacaagctcgttgtgctcaagcttaacggagggctcgggacgaccatgggctgcactgggcccaagtctgtcattgaagtccgcaatgggttcacattccttgatcttattgtgatccaaattgagtccctgaacaagaagtatggatgcagtgtccctttacttctgatgaactctttcaacacccatgatgacacacagaagattgttgaaaagtattccaactccaacattgaaattcatactttcaatcagagccagtatcctcgcattgttaccgaggacttcttgccacttccaagcaaagggaactctgggaaggatggctggtatcctccaggccatggtgatgtgttcccctctctgaataacagcggaaaacttgacatcttattggctcagggcaaggagtatgtcttcgttgcaaactcagacaacttgggtgctatagtcgacatcaagatcctaaaccatctgatcaataaccagaacgagtattgcatggaggttactccaaagacgctggctgatgttaagggcggtacactcatctcttacgaaggaagagttcagcttttggagattgcccaagtacctgatgagcatgtcaatgaatttaaatcaatcgagaagtttaagatattcaacactaacaacttgtgggtgaaccttaaagctatcaagagactcgtagaggctgaggctcttaagatggaaattattccaaaccccaaggaagttgatggtgtaaaggtccttcaactcgaaactgcagctggtgcagctattcggttcttcgacaaagcgattggaattaatgttccccgctcaaggtttctcccagtgaaggctacatctgatttgttgcttgtgcagggttttgtcatccccaccccagccggggggaatccagttaccccttggattgagctgggcccggatttcaagaaggttgccaatttccttgctcggttcaagtccatccccagcatcgtcgagcttgacaacttgaaggtttctggtgatgtctggtttggctctggaattacactcaagggcaaggtgacaatcactgccaagtctggagtgaagttggagattccagatggagctgtacttgagaacaaggatgtcaatggccctgaggatctttaa

SEQ ID NO: 3594 - protein, 468 aa, Sorghum bicolor
  misc_feature: Ceres ANNOT ID no. 6032000
  misc_feature (32)..(436): Pfam Id: UDPGP Pfam Desc: UTP--glucose-1-phosphate uridylyltransferase
  misc_feature (1)..(468): NCBI GI: 37729658 NCBI Desc: udp-glucose pyrophosphorylase [bambusa oldhamii]
  misc_feature (8)..(468): NCBI GI: 115480571 NCBI Desc: os09g0553200 [oryza sativa (japonica cultivar-group)]
  misc_feature (8)..(468): NCBI GI: 88866516 NCBI Desc: udp-glucose pyrophosphorylase [oryza sativa (indica cultivar-group)]
  misc_feature (8)..(468): NCBI GI: 114848914 NCBI Desc: udp-glucose pyrophosphorylase [oryza sativa (indica cultivar-group)]
  misc_feature (5)..(468): NCBI GI: 6136111 NCBI Desc: utp--glucose-1-phosphate uridylyltransferase (udp-glucose pyrophosphorylase) (udpgp) (ugpase)
  misc_feature (5)..(468): SWISSPROT Homolog: EC 2.7.7.9 UTP--glucose-1-phosphate uridylyltransferase
  misc_feature: Up-regulated in root tissues in response to methyl jasmonate treatment
  misc_feature: Up-regulated in root tissues in response to salicylic acid treatment
  misc_feature: The sequence is a functional homolog of SEQ ID NO. 445 in the 11/188,298 US application
MAAAAAAAVSVDEKLDKLRAEVAKLDQISENEKSGFLSLVSRYLSGEAEQIEWSKIQTPTDEVVVPYDTLASPPEDLEETKKLLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGNSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQGFVIPTPAGGNPVTPWIELGPDFKKVANFLARFKSIPSIVELDNLKVSGDVWFGSGITLKGKVTITAKSGVKLEIPDGAVLENKDVNGPEDL

SEQ ID NO: 3595 - DNA, 1128 bp, Sorghum bicolor
  misc_feature: Ceres ANNOT ID no. 6032004
  misc_feature: Encodes the peptide sequence at SEQ ID NO 3596
atgcccgcgatcccaacggccccagctcccagcccctcgagcttcctcctcgcccgccgccacagcctccacgtctcctacccatcgcctagctctaaccaccagcggctcccgccccgcctcctgcgcctgcccgctcgtccccaggccgctcccatgtctgccgtggcgcgggcacccgcgtcgccggtggcgccgccggcgcaccccacctacgatctcaaggccgtcatcgcgctcgccctcgcagaggacgccggcgaccgaggggatgtatcttgtttagccaccataccttctgatgtggaagccgaagccacatttattgctaaagcagatggtgtcattgctggaataagcctagcagatatgatatttaaccaggttgatccatctttgaaggttgaatggtttgaaagtgatggaaattatgtccataaaggattgcagtttggaaaagtatatgggtgtgcccggagcatcatcgttgcagaaagggttgtgctaaatttcatgcagcgaatgagtggcattgcgaccctaacaaaggctatgtctgatgctgcccgtccagcatgcatattggaaacaaggaaaaccgccccaggtttacgtctggttgacaagtgggcagtactgattggtggcggaaagaaccacaggcttggtttatttgatatggttatgataaaagataatcatatttctgttgccggtgggattgcaaatgcaatgagatctgttgatcaattcctgcagaaggaaaaactcacaattcctgtcgaggttgagacaaggacaattgaagaagtgaaagatttgttgaagtatgctgctgagaacaaaacttcattaacccgtataatgttggacaatatggctgtacctcttgcaaatggggatgtagatgtttcaatgcttaaagacgcagttcagttgataaatggtagatttgagactgaggcgtctggaaatgtgacaattgatacagtaaagaaaatcggagaaacgggagtcacttatatttcaagtggagcattaacgcattctgtgaaggcacttgacatctctctcaagatagacactgagctcgctcttcaggttggaagacgtacaaatcgtgcttga

SEQ ID NO: 3596 - protein, 375 aa, Sorghum bicolor
  misc_feature: Ceres ANNOT ID no. 6032004
  misc_feature (178)..(359): Pfam Id: QRPTase_C Pfam Desc: Quinolinate phosphoribosyl transferase, C-terminal domain
  misc_feature (87)..(176): Pfam Id: QRPTase_N Pfam Desc: Quinolinate phosphoribosyl transferase, N-terminal domain
  misc_feature (1)..(375): NCBI GI: 115480575 NCBI Desc: os09g0553600 [oryza sativa (japonica cultivar-group)]
  misc_feature (53)..(375): NCBI GI: 145328238 NCBI Desc: qpt (quinolinate phoshoribosyltransferase) [arabidopsis thaliana]
  misc_feature (53)..(375): NCBI GI: 21555686 NCBI Desc: nadc homolog [arabidopsis thaliana]
  misc_feature (53)..(375): NCBI GI: 7024457 NCBI Desc: quinolinate phosphoribosyltransferase [nicotiana tabacum]
  misc_feature (53)..(375): NCBI GI: 6117899 NCBI Desc: quinolinate phosphoribosyltransferase [nicotiana rustica]
  misc_feature: The sequence is a functional homolog of SEQ ID NO 2 in US patent 7304220
MPAIPTAPAPSPSSFLLARRHSLHVSYPSPSSNHQRLPPRLLRLPARPQAAPMSAVARAPASPVAPPAHPTYDLKAVIALALAEDAGDRGDVSCLATIPSDVEAEATFIAKADGVIAGISLADMIFNQVDPSLKVEWFESDGNYVHKGLQFGKVYGCARSIIVAERVVLNFMQRMSGIATLTKAMSDAARPACILETRKTAPGLRLVDKWAVLIGGGKNHRLGLFDMVMIKDNHISVAGGIANAMRSVDQFLQKEKLTIPVEVETRTIEEVKDLLKYAAENKTSLTRIMLDNMAVPLANGDVDVSMLKDAVQLINGRFETEASGNVTIDTVKKIGETGVTYISSGALTHSVKALDISLKIDTELALQVGRRTNRA

SEQ ID NO: 3597 - DNA, 957 bp, Sorghum bicolor
  misc_feature: Ceres ANNOT ID no. 6032009
  misc_feature: Encodes the peptide sequence at SEQ ID NO 3598
atgggcgacgcggaggccgcctcgagggtggggaggaggggggcggccgccgccgcggggatgagggtgttctcgccggagtactacgcgctctgcgccggcggcgggatgctggcggcgggcgcaacccacctcgccatcaccccgctcgacgtgctcaaggtcaacatgcaggtgaatcccatgaagtataacagtatattttcaggactaaatgttcttgtgaaagaagagggaccttcgtcactttggagaggctggggagggaaatttgttggctatggtgttcagggtggctgcaggtttggcctctatgaatatttcaagaagaggtactctgacatgctagtagacagtaacaagagcaccatatacttccttagtagtgcctctgctcaaatcatagctgatgttgccctgtgtccgtttgaatcggtgaaagtccgtgttcagactcagcccatgtttgcaaaaggtttggttgatggctttccaagggtgtatgcaactgaaggcctgtctggcttttacagggggcttttacctctttggggacggaaccttccattttctatgcttatgttttcggcttttgagcataccgtggacttcctttatcagaaagttattcaaaagaaaaaggaggactgctcaacaatccagcagcttggtgctacttgtgtggctggttatatctctggcgccgttggtactgttgtttcaaatcctgcagataatattgtctcatccctgtacaacaaaaaggctgaaaatatcatacatgctgtgaaaagtattgggtttcgcaatttgttcacaagaagcctgcccattcggatcgcccttgttggacccgtcataagcatgcaatggttcttctacgatactatcaagatattgactggattgccaccgagtggagggcttccgcgggaactggaagaagttaacatataa

SEQ ID NO: 3598 - protein, 318 aa, Sorghum bicolor
  misc_feature: Ceres ANNOT ID no. 6032009
  misc_feature (28)..(116): Pfam Id: Mito_carr Pfam Desc: Mitochondrial carrier protein
  misc_feature (121)..(209): Pfam Id: Mito_carr Pfam Desc: Mitochondrial carrier protein
  misc_feature (2)..(316): NCBI GI: 115480583 NCBI Desc: os09g0554000 [oryza sativa (japonica cultivar-group)]
  misc_feature (126)..(315): NCBI GI: 92867972 NCBI Desc: mitochondrial substrate carrier [medicago truncatula]
  misc_feature (20)..(309): NCBI GI: 23505897 NCBI Desc: at5g14040/mua22_4 [arabidopsis thaliana]
  misc_feature (21)..(309): NCBI GI: 46806078 NCBI Desc: mitochondrial phosphate transporter [oryza sativa (japonica cultivar-group)]
  misc_feature (21)..(318): NCBI GI: 3318613 NCBI Desc: mitochondrial phosphate transporter [zea mays]
  misc_feature: The sequence is a functional homolog of SEQ ID NO. 398 in the 11/188,298 US application
  misc_feature: The sequence is a functional homolog of SEQ ID NO. 517 in the 11/188,298 US application
MGDAEAASRVGRRGAAAAAGMRVFSPEYYALCAGGGMLAAGATHLAITPLDVLKVNMQVNPMKYNSIFSGLNVLVKEEGPSSLWRGWGGKFVGYGVQGGCRFGLYEYFKKRYSDMLVDSNKSTIYFLSSASAQIIADVALCPFESVKVRVQTQPMFAKGLVDGFPRVYATEGLSGFYRGLLPLWGRNLPFSMLMFSAFEHTVDFLYQKVIQKKKEDCSTIQQLGATCVAGYISGAVGTVVSNPADNIVSSLYNKKAENIIHAVKSIGFRNLFTRSLPIRIALVGPVISMQWFFYDTIKILTGLPPSGGLPRELEEVNI

SEQ ID NO: 3599 - DNA, 1248 bp, Sorghum bicolor
  misc_feature: Ceres ANNOT ID no. 6032011
  misc_feature: Encodes the peptide sequence at SEQ ID NO 3600
atgggattcttctcattgtttcttgtggcttcgatgccagtcgtccaggtcctgctcataggtgccattggagctttcctggcctctggtttcagcaacgttctgacgaccagtgctcgaagggatatgaacaaggttgtttttactgtattcaccccatgtttgatgttcgccagcctcgcgaagacggtcacgctcgcagacgtcatttcttggtggtttatgccggttaacatagggatcacgttcattattggtggcactctgggttggatagcatgcaacatcttgaagccaccacagcactttaggggattgatcatggccttctgctcagcagggaaccttggaaacctgctactgataattgtcccggctgtatgcgacgaagacgggagcccctttgggaaagatccaagcatttgccgctcacgtggtctctcctactcgtccttgtccatggctctgggtggcatttacatatggacacacacgtacagcctcatgcagaagtcaggcaagctgtatcacaagatgcattccaaaagcatccaatgcccagccgacagcgacgaggagcattcatctgactaccctgacgaggaggcacctcttccgacgtcagttaagcctggcgatcacgagcacggggaagaaaaccaaatggaggcccctctcttgtcctgtgagagcgaggtcgctgacaaggggttctggacgaatctgaaggacgctgtccaccagttcatcgaggagctgatggcgccacccaccatatccgcaataattgggtttgttgttggcctggtcccatggctaaaatccctaatcatcggcgacggagctccttttaaagttatacaggattccctccagctgatgggtaatggcgcgattccttgcatcaccctcatcctaggtggaaacctgactcaagggcttcggaagtcggggctgaagcgtagggtgatcgtcacaatcctgtgcatccgcttcgtgctcctcccgctgatcggcatcgccgtcgtccacgccgcctacgggctcgggttcctgtcccgtgaccctctgtaccgctacgtgctcatggtgcagttcgccgtgcctccggcgatgaacatcggaaccatggctcagctgttcgacgttggccaagaggagtgctccgtgatcttcctctggacgtacctcgttgccgcggttgcgctgacgacgtggtcgacgatcttcatgtccattctgtcttga

SEQ ID NO: 3600 - protein, 415 aa, Sorghum bicolor
  misc_feature: Ceres ANNOT ID no. 6032011
  misc_feature (9)..(407): Pfam Id: Mem_trans Pfam Desc: Membrane transport protein
  misc_feature (1)..(415): NCBI GI: 115480587 NCBI Desc: os09g0554300 [oryza sativa (japonica cultivar-group)]
  misc_feature (1)..(415): NCBI GI: 92867960 NCBI Desc: auxin efflux carrier [medicago truncatula]
  misc_feature (1)..(415): NCBI GI: 92867962 NCBI Desc: auxin efflux carrier [medicago truncatula]
  misc_feature (225)..(415): NCBI GI: 22329697 NCBI Desc: auxin efflux carrier family protein [arabidopsis thaliana]
  misc_feature (1)..(411): NCBI GI: 140066984 NCBI Desc: auxin efflux carrier [medicago truncatula]
MGFFSLFLVASMPVVQVLLIGAIGAFLASGFSNVLTTSARRDMNKVVFTVFTPCLMFASLAKTVTLADVISWWFMPVNIGITFIIGGTLGWIACNILKPPQHFRGLIMAFCSAGNLGNLLLIIVPAVCDEDGSPFGKDPSICRSRGLSYSSLSMALGGIYIWTHTYSLMQKSGKLYHKMHSKSIQCPADSDEEHSSDYPDEEAPLPTSVKPGDHEHGEENQMEAPLLSCESEVADKGFWTNLKDAVHQFIEELMAPPTISAIIGFVVGLVPWLKSLIIGDGAPFKVIQDSLQLMGNGAIPCITLILGGNLTQGLRKSGLKRRVIVTILCIRFVLLPLIGIAVVHAAYGLGFLSRDPLYRYVLMVQFAVPPAMNIGTMAQLFDVGQEECSVIFLWTYLVAAVALTTWSTIFMSILS

SEQ ID NO: 3601 - DNA, 1326 bp, Sorghum bicolor
  misc_feature: Ceres ANNOT ID no. 6032015
  misc_feature: Encodes the peptide sequence at SEQ ID NO 3602
atgatgtccaccagccatgcggtgaagcagtcgccggcgtgcgcggctcgttggcggcggcggcagcacggccagcggtccgcggacgcgccggcccgcacggcgacgttctcggctaggcacgggaggcagcggcgaggaggccgcggcgtggcgccgtgctccgtgcgcgccgcgggctccaacaccattggctgcctcgaggccgaggcgtggggcggcgccgcgcacgcccccggctccgccccttcgctgctgctgccgagcttccatgtggaggcgccggcgcccgggggcgacgcgctcgccgtgccgtccgagcagagggtgcaggaggtcgtgctcaagcaggcggcgctcgcggccgcggcgccgaggacggcgcggatcgagcccgtgcccatggacggcgggctcaaggcggccttccaccgctgcggggaggtctgccaggagtacgccaagacattctacttggcgacgcagctgatgacaccggagaggaggagggcaatctgggcaatatacgtgtggtgcaggagaacggacgagctggtcgacgggcccaacgcgtcccacatctcggcggtggcgctggaccggtgggagtcgcggctggaggacatcttcgccggccggccgtacgacatgctcgacgccgccctgtccgacaccgtcgccaacttccccgtcgacatacagccgttcagggacatgatcgaggggatgcgcatggacctgaagaagtcccggtaccggagcttcgacgagctgtacctctactgctactacgtggccggcaccgtggggctgatgagcgtcccggtgatgggcatctcgccggactccagggcggccaccgagacggtctacaagggggcgctggcgctgggcctggccaaccagctcaccaacatcctcagggacgtcggcgaggacgccagaaggggaaggatctatctcccacaggacgagctggagatggcggggctctccgacgccgacatcttggacggccgggtcaccgacgagtggaggagcttcatgaggggccagatcacgagggccagagccttcttcaggcaggccgaggaaggcgccaccgagctcaatcaggagagccgatggccggtgtgggcttctctgctcctgtaccggcagatcctggacgagatcgaggccaacgactacaacaacttcaccaggagggcctacgttccaaagacgaagaagctgatggcgctgcccaaggcgtacctgagatcactggttcccccctcttcttctcaggctgagagacagagacaccactccagcctaacatag

SEQ ID NO: 3602 - protein, 441 aa, Sorghum bicolor
  misc_feature: Ceres ANNOT ID no. 6032015
  misc_feature (150)..(424): Pfam Id: SQS_PSY Pfam Desc: Squalene/phytoene synthase
  misc_feature (53)..(441): NCBI GI: 115480597 NCBI Desc: os09g0555500 [oryza sativa (japonica cultivar-group)]
  misc_feature (74)..(428): NCBI GI: 47678187 NCBI Desc: phytoene synthase [oryza sativa]
  misc_feature (97)..(441): NCBI GI: 133251410 NCBI Desc: phytoene synthase [prunus mume]
  misc_feature (74)..(428): NCBI GI: 42521626 NCBI Desc: phytoene synthase 1; psy1 [oryza sativa (indica cultivar-group)]
  misc_feature (96)..(429): NCBI GI: 76560792 NCBI Desc: phytoene synthase [coffea canephora]
MMSTSHAVKQSPACAARWRRRQHGQRSADAPARTATFSARHGRQRRGGRGVAPCSVRAAGSNTIGCLEAEAWGGAAHAPGSAPSLLLPSFHVEAPAPGGDALAVPSEQRVQEVVLKQAALAAAAPRTARIEPVPMDGGLKAAFHRCGEVCQEYAKTFYLATQLMTPERRRAIWAIYVWCRRTDELVDGPNASHISAVALDRWESRLEDIFAGRPYDMLDAALSDTVANFPVDIQPFRDMIEGMRMDLKKSRYRSFDELYLYCYYVAGTVGLMSVPVMGISPDSRAATETVYKGALALGLANQLTNILRDVGEDARRGRIYLPQDELEMAGLSDADILDGRVTDEWRSFMRGQITRARAFFRQAEEGATELNQESRWPVWASLLLYRQILDEIEANDYNNFTRRAYVPKTKKLMALPKAYLRSLVPPSSSQAERQRHHSSLT

SEQ ID NO: 3603 - DNA, 1554 bp, Sorghum bicolor
  misc_feature: Ceres ANNOT ID no. 6032020
  misc_feature: Encodes the peptide sequence at SEQ ID NO 3604
atgcagccacaggccggttcctcctctctgcagcaaaactccactgccgctcccgatgtcgcggcgccgccgcccaagaagaagaggaaccagccaggcaacccaaatcctgacgcggaggtgatcgcgctgtcgccgcggacgctgctggcgacgaaccggttcgtgtgcgaggtgtgcaacaaggggttccagcgggagcagaacctgcagctgcaccggcggggccacaacctgccgtggaagctgaagcagaagaaccccaaggacgtgcggcggcgggtgtacctgtgcccggagccgacgtgcgtgcaccacgacccgtcccgggcgctgggcgacctcacggggatcaagaagcactactgccgcaagcacggcgagaagaagtggaagtgcgacaagtgcaacaagcgctacgccgtgcagtccgactggaaggcgcactccaagacctgcggcacccgcgagtaccgctgcgactgcggcaccctcttctccaggagggacagcttcatcacccaccgcgccttctgcgacgcgctggctcgtgagagcgcgcagatgccgcccctgggcgccggcctctacgccggccccggcagcatgagcctcgggctctccggcaccgtcgcccagatgcatggctttgcagaccaagccggccagtcctcttcagctgcagccgcgcagtttgaccacatcatgccatcgtcctcgggctccagctccatgttccgctctcaggcgtcggcctcctcgccatcctacttcctcggcggcggcgctcctcctgccgcccaggatttctccgaggacggctcccaaggcagccagggccctctgctgcacggcaaggcgcccttccatggcctaatgcaacttcccgagcagcaccaccagccggggccgggcagcagcaacgccgccgtcgccaacggtaacaacagcctcctgaaccttgggttcttctcagctggcaacaatggtggcacgtccggcagccaggacgcgcgccttgtcatccaagaccagttcaacgtcaccggcggcggcggtggaagcgcagagcatggcaacaacttgatggcgtccctcggaagccacctcggcggaggcttcccttccctgtacaacaactcatcgccatcggccgggctggcccagaactcggccacggcgctcctgatgaaggcggctcagatgggctcgacgtcgagcaccgcccacaacaacggcactactagcacgctgttccgtgctgtaagcttcagcgccgccgccgccgccgccgcaagtggacaggggacaagcagggccgcaggagaagggacgacgacgtctcacgaggcacacttccatgagctcatcatgaactctctggctggcggcggcggcgccgccggcaccggcggcttctccggcgctactgcagggttcgggggcgtggacgacggcaagctgagcacaagagacttcctcggcgtcggcaggggcgccatggcgccgcccgggctccacatcggcgccctggacccggctcagatgaagtga

SEQ ID NO: 3604 - protein, 517 aa, Sorghum bicolor
  misc_feature: Ceres ANNOT ID no. 6032020
  misc_feature (55)..(77): Pfam Id: zf-C2H2 Pfam Desc: Zinc finger, C2H2 type
  misc_feature (1)..(517): NCBI GI: 55418542 NCBI Desc: indeterminate-related protein 7 [zea mays]
  misc_feature (1)..(505): NCBI GI: 55418546 NCBI Desc: indeterminate-related protein 1 [zea mays]
  misc_feature (13)..(497): NCBI GI: 55418540 NCBI Desc: indeterminate-related protein 10 [zea mays]
  misc_feature (5)..(492): NCBI GI: 50251918 NCBI Desc: finger protein pcp1-like [oryza sativa (japonica cultivar-group)]
  misc_feature (5)..(509): NCBI GI: 55418544 NCBI Desc: indeterminate-related protein 9 [zea mays]
  misc_feature: The sequence is a functional homolog of SEQ ID NO 1074 in the 10/666,642US patent application
  misc_feature: The sequence is a functional homolog of SEQ ID NO 1075 in the 10/666,642US patent application
  misc_feature: The sequence is a functional homolog of SEQ ID NO 1076 in the 10/666,642US patent application
  misc_feature: The sequence is a functional homolog of SEQ ID NO 1077 in the 10/666,642US patent application
  misc_feature: The sequence is a functional homolog of SEQ ID NO 1078 in the 10/666,642US patent application
  misc_feature: The sequence is a functional homolog of SEQ ID NO 1079 in the 10/666,642US patent application
  misc_feature: The sequence is a functional homolog of SEQ ID NO 1086 in the 10/666,642US patent application
  misc_feature: The sequence is a functional homolog of SEQ ID NO 1087 in the 10/666,642US patent application
  misc_feature: The sequence is a functional homolog of SEQ ID NO 1785 in the 10/374,780US patent application
  misc_feature: Useful for making plants with altered Lignin content
  misc_feature: Useful for making plants with modulated growth and phenotype characteristics
  misc_feature: Functional homolog of the protein sequence given in SEQ ID NO 13275
  misc_feature: The sequence is a functional homolog of SEQ ID NO 1785 in the 20060162006 US patent application
  misc_feature: The sequence is a functional homolog of SEQ ID NO 1074 in the 20070033671 US patent application
  misc_feature: The sequence is a functional homolog of SEQ ID NO 1075 in the 20070033671 US patent application
  misc_feature: The sequence is a functional homolog of SEQ ID NO 1076 in the 20070033671 US patent application
  misc_feature: The sequence is a functional homolog of SEQ ID NO 1078 in the 20070033671 US patent application
  misc_feature: The sequence is a functional homolog of SEQ ID NO 1079 in the 20070033671 US patent application
  misc_feature: The sequence is a functional homolog of SEQ ID NO 1086 in the 20070033671 US patent application
  misc_feature: The sequence is a functional homolog of SEQ ID NO 1087 in the 20070033671 US patent application
  misc_feature: Useful for making plants with altered lignin content
  misc_feature: Functional homolog of the protein sequence given in SEQ ID NO 13275
  misc_feature: The sequence is a functional homolog of SEQ ID NO 1087 in the 10/666,642 US patent application
  misc_feature: The sequence is a functional homolog of SEQ ID NO. 455 in the 11/188,298 US application
MQPQAGSSSLQQNSTAAPDVAAPPPKKKRNQPGNPNPDAEVIALSPRTLLATNRFVCEVCNKGFQREQNLQLHRRGHNLPWKLKQKNPKDVRRRVYLCPEPTCVHHDPSRALGDLTGIKKHYCRKHGEKKWKCDKCNKRYAVQSDWKAHSKTCGTREYRCDCGTLFSRRDSFITHRAFCDALARESAQMPPLGAGLYAGPGSMSLGLSGTVAQMHGFADQAGQSSSAAAAQFDHIMPSSSGSSSMFRSQASASSPSYFLGGGAPPAAQDFSEDGSQGSQGPLLHGKAPFHGLMQLPEQHHQPGPGSSNAAVANGNNSLLNLGFFSAGNNGGTSGSQDARLVIQDQFNVTGGGGGSAEHGNNLMASLGSHLGGGFPSLYNNSSPSAGLAQNSATALLMKAAQMGSTSSTAHNNGTTSTLFRAVSFSAAAAAAASGQGTSRAAGEGTTTSHEAHFHELIMNSLAGGGGAAGTGGFSGATAGFGGVDDGKLSTRDFLGVGRGAMAPPGLHIGALDPAQMK

SEQ ID NO: 3605 - DNA, 1590 bp, Sorghum bicolor
  misc_feature: Ceres ANNOT ID no. 6032021
  misc_feature: Encodes the peptide sequence at SEQ ID NO 3606
atgatgataaatgtactgctcatgctccttttgctaccatatggagaaaggactagtgacatgcagatgcagccacagggctcctctctggaacaaaactctaaaaagaagaggaatcggcgacccggcaatccaagacctgatgcggaggtggtcgcgttatcaccacagacactactagcaacaaaccggtttgtgtgcccggtgtgccagaagggtttccagcgggaccaaaacctacagctgcacctgcgcggccacaacatgccatggaagctgaagccaaagaaccccaaagaggcatgtcgtcgcgtgtacctgtgcccagagccaacatgtgtgcaccacgacccatctcgagcattgggtgacctcacggggatcaagaagcactatagccgcaagcatggtgagaagaatttgaagtgtgataagtgcaataagcgctacgccgtggagtctgattggaaggcacactgcaagacctgtggcacgcgtgagtatcgctgcgaatgcgatgccctcttctccaggatgcacagcttcatcacccaccgcgccatctgcgacgcgctggctcttaagagcgcgcagatgccgcccctgggcgccggcctctacgtcggcaccggcagcaagagcctagggctctctggcaccgccgcccagatgcatggctttgcacaccaagccagccagtcctcttcagcagcagcagctgtgcagtttgaccacatcatgccatcctcttcgggctccagctccatgttccgctctcaggcgtcggcctcctcgtcatcttacttcctcggcggcggcgctcctccaaccgcccaggatttctccgaggactgctcccagggcagccaccaggcccccctgctccacggcaaggcgcccttccatggcctgatgcaactccccgagcagcaccaccagccggggccgggcagcagcaacaacgccgccttcgccaatggtaacaacctcctgaaccttggcttcttctcagctggcaacaatggtggcggcacgttcggcagccaggacgcgcgccttgtcatccaagaccagttcaacgtcaccggcggcggcagtggaagcaccgcagagcatggcaacctgatggcggcgtccgtcggaagccacctcagcggaggcttcccttccctgtacaacaactcatctgcatcggccgccaaggtccagaactcggccacggcgctcctgatgaaggcggctcagatgggctcgacgtcgagcaccaccacccacaccggctccagctcgctgctccctgtagcctgcttcaccggcaccgtcagcggccaggggactagcagggcagcagaagaagggatgactcaggaggcacacttccatgatctcatcatgaactctctgccgttaatgggaggcactggcaccgacggcttcgccggcactgcaggaatggcgggcgtggacgacggcaatctgagcacgagagacttcctcggcgtcggcagggacgacgacgcgatggcgccgacggccggcctccccaacatgggcgccctggaccctacccagatgaaatggttcatgtga

SEQ ID NO: 3606 - protein, 529 aa, Sorghum bicolor
  misc_feature: Ceres ANNOT ID no. 6032021
  misc_feature (65)..(87): Pfam Id: zf-C2H2 Pfam Desc: Zinc finger, C2H2 type
  misc_feature (23)..(526): NCBI GI: 55418542 NCBI Desc: indeterminate-related protein 7 [zea mays]
  misc_feature (14)..(526): NCBI GI: 55418546 NCBI Desc: indeterminate-related protein 1 [zea mays]
  misc_feature (26)..(487): NCBI GI: 55418544 NCBI Desc: indeterminate-related protein 9 [zea mays]
  misc_feature (35)..(504): NCBI GI: 55418540 NCBI Desc: indeterminate-related protein 10 [zea mays]
  misc_feature (34)..(497): NCBI GI: 50251918 NCBI Desc: finger protein pcp1-like [oryza sativa (japonica cultivar-group)]
  misc_feature: The sequence is a functional homolog of SEQ ID NO 1074 in the 10/666,642US patent application
  misc_feature: The sequence is a functional homolog of SEQ ID NO 1075 in the 10/666,642US patent application
  misc_feature: The sequence is a functional homolog of SEQ ID NO 1076 in the 10/666,642US patent application
  misc_feature: The sequence is a functional homolog of SEQ ID NO 1077 in the 10/666,642US patent application
  misc_feature: The sequence is a functional homolog of SEQ ID NO 1078 in the 10/666,642US patent application
  misc_feature: The sequence is a functional homolog of SEQ ID NO 1079 in the 10/666,642US patent application
  misc_feature: The sequence is a functional homolog of SEQ ID NO 1086 in the 10/666,642US patent application
  misc_feature: The sequence is a functional homolog of SEQ ID NO 1087 in the 10/666,642US patent application
  misc_feature: The sequence is a functional homolog of SEQ ID NO 1785 in the 10/374,780US patent application
  misc_feature: Useful for making plants with modulated growth and phenotype characteristics
  misc_feature: The sequence is a functional homolog of SEQ ID NO 1785 in the 20060162006 US patent application
  misc_feature: The sequence is a functional homolog of SEQ ID NO 1074 in the 20070033671 US patent application
  misc_feature: The sequence is a functional homolog of SEQ ID NO 1075 in the 20070033671 US patent application
  misc_feature: The sequence is a functional homolog of SEQ ID NO 1076 in the 20070033671 US patent application
  misc_feature: The sequence is a functional homolog of SEQ ID NO 1078 in the 20070033671 US patent application
  misc_feature: The sequence is a functional homolog of SEQ ID NO 1079 in the 20070033671 US patent application
  misc_feature: The sequence is a functional homolog of SEQ ID NO 1086 in the 20070033671 US patent application
  misc_feature: The sequence is a functional homolog of SEQ ID NO 1087 in the 20070033671 US patent application
  misc_feature: Useful for making plants with altered lignin content
  misc_feature: Functional homolog of the protein sequence given in SEQ ID NO 13275
  misc_feature: The sequence is a functional homolog of SEQ ID NO 1087 in the 10/666,642 US patent application
  misc_feature: The sequence is a functional homolog of SEQ ID NO. 455 in the 11/188,298 US application
MMINVLLMLLLLPYGERTSDMQMQPQGSSLEQNSKKKRNRRPGNPRPDAEVVALSPQTLLATNRFVCPVCQKGFQRDQNLQLHLRGHNMPWKLKPKNPKEACRRVYLCPEPTCVHHDPSRALGDLTGIKKHYSRKHGEKNLKCDKCNKRYAVESDWKAHCKTCGTREYRCECDALFSRMHSFITHRAICDALALKSAQMPPLGAGLYVGTGSKSLGLSGTAAQMHGFAHQASQSSSAAAAVQFDHIMPSSSGSSSMFRSQASASSSSYFLGGGAPPTAQDFSEDCSQGSHQAPLLHGKAPFHGLMQLPEQHHQPGPGSSNNAAFANGNNLLNLGFFSAGNNGGGTFGSQDARLVIQDQFNVTGGGSGSTAEHGNLMAASVGSHLSGGFPSLYNNSSASAAKVQNSATALLMKAAQMGSTSSTTTHTGSSSLLPVACFTGTVSGQGTSRAAEEGMTQEAHFHDLIMNSLPLMGGTGTDGFAGTAGMAGVDDGNLSTRDFLGVGRDDDAMAPTAGLPNMGALDPTQMKWFM

SEQ ID NO: 3607 - DNA, 504 bp, Sorghum bicolor
  misc_feature: Ceres ANNOT ID no. 6032025
  misc_feature: Encodes the peptide sequence at SEQ ID NO 3608
atgcactcctttgggcaccgcgccaacgcggtggcaacgttcggggtcaccatactggccgcgatgtgcttcgccgcctccttctccgacaacttcaacaccccgacacccaccgcctccgtcaagatcttgaatataaactggttccagaaggaggccaacggcaacgacgaggttagcatgacgctgaacatttcggcagacctttcatctcttttcacgtggaacacaaaacaggtgtttgtttttgtggcagcagagtatgagactccacagaatgctttgaatcaagtttctctttgggatggtattatacctgcaaaggagcatgccaagtttttgatccataccacaaacaagtacagatttattgaccagggaagcaatctaaagggcaaggaattcaacttaacaatgcactggcacattatgccaaagactggcaagatgtttgcagataagatagtcatgacaggctatcggctccctgagcagtacagatag

SEQ ID NO: 3608 - protein, 167 aa, Sorghum bicolor
  misc_feature: Ceres ANNOT ID no. 6032025
  misc_feature (1)..(167): Pfam Id: SPC22 Pfam Desc: Signal peptidase subunit
  misc_feature (1)..(167): NCBI GI: 115480605 NCBI Desc: os09g0556000 [oryza sativa (japonica cultivar-group)]
  misc_feature (1)..(167): NCBI GI: 28558783 NCBI Desc: signal peptidase protein-like protein [cucumis melo]
  misc_feature (1)..(167): NCBI GI: 87240531 NCBI Desc: signal peptidase 22 kda subunit [medicago truncatula]
  misc_feature (1)..(126): NCBI GI: 79313123 NCBI Desc: signal peptidase [arabidopsis thaliana]
  misc_feature (1)..(166): NCBI GI: 115434338 NCBI Desc: os01g0131800 [oryza sativa (japonica cultivar-group)]
MHSFGHRANAVATFGVTILAAMCFAASFSDNFNTPTPTASVKILNINWFQKEANGNDEVSMTLNISADLSSLFTWNTKQVFVFVAAEYETPQNALNQVSLWDGIIPAKEHAKFLIHTTNKYRFIDQGSNLKGKEFNLTMHWHIMPKTGKMFADKIVMTGYRLPEQYR

SEQ ID NO: 3609 - DNA, 2079 bp, Sorghum bicolor
  misc_feature: Ceres ANNOT ID no. 6032026
  misc_feature: Encodes the peptide sequence at SEQ ID NO 3610
atgggcaagccgtcgctgaagaagaagagggcctccggcggcggcggcaagtccggggaccatgggggcaagtcggcgtcgctggagcggtccggctccaaggtcctcgacggcgacgagaccctctttacggacatggcgcaggagcacaaggaggagggcaacaagctcttccagcgccgggactacgaccgcgcgctgctcaactacgacaaggccatcaagctgctgccccgggcgcaccccgatgtcgcctacctccacagcaacatcgccgcctgctacatgcagatgagcccgcccgactactaccgcgccatcaacgagtgcaacgtcgcgctcgagacgtcgcccaagtacaccaaggcgctgctcaagcgggcgcgctgcttcgaggcgctgggcaggctcgacctcgcctgcagggacgtcaacaaggtgctcgttctggagcccaacaacctcactgcgctggatgtggccgacagggtgaagaaatccatggaggagaaggggattgtgttggacgacaaggagatcatgcccacgccggaggaggtagtggccgctgcgcccaagcagaagccgcgcaagaaaaggggaggacggaagtttgctgccaaggctgcggctgctgctgtggaggaggtcgatgaacagaagattgcggaagctgtcaaagaggaggaagtggaggagcagccaaggcaggtgaaacttgtgtttggggaggacataaggtgggctcaggtgccggcgagctgcagcatggcacagctgcgcgaggccgtccggagcaagtttcctgggctcaaggctgttcttgtcaagtacaaggacaaggagggtgatcttgtgacaatcaccaaccaggatgagctgaaatgggctgaggacttggctgaggctgggagctcacttcggctgtatgttaccgaggccaatccagagcatgaaccttatgttgatgacaccaatagtgggccattggagagaaatgtaaacagtgcttcggataatgggagtatcagaagcaatcggcaggatgaggacaggagcacggtgacttgtattgatgattggattgtgcaattcgctcggcttttcaagaaccatgttgggattagctctgatgagtacctggacctccatgaggttagtatgaagctctacactgaggcaattgaggacactattactactgaagaagcccaggaggtgtttaatcttgctgagggaaacttccaggagatggcagcacttgcatttttccactggggtaatgttcacatgtcccgagccaggaagaggttgctgctatcaggggactccccaagagaattggtgcttgagcaggtgaaggaagcatatgaatgggcaagggacgaatacaataaggctggaaagagatatgaagatgccgtgaaggccaaaccagacttttttgaaggtttccttgcacttgcacatcagcagtttgaacaagcaaaactgtcatggtactatgcaattggtagtaacgcagatttggacagctgttcttccgaaatcctggagctcttcaataaagccgaggataacattgagaagggtatagagatgtgggagttaatggaagaacagcgtctgaagaatcgatctaaacctagccaggagaatgttgtgctagagaagatgggcttggaggagtatatcaaggatgtgtccactgatgacgcggctgaacaggcttccaatttgaggtctcagataaacattttatggggtatgctcctctatgagcgttcagttgtggaatttaaattaggtcttccaatgtgggaggattgtctgatggcagctattgaaaagtttaaacttgggggagcttctgctacagatattgctgtgctggtgaaaaaccactgcgccaatgaaactgcccaagatggtttgggcttcaagattgatgaaattgttcaagcctggaatgaaatgtatgacattaaacggtggctgcgtggtgttccatcctttcgtcttgagccattatttaggcgaagggttccacaattgcatactgcacttgaacatatatag

SEQ ID NO: 3610 - protein, 692 aa, Sorghum bicolor
  misc_feature: Ceres ANNOT ID no. 6032026
  misc_feature (235)..(314): Pfam Id: PB1 Pfam Desc: PB1 domain
  misc_feature (47)..(80): Pfam Id: TPR_2 Pfam Desc: Tetratricopeptide repeat
  misc_feature (1)..(659): NCBI GI: 115480607 NCBI Desc: os09g0556200 [oryza sativa (japonica cultivar-group)]
  misc_feature (175)..(692): NCBI GI: 115475764 NCBI Desc: os08g0296900 [oryza sativa (japonica cultivar-group)]
  misc_feature (62)..(685): NCBI GI: 15241328 NCBI Desc: octicosapeptide/phox/bem1p (pb1) domain-containing protein / tetratricopeptide repeat (tpr)-containing protein [arabidopsis thaliana]
  misc_feature (227)..(543): NCBI GI: 87240788 NCBI Desc: octicosapeptide/phox/bem1p [medicago truncatula]
  misc_feature (299)..(440): NCBI GI: 50261877 NCBI Desc: at1g62390 [arabidopsis lyrata subsp. petraea]
MGKPSLKKKRASGGGGKSGDHGGKSASLERSGSKVLDGDETLFTDMAQEHKEEGNKLFQRRDYDRALLNYDKAIKLLPRAHPDVAYLHSNIAACYMQMSPPDYYRAINECNVALETSPKYTKALLKRARCFEALGRLDLACRDVNKVLVLEPNNLTALDVADRVKKSMEEKGIVLDDKEIMPTPEEVVAAAPKQKPRKKRGGRKFAAKAAAAAVEEVDEQKIAEAVKEEEVEEQPRQVKLVFGEDIRWAQVPASCSMAQLREAVRSKFPGLKAVLVKYKDKEGDLVTITNQDELKWAEDLAEAGSSLRLYVTEANPEHEPYVDDTNSGPLERNVNSASDNGSIRSNRQDEDRSTVTCIDDWIVQFARLFKNHVGISSDEYLDLHEVSMKLYTEAIEDTITTEEAQEVFNLAEGNFQEMAALAFFHWGNVHMSRARKRLLLSGDSPRELVLEQVKEAYEWARDEYNKAGKRYEDAVKAKPDFFEGFLALAHQQFEQAKLSWYYAIGSNADLDSCSSEILELFNKAEDNIEKGIEMWELMEEQRLKNRSKPSQENVVLEKMGLEEYIKDVSTDDAAEQASNLRSQINILWGMLLYERSVVEFKLGLPMWEDCLMAAIEKFKLGGASATDIAVLVKNHCANETAQDGLGFKIDEIVQAWNEMYDIKRWLRGVPSFRLEPLFRRRVPQLHTALEHI

SEQ ID NO: 3611 - DNA, 696 bp, Sorghum bicolor
  misc_feature: Ceres ANNOT ID no. 6032028
  misc_feature: Encodes the peptide sequence at SEQ ID NO 3612
atgtcttcggaatcatcacactcgtcattggaagatctgcaaaattcactaaaggatgtgccttggggagcatttttcaaaagcaaggcagtgtgggcaatgatatatgcacacttttgtggaagttgggggcattatacttgtttgtcttggctaccaacgttctttagtgaggagctgaacctgaacttgacagaagcagcatgggtgtcagtccttcctcctttgggttcaatgatcattacatctattgcagcaccttttgcagacaacttgatatcaaatggagttgacaccacgaaggtacgaaaaatttgccaaacaattgcctttgtgtcacctgcgacattcatgatgctttcctctgtggatcttggactgcctccttgggaaattgttgcttttcttacaagtggtctagcactctctagcttcgcattgtcagggctttattgcacacatcaagatatctctcgtgaatatgcaagcattctcctgggaatcacaaacactgtaggcgctgtgccaggaattgtaggcattgcactgacaggctttctgcttgattcaactcattcttggagtatatcactctttgtgccttctatcttcttttacttaactggtactgctgtatggttagcatttgcaagcagtgagccccaggatttttccaagtcagaacctgagtcatga

SEQ ID NO: 3612 - protein, 231 aa, Sorghum bicolor
  misc_feature: Ceres ANNOT ID no. 6032028
  misc_feature (15)..(231): NCBI GI: 115480609 NCBI Desc: os09g0556400 [oryza sativa (japonica cultivar-group)]
  misc_feature (2)..(228): NCBI GI: 42567984 NCBI Desc: transporter-related [arabidopsis thaliana]
  misc_feature (3)..(226): NCBI GI: 92884254 NCBI Desc: major facilitator superfamily mfs_1 [medicago truncatula]
  misc_feature (20)..(230): NCBI GI: 145344098 NCBI Desc: mfs family transporter: sugar (sialic acid) [ostreococcus lucimarinus cce9901]
  misc_feature (17)..(220): NCBI GI: 144923552 NCBI Desc: major facilitator superfamily mfs_1 [medicago truncatula]
MSSESSHSSLEDLQNSLKDVPWGAFFKSKAVWAMIYAHFCGSWGHYTCLSWLPTFFSEELNLNLTEAAWVSVLPPLGSMIITSIAAPFADNLISNGVDTTKVRKICQTIAFVSPATFMMLSSVDLGLPPWEIVAFLTSGLALSSFALSGLYCTHQDISREYASILLGITNTVGAVPGIVGIALTGFLLDSTHSWSISLFVPSIFFYLTGTAVWLAFASSEPQDFSKSEPES

SEQ ID NO: 3613 - DNA, 1716 bp, Sorghum bicolor
  misc_feature: Ceres ANNOT ID no. 6032031
  misc_feature: Encodes the peptide sequence at SEQ ID NO 3614
atggcggcggcgatggccaggcgtgccgctggccttctccctctcctcctcctctcttcgcggtccggtgctcgcatagccctccaccgggcggtatcccagatccctccgcctcgctcctatcgcctactctcgcagcaagccaatccctccccatcctcatcattctccgcctccgcatccgcatcgaatggcacggctgcagagagaacccgggagctgcatctgtacaacacaaagtcgcggaaaaaggagcagtttcggccgcgtgatccaggcggggaggtcggcatgtacgtctgcggcgtcactccctacgacgacagtcacatcggccatgcccgcgcatacgtagcctttgacgtcctctacaggtacttgcgctatttggactatgaagttcgctatgttcggaacttcaccgacattgatgacaagataattgcaagagcaaatcagctgggggaagatccttttagcttaagcaaaaggttctctgatgacttcctgtcagacatggccaatcttcaatgtttaccaccatctgtggagccccgtgtttcagatcatattcatgagattataaatatgattaaacagatccttgataatagttgcgcatatgtagtgggtggggatgtttatttctctgtagaaaattttcctgagtacggagaattgtctggtcggaaactagatgataatagagctggtgaaagggttgctgttgatgagaggaagagaaatccagctgattttgctctatggaaggccgcaaaagatggggagccatggtgggatagcccgtggggcccaggaaggccaggatggcacatcgaatgcagtgccatgagtgcgcattatttgggtcattcttttgacatacatggtggtggggaggatctcatctttccacaccatgagaatgagattgctcagagccgtgcagcatgttgtgacagtaccataaattactggatacacaacggttttgtcaatgtaaatagccaaaagatgtctaaatcacttggtaattttgtcaccatacggaaggttatagagatgtaccatccgctggctttgagaatgttcttacttggcacacactacaggtccccaattaactacacaatagaacaactcaatgttgcatcagacagattgtactacacatatcagaccttgcgtgattgtgaagagagttgtcagcagcaaggaagcaacactggaaattcattgcctcctaataccttaaattacatccaaaaacttcatgatgaatttgagacctcaatgtcagatgatcttcacacttcagtggcattggctgctatttctgagccattgaaagttatgaatgatctgttgcacactcgtaagggaaagaagcaggacaaaaggttggaagctctttctgccttagacgagaaaataagagtagtgctctctgttctaggattgctaccttcaagttatcatgaggctttgcaacagctgcgggataaagcactaagacgagcttccatcactgaggagcttgtgctgcagaagattgaagagaggactgcagcaaggaaggcgaagcagtatgaaaaatccgatgagatccggaaagaattggctgctgttggaattgccctcatggatggccccaacggaacaacttggagaccatctttgcctctttcagaggaagctgtggttgcgaaaacatga

SEQ ID NO: 3614 - protein, 571 aa, Sorghum bicolor
  misc_feature: Ceres ANNOT ID no. 6032031
  misc_feature (86)..(386): Pfam Id: tRNA-synt_1e Pfam Desc: tRNA synthetases class I (C) catalytic domain
  misc_feature (101)..(384): Pfam Id: tRNA-synt_1g Pfam Desc: tRNA synthetases class I (M)
  misc_feature (56)..(571): NCBI GI: 42569504 NCBI Desc: trna synthetase class i (c) family protein [arabidopsis thaliana]
  misc_feature (173)..(571): NCBI GI: 145330001 NCBI Desc: trna synthetase class i (c) family protein [arabidopsis thaliana]
  misc_feature (68)..(561): NCBI GI: 15241557 NCBI Desc: trna synthetase class i (c) family protein [arabidopsis thaliana]
  misc_feature (68)..(561): NCBI GI: 9758060 NCBI Desc: cysteine-trna ligase [arabidopsis thaliana]
  misc_feature (146)..(466): NCBI GI: 115450673 NCBI Desc: os03g0143300 [oryza sativa (japonica cultivar-group)]
  misc_feature (74)..(445): SWISSPROT Homolog: EC 6.1.1.16 Cysteinyl-tRNA synthetase
MAAAMARRAAGLLPLLLLSSRSGARIALHRAVSQIPPPRSYRLLSQQANPSPSSSFSASASASNGTAAERTRELHLYNTKSRKKEQFRPRDPGGEVGMYVCGVTPYDDSHIGHARAYVAFDVLYRYLRYLDYEVRYVRNFTDIDDKIIARANQLGEDPFSLSKRFSDDFLSDMANLQCLPPSVEPRVSDHIHEIINMIKQILDNSCAYVVGGDVYFSVENFPEYGELSGRKLDDNRAGERVAVDERKRNPADFALWKAAKDGEPWWDSPWGPGRPGWHIECSAMSAHYLGHSFDIHGGGEDLIFPHHENEIAQSRAACCDSTINYWIHNGFVNVNSQKMSKSLGNFVTIRKVIEMYHPLALRMFLLGTHYRSPINYTIEQLNVASDRLYYTYQTLRDCEESCQQQGSNTGNSLPPNTLNYIQKLHDEFETSMSDDLHTSVALAAISEPLKVMNDLLHTRKGKKQDKRLEALSALDEKIRVVLSVLGLLPSSYHEALQQLRDKALRRASITEELVLQKIEERTAARKAKQYEKSDEIRKELAAVGIALMDGPNGTTWRPSLPLSEEAVVAKT

SEQ ID NO: 3615 - DNA, 1158 bp, Sorghum bicolor
  misc_feature: Ceres ANNOT ID no. 6032041
  misc_feature: Encodes the peptide sequence at SEQ ID NO 3616
atggacaaggaaggcggcggccaccatcaccaccacaccatccgagtcccatccccaaccccagataataatatagcaatgggggaggagacctcgcaggcaaatggctcaacgacgacgtcgctgagacggaaagcggccgaggtgatcgccacctccctggagacgtaccggagcaagccgttctccttctggttactcctgttcctgagcagcggcgccatgctcaccgcgttcccggcgtcgagcctgctctcgcggctctactacaccgacggcgggcagagcaagtggattctgtcgtgggcggccgtcgccggctggcccctgcccgcgctgctcctgctgccgctctacgccctcggcaaggcgtcgccgacgccgctgtcgctgacgctgtgcttctggtacgcgctcctcggcttcctcagcgccgccgacaaccttatgtacgcgtgggcgtacgcgtacctcccggcgtccacggcgtcgctcgtcgcggcgtcgtcgctcgcgttctcggcgctcttcggccgcgccatcgccaagaacacgctgaacatgtcctcgctcaacgccgtcgtggtgatcacggcgggcgtggtgatcgtcgcgctggactccgggtcggacaggccccccggcgtcacgccgcgccagtacgcgctcggctttgtcctggacgtgctcgggtcggcgctccacggcctcatattcgcgctctcggagctcgtcttcgccagggtcctcggcaggcgctccttccacgtggtgctggagcagcaggcggccgtgtcgctctgcgcgttcgccttcacctccgcggggctcgccgtcgccgagggcttcccggcgatgcggcgcgaggcggcgcggtttgcgcacggtggcgaggccgcgtacgcgaacgtgatggtgtggacggcggtcacgttccagctgggcgtcctcggcggcaccggcgtgctgttcctggcgtccaccgtactcgccggagtgctgaacgctgtcagggtgcccctcacgagcatcgccgcggtgatctggttccatgaccccatgagcgggttcaagatcttggctctggtcatcactgtgtgggggttcgcgtcctacatggttggccactcctctgttagaaaaacgtcaagaagttga

SEQ ID NO: 3616 - protein, 385 aa, Sorghum bicolor
  misc_feature: Ceres ANNOT ID no. 6032041
  misc_feature (224)..(374): Pfam Id: TPT Pfam Desc: Triose-phosphate Transporter family
  misc_feature (2)..(383): NCBI GI: 115480621 NCBI Desc: os09g0557500 [oryza sativa (japonica cultivar-group)]
  misc_feature (29)..(385): NCBI GI: 145360271 NCBI Desc: atpup5 (arabidopsis thaliana purine permease 5); purine transporter
  misc_feature (45)..(373): NCBI GI: 42571763 NCBI Desc: purine permease family protein [arabidopsis thaliana]
  misc_feature (22)..(376): NCBI GI: 38344290 NCBI Desc: osjnba0013k16.22 [oryza sativa (japonica cultivar-group)]
  misc_feature (22)..(376): NCBI GI: 38605752 NCBI Desc: osjnbb0016d16.5 [oryza sativa (japonica cultivar-group)]
MDKEGGGHHHHHTIRVPSPTPDNNIAMGEETSQANGSTTTSLRRKAAEVIATSLETYRSKPFSFWLLLFLSSGAMLTAFPASSLLSRLYYTDGGQSKWILSWAAVAGWPLPALLLLPLYALGKASPTPLSLTLCFWYALLGFLSAADNLMYAWAYAYLPASTASLVAASSLAFSALFGRAIAKNTLNMSSLNAVVVITAGVVIVALDSGSDRPPGVTPRQYALGFVLDVLGSALHGLIFALSELVFARVLGRRSFHVVLEQQAAVSLCAFAFTSAGLAVAEGFPAMRREAARFAHGGEAAYANVMVWTAVTFQLGVLGGTGVLFLASTVLAGVLNAVRVPLTSIAAVIWFHDPMSGFKILALVITVWGFASYMVGHSSVRKTSRS

SEQ ID NO: 3617 - DNA, 2655 bp, Sorghum bicolor
  misc_feature: Ceres ANNOT ID no. 6032042
  misc_feature: Encodes the peptide sequence at SEQ ID NO 3618
  misc_feature: Up-regulated in root tissues in response to methyl jasmonate treatment
  misc_feature: Up-regulated in shoot tissues in response to methyl jasmonate treatment
atggcggccgatcccctgctcgcgctcctcgcgggcgcgctgctcgccgcggcgctcgccgcagccgcggcggcggccccgtcgtgcccgcacaccaacctgacggccaacttctccgccgacctcaccatgctgcagcaccagctccgcggcacggtgcgcctggccgacgacggcaagtgcgcgctcgagctcacccgcttcgacctcctcgccgcctccccctccgcgcgcttctgggccgccgacggccccgccatggccgacctcgccgccggccgcgccttctcgccgctcccgctcaacaaaaccttccggaacgcctccctcgagctccccttcgcccgcccgctcccgcgcctcctcgcgctctacgaccccgacacctcctccgacttcggccacgtcttcctccccaacggcacgggccccgacctcgataccgccgccgatccggcgcccaccatgtttgacaactgcatccctctctccgagacggagacctaccggctccgctggacgctgaatgcatccgccggcaccgtcgagatcggcctcgaggcggccgtgggctccgagtactacatggcgttcgggtggacggaccccaaggccaactcccccgcgatgatccacgccgatgtcgttgtcgccggcttcacggaggaaggtaccccatttgccgaggattattacataagcgactacactgagtgcacgctggggaaggaggactcgcccgtgtcaggggtttgcccagataaggcctatgaggacgggaagaacgattcaatcctggtgtatggccaccggcgggatggagtgtccttcgtgaggtatgtgaggaagcttgatgctgaggatgccaagtatgatgtgccagtgggtgccacggaggagatggcggtgctttggtccattggtaagttgcggccaccggacacaatgcacccgcactacctcccacagaaccatggggggccaagggacacaacctttgggtttgcccggttgaatttgtctgagacggtggacaattgccttggaccgttggatgctgacaataaggaggatcaggagaggatcattgccgatcgcaagacaccacttgtggtgacatctgctccagccgtgcgctacccaaacccaccaaaccctgacaaggtgctttacatcaacaagaaggaggcgccgctgctaaaggttgagaggggtgtgccagtgaagttctcagtgcaggctgggcatgacgtggcactctatatcacttcagatcccattggtggtaatgctacgctgaggaacaaaacagaggtcatatatgctggtgggcctgatgctcatggtgtcctagcaaccccaaaagagcttgtttggttgcctgatcgaaatacgcctgacctagtctattaccagtcactgtatgaccagaagatgggatggaaggttcaagtggttgatggaggccttagcgacatgtataataacagtgttattttggatgatcaacaggttactttgttttggactctctccacagattataaatctatatctatagcagcccgaggtgagaagaaaagtggatatcttgctattgggtttgggagtgggatggtgaatagcttcacctatgttgcttgggtgggcaatgatggtgttgggcgagtgaaaacttattggattgatggaaagagtgcaacaggtatccacccaacatctgagaacatcacatttgtccggtgtaagtcagaaaatggcattattacatttgaatttactcgccctcttaacccttcttgtaccgggaaggtagaatgcaagaacatcattgatccaactacaccccttaaggttgtctgggccatgggtgcaagctggtcgggagatgatctgacagacagtaacatgcattcagtcacaagcagtcggccaatacgtgttctgttgttgagaggttcagctgaggcagaacaggatttgcgtcctgtcctggctgttcatgggtttatgatgtttgttgcctggggtatcttgcttcctggtggaacaatggctgcccggtatttgaagagcttgaaaggagatgggtggttccagatacatgtctatctgcagtattcaggaatttctataatgtttcttggcgtcctttttgctgcagctgagctacgtggcttctttgtcagctcagtgcatgttaagtttggtgtgctggccctattactggcagttttgcagccacttaatgctaaatttcggcctagtaagccagctaatggggaggttccatctcgcaatcgaatcctatgggagtacctgcatgttatcacagggaggtcggcaattattgtaggaatcgttgcgcttttcacaggaatgaagcatttaggccataggtatgacagtgagaatgtagaggagctcacttgggccttaatgctgtgggtgctttcagttatcgttgttgtgctgtgcttggaatataaggaggtcaaaagaaggatcagtgacagaagcgccagagggcactgggtattaggcaacaccgaggaagatgattcagttgatcttttgcatcctgatggtacagctaggaattccgaatctagcgctggagtaatggaggtgcagcttgaacctctcactagatga

SEQ ID NO: 3618 - protein, 884 aa, Sorghum bicolor
  misc_feature: Ceres ANNOT ID no. 6032042
  misc_feature (167)..(307): Pfam Id: DOMON Pfam Desc: DOMON domain
  misc_feature (503)..(622): Pfam Id: DOMON Pfam Desc: DOMON domain
  misc_feature (45)..(443): NCBI GI: 24649429 NCBI Desc: cg12492-pa [drosophila melanogaster]
  misc_feature (45)..(443): NCBI GI: 125774785 NCBI Desc: ga11661-pa [drosophila pseudoobscura]
  misc_feature (182)..(443): NCBI GI: 46560038 NCBI Desc: cg12492 [drosophila buzzatii]
  misc_feature (132)..(397): NCBI GI: 23170926 NCBI Desc: cg32922-pb, isoform b [drosophila melanogaster]
  misc_feature (132)..(397): NCBI GI: 33589346 NCBI Desc: re64209p [drosophila melanogaster]
  misc_feature: Up-regulated in root tissues in response to methyl jasmonate treatment
  misc_feature: Up-regulated in shoot tissues in response to methyl jasmonate treatment
MAADPLLALLAGALLAAALAAAAAAAPSCPHTNLTANFSADLTMLQHQLRGTVRLADDGKCALELTRFDLLAASPSARFWAADGPAMADLAAGRAFSPLPLNKTFRNASLELPFARPLPRLLALYDPDTSSDFGHVFLPNGTGPDLDTAADPAPTMFDNCIPLSETETYRLRWTLNASAGTVEIGLEAAVGSEYYMAFGWTDPKANSPAMIHADVVVAGFTEEGTPFAEDYYISDYTECTLGKEDSPVSGVCPDKAYEDGKNDSILVYGHRRDGVSFVRYVRKLDAEDAKYDVPVGATEEMAVLWSIGKLRPPDTMHPHYLPQNHGGPRDTTFGFARLNLSETVDNCLGPLDADNKEDQERIIADRKTPLVVTSAPAVRYPNPPNPDKVLYINKKEAPLLKVERGVPVKFSVQAGHDVALYITSDPIGGNATLRNKTEVIYAGGPDAHGVLATPKELVWLPDRNTPDLVYYQSLYDQKMGWKVQVVDGGLSDMYNNSVILDDQQVTLFWTLSTDYKSISIAARGEKKSGYLAIGFGSGMVNSFTYVAWVGNDGVGRVKTYWIDGKSATGIHPTSENITFVRCKSENGIITFEFTRPLNPSCTGKVECKNIIDPTTPLKVVWAMGASWSGDDLTDSNMHSVTSSRPIRVLLLRGSAEAEQDLRPVLAVHGFMMFVAWGILLPGGTMAARYLKSLKGDGWFQIHVYLQYSGISIMFLGVLFAAAELRGFFVSSVHVKFGVLALLLAVLQPLNAKFRPSKPANGEVPSRNRILWEYLHVITGRSAIIVGIVALFTGMKHLGHRYDSENVEELTWALMLWVLSVIVVVLCLEYKEVKRRISDRSARGHWVLGNTEEDDSVDLLHPDGTARNSESSAGVMEVQLEPLTR

SEQ ID NO: 3619 - DNA, 1881 bp, Sorghum bicolor
  misc_feature: Ceres ANNOT ID no. 6032043
  misc_feature: Encodes the peptide sequence at SEQ ID NO 3620
  misc_feature: Up-regulated in shoot tissues in response to methyl jasmonate treatment
atgcggacgccggcgatgctccggtgggccgcggcgctcgcggtcctgctcgccgtcgccgcgccggccgccgggttctacctccctggcgtcgccccgagcgatttcgccaagggtgatctgcttccagtgaaggtgaataagttgacatctatcaagactcaactcccgtacacatattactcccttccattctgcaagccagataccataatcgacagtgccgaaaatcttggtgaggttcttcgtggtgatcgcattgagaactctccttatgtgttcaaaatgggagagcccaagatgtgtcagattgtctgcaaagcgaagatcggtgagaaagaagccaaagagattctagacaacctcccgcttgttgttcctgttaaaaggcaagataagaacagtattgcttatcaaggtggatatcatgttggtcttaaaggcctgtattctggaactaaggatgagaaatacttcatccacaaccatttgtcatttgcggtgaagtatcacagggatgaaaattcaggactttctagaatagtgggatttgaggtcaacccacacagtgtcaagcatcaggttgatgataaatggaatggtgtagacactcgcttgagcacttgtgatcctcatgcgagcaaatttgtaacaaactctgataatcctcaggaagttgaaactgacaaggaaatcatattcacatatgatgttcattttgaggagagtgagatcaagtgggcatctcgatgggacacctacctgttgatgactgatgatcagattcactggttttctatcgtgaactctctcatgatcgtgcttttcctatctggcatggttgccatgataatgcttcgcaccctctacagagatatctctagatacaatcagcttgaaactcaagaagaagcacaagaggaaacaggctggaagcttgttcatggggatgtgttccgtcctccaacctactctgacttactctgtgtttatgttggcactggcgtccaattctttggcatgctcctagttacaatgatcttcgctgtgttgggtttcctttctccatcaaaccggggaggactgatgactgcaatgcttcttgtctgggttttgatggggctgcttgctggctattcttcttcacgcctctacaagatgttcaaaggttcagagtggaagaagattacactgcaaacggctttcctgtttcctggggttgcatttgttattttcttcatcttgaatgctcttatatggggggagaagtcatctggtgctgttcctttcaccacaatgtttgccttggtcctcctctggtttggcatctcagtaccccttgtctttgttgggagctatcttgggttcaagaaacctgccatggaagctccagtcaagacaaacaagattccacggcagatccctgagcaggcttggtacatgaatccgcttttcactattctgatcggtggggtccttccatttggagcagttttcattgaactcttcttcatcctcacctccatctggctgcaccagttctattacatctttggcttcctcttccttgtgtttgtgatccttatcatcacctgtgccgagatcacaattgtgctctgctatttccagctctgcagtgaggactacatgtggtggtggaggtcttaccttacctcaggatcctctgccctgtatctcttcctgtatgctgctttctacttcttcacgaaactgcagattactaagctggtgtctggcatcttgtacttcggctacatgcttctcgcctcctatgccttctttgtgctcactggcacaattggtttctgtgcctgcttctggttcactaggttgatttactcgtcagtgaagatcgattag

SEQ ID NO: 3620 - protein, 626 aa, Sorghum bicolor
  misc_feature: Ceres ANNOT ID no. 6032043
  misc_feature (56)..(584): Pfam Id: EMP70 Pfam Desc: Endomembrane protein 70
  misc_feature (1)..(626): NCBI GI: 115480625 NCBI Desc: os09g0557800 [oryza sativa (japonica cultivar-group)]
  misc_feature (1)..(626): NCBI GI: 115477743 NCBI Desc: os08g0554900 [oryza sativa (japonica cultivar-group)]
  misc_feature (238)..(626): NCBI GI: 115477747 NCBI Desc: os08g0555200 [oryza sativa (japonica cultivar-group)]
  misc_feature (26)..(626): NCBI GI: 92897792 NCBI Desc: nonaspanin (tm9sf) [medicago truncatula]
  misc_feature (13)..(626): NCBI GI: 51534986 NCBI Desc: endomembrane protein 70-like [oryza sativa (japonica cultivar-group)]
  misc_feature: Up-regulated in shoot tissues in response to methyl jasmonate treatment
MRTPAMLRWAAALAVLLAVAAPAAGFYLPGVAPSDFAKGDLLPVKVNKLTSIKTQLPYTYYSLPFCKPDTIIDSAENLGEVLRGDRIENSPYVFKMGEPKMCQIVCKAKIGEKEAKEILDNLPLVVPVKRQDKNSIAYQGGYHVGLKGLYSGTKDEKYFIHNHLSFAVKYHRDENSGLSRIVGFEVNPHSVKHQVDDKWNGVDTRLSTCDPHASKFVTNSDNPQEVETDKEIIFTYDVHFEESEIKWASRWDTYLLMTDDQIHWFSIVNSLMIVLFLSGMVAMIMLRTLYRDISRYNQLETQEEAQEETGWKLVHGDVFRPPTYSDLLCVYVGTGVQFFGMLLVTMIFAVLGFLSPSNRGGLMTAMLLVWVLMGLLAGYSSSRLYKMFKGSEWKKITLQTAFLFPGVAFVIFFILNALIWGEKSSGAVPFTTMFALVLLWFGISVPLVFVGSYLGFKKPAMEAPVKTNKIPRQIPEQAWYMNPLFTILIGGVLPFGAVFIELFFILTSIWLHQFYYIFGFLFLVFVILIITCAEITIVLCYFQLCSEDYMWWWRSYLTSGSSALYLFLYAAFYFFTKLQITKLVSGILYFGYMLLASYAFFVLTGTIGFCACFWFTRLIYSSVKID

SEQ ID NO: 3621 - DNA, 501 bp, Sorghum bicolor
  misc_feature: Ceres ANNOT ID no. 6032044
  misc_feature: Encodes the peptide sequence at SEQ ID NO 3622
atgtcgtggctcctggtcgtcgcggtgcttgccggcttcgcgcttggtccgtccgcgggcacggaccacatcgtgggcgccaaccatgggtggaaccccaacatcaactactccctctggtccggcaaccagaccttctacgtcggagacctcatctcgttccggtaccagaaggggacgcacaacgtgttcgaggtgaacgagacggggtacgacaactgcaccatggccggggtcgccggcaactggacctccggcaaggacttcatcccgctccccgaggcccgccgctactacttcatctgcggcaacggcttctgcctgcaaggcatgaaggtcgccatcaccgtccacccgctcccgcacaacgccacctccaagggctccagcacccgtgggggcaccggcgcacaggaagaggccgccgcggcggcgcttggggccaggagcgccgcgtggctggcgacgctcgcagtcgccgcagtgtctgctatctgctag

SEQ ID NO: 3622 - protein, 166 aa, Sorghum bicolor
  misc_feature: Ceres ANNOT ID no. 6032044
  misc_feature (31)..(111): Pfam Id: Cu_bind_like Pfam Desc: Plastocyanin-like domain
  misc_feature (4)..(165): NCBI GI: 38175738 NCBI Desc: blue copper-binding protein-like [oryza sativa (japonica cultivar-group)]
  misc_feature (4)..(132): NCBI GI: 92870326 NCBI Desc: blue (type 1) copper domain [medicago truncatula]
  misc_feature (4)..(157): NCBI GI: 119720812 NCBI Desc: lamin [brassica rapa]
  misc_feature (6)..(121): NCBI GI: 87240662 NCBI Desc: blue (type 1) copper domain [medicago truncatula]
  misc_feature (4)..(130): NCBI GI: 140040800 NCBI Desc: blue (type 1) copper domain [medicago truncatula]
MSWLLVVAVLAGFALGPSAGTDHIVGANHGWNPNINYSLWSGNQTFYVGDLISFRYQKGTHNVFEVNETGYDNCTMAGVAGNWTSGKDFIPLPEARRYYFICGNGFCLQGMKVAITVHPLPHNATSKGSSTRGGTGAQEEAAAAALGARSAAWLATLAVAAVSAIC

SEQ ID NO: 3623 - DNA, 2142 bp, Sorghum bicolor
  misc_feature: Ceres ANNOT ID no. 6032053
  misc_feature: Encodes the peptide sequence at SEQ ID NO 3624
atgtttgggtccagggtccaggatgaggtggagatgcagaggaggcctaataacaggatctttcctgatgagagacaaaatcaatctaagccattatatcaaactgcacgggccgacagatttggtgcaaatagaatggatctgaagaatcctgagaagcttaaggtgttaaatgaaggcaacaaaccgtggcaccagcgtattctagaccctgggagtaatattgtactgagatggaacagggtgtaccttgtggcatgtttgtttgctcttttcatagatccttttttctattaccttccattgattagaaaaaatggcaatgtatcttcatgtgttgccaaggaccagggactgagcataagaatcactgtcctacgatcacttgctgacttattttacatgttgaacatagcaatcaagtttcatactgcatatgtcgatccaaagtccagagtcctcggaaagggagagcttgttgtggatattaagaagattcaacgaagatatataagaactgatttctttgtagacatacttgcagccgtgccacttccacaggttactgtgtggttaattatgcctgcgatagaaagctcagattataacatccgaaacactacatttgctctcgtaattgtggttcagtatttcataagaatgtatctcatcatccctttaagcaatcagattatcaaagctgttggagtagttgcaaagtcagcttgggggggagcagcatacaatcttctgctctacatgcttgcaagccatattactggtgcaatatattaccttctctccgttgaacggcagattacatgctgggatcagcagtgcattgctgagtccaatgatacaaattgcaacttgagatttataagttgtgagaatagtggttctgatgattattctgtgtgggcaaaaaatacaagtatatttgccaactgtgatgccactaatcctaataatatatcatttaactacgggatgtttcttagtgcactgggaaaaggcgctgtctcatctccattccttgagaagtacttcttttgtctatggtggggcttgctgcagcttagttcaagcggaaatcctctcataacaagtgcatttatcacagagaacttatttgctatagctattggcgctatcagtctcatactctttgctcagttgattggcaagatgcagacatacctgcagtctatcagtaaaaggcttgaagagtggaggctgaggcaaagggacatggatgagtggatgagacaccatcaactcccatctcatcttcaagaacgtgtccgacggtttgttcaagttaaatggcttgctacaagaggagtggaagaagagtccatcttgcaagctttgcctgctgacatacgtcgggatgtgcagcgtcatctttgtttggaccttgttagacgtgtaccctttttctctgagatggatgaccaacttcttgatgctatctgtgagcggctggtgtctttcctgtgtcctgagaatacatacatctctcgcgagggtgatcctgtgaatgagatgctttttattatacgcgggaaactagagagctcaacaacaaatggtggccgtagcaacttcttcaactctatcatcctgcgccctggtgatttcgctggtgaagagctgctcacttgggccctacttccaaagaccaatgtccacttcccgctttcaacaaggactgtacggagcctcacagaggtggaagccttcgctctgcgagctgaagacctgaagttcgtcgcaaaccagttccgaaggcttcacagcaagaagctccagcacacattccggttctactcccatcactggaggacctgggctgcctgcttcatccaagctgcatggcggcagcaccagagaaggaagctggctgagagcctcagccgatgggagtcatactcatggtggtcagaggatcacccatctggtgataaacccagacaggagggcacctcaagtggcggcacaaggacgattgctgaaggtgccattgcccatatgcataagcttgcctctgcttccagaaggttccgcaccgaggacattgctattcgcagattgcagaagcctgatgaacctgatttctccgcagaccattttgattga

SEQ ID NO: 3624 - protein, 713 aa, Sorghum bicolor
  misc_feature: Ceres ANNOT ID no. 6032053
  misc_feature (498)..(598): Pfam Id: cNMP_binding Pfam Desc: Cyclic nucleotide-binding domain
  misc_feature (126)..(397): Pfam Id: Ion_trans Pfam Desc: Ion transport protein
  misc_feature (44)..(713): NCBI GI: 7269936 NCBI Desc: cyclic nucleotide and calmodulin-regulated ion channel-like protein [arabidopsis thaliana]
  misc_feature (394)..(710): NCBI GI: 115449143 NCBI Desc: os02g0789100 [oryza sativa (japonica cultivar-group)]
  misc_feature (116)..(661): NCBI GI: 91806544 NCBI Desc: cyclic nucleotide-regulated ion channel [arabidopsis thaliana]
  misc_feature (18)..(710): NCBI GI: 9758363 NCBI Desc: cyclic nucleotide and calmodulin-regulated ion channel [arabidopsis thaliana]
  misc_feature (68)..(710): NCBI GI: 92887759 NCBI Desc: cyclic nucleotide-binding; ion transport protein [medicago truncatula]
  misc_feature: The sequence is a functional homolog of SEQ ID NO. 503 in the 11/188,298 US application
MFGSRVQDEVEMQRRPNNRIFPDERQNQSKPLYQTARADRFGANRMDLKNPEKLKVLNEGNKPWHQRILDPGSNIVLRWNRVYLVACLFALFIDPFFYYLPLIRKNGNVSSCVAKDQGLSIRITVLRSLADLFYMLNIAIKFHTAYVDPKSRVLGKGELVVDIKKIQRRYIRTDFFVDILAAVPLPQVTVWLIMPAIESSDYNIRNTTFALVIVVQYFIRMYLIIPLSNQIIKAVGVVAKSAWGGAAYNLLLYMLASHITGAIYYLLSVERQITCWDQQCIAESNDTNCNLRFISCENSGSDDYSVWAKNTSIFANCDATNPNNISFNYGMFLSALGKGAVSSPFLEKYFFCLWWGLLQLSSSGNPLITSAFITENLFAIAIGAISLILFAQLIGKMQTYLQSISKRLEEWRLRQRDMDEWMRHHQLPSHLQERVRRFVQVKWLATRGVEEESILQALPADIRRDVQRHLCLDLVRRVPFFSEMDDQLLDAICERLVSFLCPENTYISREGDPVNEMLFIIRGKLESSTTNGGRSNFFNSIILRPGDFAGEELLTWALLPKTNVHFPLSTRTVRSLTEVEAFALRAEDLKFVANQFRRLHSKKLQHTFRFYSHHWRTWAACFIQAAWRQHQRRKLAESLSRWESYSWWSEDHPSGDKPRQEGTSSGGTRTIAEGAIAHMHKLASASRRFRTEDIAIRRLQKPDEPDFSADHFD

SEQ ID NO: 3625 - DNA, 2121 bp, Sorghum bicolor
  misc_feature: Ceres ANNOT ID no. 6032056
  misc_feature: Encodes the peptide sequence at SEQ ID NO 3626
atggactcggcgtcggcggcggcgctgaagccttcggcgctggacctgctggcggcgctgctgacggggcgggaggaccccgagggcggggcgcactgggccgagaaccgccacctcctgctgctgctcaccacctcgctcgccgtgctcgtcggctgcggcgtcgccctgctcgtccgccgctcctccgcgccccgcgccgccgcggcagcggcatcacaggcgccgccgcgctcgctcgccgcgaagcccaaggacgagccggaccccgacgacggcaggccgagggtcaccgtcttcttcggcacgcagaccggcaccgccgagggcttcgccaaggcactcgccgaagaggccaaggcgaggtacgacaaggccgtcttcaaggtggtcgatctggaagattacgccgccgaggatgaggaatacgaggagaagcttaagaaggaaagcatcgcattgttcttcctggcaacttatggtgatggagagccaactgacaatgcggcgaggttttataaatggttcgcagaggggaatgagagaggcgagtggttgaataatcttcggtttggggtgtttggccttggaaatagacagtacgaacactttaacaaggttggaaaggtggttgatcaactcctcgcggaacaaggtggcaaacgtatcgttcctgttggtcttggagatgatgatcaatgcattgaggatgactttaatgcatggaaggaacttctatggccagaattggataagttactccgccaggaagatgattcttcaactgcaccaactccttacacagttgctattccagaatatagagttgtgtttgtcaaaccagaggatgccatgcacattaacaagtcttttactctcagtaatggccatgctgtctatgacattcaacatccttgcagagcaaatgtggctgtgcggcgagagcttcatacaccagcttctgaccgatcctgcattcatttagagtttgatattactggaactggcctaaaatatgagacaggagatcatgttggtgtctatgctgaaaactgcatagaaactgttgaagaggcagaaaagctgctaggttattcaccagatactttattttctattcatgctgaccaagaggatggtaccccacattgtgggggttctttgccacctcctttcccgtccccttgcacagtgaggactgcgcttaccagacatgcagatctgttgaattcgcctaagaagagtgctttactggcgctggcggctcatgcatctgattctaaagaggctgagcggcttagacatctcgcgtctcctgctggaaagaaggagtattcacaatggatagtcacaagccaaagaagtctcttggaagttatgtcagagttcccatcagcaaagcccccactcggtgttttctttgcagctatttgtcctcgcctgcagccgagatattactcaatatcttcctcaccgagaatagcaccaacaaggattcatgtgacatgtgcactagtgtatgggccgacccctactggaagaattcacaaaggagtttgttctacatggatgaagcattccactcccttggaagagagccaagaatgtagctgggctccaatttttgttaggcagtcaaacttcaaactgcctgctgatcctactgtgcccattataatgattggccctgggactggtcttgcacctttcaggggcttcttacaggaacgactaggtttaaaagaggcaggggtggaactaggccatgctatcctcttctttgggtgcagaaatcggaagatggacttcatatatgaggatgagcttaataattttgttgatggtggtgtcctttctgagttgattatagccttttctcgtgagggtcctacaaaagagtatgttcagcacaaaatggcacagaaggctgccgagctctggagcatcatttctcagggaggttatatttatgtttgtggtgatgcaaaaggcatggccagagatgtccatcgcacactacataccatcgtccaggagcaggggtctatggacaactcgaagacagaaagctacgtgaagagcctgcagatggaagggagatacttgagagatgtttggtga

SEQ ID NO: 3626 - protein, 706 aa, Sorghum bicolor
  misc_feature: Ceres ANNOT ID no. 6032056
  misc_feature (298)..(523): Pfam Id: FAD_binding_1 Pfam Desc: FAD binding domain
  misc_feature (99)..(242): Pfam Id: Flavodoxin_1 Pfam Desc: Flavodoxin
  misc_feature (559)..(671): Pfam Id: NAD_binding_1 Pfam Desc: Oxidoreductase NAD-binding domain
  misc_feature (1)..(706): NCBI GI: 18103933 NCBI Desc: cytochrome p450 reductase [triticum aestivum]
  misc_feature (40)..(706): NCBI GI: 38345905 NCBI Desc: osjnba0060d06.20 [oryza sativa (japonica cultivar-group)]
  misc_feature (60)..(706): NCBI GI: 115475499 NCBI Desc: os08g0243500 [oryza sativa (japonica cultivar-group)]
  misc_feature (1)..(706): NCBI GI: 13183566 NCBI Desc: nadph-cytochrome p450 oxydoreductase isoform 3 [populus balsamifera subsp. trichocarpa x populus deltoides]
  misc_feature (8)..(706): NCBI GI: 2580499 NCBI Desc: nadph:ferrihemoprotein oxidoreductase [eschscholzia californica]
  misc_feature (6)..(706): SWISSPROT Homolog: EC 1.6.2.4 NADPH--cytochrome P450 reductase
MDSASAAALKPSALDLLAALLTGREDPEGGAHWAENRHLLLLLTTSLAVLVGCGVALLVRRSSAPRAAAAAASQAPPRSLAAKPKDEPDPDDGRPRVTVFFGTQTGTAEGFAKALAEEAKARYDKAVFKVVDLEDYAAEDEEYEEKLKKESIALFFLATYGDGEPTDNAARFYKWFAEGNERGEWLNNLRFGVFGLGNRQYEHFNKVGKVVDQLLAEQGGKRIVPVGLGDDDQCIEDDFNAWKELLWPELDKLLRQEDDSSTAPTPYTVAIPEYRVVFVKPEDAMHINKSFTLSNGHAVYDIQHPCRANVAVRRELHTPASDRSCIHLEFDITGTGLKYETGDHVGVYAENCIETVEEAEKLLGYSPDTLFSIHADQEDGTPHCGGSLPPPFPSPCTVRTALTRHADLLNSPKKSALLALAAHASDSKEAERLRHLASPAGKKEYSQWIVTSQRSLLEVMSEFPSAKPPLGVFFAAICPRLQPRYYSISSSPRIAPTRIHVTCALVYGPTPTGRIHKGVCSTWMKHSTPLEESQECSWAPIFVRQSNFKLPADPTVPIIMIGPGTGLAPFRGFLQERLGLKEAGVELGHAILFFGCRNRKMDFIYEDELNNFVDGGVLSELIIAFSREGPTKEYVQHKMAQKAAELWSIISQGGYIYVCGDAKGMARDVHRTLHTIVQEQGSMDNSKTESYVKSLQMEGRYLRDVW

SEQ ID NO: 3627 - DNA, 1479 bp, Sorghum bicolor
  misc_feature: Ceres ANNOT ID no. 6032065
  misc_feature: Encodes the peptide sequence at SEQ ID NO 3628
atggaggatggcatatctacttatactgtggatgaggcacttgtgtccatggggtttgggaaattccatgcattcgtgcttgcatactctggaatggctaaaatctctgaagcaatggagatgatgcttttgtcatttgttgggcaatcagttcaagctgagtgggggctttctgcacaggaagaaagtctcataacaagtgttgtcttcgtggggatgcttgtaggagcatatgcttggggcatagtttcggataactatggaagaagggttgggttcaacttcacggccattgttactggaggagctggtcttcttagcgctttcgccccaaattacttatctttgattgtactgagatttatggtcggtgttggactgggtggtgggccggttctaggttcttggttcctagagttcatccctgctcctaaccgaggaacttggatggttatgttctcagcattttggactgttggcactataatggaagcttctcttgcttgggccgttatgccagcttttggatggaggtggctgctggcactctcatcattgccatcatttgctctactgctcttctacccagtgacacttgagtcaccaagatacctatgcatgaagggtagaatatctgaagcagttcatgttttggaaacaatggcacgagtgaactgtgtttctctcccctctggtcgacttgtctctggccatcggatagaacttcctgatatcggggattcatcagaaacagcacaattggtgacatctaagaaaaataacactgctgatcatggtagcaaatctgagattggaggcttcactgccatcttaaagcttctatctccgaacttaatcagatcgactcttctactttggactgtctttcttggtcatgcctttttgtactatggtcttgttctgctaacatcagaattgaatcatggaaataggatctgtggatcagaagagggagcagaagtgacaacaacagcccatgtaaatgatgaaaatctctatagaaatgtattcataaccagctttggagaggttcctggtcttctcctgtctgctgccattgtcgacaagatcgggcgcaagctctcaatgtcttccatgctttacatcagctgcctgtgcatatctccgcttatgttcgcacagacagaatctctgacaactgtgtttttatttggtgcccgggtttgcatctcggcaagcttcactgttctgcacatctacgcccctgagatatacccaactgctgttagggccacgggtgtcgggtttgcaagctcaattgctcgctttggtgggatcctgtgcccccttgtggccgtcggtctggtgcacgcgtgccaccagatggcagctatcctgatattcatcacggtgatgctggcttcaggcatcgccgtgtcatacttccccttggaaacaagcggccgaaagctgagtgaccacgtcgccgccgcgtga

SEQ ID NO: 3628 - protein, 492 aa, Sorghum bicolor
  misc_feature: Ceres ANNOT ID no. 6032065
  misc_feature (29)..(443): Pfam Id: MFS_1 Pfam Desc: Major Facilitator Superfamily
  misc_feature (23)..(492): Pfam Id: Sugar_tr Pfam Desc: Sugar (and other) transporter
  misc_feature (2)..(487): NCBI GI: 90265074 NCBI Desc: h0702g05.6 [oryza sativa (indica cultivar-group)]
  misc_feature (1)..(491): NCBI GI: 92892063 NCBI Desc: major facilitator superfamily [medicago truncatula]
  misc_feature (1)..(492): NCBI GI: 28416475 NCBI Desc: at3g13050/mgh6_16 [arabidopsis thaliana]
  misc_feature (1)..(244): NCBI GI: 15795137 NCBI Desc: transporter-like protein [arabidopsis thaliana]
  misc_feature (34)..(487): NCBI GI: 38567900 NCBI Desc: osjnba0060n03.20 [oryza sativa (japonica cultivar-group)]
  misc_feature: The sequence is a functional homolog of SEQ ID NO. 296 in the 11/188,298 US application
  misc_feature: The sequence is a functional homolog of SEQ ID NO. 449 in the 11/188,298 US application
MEDGISTYTVDEALVSMGFGKFHAFVLAYSGMAKISEAMEMMLLSFVGQSVQAEWGLSAQEESLITSVVFVGMLVGAYAWGIVSDNYGRRVGFNFTAIVTGGAGLLSAFAPNYLSLIVLRFMVGVGLGGGPVLGSWFLEFIPAPNRGTWMVMFSAFWTVGTIMEASLAWAVMPAFGWRWLLALSSLPSFALLLFYPVTLESPRYLCMKGRISEAVHVLETMARVNCVSLPSGRLVSGHRIELPDIGDSSETAQLVTSKKNNTADHGSKSEIGGFTAILKLLSPNLIRSTLLLWTVFLGHAFLYYGLVLLTSELNHGNRICGSEEGAEVTTTAHVNDENLYRNVFITSFGEVPGLLLSAAIVDKIGRKLSMSSMLYISCLCISPLMFAQTESLTTVFLFGARVCISASFTVLHIYAPEIYPTAVRATGVGFASSIARFGGILCPLVAVGLVHACHQMAAILIFITVMLASGIAVSYFPLETSGRKLSDHVAAA

SEQ ID NO: 3629 - DNA, 1287 bp, Sorghum bicolor
  misc_feature: Ceres ANNOT ID no. 6032067
  misc_feature: Encodes the peptide sequence at SEQ ID NO 3630
atggcgctccgccgcatcaccccgcggaggagacccgttctccccgtcccccgtgccttcttctcctcgagccccccgttccctccgcccccgcctccggcgaacggcgaccccgacgccgcccattccccgtcctcctctccgccccccaaccccggcgcgccgcggaacccgtcgccctcgctcttccgggacatcaaagatcgcctccgcttgtctcccacgtcgcgcggcgctccttcttcgaaaccgtccgttcaagatgtccgccggttgctcggggagttccgcccaaccggcagcccgccgatccctccgtccccctccgctcccggagccgacccctccttcatggacctgctcaagaagaacagcgtcgcccagggcgccaacgctgggcagagggtgaccgacctcggtgccatccgagagagtctgaagcgctccccgccgcggacgccgcgtcgtccgccgacgccgtatttgactccgcagagcaacatcttcaacccggagctacagaggaacttgaaggctgtaggtgcggggaaggaagagaaggactctaccattgcccttttgaggcactacagccacgaagagcttggaaagaggctagctgagctccggccagcggttgcggccaaagacggtaaggagtggttctcgctcaaggagctgcaggggcggattgccaaactggcggagttggagaagcaggagaaccaggtttcggggtatcgtacagaaatcaagaattgccttgagctcctgaacaataaacaagaaaaaccgactctgtcagtaaacataccttcactgctgaaccttggcggtcagctgacactagactacatgaatcggcctccgcaggaggagttgttagagaagtacttccatccagatcatatgtcatctgaagagaagatgaaattggagctccaaagggtgagggatgagttcaagatgtctgagaatgactgtgggtctgcacgagttcaaattgcccaactgactctgaaaatcaagcatctgtcagctgttctccacaagaaggataaacattctagaaaagggcttcaggagatggtccaaaagaggaagaaatacctgaaatacttgcgaagaactgactgggactcgtactgtcttgttctgtcaaagctggggctccgcgacgtgcctgagtacaaagctcctgactacaagagcaaagcaaccaccaaggctaaatctaagaagagcaagagcaagagcaagggcaagaagagaaaggtgaaggcatag

SEQ ID NO: 3630 - protein, 428 aa, Sorghum bicolor
  misc_feature: Ceres ANNOT ID no. 6032067
  misc_feature (312)..(392): Pfam Id: Ribosomal_S15 Pfam Desc: Ribosomal protein S15
  misc_feature (25)..(428): NCBI GI: 51090583 NCBI Desc: ribosomal protein s15-like [oryza sativa (japonica cultivar-group)]
  misc_feature (1)..(428): NCBI GI: 52075654 NCBI Desc: ribosomal protein s15-like [oryza sativa (japonica cultivar-group)]
  misc_feature (313)..(393): NCBI GI: 81680380 NCBI Desc: 30s ribosomal protein s15
  misc_feature (313)..(393): NCBI GI: 81679126 NCBI Desc: 30s ribosomal protein s15
  misc_feature (315)..(392): NCBI GI: 121520831 NCBI Desc: ribosomal protein s15 [thermosipho melanesiensis bi429]
MALRRITPRRRPVLPVPRAFFSSSPPFPPPPPPANGDPDAAHSPSSSPPPNPGAPRNPSPSLFRDIKDRLRLSPTSRGAPSSKPSVQDVRRLLGEFRPTGSPPIPPSPSAPGADPSFMDLLKKNSVAQGANAGQRVTDLGAIRESLKRSPPRTPRRPPTPYLTPQSNIFNPELQRNLKAVGAGKEEKDSTIALLRHYSHEELGKRLAELRPAVAAKDGKEWFSLKELQGRIAKLAELEKQENQVSGYRTEIKNCLELLNNKQEKPTLSVNIPSLLNLGGQLTLDYMNRPPQEELLEKYFHPDHMSSEEKMKLELQRVRDEFKMSENDCGSARVQIAQLTLKIKHLSAVLHKKDKHSRKGLQEMVQKRKKYLKYLRRTDWDSYCLVLSKLGLRDVPEYKAPDYKSKATTKAKSKKSKSKSKGKKRKVKA

SEQ ID NO: 3631 - DNA, 1080 bp, Sorghum bicolor
  misc_feature: Ceres ANNOT ID no. 6032074
  misc_feature: Encodes the peptide sequence at SEQ ID NO 3632
atggacgcactttcttcaccagggacagcaatggtgccggtgaatggcgatacagccggacctagctccagccaggatgactcagcagtcaccacgaagaagcgcaacaggcctcagtatcatccgtttactcagcaacagctcccagcttgcaagcctatacttgcgcctcagacagttattcctgtacttctgtttgtgggcatagtttttatcctgattggcctgggttgcattgcagcctcaaatagggttgttgaagtggtctatcaatatgaaacttcatgcataccaagatacatgcttgacaacaaagttgcatatatccaaaatccatctatagataagacctgcacaagaattctcaaggttcctaaggatatgaagcatccaatctacatatattatcaacttgataacttctaccagaaccacagaaggtatgtgacgagccgtaacgacaagcagctgataaatcctaaggaggccaacaacacgcagtactgcaagcctgaagccactgagcatgggagccccgtcgtcccctgcggactcatagcttggagcctgttcaacgacacctacagcttcgcccgtggcaacaaggcgctgagggttcacaagcgaggcatttcatggaggagcgaaagggagcacctttttgggaagcaggtgtttccgaggaattttcagaaaggggctctcatcggcggcggtacgcttgatccaaggatacctctgagcaagcaagaagacttgatcgtgtggatgcgaaccgcggcgctgccgacgttccggaagctgtacggcaggatccaggtggacctccgtgccggcgagctgataacggtgacgatgcagaacaactacaacacgtacagcttcggcgggaagaaggcggtggtgctgtccacggccggcgtgctgggaggcaagaacagcttcctcggccgcgggtacgtcatcgtcggcctggcctgcctcctgctggcgctgctcctcaccatgctctgcctcgtcttcccactgaaagaggagcatcttgcgctgcagtaccctttgccccggcctgcacggtga

SEQ ID NO: 3632 - protein, 359 aa, Sorghum bicolor
  misc_feature: Ceres ANNOT ID no. 6032074
  misc_feature (78)..(349): Pfam Id: CDC50 Pfam Desc: LEM3 (ligand-effect modulator 3) family / CDC50 family
  misc_feature (11)..(359): NCBI GI: 52077047 NCBI Desc: lem3 (ligand-effect modulator 3)-like [oryza sativa (japonica cultivar-group)]
  misc_feature (15)..(344): NCBI GI: 49388971 NCBI Desc: lem3 (ligand-effect modulator 3)-like [oryza sativa (japonica cultivar-group)]
  misc_feature (14)..(344): NCBI GI: 52076505 NCBI Desc: lem3-like [oryza sativa (japonica cultivar-group)]
  misc_feature (43)..(342): NCBI GI: 42562089 NCBI Desc: lem3 (ligand-effect modulator 3) family protein / cdc50 family protein [arabidopsis thaliana]
  misc_feature (43)..(342): NCBI GI: 4835763 NCBI Desc: t8k14.13 [arabidopsis thaliana]
  misc_feature: Useful for making plants with modulated nitrogen use efficiency
  misc_feature: Functional homolog of the protein sequence given in SEQ ID NO 13263
  misc_feature: Useful for making plants with modulated nitrogen use efficiency
  misc_feature: Functional homolog of the protein sequence given in SEQ ID NO 13263
MDALSSPGTAMVPVNGDTAGPSSSQDDSAVTTKKRNRPQYHPFTQQQLPACKPILAPQTVIPVLLFVGIVFILIGLGCIAASNRVVEVVYQYETSCIPRYMLDNKVAYIQNPSIDKTCTRILKVPKDMKHPIYIYYQLDNFYQNHRRYVTSRNDKQLINPKEANNTQYCKPEATEHGSPVVPCGLIAWSLFNDTYSFARGNKALRVHKRGISWRSEREHLFGKQVFPRNFQKGALIGGGTLDPRIPLSKQEDLIVWMRTAALPTFRKLYGRIQVDLRAGELITVTMQNNYNTYSFGGKKAVVLSTAGVLGGKNSFLGRGYVIVGLACLLLALLLTMLCLVFPLKEEHLALQYPLPRPAR

SEQ ID NO: 3633 - DNA, 978 bp, Sorghum bicolor
  misc_feature: Ceres ANNOT ID no. 6032076
  misc_feature: Encodes the peptide sequence at SEQ ID NO 3634
atggagagggccgcctcgttcctctcctcgctcctcggcgtcgccggcggcgattccggggcaccggcggcaacggtgaagtccgtcctcgtgtaccccatcaagtcctgcagggggatctccgtggcccaagccccaatcaccgccacggggttcaggtgggatcgccagtggatgctcgtcaactccaaagggagagcgtacacgcagagggtggagcccaagcttgctctggttgaggtccagatgccgccggaggcctttgccgaggactggcagcccacgccggacgaccacatggttatcagagcacctggaatggaaccgttgaagatccctctttgtgtggaatgcgccacaatcaatgatgtttctgtgtgggagtgggctggctctgcgtatgatgaaggagctgaagcagccgaatggttttccacttttttggggtgcccaactcgactggtgcgctttaacgaagactcagaaactaggctgactgaccctaattatgcacggggttacaaaaccatgttttctgatggcttcccttatctgatagtctctcagggctcattggatgcactaaatgagatactcaaagagcctataccaattaaccgcttcagaccaaatattttagtggaggggtgccacccatatgcagaggatatgtggaaatcagtaaagataaacaagttaacatttcaaggcgtgaagttatgtggccgttgcaaggtgcctacaattaatcaagacactggaatacctagccctgctgaaccaactgaaactttgcagacatatcggtctggtgaagtgctgcttcctagccacaaaaacaaacggcaggtgtactttgggcaaaatgcggtctgcagtgaatccctgtcactgaatagcaaaggaaggatcgtcaaggtcggtgatccactttatgttacacagtcgttctcttcgtctgatgaagtgccagcctga

SEQ ID NO: 3634 - protein, 325 aa, Sorghum bicolor
  misc_feature: Ceres ANNOT ID no. 6032076
  misc_feature (23)..(151): Pfam Id: MOSC_N Pfam Desc: MOSC N-terminal beta barrel domain
  misc_feature (162)..(313): Pfam Id: MOSC Pfam Desc: MOSC domain
  misc_feature (1)..(325): NCBI GI: 52077048 NCBI Desc: molybdenum cofactor sulfurase protein -like [oryza sativa (japonica cultivar-group)]
  misc_feature (1)..(325): NCBI GI: 112031429 NCBI Desc: molybdenum cofactor sulfurase-like protein 1 [oryza sativa (japonica cultivar-group)]
  misc_feature (15)..(325): NCBI GI: 52077049 NCBI Desc: molybdenum cofactor sulfurase protein -like [oryza sativa (japonica cultivar-group)]
  misc_feature (26)..(249): NCBI GI: 42573573 NCBI Desc: molybdenum cofactor sulfurase family protein [arabidopsis thaliana]
  misc_feature (21)..(291): NCBI GI: 118038160 NCBI Desc: mosc-like beta barrel [burkholderia phytofirmans psjn]
MERAASFLSSLLGVAGGDSGAPAATVKSVLVYPIKSCRGISVAQAPITATGFRWDRQWMLVNSKGRAYTQRVEPKLALVEVQMPPEAFAEDWQPTPDDHMVIRAPGMEPLKIPLCVECATINDVSVWEWAGSAYDEGAEAAEWFSTFLGCPTRLVRFNEDSETRLTDPNYARGYKTMFSDGFPYLIVSQGSLDALNEILKEPIPINRFRPNILVEGCHPYAEDMWKSVKINKLTFQGVKLCGRCKVPTINQDTGIPSPAEPTETLQTYRSGEVLLPSHKNKRQVYFGQNAVCSESLSLNSKGRIVKVGDPLYVTQSFSSSDEVPA

SEQ ID NO: 3635 - DNA, 981 bp, Sorghum bicolor
  misc_feature: Ceres ANNOT ID no. 6032077
  misc_feature: Encodes the peptide sequence at SEQ ID NO 3636
atggccatggagaaggccgcctccttcctctcctccctcctaggcggcggcggcggtggaggcggggagccggcggcgacagtcaagtctattttcatataccccatcaagtcctgcaggggtctcgccgtgccacaggcgcccatcgcctccactgggttccggtgggatcggcagtgggtggtggtgaacgccaaagggagagcatacacccagcgggtggagcccaagctcgcccttgtccaggtggagctgccgccggaggccttcgacgaggactggcagcccacgcccgacgaccacatggctatcagagcacctggaatggacacattgaagatacctctagcagcggaacacgccacaatcgatgacgtctctgtgtgggagtggtctggctctgcctatgatgaaggcgctgaagcagccgaatggttctccacttactttgggaagccaagtcgactagtgcgcttcaaagaagcatcggaaactagaccaaccgatccagatttcgcccaaggttacaagattgcattcaacgattgcttcccatttctgatagcctctcagggttcactggatgcactaaatgagattcttaaggaacctgtaccaatgaaccgcttcagaccaaatattttagtcgatggatgccacccatactcagaggacctgtggaaaaccataaagataaacaacctaacattcctaggtgtgaagttatgcaaccgttgcaaggtgccaaccattaatcaagagaatggaatacctggcactgaaccaactgaaactctactgacattccggtctgaccaagtgcttcgtccaagccacaaaaataaacgacaggtgtactttgggcagaatttagtctgcaaggaatctctatcaggaaagggcaaaggaaagatcatcaaggttggcgatccagtttatgttctgcaagcgttcgcttcttctgatgaagccccagcctga

SEQ ID NO: 3636 - protein, 326 aa, Sorghum bicolor
  misc_feature: Ceres ANNOT ID no. 6032077
  misc_feature (25)..(153): Pfam Id: MOSC_N Pfam Desc: MOSC N-terminal beta barrel domain
  misc_feature (166)..(314): Pfam Id: MOSC Pfam Desc: MOSC domain
  misc_feature (3)..(326): NCBI GI: 52077048 NCBI Desc: molybdenum cofactor sulfurase protein -like [oryza sativa (japonica cultivar-group)]
  misc_feature (3)..(326): NCBI GI: 112031429 NCBI Desc: molybdenum cofactor sulfurase-like protein 1 [oryza sativa (japonica cultivar-group)]
  misc_feature (15)..(326): NCBI GI: 52077049 NCBI Desc: molybdenum cofactor sulfurase protein -like [oryza sativa (japonica cultivar-group)]
  misc_feature (23)..(251): NCBI GI: 42573573 NCBI Desc: molybdenum cofactor sulfurase family protein [arabidopsis thaliana]
  misc_feature (27)..(312): NCBI GI: 118038160 NCBI Desc: mosc-like beta barrel [burkholderia phytofirmans psjn]
MAMEKAASFLSSLLGGGGGGGGEPAATVKSIFIYPIKSCRGLAVPQAPIASTGFRWDRQWVVVNAKGRAYTQRVEPKLALVQVELPPEAFDEDWQPTPDDHMAIRAPGMDTLKIPLAAEHATIDDVSVWEWSGSAYDEGAEAAEWFSTYFGKPSRLVRFKEASETRPTDPDFAQGYKIAFNDCFPFLIASQGSLDALNEILKEPVPMNRFRPNILVDGCHPYSEDLWKTIKINNLTFLGVKLCNRCKVPTINQENGIPGTEPTETLLTFRSDQVLRPSHKNKRQVYFGQNLVCKESLSGKGKGKIIKVGDPVYVLQAFASSDEAPA

SEQ ID NO: 3637 - DNA, 1065 bp, Sorghum bicolor
  misc_feature: Ceres ANNOT ID no. 6032079
  misc_feature: Encodes the peptide sequence at SEQ ID NO 3638
atggggaagaagaagaagcgcgtcgacaaggtcttctgctactactgcgaccgcgagttcgacgacgagaagatcctcgtccagcaccagaaggccaagcacttcaagtgccacgtctgccacaagaagctctccaccgcctcgggcatgtccatacacgtcctccaggtccacaaggagtccgtgaccaaggttcctaatgcaaagcctgatagggagtcaacggagatagagatatttggaatgcagggaattcctgcacatgtattggctgcccattatggagaagaggaagatccttcagcaaagatggccaaagtagaagtgccacaggtaaggcctgttattatgcctaattcgctaggcatggcatttcctccgcgaccagcttatggtgtagcacctccaatctataatcctgcacttaatcctttgatggcccgtcctccaatttggcctggtccaccagcacaagcttggtatccacaacaagcagcatatccacaacaaccagcagtttcagttcctccagtagttgctgggctcccaccacaacaaccactatttcctattcagaatgtgcctactcctatgacatcagcacctgctaatgtacttcaaacatcgtttcctatggcccctccaggagtaccgtcacctgttgctcctcaggtttcccagcctttgtttcctgttaacacttcagctgtcaatggagctgcaagttccccatttttagcatctgtggtacctggaaccatcccggcaagttctccagcagcagttggtgctgcaggaattggatatggagctaacaaccaaggcactggaggtccagcagttggatcctcacctgcagtgtccaacaataaggcgtccggtgcccaaccagctacgaatgaggtctatctggtgtgggatgatgaagcaatgtcaatggaggaaagaaggttggcgttacccaagtatcaggtgcatgatgaaactagccagatgaactctgttgacgcagcaattgatcgaagaatatcagagagtcggctggcaggacgcatggccctatga

SEQ ID NO: 3638 - protein, 354 aa, Sorghum bicolor
  misc_feature: Ceres ANNOT ID no. 6032079
  misc_feature (1)..(334): NCBI GI: 52077050 NCBI Desc: zinc finger protein -like [oryza sativa (japonica cultivar-group)]
  misc_feature (1)..(353): NCBI GI: 14517410 NCBI Desc: at1g30970/f17f8_14 [arabidopsis thaliana]
  misc_feature (1)..(332): NCBI GI: 9755379 NCBI Desc: f17f8.14 [arabidopsis thaliana]
  misc_feature (65)..(353): NCBI GI: 145324090 NCBI Desc: suf4 (suppressor of frigida4) [arabidopsis thaliana]
  misc_feature (1)..(86): NCBI GI: 89269088 NCBI Desc: zinc finger protein 207 [xenopus tropicalis]
MGKKKKRVDKVFCYYCDREFDDEKILVQHQKAKHFKCHVCHKKLSTASGMSIHVLQVHKESVTKVPNAKPDRESTEIEIFGMQGIPAHVLAAHYGEEEDPSAKMAKVEVPQVRPVIMPNSLGMAFPPRPAYGVAPPIYNPALNPLMARPPIWPGPPAQAWYPQQAAYPQQPAVSVPPVVAGLPPQQPLFPIQNVPTPMTSAPANVLQTSFPMAPPGVPSPVAPQVSQPLFPVNTSAVNGAASSPFLASVVPGTIPASSPAAVGAAGIGYGANNQGTGGPAVGSSPAVSNNKASGAQPATNEVYLVWDDEAMSMEERRLALPKYQVHDETSQMNSVDAAIDRRISESRLAGRMAL

SEQ ID NO: 3639 - DNA, 879 bp, Sorghum bicolor
  misc_feature: Ceres ANNOT ID no. 6032084
  misc_feature: Encodes the peptide sequence at SEQ ID NO 3640
atgggttcgcccgggtccgccaatggcagacgcggcgagtacgtgaggatcccggaggaggtggaggtggcgtccaagggggagggggatgccgcggcggccgtcaaggcggccgcggcggcggagtgcccgagggtgctgcggtgccgcgcgatccggtggtgggccaaggtcgccgtgctcgggatcttccttgcaggggccggagctgctgcggtcgtcttcctcggcccgctccttatcaagaaggttgtttcacctattctttactgggaatcaacaactttcagcagaccagctattgctctaatatgttttggcgcaatcgctttattcccaagtgttttgttaccttcttcacccttcatgtggcttgcggggatgacttttggatatctttatggctttttgataatcacagtggggatgagcataggcatgtcattgccgtatttcataggctccgcattccacagtaggatacatagatggttggagaagtggccaaagaaagcagcttttgtaaggcttgctggcgaaggagattggcatcatcaatttaaggctgttgcattactaaggatttctccatttccatatatagtttttaattatgcttctgtggctacgaatgtcaaatattacccatacatagcgggttctatggctggaaccatacatgaaacttttcttgcaatatacagtgggaaacttctacaaagcttggctgtagcaactagccatgggtccttcttgtcgttggatcagattatctacaatggaatcggctttacaattgctgcagcttccactgctgcgatcactatttatgcaaagaaagcacttcaaaagctccaagcggaggacgagatattttga

SEQ ID NO: 3640 - protein, 292 aa, Sorghum bicolor
  misc_feature: Ceres ANNOT ID no. 6032084
  misc_feature (117)..(238): Pfam Id: SNARE_assoc Pfam Desc: SNARE associated Golgi protein
  misc_feature (12)..(286): NCBI GI: 124359825 NCBI Desc: f5o11.19, related [medicago truncatula]
  misc_feature (11)..(282): NCBI GI: 92892046 NCBI Desc: at1g12450-related [medicago truncatula]
  misc_feature (58)..(235): NCBI GI: 8778630 NCBI Desc: f5o11.19 [arabidopsis thaliana]
  misc_feature (63)..(291): NCBI GI: 75908987 NCBI Desc: deda [anabaena variabilis atcc 29413]
  misc_feature (88)..(288): NCBI GI: 53688163 NCBI Desc: cog0398: uncharacterized conserved protein [nostoc punctiforme pcc 73102]
MGSPGSANGRRGEYVRIPEEVEVASKGEGDAAAAVKAAAAAECPRVLRCRAIRWWAKVAVLGIFLAGAGAAAVVFLGPLLIKKVVSPILYWESTTFSRPAIALICFGAIALFPSVLLPSSPFMWLAGMTFGYLYGFLIITVGMSIGMSLPYFIGSAFHSRIHRWLEKWPKKAAFVRLAGEGDWHHQFKAVALLRISPFPYIVFNYASVATNVKYYPYIAGSMAGTIHETFLAIYSGKLLQSLAVATSHGSFLSLDQIIYNGIGFTIAAASTAAITIYAKKALQKLQAEDEIF

SEQ ID NO: 3641 - DNA, 816 bp, Sorghum bicolor
  misc_feature: Ceres ANNOT ID no. 6032085
  misc_feature: Encodes the peptide sequence at SEQ ID NO 3642
atggcggcggagggggagggaaagaacccggcgggcggtggcggaggggataacccccagcaccagcaggcagtgcaggctgccccggcgccggcggcacagggggaagcggcgcaggaggctggaggacaggggacgggactggagccggagggggagaaagcggatcgagagggggagggcggcggcgccggggagaaggacgacgccgcgtgcagagatctggtcctcgtcgaggatccggaggtggtcgccgtcgaggatccggaggaagctgcagcaaccgcagcacttcaggaagaaatgaaagcgcttgtggcatcaatccctgatggtgctggggcagcattcacagccatgcagcttcaggagctagagcagcagtcccgggtgtatcagtacatggctgcccgagtacctgtgcctactcacctcgtcttccctgtatggaagagtgtaaccggtgcatcctctgaaggcgcccagaagtaccctactttgatgggcttagcaacactctgcttggactttgggaagaacccagaaccagaaccagggaggtgtcggcgaacagatggtaaaaaatggcgatgttggagaagcactatcccaaatgagaaatactgtgaacgtcatatgcaccgtggtcgcaagcgtcctgtacaggttgtcgttgaggacgacgagccagattctgcttcagggtcaaaatccactcctggcaaggctaccgatggtgccaagaaggctgacgacaagagcccaagtagcaagaagcttgcagtggcagcaccagctgctgtgcagtctacataa

SEQ ID NO: 3642 - protein, 271 aa, Sorghum bicolor
  misc_feature: Ceres ANNOT ID no. 6032085
  misc_feature (182)..(227): Pfam Id: WRC Pfam Desc: WRC
  misc_feature (115)..(151): Pfam Id: QLQ Pfam Desc: QLQ
  misc_feature (115)..(219): NCBI GI: 51039853 NCBI Desc: tpa: growth-regulating factor 12 [oryza sativa (japonica cultivar-group)]
  misc_feature (116)..(261): NCBI GI: 51039849 NCBI Desc: tpa: growth-regulating factor 10 [oryza sativa (japonica cultivar-group)]
  misc_feature (112)..(265): NCBI GI: 6573149 NCBI Desc: growth-regulating factor 1 [oryza sativa]
  misc_feature (89)..(243): NCBI GI: 38345778 NCBI Desc: osjnba0083n12.16 [oryza sativa (japonica cultivar-group)]
  misc_feature (89)..(243): NCBI GI: 115460326 NCBI Desc: os04g0600900 [oryza sativa (japonica cultivar-group)]
  misc_feature: The sequence is a functional homolog of SEQ ID NO 1781 in the 10/374,780US patent application
  misc_feature: The sequence is a functional homolog of SEQ ID NO 452 in the 11/435,388US patent application
  misc_feature: Useful for making plants with modulated growth and phenotype characteristics
  misc_feature: The sequence is a functional homolog of SEQ ID NO 1781 in the 20060162006 US patent application
  misc_feature: The sequence is a functional homolog of SEQ ID NO 452 in the 20060272060 US patent application
MAAEGEGKNPAGGGGGDNPQHQQAVQAAPAPAAQGEAAQEAGGQGTGLEPEGEKADREGEGGGAGEKDDAACRDLVLVEDPEVVAVEDPEEAAATAALQEEMKALVASIPDGAGAAFTAMQLQELEQQSRVYQYMAARVPVPTHLVFPVWKSVTGASSEGAQKYPTLMGLATLCLDFGKNPEPEPGRCRRTDGKKWRCWRSTIPNEKYCERHMHRGRKRPVQVVVEDDEPDSASGSKSTPGKATDGAKKADDKSPSSKKLAVAAPAAVQST

SEQ ID NO: 3643 - DNA, 1194 bp, Sorghum bicolor
  misc_feature: Ceres ANNOT ID no. 6032099
  misc_feature: Encodes the peptide sequence at SEQ ID NO 3644
atggccgccgccccagcagcagccggaggccttgtgcgcctccgtcctccgcctccgcgatgcgtgtcgcctcgcgccagcgcctcccgcgcgccgcgcatctgggggacgccgccccggcttcgccttcgccgccgccgggccctggcgctcgcggcgccgtcggtagcggccgcggaggcggaggcgtacacggaaccggagctggtgttgctcgaggccctcctcggcgtccagggccgcggccgcgccgtcgaagtggagagcgccgtgcaggctctcgaggcccagggaggcgttcctgatccgacgagttcaagtttaatcgaaggtagctggcagctcatcttcactacgagaccagggacagcatcacccattcagaggacatttgttggagttgactccttccgtatcttccaggaagtttatcttcgaacagatgatccaagggtggtcaatgttgtcaggttttcagaatcagttggtgatctcaaagtagaggcagaagcaactattaaggatggaaatcgcatacttttccgttttgaccgagcagcattcaccttcaagtttctgccatttaaagtcccgtacccagtgccatttagacttcttggagatgaagctaagggttggcttgacacaacatacttatcccacactgggaacatacgtatttcaaggggaaacaagggaaccacttttgtcctacagaagagtgcagacccaagacaaatcttattgtcaactatatctgcaaaaacaggagtagaagaggtcatcaatgattttatttcaagccaaaatggaacaaagactgatctaagcattctggtgggtgaatggcaactattgtggagctcacagactgaaggtgaaagttggtcatctgttgcatctgccggtctcaaggacttccagattataaaagaagacgggaaattaaagaattcagctagccccttcccaggtctcaccctcaatgcaacaggcaacatatgcaaaaaagggagtggcaacacctttaccgtgtccatgaaagaaggagctgttcaagttggtggtttacagtttcccttggatgctcaaggagattttgtcatggaaatcttgtatatcgacaacaagataaggatatccaagcttaaccagcgcgtgcttgtccacttacgcattgcaaatacaacatga

SEQ ID NO: 3644 - protein, 397 aa, Sorghum bicolor
  misc_feature: Ceres ANNOT ID no. 6032099
  misc_feature (65)..(239): Pfam Id: PAP_fibrillin Pfam Desc: PAP_fibrillin
  misc_feature (2)..(397): NCBI GI: 115472009 NCBI Desc: os07g0470700 [oryza sativa (japonica cultivar-group)]
  misc_feature (3)..(390): NCBI GI: 50508347 NCBI Desc: plastid-lipid associated protein pap/fibrillin family-like [oryza sativa (japonica cultivar-group)]
  misc_feature (66)..(392): NCBI GI: 92873058 NCBI Desc: pap fibrillin [medicago truncatula]
  misc_feature (75)..(241): NCBI GI: 88175342 NCBI Desc: fibrillin 5 [coffea canephora]
  misc_feature (20)..(247): NCBI GI: 115458376 NCBI Desc: os04g0422000 [oryza sativa (japonica cultivar-group)]
MAAAPAAAGGLVRLRPPPPRCVSPRASASRAPRIWGTPPRLRLRRRRALALAAPSVAAAEAEAYTEPELVLLEALLGVQGRGRAVEVESAVQALEAQGGVPDPTSSSLIEGSWQLIFTTRPGTASPIQRTFVGVDSFRIFQEVYLRTDDPRVVNVVRFSESVGDLKVEAEATIKDGNRILFRFDRAAFTFKFLPFKVPYPVPFRLLGDEAKGWLDTTYLSHTGNIRISRGNKGTTFVLQKSADPRQILLSTISAKTGVEEVINDFISSQNGTKTDLSILVGEWQLLWSSQTEGESWSSVASAGLKDFQIIKEDGKLKNSASPFPGLTLNATGNICKKGSGNTFTVSMKEGAVQVGGLQFPLDAQGDFVMEILYIDNKIRISKLNQRVLVHLRIANTT

SEQ ID NO: 3645 - DNA, 822 bp, Sorghum bicolor
  misc_feature: Ceres ANNOT ID no. 6032100
  misc_feature: Encodes the peptide sequence at SEQ ID NO 3646
atgaacagcatcaagtcggctctcttctccggccaccgctcgcaccccctcgcagcggccgcggcggtctcgcagcagcagcttgggggcgccgcgccgttccactcgacacccgttctgcagcggaagcgcaagacccagtggcacaataggttcaactattatacgagacgtaggaagaacagagaaactaaaaggtcaatgctacggaacatgtcagagtatgcagaatatctcttccagagttggcgtgatgaagatgagaaaaatgatgcatctagtggcccttcatggtttagaggacatcgttgggtcaggaattcaaacaacggtttccgtacacatgatttttattctgggaatttcagaagcaaaggaggatttgatttttgcacaagtgatgaggatgaaccagagaatctgtttcgtaatgttttccaagaccagcacacatattattggtctttttcatctgataattatcagaggaacttcagacgtgctcgctcagaaaaatccagaaactggagttctgaaacagacgaggaggatgaggtaccagctccatcagaggtatctttggcacggcaaactcttggattgagaacttctggtccgctaaaacttgaagatgttaaaagcgcataccgagcatgcgcacttagatggcatccagatcgccacaatgggtcatctaaggtattgatccaatccaaacattcaaagtttatctttcacttgctttgcaaaattatgtgtcacttttctctttctctgaataatgtgctgttaatctttgacataagtcctcagcatacatga

SEQ ID NO: 3646 - protein, 273 aa, Sorghum bicolor
  misc_feature: Ceres ANNOT ID no. 6032100
  misc_feature (4)..(215): NCBI GI: 22093656 NCBI Desc: dnaj protein family-like protein [oryza sativa (japonica cultivar-group)]
  misc_feature (138)..(252): NCBI GI: 38345831 NCBI Desc: osjnba0070m12.14 [oryza sativa (japonica cultivar-group)]
  misc_feature (130)..(252): NCBI GI: 92876008 NCBI Desc: heat shock protein dnaj, n-terminal [medicago truncatula]
MNSIKSALFSGHRSHPLAAAAAVSQQQLGGAAPFHSTPVLQRKRKTQWHNRFNYYTRRRKNRETKRSMLRNMSEYAEYLFQSWRDEDEKNDASSGPSWFRGHRWVRNSNNGFRTHDFYSGNFRSKGGFDFCTSDEDEPENLFRNVFQDQHTYYWSFSSDNYQRNFRRARSEKSRNWSSETDEEDEVPAPSEVSLARQTLGLRTSGPLKLEDVKSAYRACALRWHPDRHNGSSKVLIQSKHSKFIFHLLCKIMCHFSLSLNNVLLIFDISPQHT

SEQ ID NO: 3647 - DNA, 1470 bp, Sorghum bicolor
  misc_feature: Ceres ANNOT ID no. 6032102
  misc_feature: Encodes the peptide sequence at SEQ ID NO 3648
  misc_feature: Down-regulated in shoot tissues in response to salicylic acid treatment
atggaggcgctcctcaagtgggcggccgagctgggcgtctccgactcgccgtcgccgtcgccgtcgctcccttcctcgtcgccctctggaaccaccacctcctcttcgccgtcctgcctcggccgctccctcgtcgtcgccgacttccccaacgccggcgggaggggcctcgcggcggcgcgcgacctgcggcgcggcgagctggtgttacgcgcgccccgcgccgcgctgctcacaagcgaccgcgtcacggccgacgaccccaggatcgccgcctgcgtcagcgcccacaggccccgcctctcctctgtgcagatactcatagtgtgcttattggctgaagtggggaaagggagaaattctgtctggtacccctacctgtctcagctacccagctactacactatcttggctacctttgacgattttgaagtcgaagctcttcaagttgatgatgccatttgggttgcacaaaaggctaaaagtgccataaaatcagactgggaagatgtgacaccactcatgaaagaattggaatttaaacctaagcttttgatgtttaaatcctggctctgggcatttgcaacggtatcttctcgcacattgcatattgcatgggatgaagctggttgcttatgccctgtgggtgatttgttcaattatgctgctcctgatgatgatacttcattggaggcagaggatacagctgaacttacgaattaccagcagaaaaatgagatgatcaattcatctgagagattaacagatggtggatacgaagattctaatgcatactgtttgtatgcaaggaaaaattataaacagggagagcaggtcctcctaggttatggaacatacacaaacctggaacttcttgaacactatggctttcttttgggcgagaaccctaatgagaaaactttcatcgagttagatttggatatttgctcaggcggaacctggccaaaagattcgatgtatattcattcaaacggacacccttcatttgcactgttatgtgcattaaggctttggtcaactcccacaaaccatagaaaggctgtcggtcatcagatttactctggatcaatgctttcgactgaaaacgagatggggattatgaaatggttaatcagcagatgtgaaggaactttgcaacaattacctacgacggtagagtttgatgagagtctgcttgtctttttacgcacaatacagaacagtagcaactgcagaacagatgtgaagcagtcaggttttgagcaggagttttctgtgttcctccggttccatcgagtggagctggattgttctggttataatcagctccctgttcgacttctgagatctctggaaagatgggaactagctgtccagtggagatgcaactacaagaagactctgaagaaatgtatttcgtactgtgaaagtttagtcaacgagcttcccttgcaactaaaccagcaataa

SEQ ID NO: 3648 - protein, 489 aa, Sorghum bicolor
  misc_feature: Ceres ANNOT ID no. 6032102
  misc_feature (34)..(290): Pfam Id: SET Pfam Desc: SET domain
  misc_feature (1)..(489): NCBI GI: 50510036 NCBI Desc: set-domain transcriptional regulator family-like protein [oryza sativa (japonica cultivar-group)]
  misc_feature (53)..(313): NCBI GI: 22202682 NCBI Desc: p0471b04.24 [oryza sativa (japonica cultivar-group)]
  misc_feature (41)..(312): NCBI GI: 28422727 NCBI Desc: mgc53706 protein [xenopus laevis]
  misc_feature (54)..(317): NCBI GI: 12804091 NCBI Desc: chromosome 21 open reading frame 18, isoform c [homo sapiens]
  misc_feature (54)..(313): NCBI GI: 22328112 NCBI Desc: chromosome 21 open reading frame 18, isoform b [homo sapiens]
  misc_feature: Down-regulated in shoot tissues in response to salicylic acid treatment
MEALLKWAAELGVSDSPSPSPSLPSSSPSGTTTSSSPSCLGRSLVVADFPNAGGRGLAAARDLRRGELVLRAPRAALLTSDRVTADDPRIAACVSAHRPRLSSVQILIVCLLAEVGKGRNSVWYPYLSQLPSYYTILATFDDFEVEALQVDDAIWVAQKAKSAIKSDWEDVTPLMKELEFKPKLLMFKSWLWAFATVSSRTLHIAWDEAGCLCPVGDLFNYAAPDDDTSLEAEDTAELTNYQQKNEMINSSERLTDGGYEDSNAYCLYARKNYKQGEQVLLGYGTYTNLELLEHYGFLLGENPNEKTFIELDLDICSGGTWPKDSMYIHSNGHPSFALLCALRLWSTPTNHRKAVGHQIYSGSMLSTENEMGIMKWLISRCEGTLQQLPTTVEFDESLLVFLRTIQNSSNCRTDVKQSGFEQEFSVFLRFHRVELDCSGYNQLPVRLLRSLERWELAVQWRCNYKKTLKKCISYCESLVNELPLQLNQQ

SEQ ID NO: 3649 - DNA, 354 bp, Sorghum bicolor
  misc_feature: Ceres ANNOT ID no. 6032123
  misc_feature: Encodes the peptide sequence at SEQ ID NO 3650
atgatgggctcactgaagctgacggagatcgtctccaagaagtggggcgtcggcggcggcagcaaggtcgcctccccgagcgcggcggcgtgcccgcgaggccacttcgcggcctacaccagggagggccgccggttcttcatccccatcgcctacctcgccagcgacaccttccaggagctgctcagcatggccgaggaggagttcggcgagcccggcgaccgccccatcgtgctgccctgctccgccgaccgcctcgagcagatcctcgacgccttccgcagcggcggcggccccaagaagaagagcgccggcgccggcgccggcagcggcaggatcagcaagatctggtag

SEQ ID NO: 3650 - protein, 117 aa, Sorghum bicolor
  misc_feature: Ceres ANNOT ID no. 6032123
  misc_feature (2)..(94): Pfam Id: Auxin_inducible Pfam Desc: Auxin responsive protein
  misc_feature (1)..(117): NCBI GI: 115472047 NCBI Desc: os07g0475700 [oryza sativa (japonica cultivar-group)]
  misc_feature (24)..(96): NCBI GI: 20149052 NCBI Desc: auxin-induced saur-like protein [capsicum annuum]
  misc_feature (27)..(94): NCBI GI: 115480483 NCBI Desc: os09g0545300 [oryza sativa (japonica cultivar-group)]
  misc_feature (33)..(90): NCBI GI: 6573709 NCBI Desc: t23e18.13 [arabidopsis thaliana]
  misc_feature (28)..(104): NCBI GI: 32187718 NCBI Desc: auxin induced protein [zea mays]
  misc_feature: Useful for making plants with modulated cold sensitivity
  misc_feature: Useful for making plants with modulated drought sensitivity
  misc_feature: Useful for making plants with modulated seed size
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13491
  misc_feature: GREAT-hit functional homolog of the protein sequence given in SEQ ID NO 13492
  misc_feature: Useful for making plants with modulated cold sensitivity
  misc_feature: Functional homolog of the protein sequence given in SEQ ID NO 13492
  misc_feature: The sequence is a functional homolog of SEQ ID NO. 443 in the 11/188,298 US application
  misc_feature: The sequence is a functional homolog of SEQ ID NO. 505 in the 11/188,298 US application
  misc_feature: The sequence is a functional homolog of SEQ ID NO. 402 in the 11/188,298 US application
MMGSLKLTEIVSKKWGVGGGSKVASPSAAACPRGHFAAYTREGRRFFIPIAYLASDTFQELLSMAEEEFGEPGDRPIVLPCSADRLEQILDAFRSGGGPKKKSAGAGAGSGRISKIW

SEQ ID NO: 3651 - DNA, 864 bp, Sorghum bicolor
  misc_feature: Ceres ANNOT ID no. 6032126
  misc_feature: Encodes the peptide sequence at SEQ ID NO 3652
atggtggcccttgcaaatgaagaggccttggcccatgatgaagacatcatggatgatgttgattccgatgttgaagaatcagactctgaagatgattcaggtgaagaagctcaggctaagccttcagacaaagctatatacaacaaggatgctattcttgaaaaacttgaagacatagcctggcccaagaatgtggactggatgcacaagctcactattgagcatgatcagggggagaaagttgatgtgaatgatgatcttgctcgcgaacttgcgttttacacccaagctttggatggcacaaggcaggcctttgagaagctgcagtcgatgaaggtccggttcctcaggccaacagattactatgctgagatggtgaagactgatgcgcacatgcacaagatcaaggggaggttgttgtcggagaagaagaggatcgaggaggctgaggagcggaggaaggctagagagtccaggaagaaagcaaaggaggttcaggctgagaagaagaaggagagggctaagcagaagaaggagcagattgagtccgtcaagaagtggaggaagcagaggcaacaaggggggttcaccaagggaaatgatgatgtgccagaccttaattttgaaggagaagaaggatttaaacaatcaaagaagaagaggcctggtgtttctcctggtgacaggtctggtggtcttgctaagcgaggtaaagaaggaaagaataggagggcaagggattccaagtttgggcatggtggtcgtaaagggctgaagaagcaaaacactgctgagaccactaatgatttcagaagctttaaccaggggggtgagtctcaaaacaagaagagaaagaggttttga

SEQ ID NO: 3652 - protein, 287 aa, Sorghum bicolor
  misc_feature: Ceres ANNOT ID no. 6032126
  misc_feature (6)..(284): Pfam Id: Ebp2 Pfam Desc: Eukaryotic rRNA processing protein EBP2
  misc_feature (4)..(286): NCBI GI: 24111281 NCBI Desc: at3g22660/mwi23_3 [arabidopsis thaliana]
  misc_feature (25)..(285): NCBI GI: 144922846 NCBI Desc: eukaryotic rrna processing [medicago truncatula]
  misc_feature (25)..(285): NCBI GI: 92886180 NCBI Desc: eukaryotic rrna processing protein ebp2 [medicago truncatula]
  misc_feature (6)..(286): NCBI GI: 126136096 NCBI Desc: ebna1-binding protein homolog [pichia stipitis cbs 6054]
  misc_feature (7)..(286): NCBI GI: 2330712 NCBI Desc: spac17h9.05 [schizosaccharomyces pombe]
MVALANEEALAHDEDIMDDVDSDVEESDSEDDSGEEAQAKPSDKAIYNKDAILEKLEDIAWPKNVDWMHKLTIEHDQGEKVDVNDDLARELAFYTQALDGTRQAFEKLQSMKVRFLRPTDYYAEMVKTDAHMHKIKGRLLSEKKRIEEAEERRKARESRKKAKEVQAEKKKERAKQKKEQIESVKKWRKQRQQGGFTKGNDDVPDLNFEGEEGFKQSKKKRPGVSPGDRSGGLAKRGKEGKNRRARDSKFGHGGRKGLKKQNTAETTNDFRSFNQGGESQNKKRKRF

SEQ ID NO: 3653 - DNA, 906 bp, Sorghum bicolor
  misc_feature: Ceres ANNOT ID no. 6032131
  misc_feature: Encodes the peptide sequence at SEQ ID NO 3654
atggcctccaccgccaccttcctgtccaccctcgccaccaggtccgcggcaaccgttagcccgcgcagcgccgccgagccgtccggcgccaagatcgtcaggttcttgcccgcccagatcagccgcacggggcgcgcggcggtgctgcccacgccgagggcggcggtctcgggcaccgagaagcaggcgccgtcgagcaagcacgagcgcgtggtcagggtgcacagcacccaggagttcgacgacgcgctcaaggccgccaagaaccggctggtggtggtggagttcgcggcgagcgacagcgagagcagcagccagatctacccgaccatggtgcagctcagccgcacctgcggcgacgtcgacttcctgctcgtcctgggcgacgagtcggaggcaaccaaggagctgttccggcgggagggcatcacgcaggtgccccacttcaacttctacaagggcgccgagaaggtgcacgaggaggaggccatggccatcggccccgagcggctcgccggcgacgtcctctactacggcgacagccactcggcggtggtgcagctgcactcgcgggaggacgtggaggcgctcatcgacgagcaccgcggcgacaagggcaagctcgtcgttctggacgtcggcctcaagcactgcgggccctgcgtcaaggtgtaccccaccgtgctgaagctgtcgaggtccatggtcgacaacaccgtcttcgcgcgcatgaacggcgacgagaacgacagctgcatggagttcctcagggacatgaaaatcgtcgaggtgcccactttcgtcttcatcagggacggacagatcgtcggccgctacgtcggctccggcaagggggagctcatcggtgagatcctcagatacaacggcgtcagggtcacctactga

SEQ ID NO: 3654 - protein, 301 aa, Sorghum bicolor
  misc_feature: Ceres ANNOT ID no. 6032131
  misc_feature (184)..(294): Pfam Id: Thioredoxin Pfam Desc: Thioredoxin
  misc_feature (48)..(301): NCBI GI: 2582822 NCBI Desc: cdsp32 protein (chloroplast drought-induced stress protein of 32kda) [solanum tuberosum]
  misc_feature (1)..(301): NCBI GI: 6573731 NCBI Desc: t23e18.2 [arabidopsis thaliana]
  misc_feature (188)..(294): NCBI GI: 6492215 NCBI Desc: thioredoxin [fasciola hepatica]
  misc_feature (188)..(294): NCBI GI: 6687568 NCBI Desc: thioredoxin (trx) [fasciola hepatica]
  misc_feature (179)..(294): NCBI GI: 13624884 NCBI Desc: thioredoxin h [pisum sativum]
MASTATFLSTLATRSAATVSPRSAAEPSGAKIVRFLPAQISRTGRAAVLPTPRAAVSGTEKQAPSSKHERVVRVHSTQEFDDALKAAKNRLVVVEFAASDSESSSQIYPTMVQLSRTCGDVDFLLVLGDESEATKELFRREGITQVPHFNFYKGAEKVHEEEAMAIGPERLAGDVLYYGDSHSAVVQLHSREDVEALIDEHRGDKGKLVVLDVGLKHCGPCVKVYPTVLKLSRSMVDNTVFARMNGDENDSCMEFLRDMKIVEVPTFVFIRDGQIVGRYVGSGKGELIGEILRYNGVRVTY

SEQ ID NO: 3655 - DNA, 702 bp, Sorghum bicolor
  misc_feature: Ceres ANNOT ID no. 6032132
  misc_feature: Encodes the peptide sequence at SEQ ID NO 3656
atggcgaggataaagcccaagcaattgctaattcaaagcaagacgaagaaggctccatctcggatcagctactctactatcatcacatggaacttgattgtcatattgattgtgctatctctctatgctacctacagccattggcatcaaaggtctgcccaagactttgaaatggagcttcatgaagctgagcttgctgtgagaccggtggatccaaaaatgataagtagaccaagatatgcggtaatgaacaccgcaaagggtccaattactatagaaatatacaaagatgcttctgctggtgttgtggatagatttattgacttgtgcaagagtaatcatttcaaaggaatgccatttcggcatatcatcaaaaattttgtaattcaaggaggtgattttgattttgatggagctgcccaagaatggataacgaaagctaaagctagtgggaaaaatgatctcagtccaaaacatgaggcgtttatgattgggactgcaaagaatcctaataacaaaggatttgatttgtttatcacgactgctccaattcctgacttgaatgacaagcttgttgtatttgggcgagttatcaagggagaggacatcgttcaggagattgaagaagttgacactgatgagcattatcagccaaaggccgcgataggcatcatcaatatcatgctaaagcaggagccttga

SEQ ID NO: 3656 - protein, 233 aa, Sorghum bicolor
  misc_feature: Ceres ANNOT ID no. 6032132
  misc_feature (80)..(230): Pfam Id: Pro_isomerase Pfam Desc: Cyclophilin type peptidyl-prolyl cis-trans isomerase/CLD
  misc_feature (1)..(232): NCBI GI: 34394822 NCBI Desc: peptidyl-prolyl cis-trans isomerase -related-like protein [oryza sativa (japonica cultivar-group)]
  misc_feature (110)..(232): NCBI GI: 20453257 NCBI Desc: at2g47320/t8i13.16 [arabidopsis thaliana]
  misc_feature (71)..(225): NCBI GI: 5670017 NCBI Desc: cyclophilin [leishmania donovani]
  misc_feature (71)..(225): NCBI GI: 68124073 NCBI Desc: cyclophilin [leishmania major]
  misc_feature (82)..(227): NCBI GI: 115477779 NCBI Desc: os08g0557500 [oryza sativa (japonica cultivar-group)]
MARIKPKQLLIQSKTKKAPSRISYSTIITWNLIVILIVLSLYATYSHWHQRSAQDFEMELHEAELAVRPVDPKMISRPRYAVMNTAKGPITIEIYKDASAGVVDRFIDLCKSNHFKGMPFRHIIKNFVIQGGDFDFDGAAQEWITKAKASGKNDLSPKHEAFMIGTAKNPNNKGFDLFITTAPIPDLNDKLVVFGRVIKGEDIVQEIEEVDTDEHYQPKAAIGIINIMLKQEP

SEQ ID NO: 3657 - DNA, 750 bp, Sorghum bicolor
  misc_feature: Ceres ANNOT ID no. 6032151
  misc_feature: Encodes the peptide sequence at SEQ ID NO 3658
atggatcattcggtgccttccccctcctcttctccccggaccgccgccgctgctcccggcggcccctgctgccgctttgacgcgctgcggcgggcgtgcgccaggcacgccgccgtcgccgcgcgggccgccgggtggacgctcggcgcgctgctcacctgcgtcttcgccgtcgtaggctcactcgtcggaatcttcatcggtgccttcatggggatgtccacggagagcggcatgttccgcggggctggcgtcggagcagtttctggagcagtcttctccattgaggctgttgagtcctgcatcgagatttggaggtccagccattcgggaaaatacagcattctctttgtgctggacatcatctctagcctcttcagcggaagaattgtgtgggagaaagtcagtccagcgctacagcgtgcagtgcaaagccagatgagtctaatgagcacaccattcatcgacaacaatgacctttttgaaactggcagtactggaggcatgtcaagggatttgattgataggatcccaaagatgaggttcagtgctgcaagcaactgtgatcaggaaactgatagcagctgctgctcagtctgcctccaggatttcggagcacaacaatttgtgagggccctgcctcagtgccaacacatattccacgtgcggtgcatcgacaattggctccttcggcacgcgtcttgcccactatgccgggccggtgttcatatagaccatatacatatgtaa

SEQ ID NO: 3658 - protein, 249 aa, Sorghum bicolor
  misc_feature: Ceres ANNOT ID no. 6032151
  misc_feature (197)..(238): Pfam Id: zf-C3HC4 Pfam Desc: Zinc finger, C3HC4 type (RING finger)
  misc_feature (59)..(249): NCBI GI: 115472067 NCBI Desc: os07g0479100 [oryza sativa (japonica cultivar-group)]
  misc_feature (27)..(242): NCBI GI: 27524904 NCBI Desc: nep1-interacting protein 2 [arabidopsis thaliana]
  misc_feature (45)..(239): NCBI GI: 27524902 NCBI Desc: nep1-interacting protein [arabidopsis thaliana]
  misc_feature (36)..(155): NCBI GI: 79332615 NCBI Desc: protein binding / ubiquitin-protein ligase/ zinc ion binding [arabidopsis thaliana]
  misc_feature (39)..(242): NCBI GI: 20147407 NCBI Desc: at1g74410/f1m20_9 [arabidopsis thaliana]
  misc_feature: The sequence is a functional homolog of SEQ ID NO 139 in the 11/479,226US patent application
  misc_feature: The sequence is a functional homolog of SEQ ID NO 216 in the 10/225,068US patent application
  misc_feature: The sequence is a functional homolog of SEQ ID NO 2210 in the 10/374,780US patent application
  misc_feature: The sequence is a functional homolog of SEQ ID NO 2322 in the 10/374,780US patent application
  misc_feature: The sequence is a functional homolog of SEQ ID NO 24 in the 10/412,699US patent application
  misc_feature: The sequence is a functional homolog of SEQ ID NO 242 in the 10/412,699US patent application
  misc_feature: The sequence is a functional homolog of SEQ ID NO 50 in the 11/375,241US patent application
  misc_feature: The sequence is a functional homolog of SEQ ID NO 515 in the 11/479,226US patent application
  misc_feature: Useful for making plants with modulated growth and phenotype characteristics
  misc_feature: Useful for making plants with modulated nitrogen use efficiency
  misc_feature: Functional homolog of the protein sequence given in SEQ ID NO 12909
  misc_feature: The sequence is a functional homolog of SEQ ID NO 24 in the 20040045049 US patent application
  misc_feature: The sequence is a functional homolog of SEQ ID NO 242 in the 20040045049 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
MDHSVPSPSSSPRTAAAAPGGPCCRFDALRRACARHAAVAARAAGWTLGALLTCVFAVVGSLVGIFIGAFMGMSTESGMFRGAGVGAVSGAVFSIEAVESCIEIWRSSHSGKYSILFVLDIISSLFSGRIVWEKVSPALQRAVQSQMSLMSTPFIDNNDLFETGSTGGMSRDLIDRIPKMRFSAASNCDQETDSSCCSVCLQDFGAQQFVRALPQCQHIFHVRCIDNWLLRHASCPLCRAGVHIDHIHM

SEQ ID NO: 3659 - DNA, 690 bp, Sorghum bicolor
  misc_feature: Ceres ANNOT ID no. 6032156
  misc_feature: Encodes the peptide sequence at SEQ ID NO 3660
atggagaaggtgaagaacatgctcaagccgcggccgacgccgcagcagcagctgcgcgagtggcagcgccgcctccgcaacgagtgccgcgtcctcgaccgccagatccgagatgtgcagagggaggagaagaatgtagagaaagccatcagggaggctgccaagcgcaatgacatgggatctgcaaaggctcttgctaaggaacttgtaagatcaagacgtgctgtcaatcgtctttacgaaaacaaggctcaactaaattcagtgtcaatgcaccttggagaaattgtcgcaactgcaagaacagtgggtcatctgtccaaaagcactgaagtgatgaaaattgttaacaacctaatgaaagctccagagctggctatcacgatgcaagaatttagcaaagaaatgaccaaggcaggtgtgatggaagagatggtgaacgaggcagttgattcagctttggactctgaggacatggaggaggaaatcgaagaggaggttgacaaggttcttgcttcagtagcaggggagactgcctcccagctaccagatgctgccagaacacagaagatacatgaggcttcaacaagcagggttccagaagagcggcaagctgttgcagagggcgctgacgatgacgaggaagacctagaagagatcagggcacggcttgctaaagtgaggtcgtaa

SEQ ID NO: 3660 - protein, 229 aa, Sorghum bicolor
  misc_feature: Ceres ANNOT ID no. 6032156
  misc_feature (20)..(190): Pfam Id: Snf7 Pfam Desc: Snf7
  misc_feature (1)..(226): NCBI GI: 115450199 NCBI Desc: os03g0108400 [oryza sativa (japonica cultivar-group)]
  misc_feature (14)..(229): NCBI GI: 108876555 NCBI Desc: neuroendocrine differentiation factor [aedes aegypti]
  misc_feature (10)..(229): NCBI GI: 125777470 NCBI Desc: ga22030-pa [drosophila pseudoobscura]
  misc_feature (5)..(229): NCBI GI: 25989659 NCBI Desc: vps24p [rattus norvegicus]
  misc_feature (14)..(229): NCBI GI: 55244508 NCBI Desc: ensangp00000019754 [anopheles gambiae str. pest]
  misc_feature: The sequence is a functional homolog of SEQ ID NO. 288 in the 11/188,298 US application
MEKVKNMLKPRPTPQQQLREWQRRLRNECRVLDRQIRDVQREEKNVEKAIREAAKRNDMGSAKALAKELVRSRRAVNRLYENKAQLNSVSMHLGEIVATARTVGHLSKSTEVMKIVNNLMKAPELAITMQEFSKEMTKAGVMEEMVNEAVDSALDSEDMEEEIEEEVDKVLASVAGETASQLPDAARTQKIHEASTSRVPEERQAVAEGADDDEEDLEEIRARLAKVRS

SEQ ID NO: 3661 - DNA, 1485 bp, Sorghum bicolor
  misc_feature: Ceres ANNOT ID no. 6032158
  misc_feature: Encodes the peptide sequence at SEQ ID NO 3662
atggccttcgcggctgctgccggcagcagctccagcggcaagcagttcgagttcgaggaggccaccgtggacgccatccaccagggcttcaagaacggcagcctcacctcgacggcgctcgtccagttctacctggaccagatcgcccgcctcaacccgctgctccacgccgtcatcgaggtcaacccggacgcggtcgcgcaggcggagcgcgccgacgccgagcgctccgcctccggcggccgctgcgccgttggcctgcacggcatccccgtcctgctcaaggacaacatcgccacgcgcgaccggctcaacaccacggccggctccctggcgctgctcggctccgtcgtcaggcgcgacgcgggcgtggtgacccgcctccgccgcgccggcgccgtcatcctcggcaaggccaacccctccgagtggtccaacttccgccccgtcaattccggctggagcgcccgcggcggccagacgctgaatccatatgttctctcggcaagcccgtgcgggtcgagcgctgggcctggcgttgccgcggcagccaacatggcagcagtgacactgggatcggagacggacggctccatcctctgtccatcgtcgcgcaactctgtggttgggatcaaaccaactgtcgggttaactagccgatctggtgtcatccccatcatgcctcttcaagacacgattggaccaatgtgtcggacagtatccgatgccgtccatctgttggacgccattgtcgggtatgatgagtttgatgcagaagccaccggagcagcgtccaagtacatcccacaagggggttacacgcagttcctgaggatccatggattgaggggcaagagaatcggtgtccctgatgtgttttttcatggatatgatggcgtgcaaatggcggtttatgagaagcatctcgatacaatgaggcaacaaggcgctgtcgtggtcaaggatcttgacattgcaacaaacttgactgatctggatgaccaagagagtctgctgatgaatgcagagttcaagttaagcatcaatgcgtatttgtctgacctactgcactctccagtgcgctcccttgcagaggtcatagcattcaacgaagcgcatcctgtagaggagagactcaaagattttgggcagccggacctgattgccgcggagaaaaccaacggcattggcaccagggagagagctgccattcagcggctcaaggagatatccaccaacgggttggagaagctggtgaaggaacaccagctggatgcgatcgtggcggccaacagcgacgcctcctctgttctcgccgtcgggggctatccgggcatcgccgtgccggcagggtacgacaagcagggagtcccctttgcgatatgctttggggggctcaggggctacgagccaaggttgattgagatcgcttatgcgttcgagcaagctaccaaagtcagaagaccacctactttcaagagctag

SEQ ID NO: 3662 - protein, 494 aa, Sorghum bicolor
  misc_feature: Ceres ANNOT ID no. 6032158
  misc_feature (39)..(474): Pfam Id: Amidase Pfam Desc: Amidase
  misc_feature (1)..(493): NCBI GI: 116317818 NCBI Desc: osigba0140c02.6 [oryza sativa (indica cultivar-group)]
  misc_feature (1)..(493): NCBI GI: 38346902 NCBI Desc: osjnbb0006l01.9 [oryza sativa (japonica cultivar-group)]
  misc_feature (1)..(493): NCBI GI: 115457174 NCBI Desc: os04g0183500 [oryza sativa (japonica cultivar-group)]
  misc_feature (4)..(493): NCBI GI: 116317819 NCBI Desc: osigba0140c02.7 [oryza sativa (indica cultivar-group)]
  misc_feature (1)..(493): NCBI GI: 38347081 NCBI Desc: osjnba0001m07.1 [oryza sativa (japonica cultivar-group)]
MAFAAAAGSSSSGKQFEFEEATVDAIHQGFKNGSLTSTALVQFYLDQIARLNPLLHAVIEVNPDAVAQAERADAERSASGGRCAVGLHGIPVLLKDNIATRDRLNTTAGSLALLGSVVRRDAGVVTRLRRAGAVILGKANPSEWSNFRPVNSGWSARGGQTLNPYVLSASPCGSSAGPGVAAAANMAAVTLGSETDGSILCPSSRNSVVGIKPTVGLTSRSGVIPIMPLQDTIGPMCRTVSDAVHLLDAIVGYDEFDAEATGAASKYIPQGGYTQFLRIHGLRGKRIGVPDVFFHGYDGVQMAVYEKHLDTMRQQGAVVVKDLDIATNLTDLDDQESLLMNAEFKLSINAYLSDLLHSPVRSLAEVIAFNEAHPVEERLKDFGQPDLIAAEKTNGIGTRERAAIQRLKEISTNGLEKLVKEHQLDAIVAANSDASSVLAVGGYPGIAVPAGYDKQGVPFAICFGGLRGYEPRLIEIAYAFEQATKVRRPPTFKS

SEQ ID NO: 3663 - DNA, 1533 bp, Sorghum bicolor
  misc_feature: Ceres ANNOT ID no. 6032159
  misc_feature: Encodes the peptide sequence at SEQ ID NO 3664
atggttgaccttcgtctccaggtcgtcgccaccgtcctgggcatggtggccctggcggccgctgccggcggcagcagctccagcggcaagcagtccgagttccaggaggtcaccgtggacgccatccatcagggcttcaagaacggcagtctcacctcgacggcgctcgtccggttctacctggaccagatcgcccgcctcaacccgctactccacgccgtcatcgaggtgaacccggacgcgctggcgcaggcggcgcgcgccgacgcggagcgctcggcctcccgcggccgctgcgccgtcggcctgcacggaatccccgtcctgctcaaggacaacatcgccacgcgcgacaggctcaacaccacggccggctccctcgctctgctcggctccgtcgtcaggcgcgacgccggcgtggtggcacgcctccgccgcgccggcgccgtcatcctcggcaaggctaacccttccgagtggtccaacttccgccccgtcgagtccggctggagcgcccgcggcggccagacgctgaatccatacgttctgtccgcgacgccatgcgggtcgagcgccgggcctggcgttgccgcggcagccaacatggcagcggtgacactgggatccgagaccgacggctccatcctctgcccatcgtcgttcaactctgtggttggcatcaaaccaactgttgggttgacaagccggtccggtgtcatccccatcactcctcttcaagacactattggaccaatgtgtcgcacagtatccgatgccgtccatgtgttggacgtcattgtcggctatgacgagcttgatgctgaagccaccggagcagcatccaaatacatcccgcacgggggatacacgcagttcctgaggatccatggattgaagggcaagaggatcggtgtcctcgacgtgttctttcaaggatacgatgacatgcaattggcggtttacgagaagcatctcgatacaatgaggcaacaaggcgctgtcgtgatcaagaatcttgacattacaacaaatttcactgatctgggtgagcaagagattctgctcatggctgcagagttcaagttaagcatcaatgcgtatttgtcggacctactgtactccccagtccgctcccttgcacagatcatagccttcaacaaagcacatcctgtagaggagagactcaaagattttgggcagccagacctgattgccgcggagaaaaccaacggcattggcaccagggagagagctgccatccagcggctcaaggagatatccaccaacgggttggagaagctgatgaaggaacaccagctggatgcgatcgtggcggccaacagcgacgcctcctctgttctcgccgtcgggggctatccgggcatcgccgtgccggcagggtacgacaagcagggagtcccatttgcaatatgctttggtgggctcaggggctacgaaccaaggttgattgagatcggttatgcgttcgagcaggctaccaaagtcagaaggccaccaacttacaagagctag

SEQ ID NO: 3664 - protein, 510 aa, Sorghum bicolor
  misc_feature: Ceres ANNOT ID no. 6032159
  misc_feature (55)..(490): Pfam Id: Amidase Pfam Desc: Amidase
  misc_feature (1)..(509): NCBI GI: 115457174 NCBI Desc: os04g0183500 [oryza sativa (japonica cultivar-group)]
  misc_feature (16)..(509): NCBI GI: 116317818 NCBI Desc: osigba0140c02.6 [oryza sativa (indica cultivar-group)]
  misc_feature (16)..(509): NCBI GI: 38346902 NCBI Desc: osjnbb0006l01.9 [oryza sativa (japonica cultivar-group)]
  misc_feature (15)..(509): NCBI GI: 116317819 NCBI Desc: osigba0140c02.7 [oryza sativa (indica cultivar-group)]
  misc_feature (12)..(509): NCBI GI: 115457176 NCBI Desc: os04g0184100 [oryza sativa (japonica cultivar-group)]
MVDLRLQVVATVLGMVALAAAAGGSSSSGKQSEFQEVTVDAIHQGFKNGSLTSTALVRFYLDQIARLNPLLHAVIEVNPDALAQAARADAERSASRGRCAVGLHGIPVLLKDNIATRDRLNTTAGSLALLGSVVRRDAGVVARLRRAGAVILGKANPSEWSNFRPVESGWSARGGQTLNPYVLSATPCGSSAGPGVAAAANMAAVTLGSETDGSILCPSSFNSVVGIKPTVGLTSRSGVIPITPLQDTIGPMCRTVSDAVHVLDVIVGYDELDAEATGAASKYIPHGGYTQFLRIHGLKGKRIGVLDVFFQGYDDMQLAVYEKHLDTMRQQGAVVIKNLDITTNFTDLGEQEILLMAAEFKLSINAYLSDLLYSPVRSLAQIIAFNKAHPVEERLKDFGQPDLIAAEKTNGIGTRERAAIQRLKEISTNGLEKLMKEHQLDAIVAANSDASSVLAVGGYPGIAVPAGYDKQGVPFAICFGGLRGYEPRLIEIGYAFEQATKVRRPPTYKS

SEQ ID NO: 3665 - DNA, 1050 bp, Sorghum bicolor
  misc_feature: Ceres ANNOT ID no. 6032162
  misc_feature: Encodes the peptide sequence at SEQ ID NO 3666
atggccgctgctcccatggtggtgccgcgcatgaagctgggctcgcaggggctggaggtctcggcgcagggcctcggctgcatgggcatgtccgcctactacggcccgcccaagccggagccggacatgatcgcgctcgtccaccacgccgtcgccgccggcgtcacactcctcgacacctcggacgtgtacgggccccacaccaacgagctcctcctcggcaaggcgctgcaggcagcaggcggggtgagggagaaggcgcaggtggcctccaagttcggcatcctcacggacgccgacggcaactggggcgtccgcggcgacccggcgtacgtgcgcgcctcgtgcgagggcagcctccagcgcctcggcgtcgactgcatcgacctctactaccagcatcgcattgacagcaaggtgcccatcgaggtcacggtaggtgaactgaagaaactagtcgcagagggcaagataaaatacattggtctgtccgaagcatcggcgtcgacgatcaggagagcgcacgcagttcatcccatcaccgctgtccaactggagtggtctctctggtcaagagatgttgaaactgacataatcccgacttgcagggagcttggcattggaatagtggcatatagtccactgggcagagggttcttgtcaagtggtcctaagctggtcgacaccttgtctgatcaagatttccgcaaggacctgcctagattccagccggaaaacatggagaagaacgccgtgatctttgagaaagtgaatgcaatggcggcgaggaaggggtgcacgccgtcgcagctggcgctggcctgggttcaccaccagggacccgacgtctgccccatacccgggacaacgaaggttgagaatttcaacagcaacgtggcggcgctttcggtgaagctgacacctgaagacatggctgagctcgagtcctacgcgtcggcggatgtccagggtgatcgctacaatgagtccttcctcgccgcttggaaggattctgagacacctcccctctcgtcctggaaggctgagtaa

SEQ ID NO: 3666 - protein, 349 aa, Sorghum bicolor
  misc_feature: Ceres ANNOT ID no. 6032162
  misc_feature (14)..(319): Pfam Id: Aldo_ket_red Pfam Desc: Aldo/keto reductase family
  misc_feature (2)..(348): NCBI GI: 116309238 NCBI Desc: h0813e03.4 [oryza sativa (indica cultivar-group)]
  misc_feature (1)..(349): NCBI GI: 115457782 NCBI Desc: os04g0337500 [oryza sativa (japonica cultivar-group)]
  misc_feature (4)..(349): NCBI GI: 38344994 NCBI Desc: osjnba0008a08.8 [oryza sativa (japonica cultivar-group)]
  misc_feature (4)..(349): NCBI GI: 116309559 NCBI Desc: osigba0115a19.1 [oryza sativa (indica cultivar-group)]
  misc_feature (1)..(348): NCBI GI: 62526573 NCBI Desc: aldo/keto reductase akr [manihot esculenta]
MAAAPMVVPRMKLGSQGLEVSAQGLGCMGMSAYYGPPKPEPDMIALVHHAVAAGVTLLDTSDVYGPHTNELLLGKALQAAGGVREKAQVASKFGILTDADGNWGVRGDPAYVRASCEGSLQRLGVDCIDLYYQHRIDSKVPIEVTVGELKKLVAEGKIKYIGLSEASASTIRRAHAVHPITAVQLEWSLWSRDVETDIIPTCRELGIGIVAYSPLGRGFLSSGPKLVDTLSDQDFRKDLPRFQPENMEKNAVIFEKVNAMAARKGCTPSQLALAWVHHQGPDVCPIPGTTKVENFNSNVAALSVKLTPEDMAELESYASADVQGDRYNESFLAAWKDSETPPLSSWKAE

SEQ ID NO: 3667 - DNA, 945 bp, Sorghum bicolor
  misc_feature: Ceres ANNOT ID no. 6032163
  misc_feature: Encodes the peptide sequence at SEQ ID NO 3668
atggctgcggcggcgactcctcctggtggtcgtcctagcagcagcagcatttcacggcgcgccgccgccgtggtgccggccttgctgctgctggcggcggcgatggccgcctccgccgccgacgcgcagccttccccggggtactacccgagctccaggttcaggccggtgccgttcaaccgcgcctacaacaacaagtggggcccgcagcaccagacgctctccggcgaccattccgccctcaccatctggctcgacaggacctgcggtagtggtttcaagtcgaagcacgcgtacaggaacggctacttctccactcgcatcaagctccccgccggctacaccgccggcaccaacaccgccttctacctgtccaacaacgaggcgcaccccggtttccacgacgagatcgacatggagttcctgggcacgatcccaggcgagccctacacgctgcagacgaacgtgtacgtgcgcggcagcggcgacggccgcatcgtgggtcgcgagatgcggttccacctctggttcgaccccaccgcggcctaccacacgtacgccatcctgtggaaccccgacgccatcactttcttcgtcgacgacgtccccgtccgccgctacgagcgccgcaccgagctcaccttcccggacagacccatgtgggtgtacggctccatctgggacgcctccgactgggccaccgacgacggccgccaccgcgccgactaccgctaccagcccttcgtcgcgcgcctcgaccgcttcgtcgtcgccgggtgctctgtctccgcgcccccggcgtgcaggcccgtgccggcgtcgccggcgggggctgggctcacggcgcagcagtacgcggcgatgcggtgggcgcagcgggaccacatggtttactactactgcaacgatttccgcagggaccattcgctcacgcccgagtgctag

SEQ ID NO: 3668 - protein, 314 aa, Sorghum bicolor
  misc_feature: Ceres ANNOT ID no. 6032163
  misc_feature (59)..(245): Pfam Id: Glyco_hydro_16 Pfam Desc: Glycosyl hydrolases family 16
  misc_feature (268)..(314): Pfam Id: XET_C Pfam Desc: Xyloglucan endo-transglycosylase (XET) C-terminus
  misc_feature (11)..(314): NCBI GI: 115483232 NCBI Desc: os10g0545500 [oryza sativa (japonica cultivar-group)]
  misc_feature (21)..(314): NCBI GI: 116871384 NCBI Desc: xyloglucan endotransglycosylase 1 [litchi chinensis]
  misc_feature (28)..(314): NCBI GI: 17402583 NCBI Desc: xyloglucan endo-transglycosylase [vitis labrusca x vitis vinifera]
  misc_feature (20)..(314): NCBI GI: 14029149 NCBI Desc: xyloglucan endo-transglycosylase [carica papaya]
  misc_feature (28)..(314): NCBI GI: 311835 NCBI Desc: cellulase [tropaeolum majus]
  misc_feature: Useful for making plants with altered cell wall content and/or composition
  misc_feature: GREAT-hit functional homolog of the protein sequence encoded by LOCUS at2g36870
  misc_feature: Useful for making plants with altered carbohydrate content
  misc_feature: Functional homolog of the protein sequence given in SEQ ID NO 13842
  misc_feature: Useful for making plants with altered cell wall content and/or composition
  misc_feature: Functional homolog of the protein sequence given in SEQ ID NO 13843
  misc_feature: The sequence is a functional homolog of SEQ ID NO. 381 in the 11/188,298 US application
MAAAATPPGGRPSSSSISRRAAAVVPALLLLAAAMAASAADAQPSPGYYPSSRFRPVPFNRAYNNKWGPQHQTLSGDHSALTIWLDRTCGSGFKSKHAYRNGYFSTRIKLPAGYTAGTNTAFYLSNNEAHPGFHDEIDMEFLGTIPGEPYTLQTNVYVRGSGDGRIVGREMRFHLWFDPTAAYHTYAILWNPDAITFFVDDVPVRRYERRTELTFPDRPMWVYGSIWDASDWATDDGRHRADYRYQPFVARLDRFVVAGCSVSAPPACRPVPASPAGAGLTAQQYAAMRWAQRDHMVYYYCNDFRRDHSLTPEC

SEQ ID NO: 3669 - DNA, 1101 bp, Sorghum bicolor
  misc_feature: Ceres ANNOT ID no. 6032168
  misc_feature: Encodes the peptide sequence at SEQ ID NO 3670
atggccgggaagttattgtccaatcacaaactaactagacttaaaaatttatatcgcaaattacaggagaaggttatcttgcagaccatgccagtcattgagaatgccataaaagaagtatacacaactcttgttcccagaaccatggtcattgctgacctaggatgctcttcaggaccaaacacattgctctttatatccaatgtgataaacatcatagctggccaatacaataaacctggtgatcctgtggaacttcaaatcttcctaaacgacctaccaggtaatgacttcaaccaactattcagttctctcaaagacttgaagctagatacaagtgaacaaacaggatacacacccccattgtgctacatttctgggttgccaaaatcatactacagcagactgtttcctcgccaaagcgtccatctctttcactcctcttgctgccttcactggctctctcaggtacctgaggaactatatgcacggaaaggagctttcttaaatgaagataatatttatatcacaaagaccacaccatcatgtgtggtgaagtgcttccaagagcaattccataaggacttctccctcttcttgaagttgcgccacaaagaacttatatatggaggggaaatggttctaacattttgtgggaggaaggatgaggatgtatacaatggatatctcaacaaactctttggattagttgcaagatcactacaatctcttgttggaaagggcctcgtggagaaagaaaaactagaagcttttaatctaccgctatatgggccatcaattggtgaagtgaaggaaatagtcaaggaaagccacatgttcaaaatagactatatcaaattatttgagcaaaattgggatccttacgatgatacagaagacaattatgttcatgacagtggtcgtagtggtatgaatgtctctaagtttgttagagcactattggagcctttgattgcaagccattttggagaaaccatacttgacttattgttcgctgattatgcatgtctcgtttccaagcaccttgagcaagagaagacaaaaaacgccctgatcgccgtgtctttgaagaaaatatag

SEQ ID NO: 3670 - protein, 366 aa, Sorghum bicolor
  misc_feature: Ceres ANNOT ID no. 6032168
  misc_feature (33)..(366): Pfam Id: Methyltransf_7 Pfam Desc: SAM dependent carboxyl methyltransferase
  misc_feature (20)..(353): NCBI GI: 115467342 NCBI Desc: os06g0242000 [oryza sativa (japonica cultivar-group)]
  misc_feature (134)..(366): NCBI GI: 115467776 NCBI Desc: os06g0313200 [oryza sativa (japonica cultivar-group)]
  misc_feature (20)..(363): NCBI GI: 42528301 NCBI Desc: benzothiadiazole-induced s-adenosyl-l-methionine:salicylic acid carboxyl methyltransferase 1; bth-induced s-adenosyl-l-methionine:salicylic acid carboxyl
  misc_feature (20)..(363): NCBI GI: 42528301 (continued) methyltransferase 1 [oryza sativa (indica cultivar-group)]
  misc_feature (21)..(365): NCBI GI: 45238343 NCBI Desc: carboxyl methyltransferase [crocus sativus]
  misc_feature (21)..(354): NCBI GI: 58201428 NCBI Desc: samt [schizanthus pinnatus]
MAGKLLSNHKLTRLKNLYRKLQEKVILQTMPVIENAIKEVYTTLVPRTMVIADLGCSSGPNTLLFISNVINIIAGQYNKPGDPVELQIFLNDLPGNDFNQLFSSLKDLKLDTSEQTGYTPPLCYISGLPKSYYSRLFPRQSVHLFHSSCCLHWLSQVPEELYARKGAFLNEDNIYITKTTPSCVVKCFQEQFHKDFSLFLKLRHKELIYGGEMVLTFCGRKDEDVYNGYLNKLFGLVARSLQSLVGKGLVEKEKLEAFNLPLYGPSIGEVKEIVKESHMFKIDYIKLFEQNWDPYDDTEDNYVHDSGRSGMNVSKFVRALLEPLIASHFGETILDLLFADYACLVSKHLEQEKTKNALIAVSLKKI

SEQ ID NO: 3671 - DNA, 1119 bp, Sorghum bicolor
  misc_feature: Ceres ANNOT ID no. 6032172
  misc_feature: Encodes the peptide sequence at SEQ ID NO 3672
atggagtgcgcggcgaaggggctggccgcggagccgtgcgccggcggcgtcgccgaccggcggtgcggcggctgcggagctgtcgcctactgctcccgcgcccaccagattattcattggagggttcacaaagaagaatgtgaaaggtttgcagaacaaatgaggcgcgttgatgtgctcaaccagtttccgttcacattcttggaacctccttctctgaaccatgaattcccaagtgcaaggtgcttatttttgcaatcaatcaaacttcaccaaaaagggatctggaaatcggaatgcatatgtgaccaagatgttgatcctgtgaaggatttaagcatagaagctgaatggaacttgcaaagctccctctgcccttgtacagagcctaaaaatcctgtgccttcggtcctggcaagctgggaagactattatcagtggagatcccttcccctgtattcacctgttgctgttttacttcattggccacttactctatatcattgcattcaactctctcggttccaaactccaagatatgatggccaggacaccctgtgcattcactatttagggcctgagaaggagctacttcagcttgcagcatttggggaactacttgcattatttccaggtgtacagattcacattgagcttgtgggaccagaagttccaaagtctagggatggtgaggttgtaaacatttccagatatgcatgctgttctgatgagagctgctgttgtaaatcttctattggttccaaagaattgagttgcactgcagtgacactcaaactgtggaaaggtttctatcatgagagatgcagtgatataatgaaggactcaattcctcatcttatttttgccccaaatgctggtgtggctgcataccctagttggatgccaactattgaaataataaggcggactgggattcctgcagtctttacggacttctgtgaagaagctgcgcatctagcatcctgctgcataagctccataactggtcaaccccttaaaattccaatccaggtaaatcctttcaggcagccagttgcagcggataacagtgcactatacctaccatgttattcaaattgctttgttttcgggatgtaa

SEQ ID NO: 3672 - protein, 372 aa, Sorghum bicolor
  misc_feature: Ceres ANNOT ID no. 6032172
  misc_feature (13)..(47): Pfam Id: zf-MYND Pfam Desc: MYND finger
  misc_feature (1)..(372): NCBI GI: 115472083 NCBI Desc: os07g0481000 [oryza sativa (japonica cultivar-group)]
  misc_feature (1)..(346): NCBI GI: 22330536 NCBI Desc: zinc finger (mynd type) family protein [arabidopsis thaliana]
  misc_feature (54)..(167): NCBI GI: 2194143 NCBI Desc: f20p5.13 gene product [arabidopsis thaliana]
  misc_feature (22)..(370): NCBI GI: 123234454 NCBI Desc: zinc finger, mynd-type containing 15 [mus musculus]
  misc_feature (22)..(370): NCBI GI: 119610820 NCBI Desc: zinc finger, mynd-type containing 15, isoform cra_a [homo sapiens]
MECAAKGLAAEPCAGGVADRRCGGCGAVAYCSRAHQIIHWRVHKEECERFAEQMRRVDVLNQFPFTFLEPPSLNHEFPSARCLFLQSIKLHQKGIWKSECICDQDVDPVKDLSIEAEWNLQSSLCPCTEPKNPVPSVLASWEDYYQWRSLPLYSPVAVLLHWPLTLYHCIQLSRFQTPRYDGQDTLCIHYLGPEKELLQLAAFGELLALFPGVQIHIELVGPEVPKSRDGEVVNISRYACCSDESCCCKSSIGSKELSCTAVTLKLWKGFYHERCSDIMKDSIPHLIFAPNAGVAAYPSWMPTIEIIRRTGIPAVFTDFCEEAAHLASCCISSITGQPLKIPIQVNPFRQPVAADNSALYLPCYSNCFVFGM

SEQ ID NO: 3673 - DNA, 1104 bp, Sorghum bicolor
  misc_feature: Ceres ANNOT ID no. 6032174
  misc_feature: Encodes the peptide sequence at SEQ ID NO 3674
  misc_feature: Up-regulated in root tissues in response to methyl jasmonate treatment
  misc_feature: Up-regulated in shoot tissues in response to methyl jasmonate treatment
atgtcaatcgcgtgctgcttgccggtcgtggagtgcgtgtactgcctggcttgtgcgcggtgggtgtggcagcgctgcctccactctggagcctacgacagtgagacctggggtgttgcatcggctgaagagtttgagcccgtgccacggttgtgccggatcatcctctcggtctatgaggatgaccttgagaacccccaatgggcgcctccaggtggttatggcatggagccacgttgggtggtgcaccggaggacatatgaagacactcatggtcatgcaccaacttaccttctgtatgttgatcaccaacattcagatgtcgtgcttgctgttcggggaatggacatgatgaaggagagtgactatgctgtccttctggataacaagcttgggcagaggaggttcgatggtggctacgtgcataatggcttgcttaaggctgctgagtgggtttttgatgctgagcgtgatgttctgaaggaccttctggagaggaaccctggttatacactcacatttgctgggcattctcttggctctggtgtggcgtcaatgctagctttgctggcggtacacgacagggagctgctgggtggcatagacaggaagaggattcgatgttttgcaatggcaccagcccgatgtatgtcgctcaatttggctgtccgttatgcggatgtcatcaatgcagtgattcttcaggatgattttttgcctcgcacagacattcctttggaagacatcttcaagtcactcttctgcttaccatgccttctatgtggaaggtgcctaatagacacctgtatacctgaaagtgtgatgttgagagatccaagacgcctctatgcacctggtaggctttaccacattgttgaaaggaaacctttcagatgtggaagatacccccctcttgtgagaacagcagttccggtggatgggagatttgaacgcattgttctctcttgcaacgcaacatctgatcatgctattatatggatagaaagagaggcccaaagggcattagatgtaagtttgcattttgtcatcgaaattgactctattccctttgaaatgcttgttagtggtattcgcctatggtaa

SEQ ID NO: 3674 - protein, 367 aa, Sorghum bicolor
  misc_feature: Ceres ANNOT ID no. 6032174
  misc_feature (109)..(247): Pfam Id: Lipase_3 Pfam Desc: Lipase (class 3)
  misc_feature (9)..(76): Pfam Id: Lipase3_N Pfam Desc: Lipase 3 N-terminal region
  misc_feature (1)..(346): NCBI GI: 55793838 NCBI Desc: calmodulin-binding heat shock protein [gossypium hirsutum]
  misc_feature (1)..(346): NCBI GI: 56118085 NCBI Desc: calmodulin binding heat shock protein [gossypium hirsutum]
  misc_feature (1)..(346): NCBI GI: 140060405 NCBI Desc: lipase, class 3; lipase 3, n-terminal; zinc finger, c2h2-type [medicago truncatula]
  misc_feature (1)..(344): NCBI GI: 9757980 NCBI Desc: calmodulin-binding heat-shock protein [arabidopsis thaliana]
  misc_feature (1)..(342): NCBI GI: 1087073 NCBI Desc: calmodulin-binding heat-shock protein; cambp [nicotiana tabacum]
  misc_feature: Up-regulated in root tissues in response to methyl jasmonate treatment
  misc_feature: Up-regulated in shoot tissues in response to methyl jasmonate treatment
MSIACCLPVVECVYCLACARWVWQRCLHSGAYDSETWGVASAEEFEPVPRLCRIILSVYEDDLENPQWAPPGGYGMEPRWVVHRRTYEDTHGHAPTYLLYVDHQHSDVVLAVRGMDMMKESDYAVLLDNKLGQRRFDGGYVHNGLLKAAEWVFDAERDVLKDLLERNPGYTLTFAGHSLGSGVASMLALLAVHDRELLGGIDRKRIRCFAMAPARCMSLNLAVRYADVINAVILQDDFLPRTDIPLEDIFKSLFCLPCLLCGRCLIDTCIPESVMLRDPRRLYAPGRLYHIVERKPFRCGRYPPLVRTAVPVDGRFERIVLSCNATSDHAIIWIEREAQRALDVSLHFVIEIDSIPFEMLVSGIRLW

SEQ ID NO: 3675 - DNA, 1242 bp, Sorghum bicolor
  misc_feature: Ceres ANNOT ID no. 6032190
  misc_feature: Encodes the peptide sequence at SEQ ID NO 3676
atggcgaccagcaacggcaaggcggcgcagggggaggaggggaagacgccaccgccggcggggtcgatcggcgggtacgagtccctgcacaggctcctggaggccaacctctccccggagctattccaggaagcaagccggttgctgttgggactgaattgtgcacagccgcttgaggctatctcactgcctgacgccacaaccactcttgcagaaacacacaattttgatgtgcaggcattccgttttagtgcagacaaagagtttctaaggcaaccacgagttgttcgagttggtctagttcagaactcaatcgccgttcccactacttgtcactttgctgaccaaaagaaggcaatcatggacaaaataaaacctgtaattgatgcagctggtgcttctggtgtcaatattttgtgcctacaagaagcctggactatgccttttgctttctgcacacgcgagaaaagatggtgtgaatttgctgaaccagttgatggagaatctactcaattccttcaggaacttgcacagaaatataacatggtaatagtgagcccaatccttgaaagggatgtaaaccatggggagactatttggaatactgctgtcattattggaaacaatggcaacataattgggattcatcgaaagaatcacattccaagagttggtgatttcaatgagagcacatactacatggagggtaacactgggcatccagtgtttgaaacagcttatggcaaaataggagtgaacatttgctatggaagacatcatccccttaattggcttgcatttggcctcaatggagctgaaatagtgttcaacccatctgcgactgttggtgaactcagtgaaccaatgtggcccattgaggcaaggaacgccgcaattgcaaacagctactttgttggatcaattaaccgggttggcacagaagtgttcccaaatccattcacatctggtgatgggaaacctcaacatgcagacttcggccatttctatggatctagccatttctcagcacctgatgcctcttgcaccccgtcactatcacgctatcgagatggcttgatcatctccgatatggacctcaacctatgccgccagatcaaagacaagtgggccttccgcatgactgctcgttatgagatgtatgcttccttgctctcagagtacttgaaaccagatttcaaacctcaagtcattgttgatcccttgattaataagaaggcataa

SEQ ID NO: 3676 - protein, 413 aa, Sorghum bicolor
  misc_feature: Ceres ANNOT ID no. 6032190
  misc_feature (97)..(280): Pfam Id: CN_hydrolase Pfam Desc: Carbon-nitrogen hydrolase
  misc_feature (12)..(413): NCBI GI: 9759413 NCBI Desc: beta-ureidopropionase [arabidopsis thaliana]
  misc_feature (21)..(413): NCBI GI: 68160670 NCBI Desc: beta-ureidopropionase [thlaspi caerulescens]
  misc_feature (7)..(412): NCBI GI: 92896179 NCBI Desc: nitrilase/cyanide hydratase and apolipoprotein n-acyltransferase [medicago truncatula]
  misc_feature (21)..(413): NCBI GI: 140071742 NCBI Desc: nitrilase/cyanide hydratase and apolipoprotein n-acyltransferase [medicago truncatula]
  misc_feature (26)..(407): NCBI GI: 28829985 NCBI Desc: similar to dictyostelium discoideum (slime mold). beta-alanine synthase (ec 3.5.1.6)
  misc_feature (26)..(404): SWISSPROT Homolog: EC 3.5.1.6 Beta-ureidopropionase
MATSNGKAAQGEEGKTPPPAGSIGGYESLHRLLEANLSPELFQEASRLLLGLNCAQPLEAISLPDATTTLAETHNFDVQAFRFSADKEFLRQPRVVRVGLVQNSIAVPTTCHFADQKKAIMDKIKPVIDAAGASGVNILCLQEAWTMPFAFCTREKRWCEFAEPVDGESTQFLQELAQKYNMVIVSPILERDVNHGETIWNTAVIIGNNGNIIGIHRKNHIPRVGDFNESTYYMEGNTGHPVFETAYGKIGVNICYGRHHPLNWLAFGLNGAEIVFNPSATVGELSEPMWPIEARNAAIANSYFVGSINRVGTEVFPNPFTSGDGKPQHADFGHFYGSSHFSAPDASCTPSLSRYRDGLIISDMDLNLCRQIKDKWAFRMTARYEMYASLLSEYLKPDFKPQVIVDPLINKKA

SEQ ID NO: 3677 - DNA, 2412 bp, Sorghum bicolor
  misc_feature: Ceres ANNOT ID no. 6032195
  misc_feature: Encodes the peptide sequence at SEQ ID NO 3678
atggagggcgacgccgccggagctgacggaggaggaggaggcggcggagagcggtctagcttcgtgatcggcctcatcgagaaccgcgccaaggaggttggtgttgcagcctttgatttaagatcagcctcattgcacctatctcagtatattgagacaggttgctcataccacaatacaaggacactacttcatttctatgatcccatggttgtcattgtgcccccgaacaaaacagcagcagatggtatggttggagtttcagaactgatcgataagcattacccagcaaacaaaaaggtcactatggcacgtggttgctttgatgacacaaagggtgctggcattgtgaaaagtctttcagctagagacccatctgcgcttggtttagatacttactgcaagcagtattatctttgtcttgcggctgtcactgcaacaattaaatggatagaatcagaaaagggcgtgttcattaccaatcactcattatcagttacattcaatgggtcatttgaccatatgagtatcgactcaactagtgttcaaacattggaaattattgatcctctccataccgaactatggggcactagcaacaaaaagaaaagcctctttcagatgctgaagactacaaagactacaggaggggctagattgctgagagccaatttattacaaccattaaaagatattcagaccatcaatgctcgtctaggctgcttggatgagctaatgagcaatgaggagctgttttttggtttgactcaaggtctacggaaatttccaaaagaatcagataaggttctctgtcatttctgcttcaagcccaaaaaggttagagatgaggtattgaagcctgccaatggtagaaagagccagaagttgatttctgatattattgttcttaaaactgctctggacgccataccattcttgtccaaggttttgaagggggcaaaaagtgttcttcttcacaacatttatcagactgtatgtgaaaaccccaagtatgcgaatatgagaaagagaattggagatgtcattgacgaggatgtggttcattcaagggctccatttgtagcctgcactcaggaatgttttgctgttaaggcaggaattgatgggctgcttgatgttgctcgtcgatctttctgtgataccagtgaagccgtacataacctcgccaaacagtacagggaagaatataatatgccaaatttgaagatgccctataatactaggcaaggattttactttatgataccccaaaaggacatcaccgataggcttcctaataaatttatccaggttgttagacatgggaagaatatccattgctcaagtttggagcttgcttcactgaatgttaggaacaagacagctgctgctgagtgcttctcgcgcacagaactttgtttggaagggcttattgacgaaatcagaggagacattggtatccttacattgctcgcggaagtattatgtcttctggacatgattgtaaattcttttgcgcatacaatatctacaaagcccgttgatcgctacacaagaccagagttcacagatgatggtccaatggctatcaatgccggacgacatcctattcttgagaccttgcgtactgattttgttcctaacgacatctttctctctgaagcatctaatatggttcttatcatggggccaaatatgagcgggaaaagcacatatctccaacagatatgtttaattgtcattcttgcacaaattggctgttatgttccagctcagtttgcatccttaagagttgttgatcgtatattcacacggattggtaacggggacaatgttgaaaacaactcgagtacgtttatgacagaaatgaaagaaactgctttcatcatgcaaaatgttacttcaaggagcttggttgttgtggatgagctgggaagagcaacatcttcctcagatggattggcaatcgcatggagctgctgtgaataccttctttctgtgaaagcatacactgtttttgccactcatatggaacgcttgtcagaacttgcaacaatgtatccaaatgtgaagatcctccattttgaagttgacttaagaaatgaccgcttggatttcaagttccgcctaaaggatggcgtccgacgggtaccgcactatgggcttctgctggccagagtagctggtatccctacttcagtgattgacacctcaacaagtatcacttcacagatcacggagcaggaaatgacaaggatggatgccaactgcgaggagtaccggtcgcttcagatgacgtaccaggttgtgcagcggcttatctgcctgaagtactcaaaccatgacgaagactacatccgtgaagcactgcagaatctcaaggagagctatgctgcaggccggctaacataa

SEQ ID NO: 3678 - protein, 803 aa, Sorghum bicolor
  misc_feature: Ceres ANNOT ID no. 6032195
  misc_feature (517)..(748): Pfam Id: MutS_V Pfam Desc: MutS domain V
  misc_feature (172)..(511): Pfam Id: MutS_III Pfam Desc: MutS domain III
  misc_feature (373)..(465): Pfam Id: MutS_IV Pfam Desc: MutS family domain IV
  misc_feature (15)..(802): NCBI GI: 79476962 NCBI Desc: msh4 (muts-like protein 4); atp binding / damaged dna binding [arabidopsis thaliana]
  misc_feature (15)..(802): NCBI GI: 50083056 NCBI Desc: msh4 [arabidopsis thaliana]
  misc_feature (344)..(636): NCBI GI: 115472123 NCBI Desc: os07g0486000 [oryza sativa (japonica cultivar-group)]
  misc_feature (204)..(797): NCBI GI: 119626797 NCBI Desc: muts homolog 4 (e. coli), isoform cra_a [homo sapiens]
  misc_feature (204)..(797): NCBI GI: 119626798 NCBI Desc: muts homolog 4 (e. coli), isoform cra_b [homo sapiens]
MEGDAAGADGGGGGGGERSSFVIGLIENRAKEVGVAAFDLRSASLHLSQYIETGCSYHNTRTLLHFYDPMVVIVPPNKTAADGMVGVSELIDKHYPANKKVTMARGCFDDTKGAGIVKSLSARDPSALGLDTYCKQYYLCLAAVTATIKWIESEKGVFITNHSLSVTFNGSFDHMSIDSTSVQTLEIIDPLHTELWGTSNKKKSLFQMLKTTKTTGGARLLRANLLQPLKDIQTINARLGCLDELMSNEELFFGLTQGLRKFPKESDKVLCHFCFKPKKVRDEVLKPANGRKSQKLISDIIVLKTALDAIPFLSKVLKGAKSVLLHNIYQTVCENPKYANMRKRIGDVIDEDVVHSRAPFVACTQECFAVKAGIDGLLDVARRSFCDTSEAVHNLAKQYREEYNMPNLKMPYNTRQGFYFMIPQKDITDRLPNKFIQVVRHGKNIHCSSLELASLNVRNKTAAAECFSRTELCLEGLIDEIRGDIGILTLLAEVLCLLDMIVNSFAHTISTKPVDRYTRPEFTDDGPMAINAGRHPILETLRTDFVPNDIFLSEASNMVLIMGPNMSGKSTYLQQICLIVILAQIGCYVPAQFASLRVVDRIFTRIGNGDNVENNSSTFMTEMKETAFIMQNVTSRSLVVVDELGRATSSSDGLAIAWSCCEYLLSVKAYTVFATHMERLSELATMYPNVKILHFEVDLRNDRLDFKFRLKDGVRRVPHYGLLLARVAGIPTSVIDTSTSITSQITEQEMTRMDANCEEYRSLQMTYQVVQRLICLKYSNHDEDYIREALQNLKESYAAGRLT

SEQ ID NO: 3679 - DNA, 1113 bp, Sorghum bicolor
  misc_feature: Ceres ANNOT ID no. 6032202
  misc_feature: Encodes the peptide sequence at SEQ ID NO 3680
atgccgctggctgagccgccccagtggcgccgcaaggccacagatttcttctccacatccagtgtcaagctgaagcaggcagggcaatcggctggggataatatagctgatgttgctgggaaggttgggtccgtggtgaagagtcggtgggctgtcttccaggaggctaggcagcagcagcaacatccaccacacgagacagtgcaagagcgtatcatcactgctgctgcctccactggtttgcttttcaggaaaggcatttcagagacaaaggagaaggttgcagtgggaaaggtcaaagttgaagaggctgctaaaaaaactgcagataaaagcaagagtatcttgaacaatattgaacgctggcagaagggagtcgcaagcactgatgtgtttggtgttcctattgaagccactgtacaacgagagcaatctggtaaagctgtgcccttggtgctagtgagatgtgctgactacctggttatatcaggtttgaataatgagtacttattcaaatcagaaggcgacaaaaaagttcttcagcagttagtttctctttacaatgaagactctggtgcatctttacctgaaggtgtaaatcctattgatgtaggtgcactggtgaagtgctaccttgccagtatccctgagccgcttactacattttcgctttatgatgaacttcgagctgcgagggttagcattcctgatcttaggaacatattgaagaagcttccaaatgtgaactacatgacgctagagtttgttacagcgttgctgcttcgagtcagccgtaaatcttcacttaacaagatggactcccgctgccttgctgtggaatttgcgcctttgatcatgtggcggcaaggtgacgctggcacagatttgcgtaaccatctcaagtttaccctgaaaccgcctccaaaaattgtagatacaacatcaaatactgccacatgggacctgttagacgaggatgacgaggatgcttcatcccagatccccttggacgatgcttcaccgccagactacagctccattgaggtcatccagtgtctcatcgagcatcacaatgccatcttcactgatgcaaatgaaaccgtgtggagatga

SEQ ID NO: 3680 - protein, 370 aa, Sorghum bicolor
  misc_feature: Ceres ANNOT ID no. 6032202
  misc_feature (150)..(294): Pfam Id: RhoGAP Pfam Desc: RhoGAP domain
  misc_feature (1)..(370): NCBI GI: 42573754 NCBI Desc: small g protein family protein / rhogap family protein [arabidopsis thaliana]
  misc_feature (132)..(297): NCBI GI: 3660275 NCBI Desc: chain a, rhorhogapgdp(dot)alf4 complex
  misc_feature (132)..(297): NCBI GI: 6730013 NCBI Desc: chain b, crystal structure of the cdc42cdc42gapalf3 complex
  misc_feature (132)..(297): NCBI GI: 30750042 NCBI Desc: chain a, crystal structure of rhoa.gdp.mgf3-in complex with rhogap
  misc_feature (132)..(297): NCBI GI: 3402098 NCBI Desc: chain c, complex between cdc42hs.gmppnp and p50 rhogap (h. sapiens)
MPLAEPPQWRRKATDFFSTSSVKLKQAGQSAGDNIADVAGKVGSVVKSRWAVFQEARQQQQHPPHETVQERIITAAASTGLLFRKGISETKEKVAVGKVKVEEAAKKTADKSKSILNNIERWQKGVASTDVFGVPIEATVQREQSGKAVPLVLVRCADYLVISGLNNEYLFKSEGDKKVLQQLVSLYNEDSGASLPEGVNPIDVGALVKCYLASIPEPLTTFSLYDELRAARVSIPDLRNILKKLPNVNYMTLEFVTALLLRVSRKSSLNKMDSRCLAVEFAPLIMWRQGDAGTDLRNHLKFTLKPPPKIVDTTSNTATWDLLDEDDEDASSQIPLDDASPPDYSSIEVIQCLIEHHNAIFTDANETVWR

SEQ ID NO: 3681 - DNA, 1731 bp, Sorghum bicolor
  misc_feature: Ceres ANNOT ID no. 6032203
  misc_feature: Encodes the peptide sequence at SEQ ID NO 3682
atgccgctacgcctacgcgtcgcgctccagctccgccgcttctcctccaccgacgccgccctcgcacccccgaagctgcggaacctgccctaccgcctccgccacgtcgccgtccccgccgcgcgcgccgtcatctccgagtacctccactcgacgcgctgcctcgcgtcctcccacgccgactccatcgccgcgcactccccgcgctccctcctctccttcctcgccgcgctccccaccgtgccgcgctccctccccacctcggagcttcccgcccacctccgccgccacctcaacttccacccgctcaatgagctccccttcttcctcgaatcaatcggcgggcccaccgcggcggccccctgcttgaactccatgttcctctccgaccacccctccctgctcggcgccgtcgccgcgctcgcgcacttcggattcccgtggtcacgcctcggactcctcttccctagcgtcctcctcgacgtgcccccggacctcatctccgcgcgcctctccgctctcgaggcccgcctccaccggctccctcgcgccgcgatcatcgccgcttgccttaccttcccatcgcttcttgagggggatctatccgactatgacgtactcattaaggatattgccgccacgttcaaaggattgtggccggatttgagttccagcaatgacattgacgcgttctcgggggtgtgccggaggatgcggatgttttatgatgccggggcagagattggtagcattgggggacttgtcggaggcagccagtgggtgtttcttgagctcggggaaaagaggattgctgagaggttttggttcttcaaggagctggggatggaggggaaggagatgggaaggtttttgctgagcaatgccaggattttcgatcttgatttctctgatgtggtgatctcagtgccaaggtatctgcggagggttggattagcagaggatgagatcgatgctgcggtggagaagcacccatatgttgttgggaagaaccaactggaaaaccttcctagggtgctgcgggcaatggagctggagcatcggttcctggagaagatattggctggtggggagagtttgcgctatttatcaccagaatttgttttggaggatgatagctatgatgccgatgttgaaagagctttcctggatgggatggctaaggtcatgcttgagaggaaagcacattttgtagacaagaagctggagttcttgaaaagtgttgggtatggtgagaatgagataaccaccaaggtaattcctgcccttaacagcaccagggatttgctgttggagcggtttgactacctcctggaaagaggagtggagtataagatactatgtcggatcttgcgcgtttttccaaaggtgctgaaccagagtaaggatatgctcaatgagaagttgaactacctcacagaggagctgggctactccttggagtacctgcattgcttccctgcatttctgtgttttgatttggagaacaggaccaagcctaggtatacaatgctttggtggctccaagagcatggcttgcttagaaaaaaattagcccctgcaacagtgcttgctaactcagagaagaggttcattagtaccctttaccttgtgcatcctgcagttccaaagttgtggcttgagtgtttttcttcaagaagacatatggagtattatctcaagaacatctatcagtatgcagaaaacatataa

SEQ ID NO: 3682 - protein, 576 aa, Sorghum bicolor
  misc_feature: Ceres ANNOT ID no. 6032203
  misc_feature (238)..(539): Pfam Id: mTERF Pfam Desc: mTERF
  misc_feature (141)..(552): NCBI GI: 22327586 NCBI Desc: mitochondrial transcription termination factor-related / mterf-related [arabidopsis thaliana]
  misc_feature (409)..(557): NCBI GI: 2160140 NCBI Desc: f19k23.9 gene product [arabidopsis thaliana]
  misc_feature (267)..(538): NCBI GI: 53850523 NCBI Desc: at1g62120 [arabidopsis thaliana]
MPLRLRVALQLRRFSSTDAALAPPKLRNLPYRLRHVAVPAARAVISEYLHSTRCLASSHADSIAAHSPRSLLSFLAALPTVPRSLPTSELPAHLRRHLNFHPLNELPFFLESIGGPTAAAPCLNSMFLSDHPSLLGAVAALAHFGFPWSRLGLLFPSVLLDVPPDLISARLSALEARLHRLPRAAIIAACLTFPSLLEGDLSDYDVLIKDIAATFKGLWPDLSSSNDIDAFSGVCRRMRMFYDAGAEIGSIGGLVGGSQWVFLELGEKRIAERFWFFKELGMEGKEMGRFLLSNARIFDLDFSDVVISVPRYLRRVGLAEDEIDAAVEKHPYVVGKNQLENLPRVLRAMELEHRFLEKILAGGESLRYLSPEFVLEDDSYDADVERAFLDGMAKVMLERKAHFVDKKLEFLKSVGYGENEITTKVIPALNSTRDLLLERFDYLLERGVEYKILCRILRVFPKVLNQSKDMLNEKLNYLTEELGYSLEYLHCFPAFLCFDLENRTKPRYTMLWWLQEHGLLRKKLAPATVLANSEKRFISTLYLVHPAVPKLWLECFSSRRHMEYYLKNIYQYAENI

SEQ ID NO: 3683 - DNA, 819 bp, Sorghum bicolor
  misc_feature: Ceres ANNOT ID no. 6032211
  misc_feature: Encodes the peptide sequence at SEQ ID NO 3684
atgtctggtcgtcgtcgtcgttcgtggacaatatgggcgcctctcctggcgtcgctgctgctcgccgggctggcgctgtcggccaaggtggtggacgaggaggcggaggcggacggcgacgacggtggtggcgccagcaagaagaagaagccccacgttaaccacggcaagttcaaggcggacccgtggacggacgggcacgcgacgttctacggcggccgcgacgggtccggcaccacggacggcggcgcgtgcggctacaagggcgagctgggaaaggactacggcgcgctcacggcggccgtgggcccgtcgctctacaccaacggcgccgggtgcggcgcgtgctacgagctcaagggctccaagggcaccgtggtcgtgacggccaccaaccaggccccgccgccggtcagcgggcagaagggcgagcacttcgacctcaccatgccggcgttcctcaagatcgacgaggagaaggccggcattgtgcccatcacctatcgcaaggtggcgtgcgcgaggcaaggcggcatccggtacaccatcacggggaacccgaactacaacatggtgatggtgaccaacgtgggcggcgccggggacgtggtggcgctgtcggtgaagggcaacaagcgcgtcaagtggacgccgatgaagcgcagctggggacagctctggatcacggaggtcaacctcaccggcgagtcgctgacgttccgcgtcatgaccggcgaccaccgcaaggccacctcctggcacgtcgcgccccgcgactggaagtacgacaaaacataccaggccaccaagaacttctag

SEQ ID NO: 3684 - protein, 272 aa, Sorghum bicolor
  misc_feature: Ceres ANNOT ID no. 6032211
  misc_feature (179)..(257): Pfam Id: Pollen_allerg_1 Pfam Desc: Pollen allergen
  misc_feature (99)..(168): Pfam Id: DPBB_1 Pfam Desc: Rare lipoprotein A (RlpA)-like double-psi beta-barrel
  misc_feature (38)..(272): NCBI GI: 25136293 NCBI Desc: alpha expansin 26 [oryza sativa (japonica cultivar-group)]
  misc_feature (38)..(272): NCBI GI: 16517062 NCBI Desc: alpha-expansin osexpa26 [oryza sativa]
  misc_feature (38)..(272): NCBI GI: 115502185 NCBI Desc: expansin-a26 precursor (osexpa26) (alpha-expansin-26) (osexp26) (osaexpa1.29)
  misc_feature (126)..(272): NCBI GI: 75225160 NCBI Desc: expansin-a32 precursor (osexpa32) (alpha-expansin-32) (osexp32) (osaexpa1.30)
  misc_feature (125)..(272): NCBI GI: 40217878 NCBI Desc: expansin-2 [petunia x hybrida]
MSGRRRRSWTIWAPLLASLLLAGLALSAKVVDEEAEADGDDGGGASKKKKPHVNHGKFKADPWTDGHATFYGGRDGSGTTDGGACGYKGELGKDYGALTAAVGPSLYTNGAGCGACYELKGSKGTVVVTATNQAPPPVSGQKGEHFDLTMPAFLKIDEEKAGIVPITYRKVACARQGGIRYTITGNPNYNMVMVTNVGGAGDVVALSVKGNKRVKWTPMKRSWGQLWITEVNLTGESLTFRVMTGDHRKATSWHVAPRDWKYDKTYQATKNF

SEQ ID NO: 3685 - DNA, 939 bp, Sorghum bicolor
  misc_feature: Ceres ANNOT ID no. 6032213
  misc_feature: Encodes the peptide sequence at SEQ ID NO 3686
atgtcacggtggcgcgcggcagcctccagcatctccgccgccaccgccgcgtcccgcaactccgcagcggaggcccgcgtcctctccagggccttggcgaaggctccctcgccgcttccgcttccgcttcctctccaaaccctctcgagaaccttcgccaagtcagctgccgccgccgcgacggctacgtcgccccgccctggcgcctccccgcccgctgggctgaggcccgagatcagactgaattctatgttcttatccaagccctgttcattagcgttgccgcctgactcccctcatagagcagtggatccacaatacaaaggcatcaagcgtttcctgcttacactgttactgttctacagtaagcaaagcaagtccatcagaggagcaaatgttgtttatgatcgaatcacttctcaagttgatgcacctgcaatttatgatgtttttcagttggagaaaacatttaagacaacattttcattgcttgttcttcatatgtggcttgttctacgccgcttgaaggaagaagggaaggatggtgttaagttcggacagtacatctatgaaatgtacaaccacgatgtagagctcagagtttcaaaagctggggttaacttgctcttgataaaatggatgaaggagctagagaaaatattctatggaaacattgtgaagtatgatgctgcgataagcccagaggctcgtcaagatgatcttgtaaatgtcatctggagaaatatttatgctgaggaaggttcagaggttatggatgcggctgctgcccctgctgtccaggcattggcaagatacacacgaagggaggcaacttgtctatcattgactgacaaagattctatgttctctgggaacttcaaattcacaaccctgctgccggcaactcccagttccagcccaaagaagcctgtgcgatga

SEQ ID NO: 3686 - protein, 312 aa, Sorghum bicolor
  misc_feature: Ceres ANNOT ID no. 6032213
  misc_feature (149)..(303): Pfam Id: Ubiq_cyt_C_chap Pfam Desc: Ubiquinol-cytochrome C chaperone
  misc_feature (52)..(298): NCBI GI: 30696021 NCBI Desc: ubiquinol-cytochrome c chaperone family protein [arabidopsis thaliana]
  misc_feature (120)..(299): NCBI GI: 90424171 NCBI Desc: ubiquinol-cytochrome c chaperone [rhodopseudomonas palustris bisb18]
  misc_feature (122)..(295): NCBI GI: 115524829 NCBI Desc: ubiquinol-cytochrome c chaperone [rhodopseudomonas palustris bisa53]
  misc_feature (120)..(295): NCBI GI: 82946290 NCBI Desc: cbp3 protein, mitochondrial precursor [magnetospirillum magneticum amb-1]
  misc_feature (121)..(307): NCBI GI: 75675596 NCBI Desc: ubiquinol-cytochrome c chaperone [nitrobacter winogradskyi nb-255]
MSRWRAAASSISAATAASRNSAAEARVLSRALAKAPSPLPLPLPLQTLSRTFAKSAAAAATATSPRPGASPPAGLRPEIRLNSMFLSKPCSLALPPDSPHRAVDPQYKGIKRFLLTLLLFYSKQSKSIRGANVVYDRITSQVDAPAIYDVFQLEKTFKTTFSLLVLHMWLVLRRLKEEGKDGVKFGQYIYEMYNHDVELRVSKAGVNLLLIKWMKELEKIFYGNIVKYDAAISPEARQDDLVNVIWRNIYAEEGSEVMDAAAAPAVQALARYTRREATCLSLTDKDSMFSGNFKFTTLLPATPSSSPKKPVR

SEQ ID NO: 3687 - DNA, 804 bp, Sorghum bicolor
  misc_feature: Ceres ANNOT ID no. 6032218
  misc_feature: Encodes the peptide sequence at SEQ ID NO 3688
atggcttccgccaaggtggagaaccgaggcgcgctgtcgaaaaggtcgcgcaacgacgtgtctgtaagggagggggactggaattgtcctcagtgtggtaatgtcaacttcagttttagaaatgtttgcaaccgtggagcctgtggtgcaccccgtccatcaccgagtccaagtcctagaatgatgccagcacctcctcctggtggatatgaccggtcacctctattttacggaggaggtggtggtgccccacctccaattcctcttggatctggtagctatggtgctccatatccgcaccttgggatgcgatatggttatggtccaccagtaggagctcctggttcatatggccttttctcgtcatatggtcaacctgggccaatgagtggtatgggatatggcccaggacctgagctaggccgatatagctatggctttagaggttctccaatgccggtttctagcccatggtctggtggagcattagctgaaaacaatgacaatattgcttcacgaaagcgccgtggaggccctgatggactttctgagggtgactggacctgccccaaatgtgacaacattaacttttccttcagaaccacttgcaacatgaagaaatgtggagccccgaggccaacttctggaggtaacacgagctcatctcgcaaggacaataacaataaggaagcccctgaaggaagctggacctgcccagagtgcaacaacctgaactacccgttccgcaccgtgtgcaacaggaaaggatgctcgtacagcaagccagccccgacgaataactga

SEQ ID NO: 3688 - protein, 267 aa, Sorghum bicolor
  misc_feature: Ceres ANNOT ID no. 6032218
  misc_feature (23)..(54): Pfam Id: zf-RanBP Pfam Desc: Zn-finger in Ran binding protein and others
  misc_feature (183)..(214): Pfam Id: zf-RanBP Pfam Desc: Zn-finger in Ran binding protein and others
  misc_feature (3)..(267): NCBI GI: 42407323 NCBI Desc: p53 binding protein-like [oryza sativa (japonica cultivar-group)]
  misc_feature (3)..(267): NCBI GI: 42407324 NCBI Desc: p53 binding protein-like [oryza sativa (japonica cultivar-group)]
  misc_feature (3)..(267): NCBI GI: 42407325 NCBI Desc: p53 binding protein-like [oryza sativa (japonica cultivar-group)]
  misc_feature (168)..(263): NCBI GI: 18698995 NCBI Desc: p53 binding protein [oryza sativa]
  misc_feature (48)..(267): NCBI GI: 9828626 NCBI Desc: f1n21.14 [arabidopsis thaliana]
MASAKVENRGALSKRSRNDVSVREGDWNCPQCGNVNFSFRNVCNRGACGAPRPSPSPSPRMMPAPPPGGYDRSPLFYGGGGGAPPPIPLGSGSYGAPYPHLGMRYGYGPPVGAPGSYGLFSSYGQPGPMSGMGYGPGPELGRYSYGFRGSPMPVSSPWSGGALAENNDNIASRKRRGGPDGLSEGDWTCPKCDNINFSFRTTCNMKKCGAPRPTSGGNTSSSRKDNNNKEAPEGSWTCPECNNLNYPFRTVCNRKGCSYSKPAPTNN

SEQ ID NO: 3689 - DNA, 801 bp, Sorghum bicolor
  misc_feature: Ceres ANNOT ID no. 6032221
  misc_feature: Encodes the peptide sequence at SEQ ID NO 3690
atggcgatggacgcggagcggcggcaggcggagctgatcgcgcagttctccgctcaggcggcggcgctgtcgtccgcgccgcagctcgccgcgctggtgcttgaggccacctcccacccggccctcttcgccttctccgagctcctcaccctcccggccctctccaagctcgctggcacgcagtacgcgtcgtcactggacttgctccggctcttcgcctacggcaccttgaaggactacaagagtaattctggatcccttccagcattgttgcctgaccaggtccggaagctaaagcaactcagtgtgctaactctggcagagtcaactaagatactaccgtatgatcagctcatgcaagagttggacgtttccaacgtaagagaactcgaagatttcctaatcaatgagtgcatgtactcgggtatcgttagaggcaaactggatcagctgagaaggtgctttgaggtacaatttgcagctggaagagatcttacacctgatcagctaaacaacatgatagagaccttgtctgactggttgggaacatcagatagcctgttgcatcaaattcaggagaaaatcaagtgggctgatacaatgagtgaggtgaacaagaagcaccagaaagaatttgaagacagagtggaagaggccaaaaaatcaatcaaggcagacatcgacttacgggggcatgacgactttctctctgaatctggaggaataatggattttgaagaggaccgcgtccgaccaaaaaggtgcataggaatagctatgtacctagaaaagccggaatga

SEQ ID NO: 3690 - protein, 266 aa, Sorghum bicolor
  misc_feature: Ceres ANNOT ID no. 6032221
  misc_feature (63)..(159): Pfam Id: PCI Pfam Desc: PCI domain
  misc_feature (3)..(254): NCBI GI: 21593551 NCBI Desc: fus5 [arabidopsis thaliana]
  misc_feature (3)..(227): NCBI GI: 42571297 NCBI Desc: cop9 signalosome complex subunit 7ii / csn complex subunit 7ii (csn7) (cop15) / fusca protein (fus5) [arabidopsis thaliana]
  misc_feature (3)..(223): NCBI GI: 18056669 NCBI Desc: csn complex subunit 7i [arabidopsis thaliana]
  misc_feature (127)..(224): NCBI GI: 115472159 NCBI Desc: os07g0490800 [oryza sativa (japonica cultivar-group)]
  misc_feature (13)..(226): NCBI GI: 83776754 NCBI Desc: cop9 signalosome complex subunit 7 [dictyostelium discoideum]
  misc_feature: Useful for making plants with modulated low light sensitivity
  misc_feature: GREAT-hit functional homolog of the protein sequence given in SEQ ID NO 13380
  misc_feature: Useful for making plants with modulated low light sensitivity
  misc_feature: Functional homolog of the protein sequence given in SEQ ID NO 13380
  misc_feature: Useful for making plants with modulated light quality sensitivity
  misc_feature: Functional homolog of the protein sequence given in SEQ ID NO 13844
MAMDAERRQAELIAQFSAQAAALSSAPQLAALVLEATSHPALFAFSELLTLPALSKLAGTQYASSLDLLRLFAYGTLKDYKSNSGSLPALLPDQVRKLKQLSVLTLAESTKILPYDQLMQELDVSNVRELEDFLINECMYSGIVRGKLDQLRRCFEVQFAAGRDLTPDQLNNMIETLSDWLGTSDSLLHQIQEKIKWADTMSEVNKKHQKEFEDRVEEAKKSIKADIDLRGHDDFLSESGGIMDFEEDRVRPKRCIGIAMYLEKPE

SEQ ID NO: 3691 - DNA, 1335 bp, Sorghum bicolor
  misc_feature: Ceres ANNOT ID no. 6032223
  misc_feature: Encodes the peptide sequence at SEQ ID NO 3692
atggcactggctacggccacgatctcatccccacagctccggtactgcccctctcctcgaggtcggcgtcgtaggcgtggacgccacggagccgcagcggctaccgtggccgcctcggcgacgccgcggtcctcggaggagaacatcgtcatcgtcggcgcgggcgtcgcggggctggccacggcggtcgcccttcgccggctgggcgtgggcgccgccgtgctggagcagggcgacgccctgcgcgcgggcggcacgtccctgacgctgttcaagaacgggtggcgcgtgctggacgccatcggcgtcgccgacgagctccggtccaagtacctccgcatccaggggatgaggatgcgatcgccggcggcgggcgggcgggagctgcgcgagttctccttcgaggaagaagctcccggacaggaggtgcgcgcggtggagaggagagtgcttctcgagacgctttcttctaagctgccaccaggcaccatatcgttctcatccaagctgaaatcgatttcagagcaagggcctgcaggaggcaccctgctcgaactggaagacgggaggcaaattctctccaagattgtgatcggctgcgacggagtgaactcgccgatcgccaagtggatgggcttctcggagccccggtacgtcgggcacatggcgttccggggcctcgcggagtacgccgacgggcagccgttcgagcccaaggtgaactacatctacggccgaggcgtccgcgccggctttgtccccgtctccccaaccaaagtctactggttcatctgcttcaacaggccagatccagggccgaagatcaccgaccccgcggcgctcaagagcgaggcgctggagctcgtccgcggctggccatcggacctgctggcggtgatgcgcagcacgcccgagggcgccgtggtgaggacgccgctggtggaccggtggctgtggccagggctggccccggccgcgtcgaggggcggccgggtggtgctggccggcgacgcgtggcaccccatgacgcccaacctcggccagggcgcctgctgcgcgctcgaggacgccgtcatcctggcgcgccgcctcgccgacgccggcggagcccaggcccaggctgccatgcgcgcgtacgaggcggagcggtgggcgcgcgtgttcccgctcacggcgcgcgcggggctggtgggcgcgctcgtgcagtgggacaacgcggcggtgtgcgcggcccgcgacggcgtcgtcatcccgaggctcgtcaggctgggcccgttcctggagcacaccaacttcgagtgcgacctgctcgagccggcgccgcagtcgccatga

SEQ ID NO: 3692 - protein, 444 aa, Sorghum bicolor
  misc_feature: Ceres ANNOT ID no. 6032223
  misc_feature (46)..(394): Pfam Id: FAD_binding_3 Pfam Desc: FAD binding domain
  misc_feature (117)..(440): NCBI GI: 115472165 NCBI Desc: os07g0491900 [oryza sativa (japonica cultivar-group)]
  misc_feature (24)..(437): NCBI GI: 4164576 NCBI Desc: ctf2a [arabidopsis thaliana]
  misc_feature (24)..(437): NCBI GI: 4164574 NCBI Desc: ctf2a [arabidopsis thaliana]
  misc_feature (25)..(416): NCBI GI: 4164578 NCBI Desc: ctf2b [arabidopsis thaliana]
  misc_feature (126)..(437): NCBI GI: 42571065 NCBI Desc: monooxygenase family protein [arabidopsis thaliana]
MALATATISSPQLRYCPSPRGRRRRRGRHGAAAATVAASATPRSSEENIVIVGAGVAGLATAVALRRLGVGAAVLEQGDALRAGGTSLTLFKNGWRVLDAIGVADELRSKYLRIQGMRMRSPAAGGRELREFSFEEEAPGQEVRAVERRVLLETLSSKLPPGTISFSSKLKSISEQGPAGGTLLELEDGRQILSKIVIGCDGVNSPIAKWMGFSEPRYVGHMAFRGLAEYADGQPFEPKVNYIYGRGVRAGFVPVSPTKVYWFICFNRPDPGPKITDPAALKSEALELVRGWPSDLLAVMRSTPEGAVVRTPLVDRWLWPGLAPAASRGGRVVLAGDAWHPMTPNLGQGACCALEDAVILARRLADAGGAQAQAAMRAYEAERWARVFPLTARAGLVGALVQWDNAAVCAARDGVVIPRLVRLGPFLEHTNFECDLLEPAPQSP

SEQ ID NO: 3693 - DNA, 1086 bp, Sorghum bicolor
  misc_feature: Ceres ANNOT ID no. 6032235
  misc_feature: Encodes the peptide sequence at SEQ ID NO 3694
atgaggacgccgcgggctgtctcctcgttcttgtccctttccgggctcctcctcctcgccgtctcggtggccgcgggctccaaaggttacggcggcgatggcgctgcggccggttcgaatggcagcggcggccaggaaggcagctacaaggtgccggcgtaccagaagcccgtggccggcctcgacgagaggtactacgagaagtcgtgcccgcaaatggaggaaatcgtcgggagggccgtgatgaaggctgtgaaagccgacgagaccctcgccgccagcatcatccgcctcttcttccacgacttcgccgtcgggggcgtggacgggtcgatcctgttagacgtgccggggcacagcgagaagtacgcgcaggcgagcaggacgctgcgcgggttcgagctgatcgaggagatcaagaaggagctggaggccaagtgccacgccaccgtctcctgcgccgacatcctcaccgcggccgcccgcgacgccgtcgcctcgccggcggtcaggggcccctactggacgctcaactacgggcgcaaggaccggaagggctacttcagcgccaacacggccgaccgcgacgtccccatgggcggccagagcgtcacccagctcatctccttcttcgagaagaacgggctcaacatccaagacctcgtcgccctctccggagctcacacgatcgggcgcgcgacgtgcggcgcggtgaggccggggctgtgcaagcgccggaaggaaggaggcgcgctgctgctgctggaccggcagtacggcgacttcctgcagcgcaagtgccgcgcgggcggcgacggggagtacgtggagctggacggcgagacgcccacggcgttcgacaaccagtactacaagaacctggtgcacgggaaggggctgctggacacggaccagaagctgctggcggactcccggacgggcggcttcgtcaggtcctacgccaaccagaggtcccaggccttcgtcggccagttcgcccaatccatgcgacgcctcggcgaggctcaggtgctcaccgggaacgagggcgaggtccgccgcaagtgctccgccgtcaactactaa

SEQ ID NO: 3694 - protein, 361 aa, Sorghum bicolor
  misc_feature: Ceres ANNOT ID no. 6032235
  misc_feature (77)..(323): Pfam Id: peroxidase Pfam Desc: Peroxidase
  misc_feature (12)..(360): NCBI GI: 55701071 NCBI Desc: tpa: class iii peroxidase 102 precursor [oryza sativa (japonica cultivar-group)]
  misc_feature (56)..(360): NCBI GI: 7453855 NCBI Desc: peroxidase prx15 precursor [spinacia oleracea]
  misc_feature (64)..(361): NCBI GI: 30725302 NCBI Desc: at5g66390 [arabidopsis thaliana]
  misc_feature (64)..(361): NCBI GI: 1429215 NCBI Desc: peroxidase atp6a [arabidopsis thaliana]
  misc_feature (61)..(361): NCBI GI: 115437360 NCBI Desc: os01g0543100 [oryza sativa (japonica cultivar-group)]
  misc_feature: Useful for making plants with altered cell wall content and/or composition
  misc_feature: GREAT-hit functional homolog of the protein sequence encoded by LOCUS at1g30870
MRTPRAVSSFLSLSGLLLLAVSVAAGSKGYGGDGAAAGSNGSGGQEGSYKVPAYQKPVAGLDERYYEKSCPQMEEIVGRAVMKAVKADETLAASIIRLFFHDFAVGGVDGSILLDVPGHSEKYAQASRTLRGFELIEEIKKELEAKCHATVSCADILTAAARDAVASPAVRGPYWTLNYGRKDRKGYFSANTADRDVPMGGQSVTQLISFFEKNGLNIQDLVALSGAHTIGRATCGAVRPGLCKRRKEGGALLLLDRQYGDFLQRKCRAGGDGEYVELDGETPTAFDNQYYKNLVHGKGLLDTDQKLLADSRTGGFVRSYANQRSQAFVGQFAQSMRRLGEAQVLTGNEGEVRRKCSAVNY

SEQ ID NO: 3695 - DNA, 3879 bp, Sorghum bicolor
  misc_feature: Ceres ANNOT ID no. 6032256
  misc_feature: Encodes the peptide sequence at SEQ ID NO 3696
atggcgacgcagccgccctcctccgccgctgccgcggttgacctctatgagacggcctcgcagccggacgcccccgccgccggcgacgcgtacacttttctcgagttcaacacgcaaggggacgacttcgattaccccgacttcccagagctctcccagccgccgcctcgatccacgccgctaacgtcctccgtccccggcgccggcgcgtcgtcctcgtcgtggcctgccccaccgccgccgccgtccgacgcggcctccccggaacccgatctcacgcctcaggacgtccccaccccgctggcctcctcctcctcgccgtcgccgcggtccgcctccaaggcgcgctcgtcggctgcggcggatgggctcgcctccggggttgccgcactcagcttcgaggagcctgtaggagccggcgccggggaggacgggtacgactacggcaagggagacttcgtggaacacgcctgccggtactgcgggatccacaatcctgcgtgcgtggcgaggtgcaacgtgccctcctgccgcaagtggttctgtaactcgcgggggaacacctctggctcccacattgtcaatcacctggttagggcaaagcataaggaagtgtgccttcacaaggatagccctttgggagaaacaattctcgaatgttacaactgtggttgtcggaatgtatttcttcttgggtttatctcagcaaagtcggagaatgttgtcgttctattatgcagagagccatgtttaagtgttaatgcactgaaggatatgaattgggatctcagccagtggtgcccacttatcgatgacaggtgtttcttgtcgtggcttgtaaaggtaccttcagagcaggagcagctaagagctcgccaaattagtgcccagcaaattaacaaagtggaagagctctggaagacaaatcctgatgcatctcttgaagatcttgaaaagcctggtgtagatgatgaacctcagtcagttgttttgaagtatgaagatgcttatcagtaccaaaatgtttttgcgccactgataaagcttgaggctgattatgacaagatgatgaaagagtcacagagcaaggataatgtaactgtccggtgggatattgggttgaacaagaagcgtgtagcttactttgtctttccaaaggaagacaatgagttgaggcttgtgcctggagatgagctacgcttgagatatcctggtgatagctcacatcccacatggcaatctgtgggacatgtgattaagctcactgcacaagaggaggtggcacttgagcttcgtgctagtcagggggtgcctactgagctaaacgttggattcagtgtggattttgtttggaagagtaccagttttgataggatgcaaggagcgatgaaaacttttgctgtggacgagacaagtgtcagtggatacatataccatcaccttttgggacatgaagttgagcaccaaataatacgtaataccctgccaagacgctttggtgcacctggacttccagaactaaatgcttcccaggttttagcagttaaaagtgtcctgcagaagcctgttagcttgattcaaggtccacctggcactggaaaaactgtcacatctgctgcaattgtgtatcacatggcaaaacaaggtcaaggacaggttcttgtatgtgccccaagtaatgttgctgttgatcagctggcagagaagataagctcaactggtctcaaggttgttaggctgtgtgcaaaatctagagaagctgtttcgtctcctgttgagcatctgacacttcattatcaggttaggcaccttgatacctctgaaaagagtgaattgcacaagctacagcaactgaaagatgaacaaggtgaattgtccagcagtgatgagaagaagtacaaggccctaaagcgtgccactgaaagagagatactgcagagtgctgatgtcatttgttgcacctgtgttggtgctggagatcctcgtctttcaaacttccgtttccgacaagttcttattgatgagtccacacaggcaacagaacctgaatgtcttattcctttggtgcttggtgtcaagcaggttgtccttgtcggagatcattgtcaactgggtccagtcatcatgtgcaaaaaagcagcccgtgcagggttagcacaatctctctttgaacgcctcgttatccttggagtgaagccattcaggttacaggtccagtatagaatgcatccttgcctctcagagtttccatccaactgcttctatgaaggcacactgcaaaatggagtgactgttaatgagaggcaatcgtctggaattgattttccttggcctgttccaaatcggcctatgttcttctatgtgcagatgggacaagaagagatcagtgctagtgggacatcgtatctcaatagaactgaagctgcaaatgttgaaaaaattgtaacaacatttttaagaagtggtgttgtacccagccagattggagttatcacaccttatgaaggacaaagggcatacatcgtaaattacatgtcaaggaatggctctcttcgccaacaactttacaaggaaatcgaggttgctagtgtagactcatttcagggtagagagaaagactacattattctatcttgtgttagaagcaatgagcaccagggaattgggtttctcaatgatccgcgcaggttaaatgttgcgttaactcgtgcacgttatgggatagttattcttggtaatccaaaagtactaagcaagcagccactttggaatagcttgttgacacattacaaggagcatgagtgcttggtagaagggcctttgaacaacttaaagcagagtatggtgcaatttcagaagccaaaaaagatatataatgaccggagattgttcctgggcggtggtcaaggtgtcatgcatggggctggggcgtcaagccaagcagcagataagagaagcggcagggggaaaggacaatcatttgttccttatggccctccaaatggggtgcataagcctggcgtgcacccagcaggctatgctgtacctcgtatgccttttcctccatttcctggggctccacattctcaaccatatacgattccgacccggggtttgcatgggcccattggagctgttccaccggtgcatcaacctggaagtagaaactttggggcgcctcgttcaaatactggtgggcctattggtggccaccttgctcatcaacagaactcccagcaagctatggggggcatcgggtcaaactttaactacactggcatggagaatccgagtagtcagccttctggtggagcccaaatgtcccaaactggattaatgacacagatgcctgtccaaggactaagtcaaacattccgtgatggtttttccattggtgggatgtctcaggacttctttgtagatgattttaagagccaagggtcacatgtgccatacaacattgcagaattttctacccaggcttctcaaggtggttatggcgttgaatttactcaagcgcccccatctggatactctgggagttatatgaaccaaaatgcacatcctggatactcccatattggtacaacaaatgacattgtatctcaggatcacatggcccatggatctcatggaatgtttacacaagcgggatataatgatccctcacaagatgactcgtctcagattcattatggaatggctgctgctggccccctacagtcgcagagtatgatgaaccccttgtactctcaatcctatgctcactacaacacccaaccacagtctcttcaacctcctccccaagaggttgacggcactaccctcatctctcacctgtatagaaaggcaatcggggcctataatggtacgatgtga

SEQ ID NO: 3696 - protein, 1292 aa, Sorghum bicolor
  misc_feature: Ceres ANNOT ID no. 6032256
  misc_feature (504)..(643): Pfam Id: ResIII Pfam Desc: Type III restriction enzyme, res subunit
  misc_feature (151)..(1269): NCBI GI: 115472199 NCBI Desc: os07g0495900 [oryza sativa (japonica cultivar-group)]
  misc_feature (19)..(1269): NCBI GI: 19569060 NCBI Desc: upf1 [arabidopsis thaliana]
  misc_feature (14)..(1248): NCBI GI: 9759443 NCBI Desc: prematurely terminated mrna decay factor-like protein [arabidopsis thaliana]
  misc_feature (128)..(1137): NCBI GI: 18375673 NCBI Desc: regulator of nonsense transcripts 1 [homo sapiens]
  misc_feature (128)..(1137): NCBI GI: 1885356 NCBI Desc: type 1 rna helicase pnorf1
MATQPPSSAAAAVDLYETASQPDAPAAGDAYTFLEFNTQGDDFDYPDFPELSQPPPRSTPLTSSVPGAGASSSSWPAPPPPPSDAASPEPDLTPQDVPTPLASSSSPSPRSASKARSSAAADGLASGVAALSFEEPVGAGAGEDGYDYGKGDFVEHACRYCGIHNPACVARCNVPSCRKWFCNSRGNTSGSHIVNHLVRAKHKEVCLHKDSPLGETILECYNCGCRNVFLLGFISAKSENVVVLLCREPCLSVNALKDMNWDLSQWCPLIDDRCFLSWLVKVPSEQEQLRARQISAQQINKVEELWKTNPDASLEDLEKPGVDDEPQSVVLKYEDAYQYQNVFAPLIKLEADYDKMMKESQSKDNVTVRWDIGLNKKRVAYFVFPKEDNELRLVPGDELRLRYPGDSSHPTWQSVGHVIKLTAQEEVALELRASQGVPTELNVGFSVDFVWKSTSFDRMQGAMKTFAVDETSVSGYIYHHLLGHEVEHQIIRNTLPRRFGAPGLPELNASQVLAVKSVLQKPVSLIQGPPGTGKTVTSAAIVYHMAKQGQGQVLVCAPSNVAVDQLAEKISSTGLKVVRLCAKSREAVSSPVEHLTLHYQVRHLDTSEKSELHKLQQLKDEQGELSSSDEKKYKALKRATEREILQSADVICCTCVGAGDPRLSNFRFRQVLIDESTQATEPECLIPLVLGVKQVVLVGDHCQLGPVIMCKKAARAGLAQSLFERLVILGVKPFRLQVQYRMHPCLSEFPSNCFYEGTLQNGVTVNERQSSGIDFPWPVPNRPMFFYVQMGQEEISASGTSYLNRTEAANVEKIVTTFLRSGVVPSQIGVITPYEGQRAYIVNYMSRNGSLRQQLYKEIEVASVDSFQGREKDYIILSCVRSNEHQGIGFLNDPRRLNVALTRARYGIVILGNPKVLSKQPLWNSLLTHYKEHECLVEGPLNNLKQSMVQFQKPKKIYNDRRLFLGGGQGVMHGAGASSQAADKRSGRGKGQSFVPYGPPNGVHKPGVHPAGYAVPRMPFPPFPGAPHSQPYTIPTRGLHGPIGAVPPVHQPGSRNFGAPRSNTGGPIGGHLAHQQNSQQAMGGIGSNFNYTGMENPSSQPSGGAQMSQTGLMTQMPVQGLSQTFRDGFSIGGMSQDFFVDDFKSQGSHVPYNIAEFSTQASQGGYGVEFTQAPPSGYSGSYMNQNAHPGYSHIGTTNDIVSQDHMAHGSHGMFTQAGYNDPSQDDSSQIHYGMAAAGPLQSQSMMNPLYSQSYAHYNTQPQSLQPPPQEVDGTTLISHLYRKAIGAYNGTM

SEQ ID NO: 3697 - DNA, 918 bp, Sorghum bicolor
  misc_feature: Ceres ANNOT ID no. 6032260
  misc_feature: Encodes the peptide sequence at SEQ ID NO 3698
  misc_feature: Down-regulated in shoot tissues in response to aminocyclopropane carboxylic treatment
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
atgacgagcatccgccacctcttcctcttcgtcctcttggcgtcgctgcgatgcggtgcggcggctggatacggaggtggcgccgaggggttctgctcggcggagccgtcgagcgagtgctccggtggccagccgctctactggaaggtcacccatcctaccctcgcgcccacgcacctccaagatttacctggcttcacacgtagtgttttcaaaagggatcatgctttaataacaccagagagtcatgttttcagtcccttgcctgattggatcaataccttaggagcatatttgatcagtccagctattggtgcacacttcactatgtatctggcaaacatgcaagatggttcaaaatcatccctaccaccgaaagatgttgaaaggcttgtttttgtactacaagggagcatttcattgactgtggggactggaactacccattctcttctggtggattcctatgcatatcttcctgcaaacacaaaacattctatgatctcagatgaaccaaccactcttgtaatatttgagaggaggtacagtgccgttgaggattcccatcctgatctaattgtcggttcaacagataagcaaccccttcttgaaaccccgggagaggtatttcaactgaggaagctgctaccgacttctctgtcctatgactttaatatccatataatggactttcaaccaggcgaatatctcaatgtaaaggaggttcattataatcaacatggacttcttcttttagaggggcaaggaatataccgcttgggggagagttggtatcctgtgcaagcaggggataccatttggatggcaccatttgttcctcagtggtacgccgctcttggtaagaccaggacgagatacttgctgtacaaagatgtcaataggaatccattgatatga

SEQ ID NO: 3698 - protein, 305 aa, Sorghum bicolor
  misc_feature: Ceres ANNOT ID no. 6032260
  misc_feature (227)..(297): Pfam Id: Cupin_2 Pfam Desc: Cupin domain
  misc_feature (63)..(303): NCBI GI: 83644016 NCBI Desc: uncharacterized protein, possibly involved in glyoxylate utilization [hahella chejuensis kctc 2396]
  misc_feature (65)..(303): NCBI GI: 116222666 NCBI Desc: cupin 2, conserved barrel domain protein [solibacter usitatus ellin6076]
  misc_feature (67)..(302): NCBI GI: 77976886 NCBI Desc: cog3257: uncharacterized protein, possibly involved in glyoxylate utilization [yersinia intermedia atcc 29909]
  misc_feature (67)..(302): NCBI GI: 109648548 NCBI Desc: cupin 2, conserved barrel [desulfitobacterium hafniense dcb-2]
  misc_feature (67)..(302): NCBI GI: 46093540 NCBI Desc: f261 [klebsiella pneumoniae]
  misc_feature: Down-regulated in shoot tissues in response to aminocyclopropane carboxylic treatment
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
MTSIRHLFLFVLLASLRCGAAAGYGGGAEGFCSAEPSSECSGGQPLYWKVTHPTLAPTHLQDLPGFTRSVFKRDHALITPESHVFSPLPDWINTLGAYLISPAIGAHFTMYLANMQDGSKSSLPPKDVERLVFVLQGSISLTVGTGTTHSLLVDSYAYLPANTKHSMISDEPTTLVIFERRYSAVEDSHPDLIVGSTDKQPLLETPGEVFQLRKLLPTSLSYDFNIHIMDFQPGEYLNVKEVHYNQHGLLLLEGQGIYRLGESWYPVQAGDTIWMAPFVPQWYAALGKTRTRYLLYKDVNRNPLI

SEQ ID NO: 3699 - DNA, 3516 bp, Sorghum bicolor
  misc_feature: Ceres ANNOT ID no. 6032264
  misc_feature: Encodes the peptide sequence at SEQ ID NO 3700
atgtcgcgctggaaggagaatggctcacctctcccgctctacccgagcggcgcctccaacccctcccatctcctcccctgcaagcgcccgctgcaatcaccatccccatgcccaccgccgcgccggccgctcgtcgacatcactagcaacgcgctggagcagcggggtgggtacgggtatacaactcccctcgcgaagccttccaggccctgcggccttcttcacgacgacgaagatgacatgaacgaggcattcttgcgggaggtggacgccatctgtgaggagcacgcgcggtccacggccaagaaggagaaggagaagaaggcagcagaggagcataaggggacgggcgaagcgccggtcgcggcggcagcgggtacgattgacgctgcgggaacagagatagcaacgcttgacgatgctttctgggaggaggtgagcgccatctgtgaggagtgtgatgcccagtctgctgccaagagccaggaggggacgaaggaagaagaagaggaggaggagagcttggtgctgtcctgcggtgatgcttcgctcccccctgctatttccatcacagcggagggtgtggagtttgaagatgcattctggaagatcaatgccgttagtgaggaccacagcaccaaagctcatgccaagtatcaggaggggctcaaggggatggaggagaaagatggattgatagcattgtgcggtgatccttcagtttccccagtaatttccattgcaaagggggatggagagcttgtcgatgcactctttggggaggttggtgcctccatccatgaggggcatgctgatatctctgctgctaaggtccaggaggagcagcaagatatggaactagaaaaggaggaagatgaagtgtgtgctccaaagaagtactatgaatatttgcactccttgaatgataggcagaaggaggctgcatgtaatgatgtggctgttccactaatgattgttgctggtccaggaagtggaaagggaattccaccatcaaacattcttgctatgacattcaccacggctgctgcctcagaaatgagagaacggatagggacagtggtgggaaaggcagttgccaaggagatcgcaataagcacatttcactcattctgcttgcagctttgcagaacacatgctgaaaagctaggccgcacatctgaattcataatctatggacatggacaacaacgaagggcggttattgaggcagagcgtctattggaaaatgacaaaaataatggtgttggagatacaactaaacagtatgatgcggacataaaaaattctttcaaagacaaagctaaaaagtggcagaaatttattacacaggcaaaagcttcaggaagaactccagaggactatgaaatgaagggtgatttgacaggagcttctgttcttcggcattacaatgaaatattaagatcttgtaatgctcttgattatcatgattttattaactcatccataacccttctcacgaactttcctgaagtatacaaagagtgtcaggatatgtggcgggcaattgtagttgatgagtttcaggataccagtgctatgcagtattgtcttctgaagattctagcttcccacaatcatataactattgtcggtgatgaagatcagtccatcttcagtttcaatggtgccgatgtatctggcttcgattcatttcgtagagattttccagattacaaagagatcaggttgagcaagaattaccgctccacacgtgcaattgttgaagcagcaacagctctaattcagaacaacagtaagcggcatcatcgtaagcttgtagagaccgacaacccttctggttgtaagatcactgtcaaggagtgccacagtgaagattcacaatgtgcctttgttattgacaaaatcattgaaactacgtctactaccgctgaggggtgcaactttggcaacattgctgtcctatatcgaagacaggtaactggcaaagctttccaagtctccttccgcaacaggaaaattccctttaatgttcatggtgtggcattctacaggaaaaaggtgatcaaagctatcatggcaatacttcggaccacattacctggttgtgatgatggcccgtggtgtcaagccttcaaggctcttttaccttgtgacaaagaagaaaagaagaagattatagatcatgttgaaaagatttcactggctagagagtgtagttttatatctgctgctactgacatcttcagcgctaaggtctctggtaccttcaaaaggtcccagattactcaaggacgtaaggttttatcgactttggatagcctatcaaaacttgttgaaagggaacaatcagtttcagtcatcatttcctctgcgggagacatgctacctcagaaatatctccttgagaagcgtgcagttgttgacattgataatggcaaattattaaatgaagatagtgatatcagatcggtccttcagtttttaatggatgatgtgtctgacttcttgtcaacacatttttctagttcagtggagagaagcaagactgacgagaaaggctgtgcttctacacttcaagctttcattgattatatatctttgagggaaaccgaaaattttcgatcccgaaaggaggaaaataagaattctatcacattaacaactattcatcagtcaaaaggtttggagtgggatgtcgtgtttattgtgcaggcaaatgattcagaaattcctttgttgcatgagtacaattgtactgtgaaagaagctggaagtacactggaggaggagaggaggttactctatgttgcaatgacacgagctcggaaaaagctgtacatcttgcatgttacagttgactctaaccgtcagcttctgcaaccttcacgtttcctcagagaaattccagttcaccttcttgaggtgcagggcgaagagactctgagaaaaatgcctgaacagccttcaggtgatattccttttgatgactctgaagggaatatatcaatcggaaagccaattatgggacagaacgaagtttcaccttatccagaactggctcaaggatgccttgctaatgatttcttgagaaagtttgacattgatgatagatcggtagtctcacatatatttcataattggggaaagaagcaggcatttcaaaatccaaagagattacttgaaaagatcagttttgtgattgatgaacgcctacgtggtaaaggatacaagcgcaaggatgtcttgcgaaaactgaagttgttcctaagcggtgatgaagcattgggctacgcacaatatgttatcaagtgggaacagattccaatagagaagcggagccagttgatgagagaaaggcaggaacatttccaaaagcagaggattgagaactctatgggttcgtcagaacccacagccaagcagatatcgtaccttcgaaacctggggtgcaccatcactccgacttctcgcttgcacgcatcaaatctcatcgaaaagtacaaatcactctga

SEQ ID NO: 3700 - protein, 1171 aa, Sorghum bicolor
  misc_feature: Ceres ANNOT ID no. 6032264
  misc_feature (307)..(785): Pfam Id: UvrD-helicase Pfam Desc: UvrD/REP helicase
  misc_feature (297)..(1019): NCBI GI: 42567136 NCBI Desc: uvrd/rep helicase family protein [arabidopsis thaliana]
  misc_feature (304)..(744): NCBI GI: 78223920 NCBI Desc: uvrd/rep helicase [geobacter metallireducens gs-15]
  misc_feature (304)..(705): NCBI GI: 77920551 NCBI Desc: atp-dependent dna helicase [pelobacter carbinolicus dsm 2380]
  misc_feature (304)..(705): NCBI GI: 106892419 NCBI Desc: uvrd/rep helicase [roseiflexus sp. rs-1]
  misc_feature (285)..(829): NCBI GI: 106895466 NCBI Desc: atp-dependent dna helicase pcra [clostridium sp. ohilas]
MSRWKENGSPLPLYPSGASNPSHLLPCKRPLQSPSPCPPPRRPLVDITSNALEQRGGYGYTTPLAKPSRPCGLLHDDEDDMNEAFLREVDAICEEHARSTAKKEKEKKAAEEHKGTGEAPVAAAAGTIDAAGTEIATLDDAFWEEVSAICEECDAQSAAKSQEGTKEEEEEEESLVLSCGDASLPPAISITAEGVEFEDAFWKINAVSEDHSTKAHAKYQEGLKGMEEKDGLIALCGDPSVSPVISIAKGDGELVDALFGEVGASIHEGHADISAAKVQEEQQDMELEKEEDEVCAPKKYYEYLHSLNDRQKEAACNDVAVPLMIVAGPGSGKGIPPSNILAMTFTTAAASEMRERIGTVVGKAVAKEIAISTFHSFCLQLCRTHAEKLGRTSEFIIYGHGQQRRAVIEAERLLENDKNNGVGDTTKQYDADIKNSFKDKAKKWQKFITQAKASGRTPEDYEMKGDLTGASVLRHYNEILRSCNALDYHDFINSSITLLTNFPEVYKECQDMWRAIVVDEFQDTSAMQYCLLKILASHNHITIVGDEDQSIFSFNGADVSGFDSFRRDFPDYKEIRLSKNYRSTRAIVEAATALIQNNSKRHHRKLVETDNPSGCKITVKECHSEDSQCAFVIDKIIETTSTTAEGCNFGNIAVLYRRQVTGKAFQVSFRNRKIPFNVHGVAFYRKKVIKAIMAILRTTLPGCDDGPWCQAFKALLPCDKEEKKKIIDHVEKISLARECSFISAATDIFSAKVSGTFKRSQITQGRKVLSTLDSLSKLVEREQSVSVIISSAGDMLPQKYLLEKRAVVDIDNGKLLNEDSDIRSVLQFLMDDVSDFLSTHFSSSVERSKTDEKGCASTLQAFIDYISLRETENFRSRKEENKNSITLTTIHQSKGLEWDVVFIVQANDSEIPLLHEYNCTVKEAGSTLEEERRLLYVAMTRARKKLYILHVTVDSNRQLLQPSRFLREIPVHLLEVQGEETLRKMPEQPSGDIPFDDSEGNISIGKPIMGQNEVSPYPELAQGCLANDFLRKFDIDDRSVVSHIFHNWGKKQAFQNPKRLLEKISFVIDERLRGKGYKRKDVLRKLKLFLSGDEALGYAQYVIKWEQIPIEKRSQLMRERQEHFQKQRIENSMGSSEPTAKQISYLRNLGCTITPTSRLHASNLIEKYKSL

SEQ ID NO: 3701 - DNA, 1203 bp, Sorghum bicolor
  misc_feature: Ceres ANNOT ID no. 6032266
  misc_feature: Encodes the peptide sequence at SEQ ID NO 3702
atgggcagcgctcccgccaccgtcggcgatatgaggcgtgcccagcgcgcggatggcccggctgccgtgctaggcatcggcacggcgaacccgccgacgtgcttggcccaggacgagtaccccgactactacttccgcgtcacaaagagcgagcacctcaccgacctcaagggcaagctcaccaggatctgtaacaagtcgggcatcaagaagcgcttcatccaccttgacaagcagctcctcgccgcgaacccggacttcaccgaccgcacgctgccgtccctggacgcccgcgtggagatcgcctccgccgccgtcccggagctggccgcgtccgccgcggccaaggccatcgccgagtggggccgcccagccaccgacatcacccacctcatcttcagcacgtactccggcgcgcgcgcgccgagcgccgaccgccgcctcgcgtccctgctgggcctcagccccacggtgtcccgcaccatactcaacctccacggctgctacggcgggggcaggtcgctccagctcgccaaggagctcgcggagaacaaccgcggcgcgcgcgtcctcgtggcgtgctccgagatcacgctcatcgccttctacgggccggaaggcggctgccccgacaacatcctgggacaggctctgttcggcgacggcgccggtgccgtcatcgtcggcgccgaccctgtcagccccgtggagcgcccgctgttcgagatggccttcgcctcgcagaccaccataccggaaaccgaggatgccatctccatgcagatcaacaagggtggcatggagtatcacatctccaaccaggttccccggttgctgggatgcaacgtggaacgctgcctcgtcgacgcgtttggcgcgcttggcatcaacaatgccgattggaacgacctcttctgggcgatccatcctggcggccgtgccattctggaccatatcgagggagtgctcggcctagacgatggcaaattggcagccagccgccacgtgctcagcgagttcggtaacatgagcggcacaacggtgatcttcgtgctcgacgagctgcgccgccgtcgggttctggcagccaagcaggaggaaggcaaagcaccggagtggggagtcatgatggcattcggaccgggaatcacaatagagaccatggtgctgcgtgcccctaccgccactctggagggaaattag

SEQ ID NO: 3702 - protein, 400 aa, Sorghum bicolor
  misc_feature: Ceres ANNOT ID no. 6032266
  misc_feature (6)..(232): Pfam Id: Chal_sti_synt_N Pfam Desc: Chalcone and stilbene synthases, N-terminal domain
  misc_feature (242)..(394): Pfam Id: Chal_sti_synt_C Pfam Desc: Chalcone and stilbene synthases, C-terminal domain
  misc_feature (294)..(392): Pfam Id: ACP_syn_III_C Pfam Desc: 3-Oxoacyl-[acyl-carrier-protein (ACP)] synthase III C terminal
  misc_feature (1)..(393): NCBI GI: 115472461 NCBI Desc: os07g0525900 [oryza sativa (japonica cultivar-group)]
  misc_feature (1)..(397): NCBI GI: 17978544 NCBI Desc: chalcone synthase 8 [sorghum bicolor]
  misc_feature (4)..(398): NCBI GI: 2253119 NCBI Desc: chalcone synthase [bromheadia finlaysoniana]
  misc_feature (4)..(398): NCBI GI: 2253115 NCBI Desc: chalcone synthase [bromheadia finlaysoniana]
  misc_feature (4)..(398): NCBI GI: 2253117 NCBI Desc: chalcone synthase [bromheadia finlaysoniana]
  misc_feature (4)..(398): SWISSPROT Homolog: EC 2.3.1.74 Chalcone synthase 8
  misc_feature (6)..(396): SWISSPROT Homolog: EC 2.3.1.95 Stilbene synthase 1
  misc_feature (4)..(394): SWISSPROT Homolog: EC 2.3.1.156 Phloroisovalerophenone synthase
  misc_feature: The sequence is a functional homolog of SEQ ID NO 2 in US patent 7202397
MGSAPATVGDMRRAQRADGPAAVLGIGTANPPTCLAQDEYPDYYFRVTKSEHLTDLKGKLTRICNKSGIKKRFIHLDKQLLAANPDFTDRTLPSLDARVEIASAAVPELAASAAAKAIAEWGRPATDITHLIFSTYSGARAPSADRRLASLLGLSPTVSRTILNLHGCYGGGRSLQLAKELAENNRGARVLVACSEITLIAFYGPEGGCPDNILGQALFGDGAGAVIVGADPVSPVERPLFEMAFASQTTIPETEDAISMQINKGGMEYHISNQVPRLLGCNVERCLVDAFGALGINNADWNDLFWAIHPGGRAILDHIEGVLGLDDGKLAASRHVLSEFGNMSGTTVIFVLDELRRRRVLAAKQEEGKAPEWGVMMAFGPGITIETMVLRAPTATLEGN

SEQ ID NO: 3703 - DNA, 657 bp, Sorghum bicolor
  misc_feature: Ceres ANNOT ID no. 6032291
  misc_feature: Encodes the peptide sequence at SEQ ID NO 3704
atgcccgactcctccttcgccagcacaggcatggccccctcgagctcggcagcggcgtccatggccgcgctcgcggccgccgcggcgtctggcgacggctcggacgactccggggcggccaaaaacggtggcgcgcctccgacgcacggggtggaggcgggcaacaatcccgcggagctggcggcggccgtgggtggcgcctccagcagctcctcccgggcggcggcgaggagcagggtcgcggcggctgctggcgcctccggctcctccccggtggcggcggcgaggagcaggggcgccggcgccgtggccgcggcggcgggcggcggcggtggcgtcgggccgagctgccaggtggagcggtgcaacgccgacatgggcgtggagaagcggtacaaccggaggcacaaggtgtgcgacgcgcaccgcaaggcgtccgtcgtcctcctcgccggcctccgccagcgcttctgccagcaatgcagccggttccacgagctgtcgcacttcgacgacaccaagcggagctgccgcctgcgcctggcggggcacaacgagcggcgccggaggaacccggcggaggcgcacgaccagaacggcggccggggcgacccggggaaccaccacctccacatcagatcagataaacctatctaa

SEQ ID NO: 3704 - protein, 218 aa, Sorghum bicolor
  misc_feature: Ceres ANNOT ID no. 6032291
  misc_feature (116)..(194): Pfam Id: SBP Pfam Desc: SBP domain
  misc_feature (85)..(195): NCBI GI: 55419652 NCBI Desc: sbp transcription factor [gossypium hirsutum]
  misc_feature (110)..(210): NCBI GI: 62856979 NCBI Desc: squamosa promoter binding-like protein [betula platyphylla]
  misc_feature (110)..(196): NCBI GI: 92886945 NCBI Desc: sbp [medicago truncatula]
  misc_feature (96)..(196): NCBI GI: 30577630 NCBI Desc: squamosa promoter binding like-protein [betula pendula]
  misc_feature (16)..(195): NCBI GI: 115480037 NCBI Desc: os09g0507100 [oryza sativa (japonica cultivar-group)]
  misc_feature: Useful for making plants with altered Lignin content
  misc_feature: Functional homolog of the protein sequence given in SEQ ID NO 12915
  misc_feature: Useful for making plants with altered terpenoid content
  misc_feature: Useful for making plants with modulated flowering time
  misc_feature: Functional homolog of the protein sequence given in SEQ ID NO 13706
  misc_feature: The sequence is a functional homolog of SEQ ID NO. 452 in the 11/188,298 US application
MPDSSFASTGMAPSSSAAASMAALAAAAASGDGSDDSGAAKNGGAPPTHGVEAGNNPAELAAAVGGASSSSSRAAARSRVAAAAGASGSSPVAAARSRGAGAVAAAAGGGGGVGPSCQVERCNADMGVEKRYNRRHKVCDAHRKASVVLLAGLRQRFCQQCSRFHELSHFDDTKRSCRLRLAGHNERRRRNPAEAHDQNGGRGDPGNHHLHIRSDKPI

SEQ ID NO: 3705 - DNA, 3858 bp, Sorghum bicolor
  misc_feature: Ceres ANNOT ID no. 6032307
  misc_feature: Encodes the peptide sequence at SEQ ID NO 3706
atggaggggaacgggaacgcggaggtcgaccttgacgctacgatgaccaccctaggcccggaggacgacacgtcgcaggggctaattctgacgaacaagcagcgggtcatgtaccggccgccggcggggaagtccgtcctaggtcttgacacccttgctgacaagaaacgggcagcgggaggcggcagtgtgtttaagccaccccctcccaatgtagctgttgctgctgattccatcgatgaagatgagaagccaggacctacagagaatgatgcgccaagcctctccacggcgattcgcagtaactcatcacggcgctatcgaggaagcggttctgatgataaaacatctttgaatgaaccaacagtcactgatgacaatcaaagggccccaacacccagccatcgggatgagacccaccggcaagagacccacatctctggaagctctcaaggttctcgtcctcatggcactcctcgtggttctgattactatgatgatagaggatcccgtgataaatatggtgatcgtgagagatctgcatccattggctatagtagtagtggaaggcgaagataccatgatgatagagaatctcatactaggcgtgacgagcgtgggaggtctacatcaattgaatatactaacaagagaagccgacatgagcatagctcaagaagctcaagaacacctgcaagatctgattgggatgatggacgctgggaatgggaagacacacctcgtcgagattaccgtgataatcgtcctggctccagaagacagcatccaacacgatctcctatgctcgctgctgcatcccccgatgcacgcttggtgtctccttggttaggcgggagtacaccacgttcagcagcgtccccgtgggataatgtatctccttcacctgctccaatacgtgcttctggttcctcaaaagggtcttcttattcacattccagtggaagatcgcaccagctttccttttcatcgacaactagttctaatatcttcgatgctgatagaagtccctcaaatcctgataggaactatgagataactgaggaaatgatgcaagagatggactacaatgctgaccgtgcatggtacgactgtgaagaacacaccaccatgtttgacggtgataattctatgtatcttggagatgataattcctacaaaaagaaggaagcagagatgccgaagaagctgactcgtagagatggtagcttgatgacccttgctcaaagcaaaaagctgtcacagatgactgctgataatgctcagtgggaggatagacaattgttgagatctggagccgttaaaggaacagaagtgcaaactgaatttgatgatgaggaggaacggaaagtaatacttcttgttcatgacacaaagcctccgttcctggatgggagagttgtattcacaaaacaagcagaacctgtaatgcctctgaaggacccaacatctgatatggctattattgcacgcaaaggttctagtctggttagggaaatccgtgaaaagcaaagcatgaacaaatcgaggcaacgattttgggagcttgctggatccaagcttggaaatatcttgggtgttgagaaaacagctgaacaggttgatgcagatactgctgttgttggtgaccaaggtgagattaattttaaagaagaagcaaaattttcacaacatttgaaggataaagcagaagctgtgagtgattttgcaaaatcaaaatccctttctcaacaaagacagtatcttcccatatttactgtacgggatgatctgctacaggttgtgcgtgaaaatcaagtagttgtggttgttggtgaaactggttctgggaagactactcaactgactcagtatttgcatgaggatggatatactaccacaggagttgttggctgtacccaaccaaggcgtgttgctgccatgagtgttgctaagcgagtcagtgaggaaatggagactgatctgggagataaagtcggttatgcaatacggtttgaggatgtcactggtccaaacactataataaagtatatgacagatggagtgcttctccgtgaaaccttgaaagatgctgacctcgataaatatcgtgttattgtcatggatgaagcacatgaaagatcactgaacactgatgttttgtttggtatactgaagaaggttgttgcacgtagacgggattttaaactaatcgtcacatctgcaaccctaaatgcagacaagttctccaagttcttcggaggtgtgcctgttttccatattcctggccggacatttccagttaacattatgttcagtaaaacaccatgtgaggactatgtggaagcggcagtgaagcaggccatgactatccacataaccagtggccctggtgatatcctaatattcatgactgggcaggaagaaatcgaagctacctgctatgcgcttgctgaacgcatggaacagttaatatcatcatccaccaagactgtgcccaagctagagattctgcccatctactcacagttgcctgctgacttgcaagccaagatttttcagaaggctgaagagggcgctcgcaagtgtattgttgctaccaatattgctgagacctcattaacagtcgatggtatcttctatgtcattgataccgggtatgggaagatgaaggtgtacaacccacggatgggtatggatgcccttcaggttttccctgtcagccgggcagctgcagaccagcgtgcaggtagggcaggaagaactggccctggtacatgttacaggttgttcacagaatcagcctaccagaatgagatgctccctaaccctgtgccagagatccaaaggaccaacctggggaatgtggtgcttttactgaaatccctcagggttgaaaacttgcttgactttgactttatggacccacccccccaggagaatatccttaactcaatgtaccaactctgggtgttaggtgcattaaacaatgttggtggccttacagaaattggctggaagatggtggagttccccttggatccaactctggcaaaaatgcttcttatgggggagcaactagagtgccttgatgaggtgctgacaattgtatccatgctatcagtgccctcagtcttcttccggccaaaagaccgagcagaggagagtgatgcggcaagggagaagttctttgtcccagagtctgaccacctgacactcctgaatgtatatcttcagtggaagtctaatcagtatcgaggcgactggtgcaacgaccacttcctccatgtcaagggtctccgcaaggctcgtgaagtgagatctcagctgctggacatactgaaaaccctgaagatccccctgacatcatgccatatggaatgggacgtggtgaggaaagccatctgctctgcatacttccacaactctgcccggttgaagggtgttggggagtacgtcaactgccggaatgggatgccatgccacctgcaccccagcagtgcgctatatggcctcggctatactcctgactacgtcgtctaccacgagcttgtcctgaccaccaaggagtacatgcagtgtgtcaccgcagttgatccgcagtggctagcagagatgggccccatgttcttctcagtgaaggagacagacacctctcttctggaccacaagaagaggcagaaggaagagaagacggcgatggaggaggagatggagaagctgaggcaggagcaagcagaggccgcgcgcatggagaaggagaaggagcgggagaagagagctaagcagcagcagcaggttgctatgccaggcctgaagaagggagcgacttatctgaggcccaggaagatgggtttgtag

SEQ ID NO: 3706 - protein, 1285 aa, Sorghum bicolor
  misc_feature: Ceres ANNOT ID no. 6032307
  misc_feature (983)..(1073): Pfam Id: HA2 Pfam Desc: Helicase associated domain (HA2)
  misc_feature (828)..(922): Pfam Id: Helicase_C Pfam Desc: Helicase conserved C-terminal domain
  misc_feature (591)..(751): Pfam Id: DEAD Pfam Desc: DEAD/DEAH box helicase
  misc_feature (109)..(1285): NCBI GI: 12044832 NCBI Desc: deah-box rna helicase [chlamydomonas reinhardtii]
  misc_feature (125)..(1282): NCBI GI: 85700389 NCBI Desc: pre-mrna splicing factor atp-dependent rna helicase prp16 (atp-dependent rna helicase dhx38) (deah box protein 38)
  misc_feature (125)..(1282): NCBI GI: 3123906 NCBI Desc: pre-mrna splicing factor [homo sapiens]
  misc_feature (125)..(1282): NCBI GI: 40788918 NCBI Desc: kiaa0224 [homo sapiens]
  misc_feature (125)..(1282): NCBI GI: 123981966 NCBI Desc: deah (asp-glu-ala-his) box polypeptide 38 [synthetic construct]
MEGNGNAEVDLDATMTTLGPEDDTSQGLILTNKQRVMYRPPAGKSVLGLDTLADKKRAAGGGSVFKPPPPNVAVAADSIDEDEKPGPTENDAPSLSTAIRSNSSRRYRGSGSDDKTSLNEPTVTDDNQRAPTPSHRDETHRQETHISGSSQGSRPHGTPRGSDYYDDRGSRDKYGDRERSASIGYSSSGRRRYHDDRESHTRRDERGRSTSIEYTNKRSRHEHSSRSSRTPARSDWDDGRWEWEDTPRRDYRDNRPGSRRQHPTRSPMLAAASPDARLVSPWLGGSTPRSAASPWDNVSPSPAPIRASGSSKGSSYSHSSGRSHQLSFSSTTSSNIFDADRSPSNPDRNYEITEEMMQEMDYNADRAWYDCEEHTTMFDGDNSMYLGDDNSYKKKEAEMPKKLTRRDGSLMTLAQSKKLSQMTADNAQWEDRQLLRSGAVKGTEVQTEFDDEEERKVILLVHDTKPPFLDGRVVFTKQAEPVMPLKDPTSDMAIIARKGSSLVREIREKQSMNKSRQRFWELAGSKLGNILGVEKTAEQVDADTAVVGDQGEINFKEEAKFSQHLKDKAEAVSDFAKSKSLSQQRQYLPIFTVRDDLLQVVRENQVVVVVGETGSGKTTQLTQYLHEDGYTTTGVVGCTQPRRVAAMSVAKRVSEEMETDLGDKVGYAIRFEDVTGPNTIIKYMTDGVLLRETLKDADLDKYRVIVMDEAHERSLNTDVLFGILKKVVARRRDFKLIVTSATLNADKFSKFFGGVPVFHIPGRTFPVNIMFSKTPCEDYVEAAVKQAMTIHITSGPGDILIFMTGQEEIEATCYALAERMEQLISSSTKTVPKLEILPIYSQLPADLQAKIFQKAEEGARKCIVATNIAETSLTVDGIFYVIDTGYGKMKVYNPRMGMDALQVFPVSRAAADQRAGRAGRTGPGTCYRLFTESAYQNEMLPNPVPEIQRTNLGNVVLLLKSLRVENLLDFDFMDPPPQENILNSMYQLWVLGALNNVGGLTEIGWKMVEFPLDPTLAKMLLMGEQLECLDEVLTIVSMLSVPSVFFRPKDRAEESDAAREKFFVPESDHLTLLNVYLQWKSNQYRGDWCNDHFLHVKGLRKAREVRSQLLDILKTLKIPLTSCHMEWDVVRKAICSAYFHNSARLKGVGEYVNCRNGMPCHLHPSSALYGLGYTPDYVVYHELVLTTKEYMQCVTAVDPQWLAEMGPMFFSVKETDTSLLDHKKRQKEEKTAMEEEMEKLRQEQAEAARMEKEKEREKRAKQQQQVAMPGLKKGATYLRPRKMGL

SEQ ID NO: 3707 - DNA, 1047 bp, Sorghum bicolor
  misc_feature: Ceres ANNOT ID no. 6032309
  misc_feature: Encodes the peptide sequence at SEQ ID NO 3708
atggaggcgctgaggaagcaggcgagcaagttcaaggagcaggtcgccaagcagcagcaggctgttataaagcagttcagtactactggttatgagcggtcagattccgttgtaattgatgaggttgaactacagagacatcaacagcttgagaaattgtatacttctactcgttctggaagggatttccagaaggacatagttagagcagctgaaggtttggtgtctattggaaacaaacatattgaagtgggaacaaaattttctgaggactgctatagatatggaggtgaaaatactgcaagcgacgaagcccttggaaaagcagcatcactatatggaggtgctttgagaaatattgagaaagagtatgaggatttcaacagaattttatcttctcagactatagacccattgaggtcaatggctatgggtgcacccctggaagatgctcgtggtcttgcacagcgctatagccggatgagacatgaagctgagatcctttcggctgaaattgctagaagaaaggcacgggtaagagaagccccaattcctgagcacactacaaagcttcagcagtcagaagctaaaatgatagagcacaaagcaagcatggctgtgttaggaaaggaagcagcagctgcacttgcagctgttgaatctcagcagcaacgagtgacccttcagaggctggttggcgtggtagaagcagaaaagttattccatctgagattagctgctatccttgatgacgttgaagcagagatgtcctctgagaagcaaaggagagaatcagcaccacctattatatctttgcataagcgtgctgagaaagcccagtacttccttgctgaggcaatgcataatttcaatggaaccacagagaaggaactgagcttaattgttggcgactatgttgtcgttcgtcagattgctcccaatggctgggcggaaggagaatgccgagggaaggctggttggtttccagccgcctatgttgagaggcgagaaaatatccccccaaataaagttttcccacaagcataa

SEQ ID NO: 3708 - protein, 348 aa, Sorghum bicolor
  misc_feature: Ceres ANNOT ID no. 6032309
  misc_feature (282)..(336): Pfam Id: SH3_1 Pfam Desc: SH3 domain
  misc_feature (283)..(336): Pfam Id: SH3_2 Pfam Desc: Variant SH3 domain
  misc_feature (1)..(340): NCBI GI: 21928139 NCBI Desc: at4g18060/f15j5_30 [arabidopsis thaliana]
  misc_feature (1)..(340): NCBI GI: 22328762 NCBI Desc: sh3 domain-containing protein 3 (sh3p3) [arabidopsis thaliana]
  misc_feature (1)..(344): NCBI GI: 92895643 NCBI Desc: sh3; trna-binding arm [medicago truncatula]
  misc_feature (1)..(340): NCBI GI: 16974680 NCBI Desc: sh3 domain-containing protein 3 [arabidopsis thaliana]
  misc_feature (1)..(268): NCBI GI: 38344978 NCBI Desc: osjnba0011l07.8 [oryza sativa (japonica cultivar-group)]
MEALRKQASKFKEQVAKQQQAVIKQFSTTGYERSDSVVIDEVELQRHQQLEKLYTSTRSGRDFQKDIVRAAEGLVSIGNKHIEVGTKFSEDCYRYGGENTASDEALGKAASLYGGALRNIEKEYEDFNRILSSQTIDPLRSMAMGAPLEDARGLAQRYSRMRHEAEILSAEIARRKARVREAPIPEHTTKLQQSEAKMIEHKASMAVLGKEAAAALAAVESQQQRVTLQRLVGVVEAEKLFHLRLAAILDDVEAEMSSEKQRRESAPPIISLHKRAEKAQYFLAEAMHNFNGTTEKELSLIVGDYVVVRQIAPNGWAEGECRGKAGWFPAAYVERRENIPPNKVFPQA

SEQ ID NO: 3709 - DNA, 1065 bp, Sorghum bicolor
  misc_feature: Ceres ANNOT ID no. 6032316
  misc_feature: Encodes the peptide sequence at SEQ ID NO 3710
atggctggcgcggggggtgcgacggctgtgcagcagccggcggcgggggcgcccgccgccgctggtggggccgccaggagcggggtcggggcaggcgccgcgggggcgccggtcgccgacccgcgcgccgaggcgctgcggtgcccgcgctgcgactcggccaacaccaagttctgctactacaacaactactcgctgtcgcagccgcggcacttctgcaaggcgtgcaagcgctactggacgcgcgggggcacgctccgcaacgtccccgtcggcgggggctgccgcaagaacaagcgctccaggagcagcggcggagccggcgggaggaacgggtcctcctcatccgcctccgctgccgcggcagccgtcacgtcgtcctcggcggcgtcgacgctgtccctcccgccgccgacggggtccctgccgtcgctgacctcggcgctgggcctgcccgggggcgcatcgctcgcgtcgctcctcctcgggaccgccggctctggcggtgaccacctcggtctcttccaggccgccatgcagtcggtggtctcctcggaggcgaccgcctacgagatgcagcagcagcagtcgcaggtggaccacctgctaggcctcggctacggaggcgccaccggcgccggcgcgcagatccacctcaagccgtggatgcaggaggccgctggcgcgggcgggatcatggacagcttctacgcgccgctgctgtccagctccctcgtgccggggctggaggagctgcacgtcaaggcggaggtcgccggcgccggggatcaccagcagaagccggcgcccggggaccagcagagcgccagctgggagctgccgacgccgtcctcgtccaacgtcgacgccaacgtcatcgcgtccgacgcgctcatggccgccgcggccgcgtccatgaaccctgcggttagcagctccacctccacggcgccaacaaccgtcccgtcctcgttcatgtactggggcaacggcggcattggcggcgctgccgcggcgtggccagacctcgccaactgcggatcctccattgccacgctcttctag

SEQ ID NO: 3710 - protein, 354 aa, Sorghum bicolor
  misc_feature: Ceres ANNOT ID no. 6032316
  misc_feature (41)..(103): Pfam Id: zf-Dof Pfam Desc: Dof domain, zinc finger
  misc_feature (2)..(157): NCBI GI: 20372895 NCBI Desc: dof zinc finger protein [hordeum vulgare subsp. vulgare]
  misc_feature (2)..(157): NCBI GI: 20372847 NCBI Desc: dof zinc finger protein [hordeum vulgare subsp. vulgare]
  misc_feature (14)..(248): NCBI GI: 115456249 NCBI Desc: os03g0821200 [oryza sativa (japonica cultivar-group)]
  misc_feature (7)..(135): NCBI GI: 4996642 NCBI Desc: dof zinc finger protein [oryza sativa]
  misc_feature (2)..(222): NCBI GI: 21538785 NCBI Desc: dof zinc finger protein [hordeum vulgare subsp. vulgare]
  misc_feature: The sequence is a functional homolog of SEQ ID NO 1133 in the 10/374,780US patent application
  misc_feature: The sequence is a functional homolog of SEQ ID NO 1624 in the 11/479,226US patent application
  misc_feature: The sequence is a functional homolog of SEQ ID NO 1790 in the 10/374,780US patent application
  misc_feature: The sequence is a functional homolog of SEQ ID NO 1967 in the 11/479,226US patent application
  misc_feature: The sequence is a functional homolog of SEQ ID NO 2748 in the 10/374,780US patent application
  misc_feature: The sequence is a functional homolog of SEQ ID NO 394 in the 10/225,066US patent application
  misc_feature: The sequence is a functional homolog of SEQ ID NO 796 in the 10/412,699US patent application
  misc_feature: Useful for making plants with modulated growth and phenotype characteristics
  misc_feature: The sequence is a functional homolog of SEQ ID NO 796 in the 20040045049 US patent application
  misc_feature: The sequence is a functional homolog of SEQ ID NO 394 in the 20050160493 US patent application
  misc_feature: The sequence is a functional homolog of SEQ ID NO 1133 in the 20060162006 US patent application
  misc_feature: The sequence is a functional homolog of SEQ ID NO 1790 in the 20060162006 US patent application
  misc_feature: The sequence is a functional homolog of SEQ ID NO 1967 in the 20070022495 US patent application
  misc_feature: The sequence is a functional homolog of SEQ ID NO. 379 in the 11/188,298 US application
  misc_feature: The sequence is a functional homolog of SEQ ID NO. 489 in the 11/188,298 US application
  misc_feature: The sequence is a functional homolog of SEQ ID NO. 486 in the 11/188,298 US application
MAGAGGATAVQQPAAGAPAAAGGAARSGVGAGAAGAPVADPRAEALRCPRCDSANTKFCYYNNYSLSQPRHFCKACKRYWTRGGTLRNVPVGGGCRKNKRSRSSGGAGGRNGSSSSASAAAAAVTSSSAASTLSLPPPTGSLPSLTSALGLPGGASLASLLLGTAGSGGDHLGLFQAAMQSVVSSEATAYEMQQQQSQVDHLLGLGYGGATGAGAQIHLKPWMQEAAGAGGIMDSFYAPLLSSSLVPGLEELHVKAEVAGAGDHQQKPAPGDQQSASWELPTPSSSNVDANVIASDALMAAAAASMNPAVSSSTSTAPTTVPSSFMYWGNGGIGGAAAAWPDLANCGSSIATLF

SEQ ID NO: 3711 - DNA, 2067 bp, Sorghum bicolor
  misc_feature: Ceres ANNOT ID no. 6032353
  misc_feature: Encodes the peptide sequence at SEQ ID NO 3712
atggccggcacgccggaggagttcccggtgcaggggggccccgagcctgagccgttctccccctccgtcttcctcgaccttcctccgacgccaagcgaagaggacccgccggcctccacggacgacctcgcgctaaccttcatctcgcgcatcctcatggaggaggacatcgacgaaaagttcttgtaccactaccccgaccacccagagctcctccaggcccagcagccattcgcgcagatcctctccgatgcaggcgcctcctccgattttttcgccaccaacaacgatggaagcggcgcctgcacccttccgccatcctcggacgtcccggcgttggccaacaccacctggcccttcgatccagtcgagttcccccagctgttcctgtcctcgccatgcccagacatgggagtgggaatcggcgagttcaccgcagatgatgccaaccgatttttgtttggccagaacagggtaaacatagacatgctcaaccaggcgttcctcaggggcatggaggaggccaaaaaattcttgccgattgacagcagccttctcgtcgaggctcgaggctgcaagccaccacaagtctttatcccaggccatgcgaggaatgaagacaaggtggacagaatgctaacattccaaggaatcagtaatgcccggggccgcaagaagtggtgtaattggcaggacttggagagtacagagatgagcaggaacagcaagctgatggcgctggcagagttggaggaaacagatgagatcattgatgagataattctcaatgagtatcgcttgtgcctcaatggaatgctgggtctggacatcaccatggatagcaaggatgggaatttcgtcaggaaggggaattggaagtctgcgctgagaaggcggagcctgaatgaggcagtggacttccacacattgcttatccactgtgcacaggccatttcgacggacgatcgttggagtgcagccatgctacttgggaagatcaagcagcattcctcaccgaggggggatgccaatcaaaggttggcacattgttttgcagatggattagaggcacgactggcaggcacaggaagccaggtttacaagtcgctcatgtcaaagcgaacctcgcaagtggatatccttaaagcctatcagctgtacctaacagtttgctgcttcaagatgatggcttacaagttctccaacatgaccattgccaatgttattggagggaggagaaaactgcacattgtagactatggcatgcgtgacgggatccagtggccaagcttccttggcattttgtctacttgggaaggtggaccaccagaggtgaggatcaccggcattgacctcccccagcctggattccgcccagctgctcatattgaagagatcggacgccggctcagcaaatgtgcccgacagtttggcataccattcaagttccaaagcattgcggcaaagtgggagatggtttctgttgatgacctgaacattgaccctgacgaggcactcatcatcaatggtctatttgattttgggaacttgatggatgagggtgttgacatatatagcccaagccctagggatatggtcctcaataacatccgagagatgcggccagatgtgtttatcttttgtaatgtcaatggctcccatggcacgccattctttgtaacacggttccgagaggtactgttctttttctcggcattgtttgacatgcttgatgttacagtgccacgggacaatgaccgacgcttgctgattgaacgggtcctctttggacggtttgctatgaatgtcattgcctgtgagggctccgatagggttgagcgccacgagacatataagcaatggcaagtgcggaaccaccgggcaggactaaaacagctgcctttggatccagatattgttaaggtcgtgaggaataaggtcaaggacagctatcataaggactttgtcatcgatatggatcaccaatggctcttggaagggtggaaggggcgcataatctgtgccatgtcgacgtgggtcgcagatgatgctttctcggaacattag

SEQ ID NO: 3712 - protein, 688 aa, Sorghum bicolor
  misc_feature: Ceres ANNOT ID no. 6032353
  misc_feature (280)..(589): Pfam Id: GRAS Pfam Desc: GRAS family transcription factor
  misc_feature (160)..(673): NCBI GI: 115486811 NCBI Desc: os11g0705800 [oryza sativa (japonica cultivar-group)]
  misc_feature (140)..(679): NCBI GI: 32813435 NCBI Desc: scarecrow-like protein [lilium longiflorum]
  misc_feature (235)..(679): NCBI GI: 89474466 NCBI Desc: gras4 [solanum lycopersicum]
  misc_feature (168)..(680): NCBI GI: 125743148 NCBI Desc: scarecrow-like protein 1 [castanea sativa]
  misc_feature (212)..(679): NCBI GI: 90970946 NCBI Desc: gras1 [nicotiana tabacum]
  misc_feature: The sequence is a functional homolog of SEQ ID NO 1324 in the 10/374,780US patent application
  misc_feature: The sequence is a functional homolog of SEQ ID NO 1471 in the 10/412,699US patent application
  misc_feature: The sequence is a functional homolog of SEQ ID NO 1938 in the 10/412,699US patent application
  misc_feature: The sequence is a functional homolog of SEQ ID NO 2202 in the 10/374,780US patent application
  misc_feature: Useful for making plants with modulated growth and phenotype characteristics
  misc_feature: The sequence is a functional homolog of SEQ ID NO 1471 in the 20040045049 US patent application
  misc_feature: The sequence is a functional homolog of SEQ ID NO 1938 in the 20040045049 US patent application
MAGTPEEFPVQGGPEPEPFSPSVFLDLPPTPSEEDPPASTDDLALTFISRILMEEDIDEKFLYHYPDHPELLQAQQPFAQILSDAGASSDFFATNNDGSGACTLPPSSDVPALANTTWPFDPVEFPQLFLSSPCPDMGVGIGEFTADDANRFLFGQNRVNIDMLNQAFLRGMEEAKKFLPIDSSLLVEARGCKPPQVFIPGHARNEDKVDRMLTFQGISNARGRKKWCNWQDLESTEMSRNSKLMALAELEETDEIIDEIILNEYRLCLNGMLGLDITMDSKDGNFVRKGNWKSALRRRSLNEAVDFHTLLIHCAQAISTDDRWSAAMLLGKIKQHSSPRGDANQRLAHCFADGLEARLAGTGSQVYKSLMSKRTSQVDILKAYQLYLTVCCFKMMAYKFSNMTIANVIGGRRKLHIVDYGMRDGIQWPSFLGILSTWEGGPPEVRITGIDLPQPGFRPAAHIEEIGRRLSKCARQFGIPFKFQSIAAKWEMVSVDDLNIDPDEALIINGLFDFGNLMDEGVDIYSPSPRDMVLNNIREMRPDVFIFCNVNGSHGTPFFVTRFREVLFFFSALFDMLDVTVPRDNDRRLLIERVLFGRFAMNVIACEGSDRVERHETYKQWQVRNHRAGLKQLPLDPDIVKVVRNKVKDSYHKDFVIDMDHQWLLEGWKGRIICAMSTWVADDAFSEH

SEQ ID NO: 3713 - DNA, 1083 bp, Sorghum bicolor
  misc_feature: Ceres ANNOT ID no. 6032355
  misc_feature: Encodes the peptide sequence at SEQ ID NO 3714
atgtcgtgctcccacctctccaccgcctggtcctcctcggcgctcgccagcagcgcctccaccacccagcggcgcggaagctccgccccgcgctcgggcctcgtggtgcggtgctccctccgcgagctccgcacccgcatcgactccgtcaagaacacgcagaagatcacggaggccatgaagctggtggccgccgccaaggtccggcgcgcgcaggaggccgtcgtctcctcccgccccttctcggaggcgctggttgaggtgctctacaacatgaaccaggagatccagacggaggacatcgacctgcccctcacccgcacccgccccgtcaagaaggtggcgctcgtggtcctgaccggcgagcgcggcctctgcgggagcttcaacaacaacgtgctcaagaaggcggaggcccgcatcgaggagctcaagcagctgggcctccagtacagcgtcatcagcgtggggaagaaaggcaacgcctacttccagcgccgcccctacatcccgctggagcgggacctggaggtgaacggcgtgcccaccgtcaaggactcgcagtccatctgcgacctcgtctactcgctcttcgtctcggaggaggtggacaaggtggagctgctctactccaagttcgtgtcgctggtgcgctccgaccccatcatccagacgctgctccccatgtcccccaagggcgagatctgcgacatcaacggcgtctgcgtggacgccaccgaggacgagctcttccgcctcaccaccaaggagggcaagctcaccgtggagcgcgagaaggtgaagatcgagacgcagcccttctcccccgtggtgcagttcgagcaggaccccgtgcagatcctcgacgcgctgctcccgctctacctcaacagccagatcctccgtgccctgcaggagtcgctcgccagcgagctcgccgcccggatgagcgccatgagcagcgccaccgacaacgccatcgagctcgccaagaacctctccatcgcctacaaccgacagcgccaggccaagatcaccggggagatcctcgagatcgtcgccggtgccgaagccctcgcctga

SEQ ID NO: 3714 - protein, 360 aa, Sorghum bicolor
  misc_feature: Ceres ANNOT ID no. 6032355
  misc_feature (38)..(359): Pfam Id: ATP-synt Pfam Desc: ATP synthase
  misc_feature (1)..(360): NCBI GI: 110278822 NCBI Desc: atp synthase subunit gamma, chloroplast precursor [contains: inceptin]
  misc_feature (12)..(359): NCBI GI: 19785 NCBI Desc: atp synthase (gamma subunit) [nicotiana tabacum]
  misc_feature (1)..(358): NCBI GI: 531111 NCBI Desc: gamma subunit of the chloroplast atp synthase [spinacia oleracea]
  misc_feature (36)..(358): NCBI GI: 755801 NCBI Desc: atp synthase [spinacia oleracea]
  misc_feature (22)..(355): NCBI GI: 20654 NCBI Desc: atp synthase (gamma subunit) [pisum sativum]
  misc_feature (1)..(360): SWISSPROT Homolog: EC 3.6.3.14 ATP synthase subunit gamma, chloroplast precursor
MSCSHLSTAWSSSALASSASTTQRRGSSAPRSGLVVRCSLRELRTRIDSVKNTQKITEAMKLVAAAKVRRAQEAVVSSRPFSEALVEVLYNMNQEIQTEDIDLPLTRTRPVKKVALVVLTGERGLCGSFNNNVLKKAEARIEELKQLGLQYSVISVGKKGNAYFQRRPYIPLERDLEVNGVPTVKDSQSICDLVYSLFVSEEVDKVELLYSKFVSLVRSDPIIQTLLPMSPKGEICDINGVCVDATEDELFRLTTKEGKLTVEREKVKIETQPFSPVVQFEQDPVQILDALLPLYLNSQILRALQESLASELAARMSAMSSATDNAIELAKNLSIAYNRQRQAKITGEILEIVAGAEALA

SEQ ID NO: 3715 - DNA, 2763 bp, Sorghum bicolor
  misc_feature: Ceres ANNOT ID no. 6032356
  misc_feature: Encodes the peptide sequence at SEQ ID NO 3716
atgccaggcgccgccaccctcagatcgcgcgcggccgtcgcggccgccgcgtgccttgcggtcctcgccgcggcggcgctgctacaccgcaggcgacgccggaacctggcgcccttctcgtctcgccgcctcggggtcggggggcgcccccgccgcgcctgcgaggaggaggagaagccgcaggcccggttcaagcgcgtgctcgcggacaactcctactccccgttcaaacacctacgtcgtcagagtgctcagccgggaagtgcagaaggcgagggacccctgccacctcctcaagaatcatcacaaaaagttcatccatttgaggaagaaatcacatctttgctaaacaacccccctgatttccatagctttatgctgggtgcccagtgcccaaaaatgagtactacatataattgggttgatacagaagctcaactggagcatctggcaagattattaggtgaggaaagagcttttgctgttgatacagagcaacatagcattcggtctttcctaggatatacggcactaatgcagatctccacccagaatgatgactatttgatagacacaatagcattgcatgatgtgatgggcattctacgaccagtctttgctaattcttctatttgtaagatattccatggagctgacaatgatgttctttggcttcaaagggattttcatatttatgttgtgaatatgtttgatactgccaaggcatgtgaaactctatcaaaaccacaaaaatcacttgcatatttgcttgaagtatattgtgaagtgaccactgacaagaccatgcagcgtgaagattggagactgcgtcctctgactcccgaaatgattgagtatgctcgcactgatgctcactatctgttgtacattgcaaattgtttggcatcggagctccatgcaaaagcctgtgatacttccagtgataaaatcaattttttcttcgaggctagtcatcgctcaaatatggatcttgtttggaaattctgtgcatggagggacttaatggctcggatgcatgatgaaagcttacgatatgttctgtcagaccaagctatagctgcccttgctgttagtcttccaaaaggcccaacagaggtgtttgctgtcatatcagaaactgacctaagcatttcaagtatgtacccttccttgtcatcaccgtcacctcttgtggtcgctcatgttgaagaactttgctatctgctagatgacatcactaccagcatggaaggcatctttaaaagtttactggagaagtataaagatccaagtggattatgtcgactgtcagtttataattataaccttataacacacctaagtttgaagcaaacaaatatgttttcttttgctccaagtggagaaaagttgctgacagcaccgcctaataaaaaggcttcacgggatttattcattaaaaagttctcctgcaagtcccctgtatatcacaattgcaggatttatgctagtgatggaagactactttgctactgtgaccacaaaaaattggaatggtatgttcaacgtaatttggcgaaattgattgaagatagtcctccagcaatcatgcttctctttgaacctaaaggtcgtccagaggacgaagataatgagttctatattcagagcaagaaaaatatttgtgttggctgtggagaaaagagccattatattagatacagaataataccatcatgctacaggatgcattttccagaacatctgaagagccatcgttcacatgatattgtacttctttgtgtagactgtcatgaaattgctcattcagcagctgagaaatacaagaggcgaatagcagaagaatttggaatacccctttttgtgcaaaagataatgaactcgggtgatataagtttgattacgagcacatcagtatctgaagataaattgaatggaacaggtgtctccccattgcagctgaggaccgctgccatggctcttctacggcatggatccaccatgccattgaagagatgtgaagagctaatgcagattgtgaagtcatattatggtggtagggatgtgactcctgaagatctcgaggtggcattacttgttggtatgagtcctcatgagcgaaggcgtctggaaaagaaaaagggctattcgttcagagctcaggctcaaaatattattagaaagagcagcagcaataccatctcagaagacagtggacatggatcagaaaattctcattccttatctgagcgatttcctgaggatggaactgagagtaatggtcaacaggagtttgacgagacagagagtcaaaaccagctagagaatttaaccctgagccaggttggctcaagtttgccagtcagcatggaggacaccacttttgatcatgacactgtgacactcaagacagataccaagcagcaagcaagaggcacctgcactcctggaaacagccatgtcgacagggaattatccatccgcgacaattctagccaggccatttccaagaatgctgagaagaagatttccctgttgggtcatgggcatcacggtaaacaagttgtggaacttttgctttcaaatggtggggaagaagctattaaccagttctgccaaagatggaggcagatctttgttgaagctgttcacccccgttatttaccttctggctggaatattaaccacagtggacggcgggatttcggtgacttcagtgtctacaagccaccaaggaaagatgctcaatctgcaagggattag

SEQ ID NO: 3716 - protein, 920 aa, Sorghum bicolor
  misc_feature: Ceres ANNOT ID no. 6032356
  misc_feature (138)..(306): Pfam Id: 3_5_exonuc Pfam Desc: 3'-5' exonuclease
  misc_feature (330)..(783): NCBI GI: 145361633 NCBI Desc: 3'-5' exonuclease/ nucleic acid binding [arabidopsis thaliana]
  misc_feature (466)..(618): NCBI GI: 89304534 NCBI Desc: 3'-5' exonuclease family protein [tetrahymena thermophila sb210]
  misc_feature (59)..(329): NCBI GI: 3859771 NCBI Desc: spac1f3.01 [schizosaccharomyces pombe]
  misc_feature (59)..(319): NCBI GI: 116129847 NCBI Desc: ensangp00000020658 [anopheles gambiae str. pest]
  misc_feature (478)..(685): NCBI GI: 89304535 NCBI Desc: 3'-5' exonuclease family protein [tetrahymena thermophila sb210]
MPGAATLRSRAAVAAAACLAVLAAAALLHRRRRRNLAPFSSRRLGVGGRPRRACEEEEKPQARFKRVLADNSYSPFKHLRRQSAQPGSAEGEGPLPPPQESSQKVHPFEEEITSLLNNPPDFHSFMLGAQCPKMSTTYNWVDTEAQLEHLARLLGEERAFAVDTEQHSIRSFLGYTALMQISTQNDDYLIDTIALHDVMGILRPVFANSSICKIFHGADNDVLWLQRDFHIYVVNMFDTAKACETLSKPQKSLAYLLEVYCEVTTDKTMQREDWRLRPLTPEMIEYARTDAHYLLYIANCLASELHAKACDTSSDKINFFFEASHRSNMDLVWKFCAWRDLMARMHDESLRYVLSDQAIAALAVSLPKGPTEVFAVISETDLSISSMYPSLSSPSPLVVAHVEELCYLLDDITTSMEGIFKSLLEKYKDPSGLCRLSVYNYNLITHLSLKQTNMFSFAPSGEKLLTAPPNKKASRDLFIKKFSCKSPVYHNCRIYASDGRLLCYCDHKKLEWYVQRNLAKLIEDSPPAIMLLFEPKGRPEDEDNEFYIQSKKNICVGCGEKSHYIRYRIIPSCYRMHFPEHLKSHRSHDIVLLCVDCHEIAHSAAEKYKRRIAEEFGIPLFVQKIMNSGDISLITSTSVSEDKLNGTGVSPLQLRTAAMALLRHGSTMPLKRCEELMQIVKSYYGGRDVTPEDLEVALLVGMSPHERRRLEKKKGYSFRAQAQNIIRKSSSNTISEDSGHGSENSHSLSERFPEDGTESNGQQEFDETESQNQLENLTLSQVGSSLPVSMEDTTFDHDTVTLKTDTKQQARGTCTPGNSHVDRELSIRDNSSQAISKNAEKKISLLGHGHHGKQVVELLLSNGGEEAINQFCQRWRQIFVEAVHPRYLPSGWNINHSGRRDFGDFSVYKPPRKDAQSARD

SEQ ID NO: 3717 - DNA, 2940 bp, Sorghum bicolor
  misc_feature: Ceres ANNOT ID no. 6032357
  misc_feature: Encodes the peptide sequence at SEQ ID NO 3718
  misc_feature: Up-regulated in shoot tissues in response to salicylic acid treatment
  misc_feature: Up-regulated in root tissues in response to salicylic acid treatment
atgtacagagcggccgcctcgccgctccgtcacagcctccgccgcctctcctcctcctattccgcggctaccccgctcgctggggccgcccgcttcctcgcgccctcctccgagggtcggctctccgcactcacctcgtctcgcctcctcgggtcggcgccgtgccggtgctgctcaggcgccgggatcgccgagcggcctgcgtctgcgtggcgcggactcgccaccatggctgacggtaatagccgctttgggcatgtgctgacaagcctcccaaagcccggtggtggagagtacgggaagtactacagcttaccagccctgaatgatcctaggatagaaagattgccatattctatccggtatctactggagtcagccatccgcaactgtgacggatttcagattacagagaaggatgtcgaaaacatcattgattgggagaatactgctcccaagctggtggagatacctttcaagcctgcccgtgtgcttctgcaggattttactggtgtcccagctatcgtagatcttgcaagcatgcgcgatgctatggctcaactgggcgatgatcctggcaagattgatcccatgattccagtggatctagtcattgatcattcggtacaggctgatgtggtaaaatcagagaatgccctccaagctaatatgcaacgcgaattcgacaggaacaaggagcgcttcgccttccttcggtggggctctacggcattcaataatatgcttattgttccaccaggttcaggaattgttcaccaggtgaatcttgaatatcttggacgagttgttttcaatacggatggcattttatatcttgacagtgtgctgggaacggattctcacactactatgattgatggaatgggggttgctggctggggtgttgggggaattgaagcagaagcaacaatgcttggtcagccaatgagcatggtcttgcccagtgtagttggatttaaactgacagggaaattgcgtgatggtgttactgcaaccgacttagtcctgacagtgacacatattcttaggaagcatggtgttgttggcaaatttgttgagttttatggtgaggggatgagtgagttagcagttgctaacagggcaacaattgctaacatgtcaccagaatacggtgcaacaatgggcttcttccctgttgatcatgtgacccttggatacctgaagctgacagggagaagtgatgaaaaggttgacatggtagaggcatatcttcgagctaacaaaatgtttgttgattacaacgagactcaaacagaaagagtttactcatcgtacctagagttagatcttgcagatgttgaaccatgtgtttcaggcccgaaaagacctcatgaccgtgttgctctgaaagatatgaaagcagactggcgtgcctgtctcagaaataaagttggttttaagggctttggcatacctaaagagcaacaggataaactagtcaagttcaccttccatggacaacctgcagagattagacatggtagcattgtgatcgctgccataacaagttgcacaaacacctcgaacccaagtgtcatgcttggtgctggccttgttgcaaagaaggcgtgtgagcttggccttgaggttaatccatggattaaaactagtcttgcgccaggatccggggcagtgaccaaatatctgctgaagagtggcttgcaaaagtatttagatcatctaggtttcaacttaattggatatggctgtacaacatgcattggtaactctggggagcttgatgaagatgttgctaaggcagttactgacaacgatatcattgctgctgcagtactctctggtaacaggaacttcgaagggcgaattcatgcattggttcgggccaattaccttgcctcccctcctctggttgtggcctatgcccttgctggcactgttgatattgattttgagacggaaccaattgggaaaggaaaaaatggaaaagatgtgtacttcaaggacatatggccatcaaatgaagaaattgcagaggttgagcaatcaagtgtgctgcctgacatgttcaggagcacctatgaagcaatcacacaaggcaacccaatgtggaaccagctgtcagttcccaaggcaaagcgcttcccatgggaccccagttccacctacattcatgatcctccgttcttcaaggatattacaccgactccgccaggtccacgcagcatagagaatgcctattgcctgttgaagtttggtgacagcatcacgacagaccacatctcaccagctgggagcatccccagggacagccctgctggcatgtacctgcttgagcgcggtgtgcagccaaaggatttcaattcttatggaagccgtcggggcaacgacgaagtgatggcacgaggaacttttgcaaatatcaggattgtgaataggctgttaaatggagaagttggaccgaagacgattcacgtccctacaagtgataagctcttcgtgtttgatgctgcaatgagatacaaagctgatgggcatcataccatagtgttggctggagaggaatatggcagtggaagttctcgggattgggctgccaagggaccaatgttactgggggtcaaagcagtgatcgccaagagtttcgagaggatccaccgcagcaacctcgtgggaatgggagtgttaccgctgtgcttcaagcctggtgaggatgctgattctctggggctcaccggtcatgagcgctacacaataaggctccctaccaatgtgagtgagatacaaccgggccaagatgtccaagtggtcactgacactgggaagtcatttacctgcaagctccggattgataccctggtggagctggcttactttgatcatggcgggatccttcactacgttctgaggaacctggtgaagcagcaacagcagcagtaa

SEQ ID NO: 3718 - protein, 979 aa, Sorghum bicolor
  misc_feature: Ceres ANNOT ID no. 6032357
  misc_feature (135)..(645): Pfam Id: Aconitase Pfam Desc: Aconitase family (aconitate hydratase)
  misc_feature (773)..(903): Pfam Id: Aconitase_C Pfam Desc: Aconitase C-terminal domain
  misc_feature (77)..(975): NCBI GI: 3309243 NCBI Desc: aconitase-iron regulated protein 1 [citrus limon]
  misc_feature (77)..(975): NCBI GI: 7437043 NCBI Desc: aconitate hydratase (ec 4.2.1.3) - cucurbit
  misc_feature (84)..(975): NCBI GI: 4586021 NCBI Desc: cytoplasmic aconitate hydratase [arabidopsis thaliana]
  misc_feature (77)..(975): NCBI GI: 868003 NCBI Desc: aconitase [cucurbita cv. kurokawa amakuri]
  misc_feature (77)..(975): NCBI GI: 1351856 NCBI Desc: aconitate hydratase, cytoplasmic (citrate hydro-lyase) (aconitase)
  misc_feature (72)..(975): SWISSPROT Homolog: EC 4.2.1.3 Aconitate hydratase 2, mitochondrial precursor
  misc_feature: Up-regulated in shoot tissues in response to salicylic acid treatment
  misc_feature: Up-regulated in root tissues in response to salicylic acid treatment
MYRAAASPLRHSLRRLSSSYSAATPLAGAARFLAPSSEGRLSALTSSRLLGSAPCRCCSGAGIAERPASAWRGLATMADGNSRFGHVLTSLPKPGGGEYGKYYSLPALNDPRIERLPYSIRYLLESAIRNCDGFQITEKDVENIIDWENTAPKLVEIPFKPARVLLQDFTGVPAIVDLASMRDAMAQLGDDPGKIDPMIPVDLVIDHSVQADVVKSENALQANMQREFDRNKERFAFLRWGSTAFNNMLIVPPGSGIVHQVNLEYLGRVVFNTDGILYLDSVLGTDSHTTMIDGMGVAGWGVGGIEAEATMLGQPMSMVLPSVVGFKLTGKLRDGVTATDLVLTVTHILRKHGVVGKFVEFYGEGMSELAVANRATIANMSPEYGATMGFFPVDHVTLGYLKLTGRSDEKVDMVEAYLRANKMFVDYNETQTERVYSSYLELDLADVEPCVSGPKRPHDRVALKDMKADWRACLRNKVGFKGFGIPKEQQDKLVKFTFHGQPAEIRHGSIVIAAITSCTNTSNPSVMLGAGLVAKKACELGLEVNPWIKTSLAPGSGAVTKYLLKSGLQKYLDHLGFNLIGYGCTTCIGNSGELDEDVAKAVTDNDIIAAAVLSGNRNFEGRIHALVRANYLASPPLVVAYALAGTVDIDFETEPIGKGKNGKDVYFKDIWPSNEEIAEVEQSSVLPDMFRSTYEAITQGNPMWNQLSVPKAKRFPWDPSSTYIHDPPFFKDITPTPPGPRSIENAYCLLKFGDSITTDHISPAGSIPRDSPAGMYLLERGVQPKDFNSYGSRRGNDEVMARGTFANIRIVNRLLNGEVGPKTIHVPTSDKLFVFDAAMRYKADGHHTIVLAGEEYGSGSSRDWAAKGPMLLGVKAVIAKSFERIHRSNLVGMGVLPLCFKPGEDADSLGLTGHERYTIRLPTNVSEIQPGQDVQVVTDTGKSFTCKLRIDTLVELAYFDHGGILHYVLRNLVKQQQQQ

SEQ ID NO: 3719 - DNA, 3093 bp, Sorghum bicolor
  misc_feature: Ceres ANNOT ID no. 6032361
  misc_feature: Encodes the peptide sequence at SEQ ID NO 3720
atggatttcggtcgccggaaggcggcggcgctggctgcgctctcctcgccgacgccggacaagtccccgaagggcggcgtcgacgcccctatcgccccgctcctcgacgtcctcaactcccacccggacctcttcaccacctcctcctgctccggccgcgtctccgtcctcgcgcagcctccgccgcagcatgagggccagggcgatggcgccaccaagccgaagaagaaggcgcggggcggcgggtgggtatacgtatcgcacgaccccgccgacccggacgccgtggtggagcagctgttcggcgggagcgggtcgggagtggcgggggacgagctcgtgttcaggttcgagccgatgatcgtggcggtggagtgcagggacgccgccgcagctgcggcgctcgtcgcggccgcgatcggtgcaggtttccgtgaatcaggtatcacaagcttgcagaaacgtgcaatggtagcaataagatgctcaattcgcatggaagtgccactggggcagattgacgaacttgttgtttctccggagtatgttcgataccttgttagaattgccaacagtaaaatggaggcaaataaaaggcgaatggatggatttctggatctcttccagactaagggttcaatagaagcaaggtattttggaaatcaagactctgcatggagcaagggtgccaagcatggttttggtaatgctaaacggcatgttctcttatctctttgtctcatcttattattaacgcaggagaagttgtcagaaaagaaaaatcatctctctaccacaacattgaagattagtggtgaaccaattgagaagctcttcctatggggccagtcctcttgtgtgtttactgttggagaagagcagcaggtcctaacttttggtggttttggaggaccaggaagacatgctaggagaaactattcccttctgctcgatcataaatctggttttttgatagaaatgatcttcaaagcatctccttcaccaaggatggggcatacagttactgcagttggtaatagcacttatctaattggaggtagaggtggcccttcagaaattcttgatgatgtctgggttttgctgagcactgggaatacatggtcaaaagtggagtgctgtggagatctgttccaaccaaggcaccgacatgcagctgctgcagtagcttcaaaaatttatgtatttggaggactcagtaatgaaggcatatattcttgtatgaatgtattggacacaaaaaatatgcaatggagtgtacttgctgcttcaggcgaatggccatgtgctcgacattcgcattctatggtgtcatatggtacaaatctattcatgttcggaggtcatgatggccaacgggcgctgaaggacttttacagttttgatacaacaacacttaggtggaacaaggaaaacacaaatgggggatttccgtcacctaggttttcacactgcatgttcatctacaaaaattatcttgggatacttggtggctgtcctattacagaaaacaaccaagaaatttcattgctgaacttaaagcatcgagtctggtttcgtgtttccgttccattactgagccagtccctctgtgtccgtagttcatcggttgtaattaaagatgatcttgttattttaggtggtggtgcatcttgttatgcatttggaaccaaattcagtcaaccaataattcttgatctgcattcagtggagtctatgtttcaatatgataggaacaaagatgacacagttcaaagtcgtgatgcaatatctgctgctgacttgccaagagatgggcaaaatggcatctttgatcatgatacaaaatcacaagatgcttgttctggtggtttgatggattcaggccctctggttcttcaactggagaagacgtatgccaaattagcaaaagacattctgaaaaagtttggatggttggatctttctagaaaagttcgagtgagccatgataatggccatgttctttttcctattaaagaagctttccgagtcctaaatgctgaagagcatatcaagatgacacatgatgtttcatctacctttggggaatcattattgtttactgaaaagaaacttgtcgtagacaacctatctcttaaggatgcattaaatattttgtcatcttgcagtggttcctttatgaaagatgaactagccatcagccgaaagccttccaagtctcctcaaaccatcatgaaagaacttgtatcttctctactggaaagtaaagggatgccccctcagttgttggagcagcttccagctaggtgggagacacttggtgatgtcgtcatacttccgaagacatgttttaagaatccattgtgggaatcagttagcgaggaactttggccactagttgccaagtcacttggtgcacaacgtcttgcacgccaaggtaaaatcatgccaaatggtacaagagatagtacactggaacttcttctgggtgataatggatgggttacccattatgaaaatggcatctgctattcacttgatgcaacaaaatgcatgttttcttctggtaatcgttcagagaaacttcgcatgggacagctaaactgcagagatgaggtggtcgtggatttgtttgctggaattggatactttgttcttccgtttcttgtgaaggctaatgccaagctagtttatgcatgtgaatggaatccacatgctctggaggctcttcggcgcaatgttagtgacaacagtgtggaggatcgatgcattatacttgaaggagataaccgggtgactgcacccaaaggtgttgctgatcgagtctgtcttggattgttaccctcaagtgaatgtagctgggccactgctgttgaagctttaaggattggcggcggcatattgcatatacatgggaatgtcaatgactctgatgagacacgctggttggacaatgttgttgaatccatcagtaatatcgccaaaaaccatggactatcttggaacgtgttagtggagcacgttgaacgtgtcaaatggtacgggccacatattcgccaccttgtagttgatgttagatgccggcaaatctaa

SEQ ID NO: 3720 - protein, 1030 aa, Sorghum bicolor
  misc_feature: Ceres ANNOT ID no. 6032361
  misc_feature (436)..(481): Pfam Id: Kelch_1 Pfam Desc: Kelch motif
  misc_feature (335)..(381): Pfam Id: Kelch_1 Pfam Desc: Kelch motif
  misc_feature (386)..(431): Pfam Id: Kelch_1 Pfam Desc: Kelch motif
  misc_feature (1)..(213): Pfam Id: TYW3 Pfam Desc: TYW3 like
  misc_feature (335)..(381): Pfam Id: Kelch_2 Pfam Desc: Kelch motif
  misc_feature (436)..(481): Pfam Id: Kelch_2 Pfam Desc: Kelch motif
  misc_feature (386)..(431): Pfam Id: Kelch_2 Pfam Desc: Kelch motif
  misc_feature (768)..(970): Pfam Id: Met_10 Pfam Desc: Met-10+ like-protein
  misc_feature (268)..(1030): NCBI GI: 140068638 NCBI Desc: sam (and some other nucleotide) binding motif; serine/threonine protein phosphatase, bsu1 [medicago truncatula]
  misc_feature (1)..(573): NCBI GI: 7267225 NCBI Desc: at4g04670 [arabidopsis thaliana]
  misc_feature (712)..(974): NCBI GI: 33416520 NCBI Desc: 4632406n01rik protein [mus musculus]
  misc_feature (720)..(999): NCBI GI: 143679771 NCBI Desc: trna wybutosine-synthesizing protein 2 homolog (trna methyltransferase 12)
  misc_feature (712)..(974): NCBI GI: 127800251 NCBI Desc: trmt12 protein [rattus norvegicus]
  misc_feature: The sequence is a functional homolog of SEQ ID NO. 354 in the 11/188,298 US application
MDFGRRKAAALAALSSPTPDKSPKGGVDAPIAPLLDVLNSHPDLFTTSSCSGRVSVLAQPPPQHEGQGDGATKPKKKARGGGWVYVSHDPADPDAVVEQLFGGSGSGVAGDELVFRFEPMIVAVECRDAAAAAALVAAAIGAGFRESGITSLQKRAMVAIRCSIRMEVPLGQIDELVVSPEYVRYLVRIANSKMEANKRRMDGFLDLFQTKGSIEARYFGNQDSAWSKGAKHGFGNAKRHVLLSLCLILLLTQEKLSEKKNHLSTTTLKISGEPIEKLFLWGQSSCVFTVGEEQQVLTFGGFGGPGRHARRNYSLLLDHKSGFLIEMIFKASPSPRMGHTVTAVGNSTYLIGGRGGPSEILDDVWVLLSTGNTWSKVECCGDLFQPRHRHAAAAVASKIYVFGGLSNEGIYSCMNVLDTKNMQWSVLAASGEWPCARHSHSMVSYGTNLFMFGGHDGQRALKDFYSFDTTTLRWNKENTNGGFPSPRFSHCMFIYKNYLGILGGCPITENNQEISLLNLKHRVWFRVSVPLLSQSLCVRSSSVVIKDDLVILGGGASCYAFGTKFSQPIILDLHSVESMFQYDRNKDDTVQSRDAISAADLPRDGQNGIFDHDTKSQDACSGGLMDSGPLVLQLEKTYAKLAKDILKKFGWLDLSRKVRVSHDNGHVLFPIKEAFRVLNAEEHIKMTHDVSSTFGESLLFTEKKLVVDNLSLKDALNILSSCSGSFMKDELAISRKPSKSPQTIMKELVSSLLESKGMPPQLLEQLPARWETLGDVVILPKTCFKNPLWESVSEELWPLVAKSLGAQRLARQGKIMPNGTRDSTLELLLGDNGWVTHYENGICYSLDATKCMFSSGNRSEKLRMGQLNCRDEVVVDLFAGIGYFVLPFLVKANAKLVYACEWNPHALEALRRNVSDNSVEDRCIILEGDNRVTAPKGVADRVCLGLLPSSECSWATAVEALRIGGGILHIHGNVNDSDETRWLDNVVESISNIAKNHGLSWNVLVEHVERVKWYGPHIRHLVVDVRCRQI

SEQ ID NO: 3721 - DNA, 540 bp, Sorghum bicolor
  misc_feature: Ceres ANNOT ID no. 6032365
  misc_feature: Encodes the peptide sequence at SEQ ID NO 3722
atggcgtggagcgccgccgccgtctccaggttcgccgccacctccccggccgcggcacccatctccgtcaggctcggagccgccgcctcccgctcctccctgtccttctccagcgggcgacgccgctccgtcgccgcgtccctctcgacctccgccaccgctgtaaaggaggctgttcagacagagaaggcaccggcagctctaggcccttattctcaggccatcaaagcaaacaatcttgtgtttgtttctggagttcttggcttgaatcctgagaccgggaagtttgtatctgaaaatgttgaggagcaaactgagcaggttatgaagaacatgggcgagatattgaaagcaagtggtgctagttattcttcagttgtgaagacaacaatcatgttggctgatctgcaggatttcaagaaagtgaacgaggtctatggcaaatatttcccggcacctgcacctgcacgttcaacataccaagtggcagcgctgccactgaatgccaggattgagatcgagtgcatcgcggctctctaa

SEQ ID NO: 3722 - protein, 179 aa, Sorghum bicolor
  misc_feature: Ceres ANNOT ID no. 6032365
  misc_feature (61)..(179): Pfam Id: Ribonuc_L-PSP Pfam Desc: Endoribonuclease L-PSP
  misc_feature (1)..(179): NCBI GI: 75266239 NCBI Desc: constitutive plastid-lipid associated protein [solanum lycopersicum]
  misc_feature (2)..(179): NCBI GI: 37991674 NCBI Desc: perchloric acid soluble translation inhibitor protein homolog [gentiana triflora]
  misc_feature (21)..(179): NCBI GI: 110739384 NCBI Desc: translational inhibitor protein like [arabidopsis thaliana]
  misc_feature (11)..(177): NCBI GI: 75266304 NCBI Desc: inducible plastid-lipid associated protein [solanum lycopersicum]
  misc_feature (4)..(179): NCBI GI: 75266004 NCBI Desc: plastid-lipid associated protein [cucumis sativus]
MAWSAAAVSRFAATSPAAAPISVRLGAAASRSSLSFSSGRRRSVAASLSTSATAVKEAVQTEKAPAALGPYSQAIKANNLVFVSGVLGLNPETGKFVSENVEEQTEQVMKNMGEILKASGASYSSVVKTTIMLADLQDFKKVNEVYGKYFPAPAPARSTYQVAALPLNARIEIECIAAL

SEQ ID NO: 3723 - DNA, 1491 bp, Sorghum bicolor
  misc_feature: Ceres ANNOT ID no. 6032374
  misc_feature: Encodes the peptide sequence at SEQ ID NO 3724
atgggtcggacaggtgacgacgaccaccgcgtcgtcgactgccggctggaggcgctgctctccggcgccgcctccgaggctccatggctccgtcgcatggcgtctgcgacggcgctggagctgcgtctgctggctcccctcgccgcgccggccgtggtggtctacatgctcatcatcgtcatgtcgtcgaccactcagatcgtgtgcggccagctcggcaacgtccagctcgccgccgcctccctcggcaacaacggcatccaggtcttcgcctacggcctcatgctggggatgggcagcgcggtggagacgctgtgcggtcaggcgtacggcgcggagaagtacgagatgctgggcgtgtacctgcagcgctcgacggtgctgctcatggccaccggcgtgccgctcgccgccatgtacgcgctgtcggagccgctgctcctgctgctgggccagtcgccggagatcgccggcgccgccgccgagttcgcctacggcctcgtcccgcagatcttcgcgtacgccgccaacttccccatccagaagttcctgcaggcgcagagcatcgtggcgcccagcgcctacatcctggcggccagcttcgcgctccacgtcccgctcagctggctcgccgtctacgggctgggcctgggcctgctcggggcctcgctcacgctcagcctcacgtggtgggtgctggtcgcggggcagttcgcgtacatcgtgtggagcccgcgatgccgggccacctggaccgggttcacgtgggccgcattcgccgacctgcccgggttcgccggcctgtccgccgcgtcggcggtcatgctggcgctcgaggtctggtacttccaggtgctcatcctcctcgccggcatgctgccggacccgcaggtcgccctcgactcgctcaccgtctgcacgtcgatccagtcatgggtgttcatgatctctgtgggcttcaatgcagcggccagtgtgagagtagggaacgagctgggcgccggcaaccccaggtctgcggcgttctctgcatggatggtcaccgccctgtcggcgttcgtgtcagcgatagctggcctcgtcactttcctgctccggcacaagctcagctacatcttcaccagcggcgaggtcgtctcgcgcgccgtcgccgacctgtgcccactgctcgttgggaccattgtgctctgcgggatccagcccgtgttatcaggtgtggccgttggctgtgggtggcaagcaacggttgcctacatcaacattggatgctactacttcattggcatacccctcggcgtgctcctcggattcaagtttgattttgggatcaagggattgtggggaggcatgattgggggtaccctcatccaaacactcattttgatctggatcaccttaagaactgactggaacaaggaggtggaggaagcgcggaaaagattagataagtgggacgatacaaggcagcctcttctcgcaagcaaggagtga

SEQ ID NO: 3724 - protein, 496 aa, Sorghum bicolor
  misc_feature: Ceres ANNOT ID no. 6032374
  misc_feature (50)..(210): Pfam Id: MatE Pfam Desc: MatE
  misc_feature (271)..(434): Pfam Id: MatE Pfam Desc: MatE
  misc_feature (12)..(496): NCBI GI: 115472373 NCBI Desc: os07g0516600 [oryza sativa (japonica cultivar-group)]
  misc_feature (2)..(493): NCBI GI: 115453843 NCBI Desc: os03g0571900 [oryza sativa (japonica cultivar-group)]
  misc_feature (16)..(491): NCBI GI: 126363776 NCBI Desc: multi antimicrobial extrusion family protein [nicotiana tabacum]
  misc_feature (16)..(491): NCBI GI: 126363774 NCBI Desc: multi antimicrobial extrusion family protein [nicotiana tabacum]
  misc_feature (12)..(492): NCBI GI: 15081773 NCBI Desc: at1g61890/f8k4_9 [arabidopsis thaliana]
MGRTGDDDHRVVDCRLEALLSGAASEAPWLRRMASATALELRLLAPLAAPAVVVYMLIIVMSSTTQIVCGQLGNVQLAAASLGNNGIQVFAYGLMLGMGSAVETLCGQAYGAEKYEMLGVYLQRSTVLLMATGVPLAAMYALSEPLLLLLGQSPEIAGAAAEFAYGLVPQIFAYAANFPIQKFLQAQSIVAPSAYILAASFALHVPLSWLAVYGLGLGLLGASLTLSLTWWVLVAGQFAYIVWSPRCRATWTGFTWAAFADLPGFAGLSAASAVMLALEVWYFQVLILLAGMLPDPQVALDSLTVCTSIQSWVFMISVGFNAAASVRVGNELGAGNPRSAAFSAWMVTALSAFVSAIAGLVTFLLRHKLSYIFTSGEVVSRAVADLCPLLVGTIVLCGIQPVLSGVAVGCGWQATVAYINIGCYYFIGIPLGVLLGFKFDFGIKGLWGGMIGGTLIQTLILIWITLRTDWNKEVEEARKRLDKWDDTRQPLLASKE

SEQ ID NO: 3725 - DNA, 483 bp, Sorghum bicolor
  misc_feature: Ceres ANNOT ID no. 6032383
  misc_feature: Encodes the peptide sequence at SEQ ID NO 3726
atggattattattacccaatggaaatggaggagcatccaggattcttccggccggcgcagctgccatggcagtggcagtggcagtggcagtggcgcctcttctccctcctctcgtcccagccgccggagctgctcccgccgcggcgccccccggccaaccatgtccgctgggaggagaccgccgccgcgcacctcttctccgcaagcctccctggcgtgcgcaaggaggagattcgggtggaggtggaggacgccaggtacctcgtcatccgcaccgagctggacgacgacgacgacgcgggcgcgaggagcttcggccggaagttccggctgccggggatggtggacgtggacggcatcgcggcggcgtacgcccacggcgtgctgaccgtgacggtcccgcggatgcacacccgggccaggcctgttgccggcgtcctcggcgccggcccggcccgcgaccacgcggcccgggcggcctga

SEQ ID NO: 3726 - protein, 160 aa, Sorghum bicolor
  misc_feature: Ceres ANNOT ID no. 6032383
  misc_feature (56)..(144): Pfam Id: HSP20 Pfam Desc: Hsp20/alpha crystallin family
  misc_feature (53)..(139): NCBI GI: 21592394 NCBI Desc: heat shock protein-like [arabidopsis thaliana]
  misc_feature (52)..(143): NCBI GI: 169101 NCBI Desc: 17.9 kda heat shock protein (hsp17.9)
  misc_feature (52)..(146): NCBI GI: 1122315 NCBI Desc: heat shock protein 17.0 [pennisetum glaucum]
  misc_feature (38)..(146): NCBI GI: 123555 NCBI Desc: 18.1 kda class i heat shock protein (hsp 18.1)
  misc_feature (55)..(146): NCBI GI: 22335 NCBI Desc: heat shock protein 17.2 [zea mays]
  misc_feature: The sequence is a functional homolog of SEQ ID NO. 374 in the 11/188,298 US application
MDYYYPMEMEEHPGFFRPAQLPWQWQWQWQWRLFSLLSSQPPELLPPRRPPANHVRWEETAAAHLFSASLPGVRKEEIRVEVEDARYLVIRTELDDDDDAGARSFGRKFRLPGMVDVDGIAAAYAHGVLTVTVPRMHTRARPVAGVLGAGPARDHAARAA

SEQ ID NO: 3727 - DNA, 2463 bp, Sorghum bicolor
  misc_feature: Ceres ANNOT ID no. 6032399
  misc_feature: Encodes the peptide sequence at SEQ ID NO 3728
atggcagctgtggcgccggcggcggggaaggggaagcgaaagcgccaactctctgaggacgacgtctacctcctcctccacaggtacgctccggggacgatcctgacggcgctgcaggaggtggcgcagcacgcggagggccggcgcatcgactggaaggcggtggttgggaagtcggccacggggatcacctccgcccgcgagtaccagatgctctggcgccacttcgcctatcaccacgacctagaggatagcgtcgacgccggcgaccagcctctgggcgatgacagtgacctggaattggagcttgaacccaatcccatcccgaccaaggaagctttatctgaggcctctgcattagctaaggcactaatatccggatcttcacgtgagcaagcctctggtcatcgcattaacttggatcctcctgtgctgaacacccaaaatgaaaagatagtacgggttccatctgagaaacagcttgctcagagtcattgtataacaaatgttacaggtcctgttgccaattcaaaacagttatctcatataggaccctctcctagccatttggatccaaatggagcttctaaaaagagaaagaagccaaaagcatggtctaaagaggaggatgcagacctagcagctggtgtgcagaagtatggtgaaggaaattgggaggatattttgcatagatgtaactttgatagtacaagaacgcctgatcagttatctcagagatgggcactaaagcgtccaggaggatcaaccaagcctgctagcactaaacatgcttctgttggctcagaggaaagatcagcagctctcaaggcactttcattggctgtcggtcctatgcgtagaacaggagcttatcaacaaagcattcagcataagtctacagcgtttgctcctaagatgccagaagtaagatctgcagcaaccccttcaccggcactggcgctgccagtcccagtcccagttgcaatgccactgcgtgtggcagctcaagtgcagactccgcttcatcaagggcaacaagcttctgtccaagctgcgccaccaaaattgtcaaatgcttcaaataagacacggaagaagcaagcagcccagccaagtcccaccattggtccttcttcaatacaagcagcagcaattgctgctggtgggcgacttgccacagcctcaactgccgcaagttttttaaaagccgcacaatctaagaatgttgtgcacataaaatctctaggagcaacatctttgaaatcttctgcaagctctaaggcatcgattgtggttgagcatggaacacaacctgggggctcccagcacctagaacctctaaatcctagagcagttcatggtgtttcaggagttactgtagttaatcaatcagggccacctgctggggcacgttcgttggaaacaaagaaggcattgagtaccacactagcacctgtcccatgtgaggaggatgactctgaattttgtgtgattacgatagatgacttgtttcctgaagatgcaaaggagccagaagttgtcgatgtaatgcagccggaaactgtggataccaaggcaaagcaaccagaaaccacaggtctcaaggcaaagctgccagaaaacacagatcccaaggcaatgcaacaagaaaccatggaccccaaatcaaagcagccagatacattagaggttgagatagtagatcccaaagataaagacatgctagaatttgatcaatatgttgcttctcaaggaggacacttaaacacggatgagctgaataaaagcaagtgtaccgacagtgcttcccaagcccaaggtcttgttggcagccagaagaagccacagaatctgattcctgcggatgggaaagggaaccctgtaactgtggttgggaaagttaagcctgtaactgctggagtggcagcaactgggaagaagactaaaattcctgtctcacattcagcagcaggaaccccacgtggcattgttgacacagtcaatgccaatgccccaaataaaacactagtaaggagggcagccacccctgtacctgcttgttgccaagcgtcacccctgaagcatgccatgaacacaaaaggtaaccaaatgacaaccagcaatgccacggttttcagttgtggagtaccagccagcagccagactagcaaggttgcagaaggtgctagcaaagcaaatccaccatccagcagcagccaggctaagccgaatggtgtggcggtgaacggtgctaacaaggtggtgaatccaccgtccatcaaccaagctagcgctgcggtgaacaacactaacagggctgcgataccactgtccagcagccaggctagtccgactattgacggtgccaacagagtggctaatccaccacccagcaaccaggctagcacagctgtgaatggtgctgctaacaaggggaatccgccagcagcagccaggcaatag

SEQ ID NO: 3728 - protein, 820 aa, Sorghum bicolor
  misc_feature: Ceres ANNOT ID no. 6032399
  misc_feature (202)..(251): Pfam Id: Myb_DNA-binding Pfam Desc: Myb-like DNA-binding domain
  misc_feature (2)..(689): NCBI GI: 46389878 NCBI Desc: myb-family transcription factor-like protein [oryza sativa (japonica cultivar-group)]
  misc_feature (12)..(283): NCBI GI: 79340059 NCBI Desc: dna binding [arabidopsis thaliana]
  misc_feature (12)..(283): NCBI GI: 22137264 NCBI Desc: at1g09710/f21m12_10 [arabidopsis thaliana]
  misc_feature (12)..(118): NCBI GI: 2160164 NCBI Desc: f21m12.10 gene product [arabidopsis thaliana]
  misc_feature (252)..(818): NCBI GI: 72547036 NCBI Desc: proteophosphoglycan 5 [leishmania major]
MAAVAPAAGKGKRKRQLSEDDVYLLLHRYAPGTILTALQEVAQHAEGRRIDWKAVVGKSATGITSAREYQMLWRHFAYHHDLEDSVDAGDQPLGDDSDLELELEPNPIPTKEALSEASALAKALISGSSREQASGHRINLDPPVLNTQNEKIVRVPSEKQLAQSHCITNVTGPVANSKQLSHIGPSPSHLDPNGASKKRKKPKAWSKEEDADLAAGVQKYGEGNWEDILHRCNFDSTRTPDQLSQRWALKRPGGSTKPASTKHASVGSEERSAALKALSLAVGPMRRTGAYQQSIQHKSTAFAPKMPEVRSAATPSPALALPVPVPVAMPLRVAAQVQTPLHQGQQASVQAAPPKLSNASNKTRKKQAAQPSPTIGPSSIQAAAIAAGGRLATASTAASFLKAAQSKNVVHIKSLGATSLKSSASSKASIVVEHGTQPGGSQHLEPLNPRAVHGVSGVTVVNQSGPPAGARSLETKKALSTTLAPVPCEEDDSEFCVITIDDLFPEDAKEPEVVDVMQPETVDTKAKQPETTGLKAKLPENTDPKAMQQETMDPKSKQPDTLEVEIVDPKDKDMLEFDQYVASQGGHLNTDELNKSKCTDSASQAQGLVGSQKKPQNLIPADGKGNPVTVVGKVKPVTAGVAATGKKTKIPVSHSAAGTPRGIVDTVNANAPNKTLVRRAATPVPACCQASPLKHAMNTKGNQMTTSNATVFSCGVPASSQTSKVAEGASKANPPSSSSQAKPNGVAVNGANKVVNPPSINQASAAVNNTNRAAIPLSSSQASPTIDGANRVANPPPSNQASTAVNGAANKGNPPAAARQ

SEQ ID NO: 3729 - DNA, 2775 bp, Sorghum bicolor
  misc_feature: Ceres ANNOT ID no. 6032416
  misc_feature: Encodes the peptide sequence at SEQ ID NO 3730
atgggctctgctcacttggctgccctgcttctgtgcggctgcatgttcgtcactggaaccgtggcagctagccagaacggcaacctcacaaggccagctgaggtgcgcatcggtgcactgttcacgtttgattcagttatcggaaaggcggtgagacccgctatagagcttgccgttgcagatgtcaatgctgaccctagcatactctgggggacgaacctgagtgttcttatgcaggacaccaattgcagtggctttgttggcaccatagaagcattgcagcttctggctaaagatgtagtcgccgtattaggtccacaatcttcggctgttgctcatgtcatttcccatgctgtcaatgaactccatgtcccacttatctctttcgcagccaccgatcctgccctttcttcccttgaatacccatattttgtgagggctacacatagtgattactaccaaatgggtgctatcgctgccatcattagtcaatatcaatggaaacaagtcattgccatatatgttgatgatgattatggtagaggtggcatctcagtactaggtgatgcccttgcaaaaaggaagtgcaagatatcctacaaagctaagttgccacctggtgctgcaaagacttctatcaaggatatcttgatgcaggtaaatgacatggagtctcgtgtctatgttatccacgttaaccctgactctggtcttaacgtgttcttagctgcaaaatctttgggcatgatgagcagtggctatgtatggatagcgacagactggctttctgcagtgatagattcttctgagcatggtaatcctgatgtgatggaacttacgcagggcgttcttgtgcttcggcagcatatagctgattctgatattcagcatgcttccaagtggaataatcttactaggaatggaagctcttactttatgcatgcttatgactctgtatggttagttgctcatgctgttgagcgttttctgagagaaggggatgctatatctttttctgctgatccaaatttgcaagctaaaaaggaaagtaaccttcagttagattctctcaggattttcaacagtggagataaactactggagaaagtgtggagtgcaaacttctcaggggtttctggtccagttcaatttactttggatcgagatttggtacacccagcctatgatattctgaatattggtggtacaggattaagaaccattggatattggtcaaattcttctggtctctcagttgttgctccagaaagcttaagttcatcagcactggactcttcagtcaacaatgtagaactccatagtgttatatggcctggtcagacttctgagaaacctcgcggttgggtgttttcgtatcatgggaagcctatgaggattggagtacctctccgaacaagctacaaagaatttgttatgcaagacaatggtcctgatggagtaaagggctttgcagttgatgtcttcaaagctgcaataagcttgttgccctatccagtttcatgcaagtttgttttatttggtgatggtttgaagaatcctagctacagtgaacttgttcagaaagtatctgaaaattactttgatgctgcagtaggggacattgctatagtgacgaatagaacaagacttgttgattttacccaaccatatatagaatcgggtcttatcattgtagctccggcaagggtggttgaatcaaatgcttgggcttttttgaaaccattcacctttcggatgtggtgtgtcctagttgttatattcctcttcgtgggtgcagttgtttggatacttgaacaccgcactaatactgagtttcgtggacctccaaggcaacaaattatgacagtatgctggtttagtttctctaccatgttctttgcacacagagagaacacagttagtgcacttggtagatttgtgctgcttatctggctctttgctgtgctcattattaactcaagctacacggcaaacttgacatcacttctcacggttcaggagctgacttcagggatacagggcctcgatagcttgatctctagttcaagtgcaattggctatcaagttggatctttttccagaaactacctcgtggatgagctcaatattgccgagtcccgtttggtgccactgaacagcccatctgattatgcaagagcactagagctaggttcaggaaatggtggtgttgctgcaataattgacgagcttccatatgttgagatcttcctatcaaaatactgcaagttcaagacagttggtcaggttttcacaaaaagtggatggggatttgccttcccaagagattcccctcttgctgaggacttgtcaacagcaatcctggcactatcagagaatggcaatctccaaaggatccatgatgaatggttaagtgcgacagagtgcagtgcagacaacaatggtgctgcgtcgaactccttgagcctatcaagcttctggggcctcttcctcatctgtggccttgcatgtctcgttgctcttgtaattttcttccttcgcatattctgtcagtacagcagatacagtaaccaggtcgaggctcagtttcctgagccccaacagattctgaacagaccagcaaggttaactaccatcaagtcattgatctcttttgttgataagaaagaggaggaggtgaagaatgctctcaagaagagaccaaatggcagtcagcatccaagcattggcagtacagaagaacaatccacattaccacctacatccattgcataa

SEQ ID NO: 3730 - protein, 924 aa, Sorghum bicolor
  misc_feature: Ceres ANNOT ID no. 6032416
  misc_feature (50)..(402): Pfam Id: ANF_receptor Pfam Desc: Receptor family ligand binding region
  misc_feature (583)..(847): Pfam Id: Lig_chan Pfam Desc: Ligand-gated ion channel
  misc_feature (59)..(916): NCBI GI: 115469546 NCBI Desc: os06g0680500 [oryza sativa (japonica cultivar-group)]
  misc_feature (32)..(900): NCBI GI: 5713181 NCBI Desc: ligand-gated channel-like protein precursor [arabidopsis thaliana]
  misc_feature (10)..(902): NCBI GI: 22324479 NCBI Desc: glutamate receptor, ionotropic kainate 5 precursor-like protein [oryza sativa (japonica cultivar-group)]
  misc_feature (31)..(625): NCBI GI: 11358470 NCBI Desc: ionotropic glutamate receptor homolog glr4 [imported] - arabidopsis thaliana
  misc_feature (19)..(917): NCBI GI: 41017241 NCBI Desc: glutamate receptor 3.5 precursor (ligand-gated ion channel 3.5) (ionotropic glutamate receptor glr6)
MGSAHLAALLLCGCMFVTGTVAASQNGNLTRPAEVRIGALFTFDSVIGKAVRPAIELAVADVNADPSILWGTNLSVLMQDTNCSGFVGTIEALQLLAKDVVAVLGPQSSAVAHVISHAVNELHVPLISFAATDPALSSLEYPYFVRATHSDYYQMGAIAAIISQYQWKQVIAIYVDDDYGRGGISVLGDALAKRKCKISYKAKLPPGAAKTSIKDILMQVNDMESRVYVIHVNPDSGLNVFLAAKSLGMMSSGYVWIATDWLSAVIDSSEHGNPDVMELTQGVLVLRQHIADSDIQHASKWNNLTRNGSSYFMHAYDSVWLVAHAVERFLREGDAISFSADPNLQAKKESNLQLDSLRIFNSGDKLLEKVWSANFSGVSGPVQFTLDRDLVHPAYDILNIGGTGLRTIGYWSNSSGLSVVAPESLSSSALDSSVNNVELHSVIWPGQTSEKPRGWVFSYHGKPMRIGVPLRTSYKEFVMQDNGPDGVKGFAVDVFKAAISLLPYPVSCKFVLFGDGLKNPSYSELVQKVSENYFDAAVGDIAIVTNRTRLVDFTQPYIESGLIIVAPARVVESNAWAFLKPFTFRMWCVLVVIFLFVGAVVWILEHRTNTEFRGPPRQQIMTVCWFSFSTMFFAHRENTVSALGRFVLLIWLFAVLIINSSYTANLTSLLTVQELTSGIQGLDSLISSSSAIGYQVGSFSRNYLVDELNIAESRLVPLNSPSDYARALELGSGNGGVAAIIDELPYVEIFLSKYCKFKTVGQVFTKSGWGFAFPRDSPLAEDLSTAILALSENGNLQRIHDEWLSATECSADNNGAASNSLSLSSFWGLFLICGLACLVALVIFFLRIFCQYSRYSNQVEAQFPEPQQILNRPARLTTIKSLISFVDKKEEEVKNALKKRPNGSQHPSIGSTEEQSTLPPTSIA

SEQ ID NO: 3731 - DNA, 939 bp, Sorghum bicolor
  misc_feature: Ceres ANNOT ID no. 6032417
  misc_feature: Encodes the peptide sequence at SEQ ID NO 3732
atgaccaccaccacgacaacggcgccggcggcgaccatgaacgttaccacggtcgcgcagctctgcgcggggccacggcagcgcaagccggcggcggcagcagcagcggcaggggctcgggtcgacctgcgctgggcgcgcctgctccgcctcgccgtcgtcaccagggtctgctcgcctgctcctcctgcggcggcggcggcggggacggcaccaccgcacaccgcccgcggccggtaccgccgcctcggcccgcccaacgccggtcccgtgctgtcaccggtcgacagggacgacgacgactgcgccgccgatgccgacgctgacgccgaagccgcccctcgcgacgcggctgacgatgtcgataacgtcgttagcctcaaggtcagcctgctcggcgattgccagattggcaagaccagcttcatggttaagtatgtgggagacgacggggaggagcagaacggtttgcagatgactggcctgaatctcatggacaagacgatggccgtcaggggagctaggattgcctacagcatctgggatgtggcaggagaccaccagtctgtcgaccacatcccgatcgcttgcaaggacgccgtggcgatcctctacatgtttgatctcacgagccgctgcacgcttaataacattgtagattggtacgagagggcaaggaaatggaataagacggctattccaatcctaatcgggacaaagtttgatgactttgctcagcttcctcttgaaatgcaatgggccatcgttaaccaggccagagcatacgcaagagcgatgaaggcgaccctcttcttctcgagcgcgacgcacaacatcaacgtgaacaagatcttcaagttcatcactgccaagctcttcaacctgccgtggacggtggagcgcaacctcaccatcggcgagcccatcatagacttctga

SEQ ID NO: 3732 - protein, 312 aa, Sorghum bicolor
  misc_feature: Ceres ANNOT ID no. 6032417
  misc_feature (128)..(242): Pfam Id: Miro Pfam Desc: Miro-like protein
  misc_feature (128)..(294): Pfam Id: Ras Pfam Desc: Ras family
  misc_feature (144)..(312): NCBI GI: 115472433 NCBI Desc: os07g0522900 [oryza sativa (japonica cultivar-group)]
  misc_feature (80)..(312): NCBI GI: 9758264 NCBI Desc: sgp1 monomeric g-protein [arabidopsis thaliana]
  misc_feature (120)..(312): NCBI GI: 92876222 NCBI Desc: ras small gtpase, rab type [medicago truncatula]
  misc_feature (118)..(312): NCBI GI: 2408103 NCBI Desc: sid3 [schizosaccharomyces pombe]
  misc_feature (117)..(312): NCBI GI: 60463433 NCBI Desc: rab gtpase [dictyostelium discoideum]
  misc_feature: The sequence is a functional homolog of SEQ ID NO. 400 in the 11/188,298 US application
MTTTTTTAPAATMNVTTVAQLCAGPRQRKPAAAAAAAGARVDLRWARLLRLAVVTRVCSPAPPAAAAAGTAPPHTARGRYRRLGPPNAGPVLSPVDRDDDDCAADADADAEAAPRDAADDVDNVVSLKVSLLGDCQIGKTSFMVKYVGDDGEEQNGLQMTGLNLMDKTMAVRGARIAYSIWDVAGDHQSVDHIPIACKDAVAILYMFDLTSRCTLNNIVDWYERARKWNKTAIPILIGTKFDDFAQLPLEMQWAIVNQARAYARAMKATLFFSSATHNINVNKIFKFITAKLFNLPWTVERNLTIGEPIIDF

SEQ ID NO: 3733 - DNA, 636 bp, Sorghum bicolor
  misc_feature: Ceres ANNOT ID no. 6032423
  misc_feature: Encodes the peptide sequence at SEQ ID NO 3734
atggaagatttagtcagtagcccatctttcaggagcgtccttagctgtagtgaagggcaggctcagtcaggagagagttcttggacggattactttgtggatttcatgttatccgaggaggagaggaagagacaagcagatgctggttcatactgcgccaccgaagacgaaggcaaaaatgatggtgatgatggaagctgccgtgaggaggaagaagaggaggattccatgatctctgatgccgcctctcatgccccatggcctactgcagcactgctgcctggcaggtacaaggagttgaagaagctcaagaagaagcctttcagcaaggccctggatcatgatggttcccttgaggatactgcaagctctccagtgaatagcccaaaggtcagtgttgtgtcacagctggaattgagtcctaaaaggaggtgcaacatcagggacctcaccaaggaagttggaattggcgatgatcacggaggagaggggatggactgtacagatgcagccatggaaggagcgagatttggtgatcagagtcagacaagtatagctccatgtgcagacctcaaggacaaggggatttgtttgttccccatttccgtcctgctacactaccatgggccaaactga

SEQ ID NO: 3734 - protein, 211 aa, Sorghum bicolor
  misc_feature: Ceres ANNOT ID no. 6032423
  misc_feature (113)..(209): NCBI GI: 116312006 NCBI Desc: osigba0117n13.7 [oryza sativa (indica cultivar-group)]
  misc_feature: The plant is abnormally small.
  misc_feature: The plant produces a reduced number of seeds.
  misc_feature: Useful for biocontainment applications
  misc_feature: Useful for making plants with modulated biomass
  misc_feature: GREAT-hit functional homolog of the protein sequence given in SEQ ID NO 13004
  misc_feature: Useful for biocontainment applications
  misc_feature: Useful for making plants with modulated biomass
  misc_feature: Functional homolog of the protein sequence given in SEQ ID NO 13004
MEDLVSSPSFRSVLSCSEGQAQSGESSWTDYFVDFMLSEEERKRQADAGSYCATEDEGKNDGDDGSCREEEEEEDSMISDAASHAPWPTAALLPGRYKELKKLKKKPFSKALDHDGSLEDTASSPVNSPKVSVVSQLELSPKRRCNIRDLTKEVGIGDDHGGEGMDCTDAAMEGARFGDQSQTSIAPCADLKDKGICLFPISVLLHYHGPN

SEQ ID NO: 3735 - DNA, 1458 bp, Sorghum bicolor
  misc_feature: Ceres ANNOT ID no. 6032425
  misc_feature: Encodes the peptide sequence at SEQ ID NO 3736
atgatctcctcaagcaagctcaagtccgtcgacttctacaggaaaatccctagggatttgactgaggcatcactatctggcgctggattatccatagtagcagcactagccatggtgtttttgtttggaatggagttgagcaattacttagcagtcaatactaccacatctgtgattgttgataggagttcagatggggagtttttacggatagatttcaatataagctttcctgcactttcatgtgaatttgtatcagttgatgttagtgatgtgctgggaacaaacagattgaacataaggaaaactgttcgaaagtattcaattgatcggaattttgtaccaactggatcagaattccaccccgggcctatccccactgtcaataagcatggagatgatgttgaagaggatcatgtggatggtgcattttcattgtcatctcgcaattttgatagcttttcacaccaatatcctgttttggttgtcaacttctatgctccctggtgttactggagcaatcgactgaaaccttcctgggagaagacagcaaaaataattagggagagatatgaccctgaaatggatggtagaatccttctaggcaaagttgattgcactgaggaagttgacttgtgtaggagacaccacatacaaggatacccatccattcgcgttttccgtaaagggtctgatataaaggaaaatcagggtcaccatgaccatgaatcatactatggggaacgtgatactgagagtttagtcgcggcaatggaaacatacgtagcaaacattccaaaagaggctcatgtgcttgctttggaagacaaatccaataagactgctgatcctgcaaagcgccctgctccaatgaccagtgggtgcagaatagaaggttttgtgcgggtcaaaagggttccagggagtgttattgtcgcagctcgatctggatctcactcatttgatccatcccagataaatgtttcacactatgtgacacagttctcatttggcaagagactttcgcataggatgcttgatgaattcacaagacttactccctatcttagtggatacaatgatagattagctggccagtcttatattgttaagcatggcgaggttaacgccaatgttactattgagcactaccttcaagttgtgaagactgagattgtaacacagaggtcgtcaaaggaactaaaagtgctcgaggaatatgaatacacagcacacagcagcttggtgcacagcttctatgttcctgttgtgaaattccatgttgagccttctcccatgcaggtcttggtaactgaagttccgagatccttctcccatttcatcacaaatgtctgcgctatcattggtggagtcttcacggttgctggaatactggattccatctttcacaacacactcaggatggtgaagaaggttgagctgggaaagaacatttaa

SEQ ID NO: 3736 - protein, 485 aa, Sorghum bicolor
  misc_feature: Ceres ANNOT ID no. 6032425
  misc_feature (142)..(261): Pfam Id: Thioredoxin Pfam Desc: Thioredoxin
  misc_feature (1)..(485): NCBI GI: 59861281 NCBI Desc: protein disulfide isomerase [zea mays]
  misc_feature (1)..(485): NCBI GI: 50508559 NCBI Desc: thioredoxin family-like protein [oryza sativa (japonica cultivar-group)]
  misc_feature (1)..(485): NCBI GI: 42562656 NCBI Desc: thioredoxin-related [arabidopsis thaliana]
  misc_feature (294)..(483): NCBI GI: 59857741 NCBI Desc: serologically defined breast cancer antigen 84 isoform b [bos taurus]
  misc_feature (294)..(483): NCBI GI: 38347102 NCBI Desc: osjnba0006m15.17 [oryza sativa (japonica cultivar-group)]
MISSSKLKSVDFYRKIPRDLTEASLSGAGLSIVAALAMVFLFGMELSNYLAVNTTTSVIVDRSSDGEFLRIDFNISFPALSCEFVSVDVSDVLGTNRLNIRKTVRKYSIDRNFVPTGSEFHPGPIPTVNKHGDDVEEDHVDGAFSLSSRNFDSFSHQYPVLVVNFYAPWCYWSNRLKPSWEKTAKIIRERYDPEMDGRILLGKVDCTEEVDLCRRHHIQGYPSIRVFRKGSDIKENQGHHDHESYYGERDTESLVAAMETYVANIPKEAHVLALEDKSNKTADPAKRPAPMTSGCRIEGFVRVKRVPGSVIVAARSGSHSFDPSQINVSHYVTQFSFGKRLSHRMLDEFTRLTPYLSGYNDRLAGQSYIVKHGEVNANVTIEHYLQVVKTEIVTQRSSKELKVLEEYEYTAHSSLVHSFYVPVVKFHVEPSPMQVLVTEVPRSFSHFITNVCAIIGGVFTVAGILDSIFHNTLRMVKKVELGKNI

SEQ ID NO: 3737 - DNA, 699 bp, Sorghum bicolor
  misc_feature: Ceres ANNOT ID no. 6032427
  misc_feature: Encodes the peptide sequence at SEQ ID NO 3738
atgagcaaagacaaggcgagcaagctggcgaggcggaaggcgcactgcatggcgtgctgcgtggcgctgggcgtgctcgtcatcctgggcgcgctggcgctggccttctacctggtgtaccgtccgcgtccgccgcgcgtggtggcgacgcccgtggacatcagcgtcgacgagttcagcctgctcccgcacccgacgctcaaggtgtcggtgggcgtgcacgtggtggtgagcaacccgagccactcgccgtaccggtacggcccgacgctgagcgcggtgacgtaccacggcgcgcccgtcggggagacgctggtgccggcgggcgaggtcgggggcaaggccacggcgcggatcgagccggccacggtggtggacggcgtgaaggtggccgagaacccgcacttcgcgtccgacgccgtggccggggtgctgccgttcgtggccgtggcgagggtggtgggcaaggcgctcgtgctcagggccttcgaggtgcccgtcaccgtcgagaccgtgtgcttcgtccgcatgtacgtgttccacggcgagagcagctcccggtgcgtgtccaccgtccgcaccggcgccgccgccgcgtcggcgtcgcggtccggcaacgggaacggctacggctacggctacggctatggcgcggggttcccagctgaggcggcagggcgtgcgcaggagcatgactag

SEQ ID NO: 3738 - protein, 232 aa, Sorghum bicolor
  misc_feature: Ceres ANNOT ID no. 6032427
  misc_feature (37)..(173): Pfam Id: Hin1 Pfam Desc: Harpin-induced protein 1 (Hin1)
  misc_feature (8)..(188): NCBI GI: 115435516 NCBI Desc: os01g0234700 [oryza sativa (japonica cultivar-group)]
  misc_feature (11)..(193): NCBI GI: 94549041 NCBI Desc: plant cell wall protein sltfr88 [lycopersicon esculentum]
  misc_feature (9)..(192): NCBI GI: 15624041 NCBI Desc: b1060h01.30 [oryza sativa (japonica cultivar-group)]
  misc_feature (5)..(173): NCBI GI: 92896037 NCBI Desc: harpin-induced 1 [medicago truncatula]
  misc_feature (18)..(154): NCBI GI: 3193310 NCBI Desc: contains similarity to nicotiana tabacum hin1 (gb:y07563) [arabidopsis thaliana]
  misc_feature: Useful for making ornamental plants with delayed petal abscission
  misc_feature: Functional homolog of the protein sequence given in SEQ ID NO 13453
MSKDKASKLARRKAHCMACCVALGVLVILGALALAFYLVYRPRPPRVVATPVDISVDEFSLLPHPTLKVSVGVHVVVSNPSHSPYRYGPTLSAVTYHGAPVGETLVPAGEVGGKATARIEPATVVDGVKVAENPHFASDAVAGVLPFVAVARVVGKALVLRAFEVPVTVETVCFVRMYVFHGESSSRCVSTVRTGAAAASASRSGNGNGYGYGYGYGAGFPAEAAGRAQEHD

SEQ ID NO: 3739 - DNA, 1692 bp, Sorghum bicolor
  misc_feature: Ceres ANNOT ID no. 6032449
  misc_feature: Encodes the peptide sequence at SEQ ID NO 3740
atggaggaggaagggcggttcgaggcggaggtggcggaagtggagtcatggtggacgacggagcggttccggctcaccaagcgcccctacaccgcccgcgacgtggtcctcctccggggcacgctccgccagagctacgcgtcgggggagatggccaagaagctgtggcgcacgctcaaggcgcaccaggccgggggcacggcgtcccgcaccttcggcgcgctggaccccgtccaggtcaccatgatggccaagcacctggacaccatctacgtctccggctggcagtgctcctccacgcacacctccaccaacgagcccggcccggacctcgccgactacccctacgacaccgtgcccaacaaggtggagcacctcttcttcgcgcagctctaccacgaccgcaagcagcgggaggcgcgcatgtcgctgccccgcgccgaccgggccagggcgccctacgtcgacttcctcaagcccatcatcgccgacggcgacaccgggttcggcggcgccacggccaccgtcaagctctgcaagctcttcgtcgagcgcggggcggcgggcgtccacctcgaggaccagtcgtcggtcaccaagaagtgcgggcacatggccgggaaggtgctcgtcgcggtgtcggagcacgtcaaccgcctcgtcgccgcgcggctccagttcgacgtcatgggcgtcgagaccgtcctcgtcgcgcgcaccgacgccgtcgccgccacgctgatccagaccaacgtcgacgcgcgcgaccaccagttcatcctcggcgccaccaacccgcgcctgaggggacagagcctggcggccgtgctgtcggacggcatggcggcgggcaagaacggcagggagctgcaggccatcgaggacgagtggctcgccgcggcgcagctcaagaccttctccgactgcgtcagggacgccatcgcggggctcgccgtctccgcccaggagaagcagcgcagggtccaggagtgggaccgcgccaccggcgctggcggctacgacaggtgcgtgtccaacgagcaggcgcgcgacatcgccgcggggctcggcgtcgcgtccgtgttctgggactgggacctcccgcggaccagggaagggttctaccggttccggggctccgtgggcgccgccgtggtccggggccgcgccttcgcgccgcacgccgacgtgctgtggatggagacgtccagccccaacgtggccgagtgcaccgccttcgccgagggcgtcaaggcggcgtgcccggaggcgatgctggcctacaacctctcgccgtccttcaactgggacgcctccgggatgacggacgccgagatggcggccttcatccccagcgtcgcacgcctcgggtacgtctggcagttcatcacgctcgccgggttccacgccgacgcgctcgtcaccgacacgttcgcgcgggacttcgcgcggcggggcatgctggcctacgtggagaggatccagagggaggagaggatcaacggcgtggagacgctggagcaccagaagtggtcgggcgccaatttctatgacagggtgctcaagacggtgcagggtggcatctcctcaactgcagccatgggcaaaggagttactgaagagcaattcaaggattcaaggccggcaactgggagcagtggcctgcaagttatggccaaatccaggatttga

SEQ ID NO: 3740 - protein, 563 aa, Sorghum bicolor
  misc_feature: Ceres ANNOT ID no. 6032449
  misc_feature (10)..(543): Pfam Id: ICL Pfam Desc: Isocitrate lyase family
  misc_feature (1)..(563): NCBI GI: 119732335 NCBI Desc: isocitrate lyase [oryza sativa (japonica cultivar-group)]
  misc_feature (1)..(563): NCBI GI: 8134299 NCBI Desc: isocitrate lyase (isocitrase) (isocitratase) (icl)
  misc_feature (1)..(563): NCBI GI: 1695645 NCBI Desc: isocitrate lyase [cucurbita cv. kurokawa amakuri]
  misc_feature (1)..(563): NCBI GI: 1052578 NCBI Desc: isocitrate lyase [cucumis sativus]
  misc_feature (1)..(563): NCBI GI: 113032 NCBI Desc: isocitrate lyase (isocitrase) (isocitratase) (icl)
  misc_feature (1)..(563): SWISSPROT Homolog: EC 4.1.3.1 Isocitrate lyase
MEEEGRFEAEVAEVESWWTTERFRLTKRPYTARDVVLLRGTLRQSYASGEMAKKLWRTLKAHQAGGTASRTFGALDPVQVTMMAKHLDTIYVSGWQCSSTHTSTNEPGPDLADYPYDTVPNKVEHLFFAQLYHDRKQREARMSLPRADRARAPYVDFLKPIIADGDTGFGGATATVKLCKLFVERGAAGVHLEDQSSVTKKCGHMAGKVLVAVSEHVNRLVAARLQFDVMGVETVLVARTDAVAATLIQTNVDARDHQFILGATNPRLRGQSLAAVLSDGMAAGKNGRELQAIEDEWLAAAQLKTFSDCVRDAIAGLAVSAQEKQRRVQEWDRATGAGGYDRCVSNEQARDIAAGLGVASVFWDWDLPRTREGFYRFRGSVGAAVVRGRAFAPHADVLWMETSSPNVAECTAFAEGVKAACPEAMLAYNLSPSFNWDASGMTDAEMAAFIPSVARLGYVWQFITLAGFHADALVTDTFARDFARRGMLAYVERIQREERINGVETLEHQKWSGANFYDRVLKTVQGGISSTAAMGKGVTEEQFKDSRPATGSSGLQVMAKSRI

SEQ ID NO: 3741 - DNA, 2007 bp, Sorghum bicolor
  misc_feature: Ceres ANNOT ID no. 6032453
  misc_feature: Encodes the peptide sequence at SEQ ID NO 3742
atggcctccgcatctcgagtgaggcttggcactctagtccctcttaccaaggacaatgctggctcatcgaacggatctgtatcaaacattcccatattccaggggtccaatgtagttgggagggatcatttggttgtcgtcgacaagaggatcagccgcaagcatctgagcctccacgcctccactgatggctccattgaagtagtagtggaaggtccaaaccctataatggtgcgatcgaatgggcagaggaggaaggtttgtgctacagggaaagccaagattgcacacggtgatgtcctggaactgattcctggtgactatttcgtgaagtatgtggacatgggtgatgaacataaaatttctgtaccaatgcatttgagcgacttaaagaagggtaagaggcatagtgaggaagatagtgcagcagtcaagaggaatagacagattatggaagatgaggctttggcaagaacactacaggaaagcttcgcggaagacaacacagctgtttctggcatgacttctggccaaaaaataagctcacatgacagtgctggttcttctggaagaaataatgagagaaaacactctattggtcctttgaaagatatgctcccattgacttttcggctcatgcgtgtccaaggtcttccatcatggactaacacttcctcagttagcattcaagatgtcattcagggtgaagtgcttcttgctgtactctcaaattacatggtggacattgactggttgcttactgcatgtccaagtttgaagaaggttccacatgtcctggttctacatggacaagatggtgcttcattaaagcttatgaagaaactgaagcctgcaaattggatcctccacaaacctccactcccaatttcatttggaacacatcattctaaggccatgttgcttgtatatcctcaaggaattcgaattgttgtgcacacagcaaatttgatacatgttgactggaattacaaaagtcagggactatggatgcaagattttccctggaaagacacaaatgatatgaataataaagttccctttgagaatgatctagttgattatctcagtgcacttaagtggcctgagttcagcgtaaatctccccgaggttggtgatgtcaacatcaatgcagcattctttaggaaatttgactatagaaattcaatggtcaggttgattggatcggttcctggttatcatgtgggccccaatattagaaagtggggccatatgaagcttaggaatgttcttgatgaaatcacgttcaataaacaattttgcaagtcccctttgatttatcagttttcttccctggggtcacttgatgagaaatggatgagtgaatttgcatgctcgctgtcagctggtaaatcagatgatggatcacagctaggaatcgggaaaccactgattgtctggcctacagtggaggatgttcggtgctcaatagagggttatgcagctggtagttgcattccaagccctcaaaagaatgttgagaaagacttcttgaagaaatattggtccaggtggaaagcggatcatgtaggtcgctgtcgggctatgcctcacataaaaacttttactcgttacagtggccaaaacatcgcatggtttctgcttacctcatcaaatttaagcaaagctgcttggggcgctctgcagaagaacaacacacagctaatgatacgctcatatgagctaggtgtattattcttgccccaaacgctccaatcaataccccaattttcatgcacggaaaagagccgctcaagccgggatggcgtcgccattggcaggacgatcaagaccaagctggtcactctttgctggaaaggggacgaagaggatccatctattgtgaaattgcctgtgccataccagcttcctccacaaccttatggcacacaagatgtcccttggtcatgggatcggaggtacacaaagaaggatgtgtatggttccgtctggccacgacacggctag

SEQ ID NO: 3742 - protein, 668 aa, Sorghum bicolor
  misc_feature: Ceres ANNOT ID no. 6032453
  misc_feature (203)..(642): Pfam Id: Tyr-DNA_phospho Pfam Desc: Tyrosyl-DNA phosphodiesterase
  misc_feature (179)..(666): NCBI GI: 92868600 NCBI Desc: forkhead-associated; tyrosyl-dna phosphodiesterase [medicago truncatula]
  misc_feature (183)..(647): NCBI GI: 46015512 NCBI Desc: chain b, crystal structure of human tyrosyl-dna phosphodiesterase complexed with vanadate, octopamine and trinucleotide gtt
  misc_feature (183)..(647): NCBI GI: 49258604 NCBI Desc: chain b, human tyrosyl dna phosphodiesterase
  misc_feature (207)..(647): NCBI GI: 85725382 NCBI Desc: tyrosyl-dna phosphodiesterase 1 [homo sapiens]
  misc_feature (207)..(586): NCBI GI: 49903395 NCBI Desc: tdp1-prov protein [xenopus laevis]
MASASRVRLGTLVPLTKDNAGSSNGSVSNIPIFQGSNVVGRDHLVVVDKRISRKHLSLHASTDGSIEVVVEGPNPIMVRSNGQRRKVCATGKAKIAHGDVLELIPGDYFVKYVDMGDEHKISVPMHLSDLKKGKRHSEEDSAAVKRNRQIMEDEALARTLQESFAEDNTAVSGMTSGQKISSHDSAGSSGRNNERKHSIGPLKDMLPLTFRLMRVQGLPSWTNTSSVSIQDVIQGEVLLAVLSNYMVDIDWLLTACPSLKKVPHVLVLHGQDGASLKLMKKLKPANWILHKPPLPISFGTHHSKAMLLVYPQGIRIVVHTANLIHVDWNYKSQGLWMQDFPWKDTNDMNNKVPFENDLVDYLSALKWPEFSVNLPEVGDVNINAAFFRKFDYRNSMVRLIGSVPGYHVGPNIRKWGHMKLRNVLDEITFNKQFCKSPLIYQFSSLGSLDEKWMSEFACSLSAGKSDDGSQLGIGKPLIVWPTVEDVRCSIEGYAAGSCIPSPQKNVEKDFLKKYWSRWKADHVGRCRAMPHIKTFTRYSGQNIAWFLLTSSNLSKAAWGALQKNNTQLMIRSYELGVLFLPQTLQSIPQFSCTEKSRSSRDGVAIGRTIKTKLVTLCWKGDEEDPSIVKLPVPYQLPPQPYGTQDVPWSWDRRYTKKDVYGSVWPRHG

SEQ ID NO: 3743 - DNA, 1116 bp, Sorghum bicolor
  misc_feature: Ceres ANNOT ID no. 6032463
  misc_feature: Encodes the peptide sequence at SEQ ID NO 3744
atggcaagctcgtctgtggcggcggacatggagctggaccgcccgaacctggaggactacctcccgcccgactcgctcccgcaggaggcgccccggaatctccatctgcgcgatctgctggacatctcgccggtgctaaccgaggcggcgggtgccatcgtcgatgattcattcacgcgttgctttaagtcgaattctccagaaccatggaattggaacatatatttgttccctttatggtgcttcggtgtagtaattagatatggaatactcttcccactgaggtccttaacacttgcattaggatggctagcattttttgccgcctttttccccgtccatttcttattcaaaggtcaagacaagttgagaagtaaaattgagaggaagttggttgaaatgatgtgcagtgtttttgttgcttcatggactggagtgatcaagtaccatggaccacgcccaagcacacgacctcatcaggtatttgttgcaaaccatacatcaatgatagatttcattattctggagcaaatgacggcatttgctgtcatcatgcagaagcatcctggatgggttggatttattcagaagactatcttggaaagtgtgggttgcatctggtttaaccgtaatgatctccgggatcgtgaagttacggcacggaagttgcgtgaccatgttcaacaaccagacaacaaccctctcttgattttcccagaaggaacttgtgttaacaaccagtacaccgtcatgttcaagaagggtgcctttgagcttgggtgcgctgtctgtccaatagctatcaagtacaataaaatattcgtggatgccttctggaacagtaagaagcaatcttttacgatgcacttggtccgactgatgacatcgtgggccgttgtgtgtgatgtttggtacttggagcctcaatatctgagggagggagagactgcaattgcgtttgctgagagagtaagagacatgatagcagctagagctggtcttaagaaggttccctgggatggctatctgaaacacaaccgccctagtcccaaacacactgaagagaagcaacgcatattcgcagaatctgtcttgaggagactagaggagaaatga

SEQ ID NO: 3744 - protein, 371 aa, Sorghum bicolor
  misc_feature: Ceres ANNOT ID no. 6032463
  misc_feature (146)..(269): Pfam Id: Acyltransferase Pfam Desc: Acyltransferase
  misc_feature (5)..(371): NCBI GI: 92882102 NCBI Desc: phospholipid/glycerol acyltransferase [medicago truncatula]
  misc_feature (38)..(371): NCBI GI: 28828546 NCBI Desc: similar to oryza sativa (japonica cultivar-group). p0681f05.34 protein [dictyostelium discoideum]
  misc_feature (38)..(371): NCBI GI: 49119075 NCBI Desc: loc443578 protein [xenopus laevis]
  misc_feature (52)..(361): NCBI GI: 24762545 NCBI Desc: cg3209-pb, isoform b [drosophila melanogaster]
  misc_feature (38)..(371): NCBI GI: 51980339 NCBI Desc: au041707 protein [rattus norvegicus]
  misc_feature: The sequence is a functional homolog of SEQ ID NO 26 in US patent 7235714
  misc_feature: The sequence is a functional homolog of SEQ ID NO. 487 in the 11/188,298 US application
MASSSVAADMELDRPNLEDYLPPDSLPQEAPRNLHLRDLLDISPVLTEAAGAIVDDSFTRCFKSNSPEPWNWNIYLFPLWCFGVVIRYGILFPLRSLTLALGWLAFFAAFFPVHFLFKGQDKLRSKIERKLVEMMCSVFVASWTGVIKYHGPRPSTRPHQVFVANHTSMIDFIILEQMTAFAVIMQKHPGWVGFIQKTILESVGCIWFNRNDLRDREVTARKLRDHVQQPDNNPLLIFPEGTCVNNQYTVMFKKGAFELGCAVCPIAIKYNKIFVDAFWNSKKQSFTMHLVRLMTSWAVVCDVWYLEPQYLREGETAIAFAERVRDMIAARAGLKKVPWDGYLKHNRPSPKHTEEKQRIFAESVLRRLEEK

SEQ ID NO: 3745 - DNA, 1383 bp, Sorghum bicolor
  misc_feature: Ceres ANNOT ID no. 6032470
  misc_feature: Encodes the peptide sequence at SEQ ID NO 3746
atggccgccaagcgatcgcttctcctctgcctgctcctcttgctgccgtcttttgccgtcccaggccacggccagccaagccgtggcatccgccttgagctgacacacgtcgacgcccgcggcgacttcacggggtccgaccgcgtccgccgcgccgctgaccggagccaccgccgcgtgaacggcctcctcgccgcggccccgccgccggctgcgtccacgctgcggagcgacggtggtggtggtggcgcctgcgccgccacggcggcggcatccgtgcacgcgagcacggcgacctacctcgtcgacttcgccatcggcacgccgccgctcgcgctctcggccgtcctcgacacgggcagcgacctcatctggacgcagtgcgatgcgccgtgccgccggtgcttcccgcagcccgcgccgctgtacgcgccggccaggtccgtcacctacgccaacgtgtcgtgcggctccaggctctgcgatgcgctcccgagcctcaggccctcctcccgctgctcggcgtcggcgtcggcgccggcgccggagcggggcggctgcacgtactactactcctacggcgatggcagctccaccgatggcgtcctcgccactgagacgttcacgttcggcgcgggcaccaccgtccatgacctcgccttcgggtgcggcacggacaacctcggcggcacagacaattcctccggcctggttggcatgggccggggcccgctgtcgctggtgtcgcagctcggcgtcaccaagttctcctactgcttcacgccattcaacgacacgacaacgtcaagccctctgttcctcggctcgtcggcgagcctctcgccggccgccaagtcgacgccgttcgtgccgagcccgagcggcccgcggcggagctcctactactacctctccctggaagggatcaccgtcggggacaccctgcttccgatcgaccccgccgtgttccggctcaccgcgtcgggccgcggcggtctcatcatcgactccggcacgacgttcacggcgctagaggagcgcgcgttcgtggtgctggcgcgcgcggtcgctgcccgcgtagcgctgccgctggccagcggcgcgcacctgggcctcagcgtctgcttcgcggcgccccaggggcgggggcccgaggccgtggacgtgccgcggctggttctccacttcgacggcgcagacatggagctgccgcggagcagcgccgttgtggaggacagggtcgccggggtcgcgtgcctggggattgtcagcgcgcgggggatgtcggtgctcggaagcatgcagcagcagaacatgcacgtgcggtacgacgtcgggagggacgtcttgtcctttgagcccgctaactgcggcgagctctag

SEQ ID NO: 3746 - protein, 460 aa, Sorghum bicolor
  misc_feature: Ceres ANNOT ID no. 6032470
  misc_feature (99)..(455): Pfam Id: Asp Pfam Desc: Eukaryotic aspartyl protease
  misc_feature (93)..(460): NCBI GI: 38344829 NCBI Desc: osjnba0064h22.10 [oryza sativa (japonica cultivar-group)]
  misc_feature (93)..(460): NCBI GI: 115458644 NCBI Desc: os04g0448300 [oryza sativa (japonica cultivar-group)]
  misc_feature (93)..(460): NCBI GI: 116310063 NCBI Desc: h0818e04.1 [oryza sativa (indica cultivar-group)]
  misc_feature (1)..(460): NCBI GI: 115472519 NCBI Desc: os07g0533800 [oryza sativa (japonica cultivar-group)]
  misc_feature (72)..(460): NCBI GI: 108707838 NCBI Desc: eukaryotic aspartyl protease family protein [oryza sativa (japonica cultivar-group)]
MAAKRSLLLCLLLLLPSFAVPGHGQPSRGIRLELTHVDARGDFTGSDRVRRAADRSHRRVNGLLAAAPPPAASTLRSDGGGGGACAATAAASVHASTATYLVDFAIGTPPLALSAVLDTGSDLIWTQCDAPCRRCFPQPAPLYAPARSVTYANVSCGSRLCDALPSLRPSSRCSASASAPAPERGGCTYYYSYGDGSSTDGVLATETFTFGAGTTVHDLAFGCGTDNLGGTDNSSGLVGMGRGPLSLVSQLGVTKFSYCFTPFNDTTTSSPLFLGSSASLSPAAKSTPFVPSPSGPRRSSYYYLSLEGITVGDTLLPIDPAVFRLTASGRGGLIIDSGTTFTALEERAFVVLARAVAARVALPLASGAHLGLSVCFAAPQGRGPEAVDVPRLVLHFDGADMELPRSSAVVEDRVAGVACLGIVSARGMSVLGSMQQQNMHVRYDVGRDVLSFEPANCGEL

SEQ ID NO: 3747 - DNA, 1338 bp, Sorghum bicolor
  misc_feature: Ceres ANNOT ID no. 6032474
  misc_feature: Encodes the peptide sequence at SEQ ID NO 3748
atgtcatcgccgacgcaaatggcttcccttgccgttctcgtttccctcgtctgcgcagcgcttgcctccaatgccgcggccgtccgcgtggagctcacgcgcatccacgccgaccccagcgtgaccgcgtcccagttcgtccgcgacgccctgcgccgcgacatgcaccggcacaacgcccggcagctcgccgcgtcgtcgtccaacggcactacggtgtccgcgccgacccagatctcgcccaccgccggggagtacctgatgacgctggccatcggcacgcctccggtgtcctaccaggccatcgccgacacgggcagcgacctcatctggacgcagtgcgcgccctgcagctcccagtgcttccagcagccgacgccgctgtacaacccgtccagctccaccacgttcgccgtgctcccgtgcaacagctcgctgagcatgtgcgcggcggcgctggccgggacgaccccgccgccggggtgcacctgcatgtacaacatgacgtacggcagcgggtggacgtctgtctaccaggggtccgagacgttcaccttcgggtcgtccacgccggcgaaccagaccggcgtcccgggcatcgccttcggatgcagcaacgcgagcggcggcttcaacacctcgtcggcgtccggcctcgtcgggctgggcagggggagcctgtcgctcgtctcccagctcggcgtccccaagttctcctactgcctcacgccgtaccaggacaccaacagcaccagcacgctcctcctcgggccgtcggcatcgctcaacgacaccggcggcgtcagctccacgcctttcgtcgccagcccttccgatgcgcccatgagcacctactactatctcaacctcaccggcatatccctcggcacgacggcactgtccatcccgaccaccgccttgtcgctgaaggcggacggcaccggcgggttcatcatcgactctggcaccaccatcacattgctgggcaacacggcgtaccagcaggtccgcgccgcggtcgtctccctggtgacgctgcccacgacagacggcgggtcggcagccacggggctcgacctgtgcttcgagctgccgtcctcaacgtcggcgccgccgaccatgccgagcatgacgctccacttcgacggcgcggacatggtgctcccggcggacagctatatgatgttggactccaacttgtggtgcctggccatgcagaaccagaccgatggcggggtaagcattctcggcaactaccagcagcagaacatgcacatcctctacgacgttgggcaggagacattgacgtttgctccggccaagtgcagcacgctctga

SEQ ID NO: 3748 - protein, 445 aa, Sorghum bicolor
  misc_feature: Ceres ANNOT ID no. 6032474
  misc_feature (85)..(440): Pfam Id: Asp Pfam Desc: Eukaryotic aspartyl protease
  misc_feature (1)..(445): NCBI GI: 115472519 NCBI Desc: os07g0533800 [oryza sativa (japonica cultivar-group)]
  misc_feature (10)..(445): NCBI GI: 38344829 NCBI Desc: osjnba0064h22.10 [oryza sativa (japonica cultivar-group)]
  misc_feature (10)..(445): NCBI GI: 115458644 NCBI Desc: os04g0448300 [oryza sativa (japonica cultivar-group)]
  misc_feature (10)..(445): NCBI GI: 116310063 NCBI Desc: h0818e04.1 [oryza sativa (indica cultivar-group)]
  misc_feature (49)..(442): NCBI GI: 61214232 NCBI Desc: aspartic proteinase nepenthesin-2 precursor (nepenthesin-ii)
MSSPTQMASLAVLVSLVCAALASNAAAVRVELTRIHADPSVTASQFVRDALRRDMHRHNARQLAASSSNGTTVSAPTQISPTAGEYLMTLAIGTPPVSYQAIADTGSDLIWTQCAPCSSQCFQQPTPLYNPSSSTTFAVLPCNSSLSMCAAALAGTTPPPGCTCMYNMTYGSGWTSVYQGSETFTFGSSTPANQTGVPGIAFGCSNASGGFNTSSASGLVGLGRGSLSLVSQLGVPKFSYCLTPYQDTNSTSTLLLGPSASLNDTGGVSSTPFVASPSDAPMSTYYYLNLTGISLGTTALSIPTTALSLKADGTGGFIIDSGTTITLLGNTAYQQVRAAVVSLVTLPTTDGGSAATGLDLCFELPSSTSAPPTMPSMTLHFDGADMVLPADSYMMLDSNLWCLAMQNQTDGGVSILGNYQQQNMHILYDVGQETLTFAPAKCSTL

SEQ ID NO: 3749 - DNA, 2877 bp, Sorghum bicolor
  misc_feature: Ceres ANNOT ID no. 6032487
  misc_feature: Encodes the peptide sequence at SEQ ID NO 3750
atgtcagtttctatgaaggacctggacccggctttccgtggttctggacaaaaggacggcttggaaatatggcgtattgagaatttcaagccggttcctgtccctgcatcttcatatggaaagttcttcatgggtgattcttacattatcttgaagacaacagccttgaaaaatggttctcttcgccatgacatccattactggattggtaaagatactagtcaggacgaagctggaactgctgcgattttaacggtagagcttgatgctgctcttggcgggcgtgctgttcagtaccgagaaatacaaggcaatgaaacagaaaaattcctgtcctattttagaccatgcatcatgccacagccaggaggagtggcatctggattcaaccatgttgaggtcaatgagcaggatcacgagacccgcttatatgtctgccatgggaagcatgttgttcatgttaaagaggttccctttgctcgatcatcccttaatcatgatgacatatttattttggatacgaagttcaaaattttccagttcagtggctcaaactcatccatccaagagcgagcaaaagctcttgaagttgtgcagtacatcaaagatacatttcatgagggcaaatgtgaaattgcatctgttgaggatggtagaatgatggctgatgcggaagctggtgaattctggagtttttttggtggcttcgcccctcttcctaggagggcacctgcagaaggcaatgagaaacatgaagaaactgctttcaaattgctatgttttgaccaaggaaagctggtgcctatcgactgccaatctttagcacatgaattacttgagacaaacaagtgttacttcttagactctggttctgaattgtatgtttggatgggcagaattacatccctgcaggagagaaagggtgctagtgaagctgctgagaaattgctctctgattcaaaccgaacaagaacacatataatcaaagtgattgaagggtttgagactgttacgttcaagtcaaaatttaaagagtggccgcagacgcctgagttgaagttgtcatcggaggatggaagaggcaaagttgcagctcttctcaaacgccagggcttaaatgttaagggtttgatgaaagctgctcctgcaaaagaagaacctcaatcctatattgattgcactggcaacttgcaggtttggcgtgtaaatgataaagacaaggttcaactctcatcctctgaccaatccaaattttacactggcgattgctacgtatttcagtatacttatcctggagatgataaggaggaatgtcttgttggaacctggtttgggaaaaagagtattgaggaggatagggtaatagcagtttcacttgcaagcaagatggttgaatctgctaagtttcaggccgtccaggcacgcttttatgaggggaaagaaccgattcagttctttgtgatatttcaaagcttgcaagtgtttaagggtggtcttagttctggatacaagagattcaccgctgaaaatggtattgatgatgaaagttattctgaagatgggcttgcactctttcgtattcaaggttcaggaccagaaaacatgcaagcgattcaagttgaaccagtggcctcgtcattgaattcatcatattgttacattctacatgatggacacacagtgttcacttgggctggaaatctgaccactgcattggatcaagagttaatggagaggcaacttgatgttattaagccaaacacacagtctaggtcacaaaaggaaggttcagaaacggaccagttttggagcttactgggaggcaaatctgagtactcaggccaaaaaatggtgcgagaacttgaaagtgatccccatcttttctcatgcatcctgtcgaaaggcaatttgaaggtcaaagaaatataccactttactcaagatgatctaatgacagaagatgttttcattctggactgtcacacgagcatatttgtttgggttggtcagcaggtggatgttaaagtcaggttacaagctctggatgttggggagaaatttattgtgcttgatttccttatggaaaaccttgcccgtgaaacaccaattttcaccgttatggaggggagtgagcctccctttttcactagattcttcacctgggacttggcaaaatcactgatgcatggcaattcataccagaggaagcttgccattgtaaaaggtggaggtgctccagcactggataaaccgaaacgacgaacacccgtctattcaggaaggagtactacacaagataaatcccaacgctccagaagcatgtccttcagtcctgagcgcgtccgtgttaggggaagatctccagcattcactgcattggctgctaattttgaaagttcaagcaacagaaatctttccactcctccacctgtagttaagaaactttacccgaaatctgttacacctgattcgtcaaatacaaagtcatctgcaattgctgctgtggctggttctttggatcgcccttctcaaactcctgctccagaattcgtgaaagatggctctgagtcagagaagccaaaacaggagggagatggtaaaggtgttgatactgtggccactagagtcgaatctctgactataaatgaagatgtaaaagaaaacgagccagaagatgacgagggccttcctatttacccatatgaacgtctgcagaccacagctgctgatcctgttactgaaattgatgtcacgaggcgagagacctacttgtcttcgactgaattcaaagagaagtttgggatgacaaaggaagcatttagcaagcttccaaagtggaagcagaataggctaaaaattgctcttcaacttttttag

SEQ ID NO: 3750 - protein, 958 aa, Sorghum bicolor
  misc_feature: Ceres ANNOT ID no. 6032487
  misc_feature (28)..(111): Pfam Id: Gelsolin Pfam Desc: Gelsolin repeat
  misc_feature (150)..(230): Pfam Id: Gelsolin Pfam Desc: Gelsolin repeat
  misc_feature (265)..(340): Pfam Id: Gelsolin Pfam Desc: Gelsolin repeat
  misc_feature (636)..(716): Pfam Id: Gelsolin Pfam Desc: Gelsolin repeat
  misc_feature (923)..(958): Pfam Id: VHP Pfam Desc: Villin headpiece domain
  misc_feature (1)..(958): NCBI GI: 115475477 NCBI Desc: os08g0240800 [oryza sativa (japonica cultivar-group)]
  misc_feature (1)..(958): NCBI GI: 38344157 NCBI Desc: osjnba0041a02.24 [oryza sativa (japonica cultivar-group)]
  misc_feature (1)..(958): NCBI GI: 116309667 NCBI Desc: osigba0118p15.6 [oryza sativa (indica cultivar-group)]
  misc_feature (1)..(958): NCBI GI: 115460368 NCBI Desc: os04g0604000 [oryza sativa (japonica cultivar-group)]
  misc_feature (1)..(958): NCBI GI: 31339056 NCBI Desc: actin filament bundling protein p-115-abp [lilium longiflorum]
MSVSMKDLDPAFRGSGQKDGLEIWRIENFKPVPVPASSYGKFFMGDSYIILKTTALKNGSLRHDIHYWIGKDTSQDEAGTAAILTVELDAALGGRAVQYREIQGNETEKFLSYFRPCIMPQPGGVASGFNHVEVNEQDHETRLYVCHGKHVVHVKEVPFARSSLNHDDIFILDTKFKIFQFSGSNSSIQERAKALEVVQYIKDTFHEGKCEIASVEDGRMMADAEAGEFWSFFGGFAPLPRRAPAEGNEKHEETAFKLLCFDQGKLVPIDCQSLAHELLETNKCYFLDSGSELYVWMGRITSLQERKGASEAAEKLLSDSNRTRTHIIKVIEGFETVTFKSKFKEWPQTPELKLSSEDGRGKVAALLKRQGLNVKGLMKAAPAKEEPQSYIDCTGNLQVWRVNDKDKVQLSSSDQSKFYTGDCYVFQYTYPGDDKEECLVGTWFGKKSIEEDRVIAVSLASKMVESAKFQAVQARFYEGKEPIQFFVIFQSLQVFKGGLSSGYKRFTAENGIDDESYSEDGLALFRIQGSGPENMQAIQVEPVASSLNSSYCYILHDGHTVFTWAGNLTTALDQELMERQLDVIKPNTQSRSQKEGSETDQFWSLLGGKSEYSGQKMVRELESDPHLFSCILSKGNLKVKEIYHFTQDDLMTEDVFILDCHTSIFVWVGQQVDVKVRLQALDVGEKFIVLDFLMENLARETPIFTVMEGSEPPFFTRFFTWDLAKSLMHGNSYQRKLAIVKGGGAPALDKPKRRTPVYSGRSTTQDKSQRSRSMSFSPERVRVRGRSPAFTALAANFESSSNRNLSTPPPVVKKLYPKSVTPDSSNTKSSAIAAVAGSLDRPSQTPAPEFVKDGSESEKPKQEGDGKGVDTVATRVESLTINEDVKENEPEDDEGLPIYPYERLQTTAADPVTEIDVTRRETYLSSTEFKEKFGMTKEAFSKLPKWKQNRLKIALQLF

SEQ ID NO: 3751 - DNA, 1467 bp, Sorghum bicolor
  misc_feature: Ceres ANNOT ID no. 6032521
  misc_feature: Encodes the peptide sequence at SEQ ID NO 3752
atggcggggaacgcgctagccaactatgtccaggtctacgccatgctcccgctggatatcatcactgtcgacaacacgttcgagaaggaggacgagacaagggcgcaactgaagaagctgacggaggccggcgtcgatggggtcatgatcgacgtctggtgggggctggtggaggggaaggagccgggggtctacgactggagcgcctacaagcaggtcttcaagctggtgcaggaggccgggctcaagctgcaggccatcatgtcgtgccaccagtgcggtggcaacgtcggcgacgtcgtcaacatcccgatcccacagtgggtgcgggacgtcggcgaggacaatcccgacatcttctacaccaaccgggaaggggtgaggaacatcgagtatctcactcttggagtggacgaccagcctctcttccatggaagaactgccattcagctgtatgctgattacatgaagagcttcagagagaacatggcagatttcttggatgctggtgtcattgtggacattgaggtgggacttggccctgctggtgagatgaggtacccctcatatccccaaagtcagggatgggtgtacccaggtattggagaattcatatgctatgataagtacctgaaagcagacttcaaagcagcagcagctgcggctgggcatcctgagtgggatttgcctgatgatgctggggagtacaatgacactcctgagaagacccagttctttgcggataatggaacataccagaccgacaaggggaagttcttcctcacatggtactccaacaaactgatcaagcacggtgataagatcttggatgaagcaaacaaggtcttcttgggatgcacggtgcagctggcaatcaaagtctctggcatacactggtggtacacggttccaaaccatgcagctgagctcactgccggatactacaacttagatgacagagatggctacagaaccatagcacacatgctaacaaggcatcctgcaagcatgaacttcacttgtgctgagatgagggacaatgagcagagttcagaggcgaaaagtgcacctgaggaactggttcaacaggtgctgagtgccggatggagagagggcctaaatctggcatgtgaaaatgcactcagtcgatatgatgcaacagcttacaacaccatcctcaggaatgcaagaccccaaggcatcaacaagaatggcgctccagaacacaagttgtatggattcacctacctccgagtatctgatgaactgttcgagggagagaactacaccactttcaaaacttttgtcaggagaatgcatgctaacctggattataacccaaaggttgacccagttgcaccattgaaaagatcaaagccagagataccaattgaagaaatcctagcagtagcacagccaagattgaagccatttcccttcgagaagaacacagacctaccagtttaa

SEQ ID NO: 3752 - protein, 488 aa, Sorghum bicolor
  misc_feature: Ceres ANNOT ID no. 6032521
  misc_feature (13)..(435): Pfam Id: Glyco_hydro_14 Pfam Desc: Glycosyl hydrolase family 14
  misc_feature (1)..(488): NCBI GI: 4321978 NCBI Desc: beta-amylase [zea mays]
  misc_feature (1)..(488): NCBI GI: 397959 NCBI Desc: beta-amylase [zea mays]
  misc_feature (1)..(488): NCBI GI: 115472617 NCBI Desc: os07g0543300 [oryza sativa (japonica cultivar-group)]
  misc_feature (1)..(488): NCBI GI: 1771782 NCBI Desc: beta-amylase [triticum aestivum]
  misc_feature (1)..(488): NCBI GI: 61006818 NCBI Desc: tissue-ubiquitous beta-amylase 2 [hordeum vulgare subsp. vulgare]
  misc_feature (1)..(488): SWISSPROT Homolog: EC 3.2.1.2 Beta-amylase
MAGNALANYVQVYAMLPLDIITVDNTFEKEDETRAQLKKLTEAGVDGVMIDVWWGLVEGKEPGVYDWSAYKQVFKLVQEAGLKLQAIMSCHQCGGNVGDVVNIPIPQWVRDVGEDNPDIFYTNREGVRNIEYLTLGVDDQPLFHGRTAIQLYADYMKSFRENMADFLDAGVIVDIEVGLGPAGEMRYPSYPQSQGWVYPGIGEFICYDKYLKADFKAAAAAAGHPEWDLPDDAGEYNDTPEKTQFFADNGTYQTDKGKFFLTWYSNKLIKHGDKILDEANKVFLGCTVQLAIKVSGIHWWYTVPNHAAELTAGYYNLDDRDGYRTIAHMLTRHPASMNFTCAEMRDNEQSSEAKSAPEELVQQVLSAGWREGLNLACENALSRYDATAYNTILRNARPQGINKNGAPEHKLYGFTYLRVSDELFEGENYTTFKTFVRRMHANLDYNPKVDPVAPLKRSKPEIPIEEILAVAQPRLKPFPFEKNTDLPV

SEQ ID NO: 3753 - DNA, 657 bp, Sorghum bicolor
  misc_feature: Ceres ANNOT ID no. 6032523
  misc_feature: Encodes the peptide sequence at SEQ ID NO 3754
atggcacaagccatggcgtcgatgaccggcctctcgcagggcgtcctgcccagcaggcgcgccgccaacagggccagggcggccgccgtcgtcgtcagggcgtccgccgagggcgaggccgccgcggcgcagccgggccgccgcgccgtgctcgggctggtggccaccggcgtcgtcggcggcgccttgtcgcaggcggtgcacgccgcgaccgtcaattccatcaagatcggagccccgccgccgccctccggtggactccccgggactgaaaactctgaccaggcgagggacttcggcctccccttgaaggatcgattctacctgcagccgctgccaccggcggaggcggcggcgagggtgaagacgtcggcgcaggacatcatcaacctgaagccgctcatcgacaagaaggcgtggccgtacgtccagaacgacctccgcctcagggcctcctacctgcgctatgacctcaagaccgtcatcgcttcaaagcccaaggaggagaagaagagcctcaaggagctcaccggcaagctcttcagcaccatcgacgatcttgaccatgccgcgaagatcaagagcaccccagaggccgagaaatactttgcagcaaccaaagatgtgctcggcgatgttctcgccaagataggctag

SEQ ID NO: 3754 - protein, 218 aa, Sorghum bicolor
  misc_feature: Ceres ANNOT ID no. 6032523
  misc_feature (15)..(218): Pfam Id: PsbQ Pfam Desc: Oxygen evolving enhancer protein 3 (PsbQ)
  misc_feature (1)..(218): NCBI GI: 11134057 NCBI Desc: oxygen-evolving enhancer protein 3-1, chloroplast precursor (oee3) (16 kda subunit of oxygen evolving system of photosystem ii) (oec 16 kda subunit)
  misc_feature (1)..(218): NCBI GI: 444338 NCBI Desc: photosystem ii oe17 protein
  misc_feature (1)..(218): NCBI GI: 407029 NCBI Desc: ferredoxin-nadp reductase binding protein [zea mays]
  misc_feature (1)..(218): NCBI GI: 115472625 NCBI Desc: os07g0544800 [oryza sativa (japonica cultivar-group)]
  misc_feature (1)..(218): NCBI GI: 56122682 NCBI Desc: chloroplast oxygen-evolving enhancer protein [manihot esculenta]
MAQAMASMTGLSQGVLPSRRAANRARAAAVVVRASAEGEAAAAQPGRRAVLGLVATGVVGGALSQAVHAATVNSIKIGAPPPPSGGLPGTENSDQARDFGLPLKDRFYLQPLPPAEAAARVKTSAQDIINLKPLIDKKAWPYVQNDLRLRASYLRYDLKTVIASKPKEEKKSLKELTGKLFSTIDDLDHAAKIKSTPEAEKYFAATKDVLGDVLAKIG

SEQ ID NO: 3755 - DNA, 1713 bp, Sorghum bicolor
  misc_feature: Ceres ANNOT ID no. 6032533
  misc_feature: Encodes the peptide sequence at SEQ ID NO 3756
atggacttgcaccagttgttaaagtacagattaactggtgctaacgtcttctacgaatttcctacagagaacaacttagcaaacactccttggccagctagtccactgaagtctgagttcagcggctccccatacactcctctttcatcccagcttgagtgtgataatttgtctgctctcagcaatactccagataaccagagctccacagaaaccatttcagcacaaccaatatcaccactggaagtagatagctcatacagacaagcagctatccttcgggagaacacccaagtgagacctgatccattgtatgcaacatcaaggcataatatgcaacacgctttacgggaaatagagactgttctgatggcacctgatgctgaggatgcagccactagcaccaagcatgaatttgaggaacataaacctgctcagctgatgaggcagcggtcgagaacatggagtcatgaatcaaggcagccatcaccaggagttgtgcggacacaattcgcatctgggtaccccacagcaagctacgaattccgcccagagaaacggctaagggagttaagggaggatccacagagcatggtgaagcagctattaaccaagtgtgctgaagcattaagtgaggagaggatagaggagttccttacccttgttcagcaagctcgtggagttgtatcaattactggagagccaatccagcggttaggtgcttaccttcttgagggtttggttgctagacatgcaaactcaggcacaaacatatatcgtgctctgaagtgccgtgaaccagagagcaatgaactcttgtcttacatgaagattttatataatatctgtccgtacttcaagtttggctatatggctgccaatggggcaattgcagaagcattaagaaatgaagacaaaatccatataattgatttccagattgctcaagggacacaatggataacactgatacaagcgctcgctgcaaagccagggggtccaccacatgtgcggatcactggaatagatgatccagtttcagagtatgctcgtggtgaaggtctggaccttgtagggaagatgttgaaaagtatgtctgaagaattcaggatacctttggagtttacccctctgcctggtatttatgcaactcaggttacaaaagaaatgctcgacatcaggccaggcgaagctctcgctgtcaacttcactctgcagctgcaccacaccccagatgagagtgtggacgtgagcaacccacgggacgggctacttcggatggtgaaaggtctgtctccaaaggtgaccacacttgtggagcaggagtcgcacaccaacacgaccccgttcctgatgcggttcaccgagaccttggactactactcggccatgttcgagtcgatcgatgcgaacctgccacgggaaaacaaggagcggatcaatgtggagcagcactgcctcgccaaggacattgtgaacatcatcgcctgcgaggggaaggaccgggtggagcggcacgagctcctgggtaagtggcggtcaaggctgaccatggccgggttcagaccatacccgctgagctcgtacgtgaactcggtgatcaggaatctccttgcctactactcggacaagtacaccctggaggagaaggatggcgcgatgctgctcggctggaagaacaggaagttgatatctgcttctgcgtggcattga

SEQ ID NO: 3756 - protein, 570 aa, Sorghum bicolor
  misc_feature: Ceres ANNOT ID no. 6032533
  misc_feature (176)..(480): Pfam Id: GRAS Pfam Desc: GRAS family transcription factor
  misc_feature (1)..(570): NCBI GI: 73620050 NCBI Desc: chitin-inducible gibberellin-responsive protein 1
  misc_feature (1)..(570): NCBI GI: 25989332 NCBI Desc: chitin-inducible gibberellin-responsive protein [oryza sativa (japonica cultivar-group)]
  misc_feature (1)..(570): NCBI GI: 89474464 NCBI Desc: gras2 [solanum lycopersicum]
  misc_feature (203)..(569): NCBI GI: 8777405 NCBI Desc: scarecrow gene regulator-like [arabidopsis thaliana]
  misc_feature (184)..(570): NCBI GI: 73620052 NCBI Desc: chitin-inducible gibberellin-responsive protein 2
  misc_feature: The sequence is a functional homolog of SEQ ID NO 1327 in the 10/374,780US patent application
  misc_feature: The sequence is a functional homolog of SEQ ID NO 474 in the 10/666,642US patent application
  misc_feature: Useful for making plants with modulated growth and phenotype characteristics
  misc_feature: Useful for making plants with modulated low light sensitivity
  misc_feature: Functional homolog of the protein sequence given in SEQ ID NO 13378
  misc_feature: The sequence is a functional homolog of SEQ ID NO 1327 in the 20060162006 US patent application
  misc_feature: The sequence is a functional homolog of SEQ ID NO 474 in the 20070033671 US patent application
  misc_feature: Useful for making plants with modulated low light sensitivity
  misc_feature: Functional homolog of the protein sequence given in SEQ ID NO 13378
  misc_feature: The sequence is a functional homolog of SEQ ID NO 474 in the 10/666,642 US patent application
  misc_feature: Useful for making plants with modulated light quality sensitivity
  misc_feature: The sequence is a functional homolog of SEQ ID NO 1018 in the 10/225,066 US patent application
  misc_feature: The sequence is a functional homolog of SEQ ID NO 2712 in the 10/374,780 US patent application
  misc_feature: Useful for making plants with altered alkaloid content
  misc_feature: Useful for making plants with altered lignin content
  misc_feature: Functional homolog of the protein sequence given in SEQ ID NO 12889
  misc_feature: The sequence is a functional homolog of SEQ ID NO 220 in the 10/412,699 US patent application
  misc_feature: The sequence is a functional homolog of SEQ ID NO 443 in the 11/479,226 US patent application
MDLHQLLKYRLTGANVFYEFPTENNLANTPWPASPLKSEFSGSPYTPLSSQLECDNLSALSNTPDNQSSTETISAQPISPLEVDSSYRQAAILRENTQVRPDPLYATSRHNMQHALREIETVLMAPDAEDAATSTKHEFEEHKPAQLMRQRSRTWSHESRQPSPGVVRTQFASGYPTASYEFRPEKRLRELREDPQSMVKQLLTKCAEALSEERIEEFLTLVQQARGVVSITGEPIQRLGAYLLEGLVARHANSGTNIYRALKCREPESNELLSYMKILYNICPYFKFGYMAANGAIAEALRNEDKIHIIDFQIAQGTQWITLIQALAAKPGGPPHVRITGIDDPVSEYARGEGLDLVGKMLKSMSEEFRIPLEFTPLPGIYATQVTKEMLDIRPGEALAVNFTLQLHHTPDESVDVSNPRDGLLRMVKGLSPKVTTLVEQESHTNTTPFLMRFTETLDYYSAMFESIDANLPRENKERINVEQHCLAKDIVNIIACEGKDRVERHELLGKWRSRLTMAGFRPYPLSSYVNSVIRNLLAYYSDKYTLEEKDGAMLLGWKNRKLISASAWH

SEQ ID NO: 3757 - DNA, 750 bp, Sorghum bicolor
  misc_feature: Ceres ANNOT ID no. 6032534
  misc_feature: Encodes the peptide sequence at SEQ ID NO 3758
atggcgggagccttcgctctccgcctcgtgcctcgcctcgccgcggagcctcccgggagggggaagggtggcggaggaggagccagccgcgacgcaggcagcagggcgctggtgtcaaagaaaccaaacaagcagcagcatttgtggatcaggaaggagacagctgggtcagggaagaaggctctccgtcttattgatgctgtttcaaagttaccaaatgaaagagaagctatttatggtgcattggacaagtggagtgcttttgagcctgaatttcctattatagcagcagcaaaagctttggggatgttgaaaaggcgacaaaaatggctaagaatcatccaggtaaccaagtggttgatgagcaaaggccaggtgctgacatggacaacgtatgatacacttatgcttgcactttttatggataaacgggtggatgaagctgagtcaatctggaatactgtaatacagactcatatgcgctcagtgcccaagaggttgttctctcggatgatcttgatgtatgacattcaccaacgtccagataaagttttggagatatacactgacatggaggaattaggggtgcgtccagatgaggatacagcgagacggatcggaaaagcatttgtggcttttggccaagaagaagaagaaaaacacgtccttgagaaatacttgaaaaagtggaagtacatccacttcaacggtgagcgtgttcgggtgcggagggacggaccattggcataa

SEQ ID NO: 3758 - protein, 249 aa, Sorghum bicolor
  misc_feature: Ceres ANNOT ID no. 6032534
  misc_feature (38)..(244): NCBI GI: 18415213 NCBI Desc: pentatricopeptide (ppr) repeat-containing protein [arabidopsis thaliana]
  misc_feature (48)..(197): NCBI GI: 115440033 NCBI Desc: os01g0757700 [oryza sativa (japonica cultivar-group)]
  misc_feature (71)..(226): NCBI GI: 2494119 NCBI Desc: est gbt04104 comes from this gene. [arabidopsis thaliana]
MAGAFALRLVPRLAAEPPGRGKGGGGGASRDAGSRALVSKKPNKQQHLWIRKETAGSGKKALRLIDAVSKLPNEREAIYGALDKWSAFEPEFPIIAAAKALGMLKRRQKWLRIIQVTKWLMSKGQVLTWTTYDTLMLALFMDKRVDEAESIWNTVIQTHMRSVPKRLFSRMILMYDIHQRPDKVLEIYTDMEELGVRPDEDTARRIGKAFVAFGQEEEEKHVLEKYLKKWKYIHFNGERVRVRRDGPLA

SEQ ID NO: 3759 - DNA, 1356 bp, Sorghum bicolor
  misc_feature: Ceres ANNOT ID no. 6032544
  misc_feature: Encodes the peptide sequence at SEQ ID NO 3760
atggttgactgcccgcggatgcttctgccggcccctcgcgtcgctgccgctcaatacacgccctgcgccgctggaagttggttgaaccaggaacccgctcccttctccatttgttgcagccgcccccgccgctgccgtcggtggagctccgttcccgtgcgatcctcatcctccggggccggaggccagtcaagcgttgcggatgagccggaggctgcagaatgggccttgcaggatttctacaccttgcggaaggatgttgagttagctcttgagcgtgtcaatgaagtcaggcagtctgccggtttggagcagcttgaggaggatatcgcttcgcttgagaagaagtctgctgatagttccttgtgggatgatccttccaaagcacaggagatacttgtttctctgacagaggtcaaagacagagtaaagcttctcaacgatttcaagttacaggttgaagaagctgagactattgtgaagcttactgaagaattagattctatagatactggtcttcttgaggaggcctcaaagattataaaggcattaaataaggcattggataactttgagatgacacagcttctttctggaccatatgacaaggaaggtgctgtaattaatatttctgctggcgctggtggcactgacgctcaggattgggctgacatgttactaaggatgtatgtgaggtggggagagaagcagcgttacaagacacgagtagttgagaaatcacctggtgaagaggctggtataaaatcagcaactgttgaactagagggaagatatgcttatggctatatctctggtgagaaaggcacacacaggattgtccgtcaatcgccatttaacgctaaagggcttcgacagacaagctttgctggtgttgaggttatgcctcttttaccagaggaatccatggctgtggacatacctgaagaggacctggatataagcttcacaagagctggaggtaaaggaggccagaacgtgaacaaggtggaaacggctgttcgtatggttcatattccaactggaatagcagttcgttgctcagaggagaggagccagctggccaacaaaataaaagccctcaaccggctcaaagcgaagctgctggtgatcgctgaggagcagcgtgcatcagaaatcaagcagatccgtggcgacatggtgaaagcagagtgggggcaacagatacgcaactacgtcttccacccctacaagctcgtcaaggacgtcaggacagggtgcgagacgtcggacatcactggcgtcatggatggagagctagatccctttatcaaagcataccttaagttcaagctcactgcggcagctaccagctga

SEQ ID NO: 3760 - protein, 451 aa, Sorghum bicolor
  misc_feature: Ceres ANNOT ID no. 6032544
  misc_feature (304)..(417): Pfam Id: RF-1 Pfam Desc: Peptidyl-tRNA hydrolase domain
  misc_feature (161)..(273): Pfam Id: PCRF Pfam Desc: PCRF domain
  misc_feature (68)..(444): NCBI GI: 92867892 NCBI Desc: peptide chain release factor 2 [medicago truncatula]
  misc_feature (83)..(442): NCBI GI: 7388055 NCBI Desc: peptide chain release factor 2 (rf-2)
  misc_feature (103)..(443): NCBI GI: 126657098 NCBI Desc: peptide chain release factor 2 [cyanothece sp. ccy0110]
  misc_feature (103)..(443): NCBI GI: 67920292 NCBI Desc: peptide chain release factor 2 [crocosphaera watsonii wh 8501]
  misc_feature (165)..(442): NCBI GI: 53688253 NCBI Desc: cog1186: protein chain release factor b [nostoc punctiforme pcc 73102]
MVDCPRMLLPAPRVAAAQYTPCAAGSWLNQEPAPFSICCSRPRRCRRWSSVPVRSSSSGAGGQSSVADEPEAAEWALQDFYTLRKDVELALERVNEVRQSAGLEQLEEDIASLEKKSADSSLWDDPSKAQEILVSLTEVKDRVKLLNDFKLQVEEAETIVKLTEELDSIDTGLLEEASKIIKALNKALDNFEMTQLLSGPYDKEGAVINISAGAGGTDAQDWADMLLRMYVRWGEKQRYKTRVVEKSPGEEAGIKSATVELEGRYAYGYISGEKGTHRIVRQSPFNAKGLRQTSFAGVEVMPLLPEESMAVDIPEEDLDISFTRAGGKGGQNVNKVETAVRMVHIPTGIAVRCSEERSQLANKIKALNRLKAKLLVIAEEQRASEIKQIRGDMVKAEWGQQIRNYVFHPYKLVKDVRTGCETSDITGVMDGELDPFIKAYLKFKLTAAATS

SEQ ID NO: 3761 - DNA, 807 bp, Sorghum bicolor
  misc_feature: Ceres ANNOT ID no. 6032565
  misc_feature: Encodes the peptide sequence at SEQ ID NO 3762
atggtgcccgccgctgcggcaatgccctttgtgaggggggggcggcgggccttccggggggcccaggaggggttggattttgccgcccacggtgatgaggaggtggggattgatggttggaacagcatggagaactgttatgcctttttgtacagcaaggaggagaagggcaagaagaaaagggtactggtgaagtgtctggtgatcggtgaagtacttgcaattgatgtcttggatcttgaggcacaagataagagcccttataatatccagattaatgtgaaagatttctttgtcgaagagcagccaaagaattatggggatatgtacaagaattttgcaagcctcattgagactgtgaactcaaatgtgttgagcaaattggatggagacaatgctgctgctgaggctgctaagagctctgctgctgctgctgctgctgccaagaactctgatgctgagagaagttcatcaatacagagcctaatttatcctccaatagcaccacttggttctgatgatctctaccctggacctggtgcgggcttctaccctcacagtggtattgggagcggtggcagcatgctcattggtcccaatgatccacgcttctttccttctaataatcccttcaatgccccgtttggtggccctgggagtgttccaccaggtggccgctatgatccaattggcccacctggtgttccagggtttgagccatctagctttgttaggcgtccaaggcggcctccaggcgggagcacccacccagacctcgagttcttccagcaaggcccagacttctga

SEQ ID NO: 3762 - protein, 268 aa, Sorghum bicolor
  misc_feature: Ceres ANNOT ID no. 6032565
  misc_feature (169)..(232): Pfam Id: PI31_Prot_Reg Pfam Desc: PI31 proteasome regulator
  misc_feature (31)..(266): NCBI GI: 28564795 NCBI Desc: proteasome inhibitor-like protein [oryza sativa (japonica cultivar-group)]
  misc_feature (31)..(266): NCBI GI: 115472663 NCBI Desc: os07g0548900 [oryza sativa (japonica cultivar-group)]
  misc_feature (14)..(218): NCBI GI: 42572661 NCBI Desc: proteasome inhibitor-related [arabidopsis thaliana]
  misc_feature (199)..(249): NCBI GI: 115470014 NCBI Desc: os06g0721600 [oryza sativa (japonica cultivar-group)]
  misc_feature (40)..(252): NCBI GI: 124504624 NCBI Desc: cdh4 protein [mus musculus]
MVPAAAAMPFVRGGRRAFRGAQEGLDFAAHGDEEVGIDGWNSMENCYAFLYSKEEKGKKKRVLVKCLVIGEVLAIDVLDLEAQDKSPYNIQINVKDFFVEEQPKNYGDMYKNFASLIETVNSNVLSKLDGDNAAAEAAKSSAAAAAAAKNSDAERSSSIQSLIYPPIAPLGSDDLYPGPGAGFYPHSGIGSGGSMLIGPNDPRFFPSNNPFNAPFGGPGSVPPGGRYDPIGPPGVPGFEPSSFVRRPRRPPGGSTHPDLEFFQQGPDF

SEQ ID NO: 3763 - DNA, 1347 bp, Sorghum bicolor
  misc_feature: Ceres ANNOT ID no. 6032572
  misc_feature: Encodes the peptide sequence at SEQ ID NO 3764
  misc_feature: Up-regulated in shoot tissues in response to methyl jasmonate treatment
  misc_feature: Up-regulated in root tissues in response to methyl jasmonate treatment
  misc_feature: Down-regulated in shoot tissues in response to aminocyclopropane carboxylic treatment
atggatcgcgccgagctcaccaccgagcaggttctcaagcgagatattccatgggagcattacatgtcaactaagcttatctccggaacatgccttcagcttttacggcgatatgaccacaaaccggagagccagcgagctcctttgcttgaggaggatgggccagcgtatgtccgagttttcctgaatatcctgcggagcatctccaaggaagagactgtggaatacgtgcttgccctcattgatgaaatgcttacaacaaatcctaagcgtgcagcactgttttatgaacaatctctgtctggtgaagatatttatgagttgttgtggaaaggcaattggtttgtacaagaaaaaagttgtaagatattgactgatataattagtgcacggccaaagcttcagaatggcacgcttccaaatggagatgcttctaattcaaagagcaaacttacttcaatacatgatgtattgagaggtttagttgattggctctgttcacagctgaggaatcctacacacccgagctgctctattcctacttctatccattgcctctccactttgctaagagaaccatatgttaggacattatttgttcaagctgatggcatcaagctgctcattcctttaatatccccagcttccacacaacagtcaattcagctcctttatgaaacttgcctctgcatctggcttttatccttttatgatgctgcagttgattatttgtccaccacaagggttatgccaagactagtagaggttgtcaagggctctactaaagagaaggtggtcagagttgttgtgttgtccttccgtaatttgctggcaaagggtgcgtttgctgcccagatgatcgatcttggattgccgcaaatagtacaaaacttgaaagctcaagcatggactgatgaggatctgttagatgctctgaatcaactagaggtgggactcaaagaaaacctcaagaagttgagttcctttgataagtacaaacagcaagttcttcttggtcatcttgactggtctccaatgcacaaagatccaagtttctggcgtgagaacattaacaattttgaagaaaatgatttccagatcctacgagttctcatgacaatcattgacacatcaagtgacaccaccgctcttgccgtggcctgctacgacctctcacagttcctccagtaccatccatctggccgaattgtggtggcagacctcaaggccaaggaccgagtcatgaagctcatgaatcatgagaacactgaagtgaggaaaaatgcgctgctctgtgtgcagaggctcttccttggcgcaaagtatgccagtttcctgcaggcttga

SEQ ID NO: 3764 - protein, 448 aa, Sorghum bicolor
  misc_feature: Ceres ANNOT ID no. 6032572
  misc_feature (1)..(403): Pfam Id: V-ATPase_H Pfam Desc: V-ATPase subunit H
  misc_feature (1)..(447): NCBI GI: 75243541 NCBI Desc: probable vacuolar atp synthase subunit h (v-atpase h subunit) (vacuolar proton pump subunit h)
  misc_feature (1)..(447): NCBI GI: 140063809 NCBI Desc: cytochrome b5; armadillo-like helical [medicago truncatula]
  misc_feature (1)..(448): NCBI GI: 20147135 NCBI Desc: at3g42050/f4m19_10 [arabidopsis thaliana]
  misc_feature (1)..(448): NCBI GI: 14334994 NCBI Desc: at3g42050/f4m19_10 [arabidopsis thaliana]
  misc_feature (107)..(447): NCBI GI: 115472671 NCBI Desc: os07g0549700 [oryza sativa (japonica cultivar-group)]
  misc_feature: Up-regulated in shoot tissues in response to methyl jasmonate treatment
  misc_feature: Up-regulated in root tissues in response to methyl jasmonate treatment
  misc_feature: Down-regulated in shoot tissues in response to aminocyclopropane carboxylic treatment
MDRAELTTEQVLKRDIPWEHYMSTKLISGTCLQLLRRYDHKPESQRAPLLEEDGPAYVRVFLNILRSISKEETVEYVLALIDEMLTTNPKRAALFYEQSLSGEDIYELLWKGNWFVQEKSCKILTDIISARPKLQNGTLPNGDASNSKSKLTSIHDVLRGLVDWLCSQLRNPTHPSCSIPTSIHCLSTLLREPYVRTLFVQADGIKLLIPLISPASTQQSIQLLYETCLCIWLLSFYDAAVDYLSTTRVMPRLVEVVKGSTKEKVVRVVVLSFRNLLAKGAFAAQMIDLGLPQIVQNLKAQAWTDEDLLDALNQLEVGLKENLKKLSSFDKYKQQVLLGHLDWSPMHKDPSFWRENINNFEENDFQILRVLMTIIDTSSDTTALAVACYDLSQFLQYHPSGRIVVADLKAKDRVMKLMNHENTEVRKNALLCVQRLFLGAKYASFLQA

SEQ ID NO: 3765 - DNA, 396 bp, Sorghum bicolor
  misc_feature: Ceres ANNOT ID no. 6032573
  misc_feature: Encodes the peptide sequence at SEQ ID NO 3766
atggcggtggcggcggcggctcgtgccgggttccggcggctattctccgtgtcggcgttcgctgcaccacctccacccgctgcgcgccccgcggcggagccctgcaacaacctcttcgtctcagggttaaataaacgcacaacatccaatggacttaaggaagcattttcgaaatttggtcaggttattgaagcaagagtaatcactgatagaatatctggatactccagaggatttggctttgtcaaatatgcgactgtacaagaagctggtgaggccataaaaggcatggatggaaagttccttgatggttgggttattttcgccgagtatgcaaagcaaagagaagccacacagccgtcacaacaaggagcaccatatgaatactctagctaa

SEQ ID NO: 3766 - protein, 131 aa, Sorghum bicolor
  misc_feature: Ceres ANNOT ID no. 6032573
  misc_feature (38)..(109): Pfam Id: RRM_1 Pfam Desc: RNA recognition motif. (a.k.a. RRM, RBD, or RNP domain)
  misc_feature (38)..(126): NCBI GI: 92897903 NCBI Desc: rna-binding region rnp-1 (rna recognition motif) [medicago truncatula]
  misc_feature (36)..(124): NCBI GI: 21388662 NCBI Desc: glycine-rich rna-binding protein [physcomitrella patens]
  misc_feature (36)..(115): NCBI GI: 15822703 NCBI Desc: rna-binding protein precursor [nicotiana tabacum]
  misc_feature (1)..(115): NCBI GI: 38346331 NCBI Desc: oj000126_13.13 [oryza sativa (japonica cultivar-group)]
  misc_feature (1)..(115): NCBI GI: 116309334 NCBI Desc: h0622f05.1 [oryza sativa (indica cultivar-group)]
  misc_feature: The sequence is a functional homolog of SEQ ID NO. 339 in the 11/188,298 US application
MAVAAAARAGFRRLFSVSAFAAPPPPAARPAAEPCNNLFVSGLNKRTTSNGLKEAFSKFGQVIEARVITDRISGYSRGFGFVKYATVQEAGEAIKGMDGKFLDGWVIFAEYAKQREATQPSQQGAPYEYSS

SEQ ID NO: 3767 - DNA, 2547 bp, Sorghum bicolor
  misc_feature: Ceres ANNOT ID no. 6032589
  misc_feature: Encodes the peptide sequence at SEQ ID NO 3768
atggcttcgccggcgccggcagccgacggtgccgtgaatgcggccaatggtggcctcactgacccacttctagtgagcgcgaacggccacggtgccgctccgaggaaggctgcccatggcgccaaaggcaagtactgggtggccgccgacaaggccgagaggcgggctgcgaaggaggccggcggtgaggacggccgcgcgctgctgttccggaagtacaaggtcaaaggcgcccttctgcacccctacaggttgctgatcatcatccgattaatcgctgtccttgtcttcttcgcgtggcgcatcaggcacaacaaatctgacatcatgtggttttggacaatgtccatagttggcgatgtttggttcggcttctcgtggctcctcaaccagctcccaaagttcaaccctgtcaagaccatcccagacctggccgccctcaagcggcactttggcttccctgacggcacctctaggctccccggaattgatgttttcgtcaccactgccgaccccattgatgaacccatactgtacaccatgaactgtgtcctctccatcctcgctgttgactacccagtcgacaggcttgcctgctatctctcagatgacagcggggcactggttctctatgaggcattggtcgaggtcggaaagttcgcacctctgtgggttccattctgccgcaagtattccattgagccaagggcaccagaaagctattttgagcatgtggcgccaccacaggctggaagggtgacacaggagttcttgaatgattataggagggtgcaaatggagtatgatgagtttaaggtgcgcttggacaacctccctgatgccatctgcaagagatctgatgtttacaatagcatgagagctgcagaaggagatcaaaaggcaacttggatggcaaatgggacgcagtggcctggcacatggattgatccaacagaaaaccatagaaaaggacatcatgctccaattgccaaggttgtgctggagcatccaaaccgtggacaacatcatgaaagcaatctcagcattggcaccactgacgagcgcctcccaatgcttgtttatgtctcccgtgagaagaacccaaattatgaccacaacaagaaggcaggggccctgaatgcacaactgcgagcctctgcactcctctctaatgcccaactcatcatcaactttgactgcgatcactacatcaacaattctcaagccctaagttcagctgtctgcttcatgctagatcaacgggatggtgacaacaccgcatttgttcagttcccacagcgcttcgacaatgttgaccccacagaccgctatggcaaccacaaccgtgtcttctttgatgggaccatgcttgcccttaatggtttgcaaggaccctcataccttggcactggttgcatgttccgccgcttagcactctatggtattgacccaccccactgcagagcagagaacatcacagccgaagctagcaggtttggtaactccacaatcttcctagattcagtgtcaaaagccctgaaaaatgacaggtcaattacaccaccaccaattgatgacacattccttgctgagctagagagagttgtgacatgttcttatgacaaaggtactgactggggcaagggtgtagggtacatctatgacatagccactgaagatatagtaacaggatttcgcatccacgggcaggggtggcgctccatgtattgcacaatggagcatgacgcgttctgtggcgttgcaccaatcaacctaactgaacgcctccatcaaattgttcgttggtctggtgggtctttagagatgttcttctcccacaacaaccccattcataggtggtcaccggattcaaccccttcagcgctctacccagtcacatcagtcttcatcctgatctatgctctaagcccggtgatgtggcttatccctgatgaagtatacatccagagaccattcactaggtatgtcgtgtaccttctcgtaatcatagtgatgattcacatgattggctggcttgagataaagtgggcgggggtcacatggctggactattggcgcaatgagcagttctttatgatcggctcaaccagcgcatatccaatggcagtgctgcacatggcagtgaacctcctcacaaagaagggcatacacttcagggtcacttccaagcaaacagccgcagatgacaatgacaaatttgctgacttgtatgattttagatgggtgccaatgctcatcccaacaatgacagttctgatctgcaatgttggtgccattggtgtagccctgggcaaaacagtggtatacattggaacatggacagcggcaaagaagatgcatgcagcattgggtctgttgttcaacatatggatcatgtttctcctctacccatttgcactagcgatcatggggcggtgggcgaagaggccaatcatccttgtagtcttgctgccagttgtctttgcacttgttgcgctgttgtatgtaggtgtccatatcttacttgctggtgtaattccattctag

SEQ ID NO: 3768 - protein, 848 aa, Sorghum bicolor
  misc_feature: Ceres ANNOT ID no. 6032589
  misc_feature (68)..(849): Pfam Id: Cellulose_synt Pfam Desc: Cellulose synthase
  misc_feature (1)..(848): NCBI GI: 16519233 NCBI Desc: cellulose synthase-like protein oscslf3 [oryza sativa]
  misc_feature (1)..(796): NCBI GI: 115472699 NCBI Desc: os07g0553400 [oryza sativa (japonica cultivar-group)]
  misc_feature (85)..(843): NCBI GI: 115472691 NCBI Desc: os07g0551500 [oryza sativa (japonica cultivar-group)]
  misc_feature (33)..(836): NCBI GI: 16519229 NCBI Desc: cellulose synthase-like protein oscslf1 [oryza sativa]
  misc_feature (40)..(836): NCBI GI: 16519231 NCBI Desc: cellulose synthase-like protein oscslf2 [oryza sativa]
  misc_feature: Useful for making plants with altered cell wall content and/or composition
  misc_feature: Functional homolog of the protein sequence encoded by LOCUS at3g03050
  misc_feature: Functional homolog of the protein sequence encoded by LOCUS at5g16910
MASPAPAADGAVNAANGGLTDPLLVSANGHGAAPRKAAHGAKGKYWVAADKAERRAAKEAGGEDGRALLFRKYKVKGALLHPYRLLIIIRLIAVLVFFAWRIRHNKSDIMWFWTMSIVGDVWFGFSWLLNQLPKFNPVKTIPDLAALKRHFGFPDGTSRLPGIDVFVTTADPIDEPILYTMNCVLSILAVDYPVDRLACYLSDDSGALVLYEALVEVGKFAPLWVPFCRKYSIEPRAPESYFEHVAPPQAGRVTQEFLNDYRRVQMEYDEFKVRLDNLPDAICKRSDVYNSMRAAEGDQKATWMANGTQWPGTWIDPTENHRKGHHAPIAKVVLEHPNRGQHHESNLSIGTTDERLPMLVYVSREKNPNYDHNKKAGALNAQLRASALLSNAQLIINFDCDHYINNSQALSSAVCFMLDQRDGDNTAFVQFPQRFDNVDPTDRYGNHNRVFFDGTMLALNGLQGPSYLGTGCMFRRLALYGIDPPHCRAENITAEASRFGNSTIFLDSVSKALKNDRSITPPPIDDTFLAELERVVTCSYDKGTDWGKGVGYIYDIATEDIVTGFRIHGQGWRSMYCTMEHDAFCGVAPINLTERLHQIVRWSGGSLEMFFSHNNPIHRWSPDSTPSALYPVTSVFILIYALSPVMWLIPDEVYIQRPFTRYVVYLLVIIVMIHMIGWLEIKWAGVTWLDYWRNEQFFMIGSTSAYPMAVLHMAVNLLTKKGIHFRVTSKQTAADDNDKFADLYDFRWVPMLIPTMTVLICNVGAIGVALGKTVVYIGTWTAAKKMHAALGLLFNIWIMFLLYPFALAIMGRWAKRPIILVVLLPVVFALVALLYVGVHILLAGVIPF

SEQ ID NO: 3769 - DNA, 1218 bp, Sorghum bicolor
  misc_feature: Ceres ANNOT ID no. 6032599
  misc_feature: Encodes the peptide sequence at SEQ ID NO 3770
atggcgtcgctggcggcggcgggtgaggcgctgcccttcagcgacgacatcctagcagagatcttcatccggctccccaccctcgaggacttgggccgcgcctgcgcgtcctgccccgcgttccgccgcgtcatcaccagccactccttcctccgccgcctccacgcgctccacccgccgtccttgctgggcttcctcaccttctcctcgtggttccaccccacggaatcgtcacgctcctcggcgcgcgccgccagcgccgtcgctgaagctgccgatttcgagttctcgttccttcccaccaagaccaagggttcctggatggtccgggacgccctcggcggccgcttcgtcctcgactgcgacgacggtgcaggttctacattcaccaccatagcggtttgcgaccccttgttccgccgccacgtaattctcccgccactcccccaaggcttggccgcggcagtcgagcagccgctcgaagtggatgatgagcgtaggtgcgatgttttccttgccccctgcagcgaggagggggcacagggagcgccgcaagcgttcagtgtgatttggatggcgcattgccagactaagttagtggcattcatattctcctcggcaagctggcagtggcgagccattgcacctcgcagttggcgtgatctgaaccctgccatgcgtcgtgtcattaaggagtcccccttgcagtcgcgcagctatgcatatggctgtttctactggtgtttgtcagaattccactcccgcagcaagctgattatgctagatgtgggcaggatggagttctgtcctgtcaatcatccattcagccacagacttggggaattcgctgttgtggagttaggggaaagcagacgggggatgttcatgcttggtgataataccagcaatgaaggccgtatagttcaactatttagtgcaagcaaccaaattcatggtgagggtgccagtcagtgggtgctggagaatacagtcagactgtattgctctcgtagcttcaaaatgctaggtgttgctgatgggaaattactattgcaaggagcaagtgaacataagtccgaagaaaagtctctttgtatttcgctggacttcaagactaggcaggttcagggggttcgagggattattcacagtggccactgtcctatggtagtccgatatattggttacccaccatcactgtcattacctactatatga

SEQ ID NO: 3770 - protein, 405 aa, Sorghum bicolor
  misc_feature: Ceres ANNOT ID no. 6032599
  misc_feature (11)..(405): NCBI GI: 116308909 NCBI Desc: osigba0107a02.1 [oryza sativa (indica cultivar-group)]
  misc_feature (11)..(405): NCBI GI: 115481050 NCBI Desc: os10g0135300 [oryza sativa (japonica cultivar-group)]
  misc_feature (1)..(164): NCBI GI: 115462089 NCBI Desc: os05g0147700 [oryza sativa (japonica cultivar-group)]
  misc_feature (130)..(222): NCBI GI: 115472723 NCBI Desc: os07g0555400 [oryza sativa (japonica cultivar-group)]
  misc_feature (14)..(254): NCBI GI: 38567955 NCBI Desc: osjnbb0115i21.11 [oryza sativa (japonica cultivar-group)]
MASLAAAGEALPFSDDILAEIFIRLPTLEDLGRACASCPAFRRVITSHSFLRRLHALHPPSLLGFLTFSSWFHPTESSRSSARAASAVAEAADFEFSFLPTKTKGSWMVRDALGGRFVLDCDDGAGSTFTTIAVCDPLFRRHVILPPLPQGLAAAVEQPLEVDDERRCDVFLAPCSEEGAQGAPQAFSVIWMAHCQTKLVAFIFSSASWQWRAIAPRSWRDLNPAMRRVIKESPLQSRSYAYGCFYWCLSEFHSRSKLIMLDVGRMEFCPVNHPFSHRLGEFAVVELGESRRGMFMLGDNTSNEGRIVQLFSASNQIHGEGASQWVLENTVRLYCSRSFKMLGVADGKLLLQGASEHKSEEKSLCISLDFKTRQVQGVRGIIHSGHCPMVVRYIGYPPSLSLPTI

SEQ ID NO: 3771 - DNA, 330 bp, Sorghum bicolor
  misc_feature: Ceres ANNOT ID no. 6032601
  misc_feature: Encodes the peptide sequence at SEQ ID NO 3772
atggcttcaaagctccaggccctttggaaccatcctgctggccccaaaaccattcatttctgggctcctacatttaaatggggtatcagcatcgccaatgttgcagactttgcaaaaccacctgaaaagatatcctatcctcagcaagttgctgtggcttgcactgggatcatttggtcacgctacagcttggttatcacaccaaaaaactggaacctgttcagtgttaatgttgcaatggccagtacaggcttgtatcagctttcacgcaaaataaggcaagactacttttctgatgagaaggaaaccgccgcgtcgcacgaaggatga

SEQ ID NO: 3772 - protein, 109 aa, Sorghum bicolor
  misc_feature: Ceres ANNOT ID no. 6032601
  misc_feature (1)..(109): NCBI GI: 38637023 NCBI Desc: light induced protein like [oryza sativa (japonica cultivar-group)]
  misc_feature (1)..(109): NCBI GI: 32401369 NCBI Desc: probable light-induced protein [triticum aestivum]
  misc_feature (3)..(106): NCBI GI: 21593026 NCBI Desc: light induced protein like [arabidopsis thaliana]
  misc_feature (3)..(109): NCBI GI: 7268175 NCBI Desc: light induced protein like [arabidopsis thaliana]
  misc_feature (3)..(102): NCBI GI: 87248275 NCBI Desc: light-induced protein-like brain protein 44 [bombyx mori]
  misc_feature: The plant flowers significantly late compared to wild-type.
  misc_feature: Useful for making plants with modulated flowering time
  misc_feature: GREAT-hit functional homolog of the protein sequence given in SEQ ID NO 13197
  misc_feature: Useful for making plants with modulated biomass
  misc_feature: Useful for making plants with modulated flowering time
  misc_feature: Functional homolog of the protein sequence given in SEQ ID NO 13197
MASKLQALWNHPAGPKTIHFWAPTFKWGISIANVADFAKPPEKISYPQQVAVACTGIIWSRYSLVITPKNWNLFSVNVAMASTGLYQLSRKIRQDYFSDEKETAASHEG

SEQ ID NO: 3773 - DNA, 1248 bp, Sorghum bicolor
  misc_feature: Ceres ANNOT ID no. 6032620
  misc_feature: Encodes the peptide sequence at SEQ ID NO 3774
atgtcgttttgcttgttctttactttcctcaagcaaaaggggaagtactttggtttgctcgtctgctttctattggggaatggatgcctcttcgcatggaacagtatgcttacaatagaagattactatgtctacctcttccctaagaaccacccaaccagagttctcacgctggtatatcagccttttgccctgggagttacagctcttctagcataccacgaagcaaaaatcaacaccaggcttcggaatctgacaggatacacaatttacttcttaagttcttttgcaataataattctggatgtggccactaaagggcgaggtgggtttggagccttcgttggcatatgcgtaacaagtgcagcattcgggatagcagatgctcatgctcaaggtggtatgattggtgacctatccttgatgtgcccagagttcattcagtcctacttgtcaggtttggctgcatcaggagcaattacatcagctttgcgtctgattacaaaagcagcttttgagaactcacaagatggtttgcgaaaaggagcgatgctattcttttcgatatcatgcttcaatgagctattatgtgttcttctgtacacatttgtcttccccacattgcctattgtcaaattttatcgcttgaaggcagcttccgaaggtagcaaaactgttgctggtgacctagctgctgcaggagtcccaattcaacatgaagagcaagctatggaggatcccaaacaatatgtgcgattaagcaccaaactactgtttctgcaaaacgttgattacgcgcttgatatctttctgacatatgtcttgactctatctatcttccctggattcctatctgaagacaccggatcacacggcctagggacttggtatgcacttgttttgattacaatgtttaacgcgtgggatctcataggcagatatgtacccattattgtcaagctgaaatctcgaaaatgtatcatggcagcaaccctcgcacgctttctactcattcctgcattctattttactgcaaagtacggcgcacaagggtacatgatctttttgacatccttcttggggttgagcaacgggtatctaaccgtatgtatccttacagaggcacccaaaggatacaatgggccagagcaaaatgcgctggggaatgttcttgttgttttcctcatgattggactgttttctggtgttgtgctcgattggttatggctgatagggaaaggttggtga

SEQ ID NO: 3774 - protein, 415 aa, Sorghum bicolor
  misc_feature: Ceres ANNOT ID no. 6032620
  misc_feature (118)..(411): Pfam Id: Nucleoside_tran Pfam Desc: Nucleoside transporter
  misc_feature (14)..(359): NCBI GI: 140067226 NCBI Desc: delayed-early response protein/equilibrative nucleoside transporter [medicago truncatula]
  misc_feature (11)..(256): NCBI GI: 115472737 NCBI Desc: os07g0557400 [oryza sativa (japonica cultivar-group)]
  misc_feature (36)..(256): NCBI GI: 50508594 NCBI Desc: equilibrative nucleoside transporter(ent3)-like protein [oryza sativa (japonica cultivar-group)]
  misc_feature (16)..(411): NCBI GI: 3176684 NCBI Desc: contains similarity to equilibratiave nucleoside transporter 1 gbu81375 from homo sapiens. ests gbn65317, gbt20785, gbaa586285 and gbaa712578 come from this gene.
  misc_feature (16)..(411): NCBI GI: 3176684 (continued) [arabidopsis thaliana]
  misc_feature (265)..(411): NCBI GI: 115475271 NCBI Desc: os08g0205200 [oryza sativa (japonica cultivar-group)]
MSFCLFFTFLKQKGKYFGLLVCFLLGNGCLFAWNSMLTIEDYYVYLFPKNHPTRVLTLVYQPFALGVTALLAYHEAKINTRLRNLTGYTIYFLSSFAIIILDVATKGRGGFGAFVGICVTSAAFGIADAHAQGGMIGDLSLMCPEFIQSYLSGLAASGAITSALRLITKAAFENSQDGLRKGAMLFFSISCFNELLCVLLYTFVFPTLPIVKFYRLKAASEGSKTVAGDLAAAGVPIQHEEQAMEDPKQYVRLSTKLLFLQNVDYALDIFLTYVLTLSIFPGFLSEDTGSHGLGTWYALVLITMFNAWDLIGRYVPIIVKLKSRKCIMAATLARFLLIPAFYFTAKYGAQGYMIFLTSFLGLSNGYLTVCILTEAPKGYNGPEQNALGNVLVVFLMIGLFSGVVLDWLWLIGKGW

SEQ ID NO: 3775 - DNA, 1254 bp, Sorghum bicolor
  misc_feature: Ceres ANNOT ID no. 6032623
  misc_feature: Encodes the peptide sequence at SEQ ID NO 3776
atgagcatggacgtagcaggtgcagaggcacctgtcaaggggaagttccttggtatacttgtctgctggcttttgggaaatggaagccttttcgcgtggaacagtatgctcaccattgaagattactactcccatctcttcccgaattaccacccaacaagagtactcacgctatcttaccagccttttgcctttggaataaccctcatcttgacattctatgaagcaaagatgaacacaagattgagaaatcttgcaggattttcccttttcttcctcggttcctttgcattgataattctggatgttgcaactaaaggacatggtgggcttggagttttcattggtgtatgcataattagtgccatatttgggacagctgatgctaattgtcaaggcgcattggttggcgacctttctttgatgtgcccagagttcattcagtccttcatggcgggcttagctgcatcaggggttctcacatcagctttgagattaattaccaaggcagcttttgagagctcaaaagatggtcttcgcattggagctatactgttcttttcaatcacatgcctgttcgagctggtgtgcctcctgctatacacgttcgtcttcgccaaactacccatcgtaaagtactaccgcgcgaaggcagccgctgaaggtagcaagactgttgccagcgaccttgccgctgcagggatcatcgctgaacaacagggacaaatcgaggaggatccacagaaatacaagcgtctgaccactaaagagctgctcatgcagaacatcgactacgcgattgatatctacctgatatacgtcctgacgctgtcaatcttcccaggatttttgtctgaagacactggagaacacaacctaggatcatggtatgctcttgtgctgattgccatgtacaatgtgtgggacctgatcgggaggtacgtgccgctgatcccgtgcttgaagctgacctcccggaagggcatgatggtggctgtcttggcgcggttcctgttcatcccggccttctacttcacggccaaatacggcgaccaggggtacatgatcttcctaacctccctcctggggctcaccaacgggtacctcaccgtgtgtgtgctcatggaggcgcccaacggctacaatggccccgagcagaacgcgctgggcaacgtgctcgtcgtctgcctcctcggcggcctcttctcaggcgtcgtgctcgactggctctggctcattggcaagggctggtga

SEQ ID NO: 3776 - protein, 417 aa, Sorghum bicolor
  misc_feature: Ceres ANNOT ID no. 6032623
  misc_feature (119)..(413): Pfam Id: Nucleoside_tran Pfam Desc: Nucleoside transporter
  misc_feature (2)..(360): NCBI GI: 140067226 NCBI Desc: delayed-early response protein/equilibrative nucleoside transporter [medicago truncatula]
  misc_feature (10)..(256): NCBI GI: 115472737 NCBI Desc: os07g0557400 [oryza sativa (japonica cultivar-group)]
  misc_feature (36)..(256): NCBI GI: 50508594 NCBI Desc: equilibrative nucleoside transporter(ent3)-like protein [oryza sativa (japonica cultivar-group)]
  misc_feature (9)..(413): NCBI GI: 3176684 NCBI Desc: contains similarity to equilibratiave nucleoside transporter 1 gbu81375 from homo sapiens. ests gbn65317, gbt20785, gbaa586285 and gbaa712578 come from this gene.
  misc_feature (9)..(413): NCBI GI: 3176684 (continued) [arabidopsis thaliana]
  misc_feature (265)..(413): NCBI GI: 115475271 NCBI Desc: os08g0205200 [oryza sativa (japonica cultivar-group)]
MSMDVAGAEAPVKGKFLGILVCWLLGNGSLFAWNSMLTIEDYYSHLFPNYHPTRVLTLSYQPFAFGITLILTFYEAKMNTRLRNLAGFSLFFLGSFALIILDVATKGHGGLGVFIGVCIISAIFGTADANCQGALVGDLSLMCPEFIQSFMAGLAASGVLTSALRLITKAAFESSKDGLRIGAILFFSITCLFELVCLLLYTFVFAKLPIVKYYRAKAAAEGSKTVASDLAAAGIIAEQQGQIEEDPQKYKRLTTKELLMQNIDYAIDIYLIYVLTLSIFPGFLSEDTGEHNLGSWYALVLIAMYNVWDLIGRYVPLIPCLKLTSRKGMMVAVLARFLFIPAFYFTAKYGDQGYMIFLTSLLGLTNGYLTVCVLMEAPNGYNGPEQNALGNVLVVCLLGGLFSGVVLDWLWLIGKGW

SEQ ID NO: 3777 - DNA, 1206 bp, Sorghum bicolor
  misc_feature: Ceres ANNOT ID no. 6033006
  misc_feature: Encodes the peptide sequence at SEQ ID NO 3778
atgctaggaggaaggcacagcagcgctttggcaagcttcttggcgactctgctcagtttgggagctgcaatggcagcgcggccggctccgctggcgacacgccctgcgggcaacggaacgtgccagtccagggtggagtcgttcgggtacaagtgcgaggaacacaccgtgaccaccgcggacgggtacatcctgagcttgcagcggatccccggcggccgcggctccggccaatcgccggcggccggcactaagatcccggtgctgctccagcacggcctcctcatggacggcgtgacgtggctgatgaactccccgaacgagtctctgggctacatcctggcggacggcggatacgacgtgtggatcgccaacacccgtggcaccgtgtacagccgcggccacaccacgctgtcctccagcgacccggcgtactgggactggtcgtgggacgagctcgccagcaacgacgtctcggcggtggtgcagtacgtgtacgcgcagtccggccagcagaggctgcactacgtcggccactcgctggggacgctcatcgcgttcgcggcgctcagccagcaccagcagctggggatgctgaggtccgcaggactgctcagccccatcgcctacctcaacaaggtggcgtcgccgctcgcgctggcgggcgcagacaccttcctcgccgaggctctgtactggctggggctcgatgagttcgacccgacaggtttgtttcctctggatttataccacagagcgagcttgagctttgctggcgcaggtgataactgctgcctcgacaactcctcggtccaggtcttccttgcccatgagccacaggcttcagcaaccaagaacatggtccatctagctcaaagtcatgatccgacgagggacgcttgcaagtacgactacggcaatgccgcggacaacacgaagcactatgggcaggcgacgccgccggcctacgacgtctcggcgatccccgacgacttcccgctcttcctcagctacggcggcagggacaccctgtcggaccagcaggacgtgagccacctgctccaggtgctcaagtcgcacgacggcgacaagctcacggtccagtacttggaggactacgcgcacgccgacttcgtcttcgctggcaacgcaagggagagagtgtatgcgcctctcatggccttcttcaaactccaggacaaatga

SEQ ID NO: 3778 - protein, 401 aa, Sorghum bicolor
  misc_feature: Ceres ANNOT ID no. 6033006
  misc_feature (37)..(105): Pfam Id: Abhydro_lipase Pfam Desc: ab-hydrolase associated lipase region
  misc_feature (119)..(391): Pfam Id: Abhydrolase_1 Pfam Desc: alpha/beta hydrolase fold
  misc_feature (144)..(401): NCBI GI: 21742925 NCBI Desc: osjnba0079f16.20 [oryza sativa (japonica cultivar-group)]
  misc_feature (35)..(399): NCBI GI: 62866924 NCBI Desc: lipase [ricinus communis]
  misc_feature (38)..(396): NCBI GI: 39636476 NCBI Desc: triacylglycerol/steryl ester lipase-like protein [medicago truncatula]
  misc_feature (99)..(399): NCBI GI: 35395931 NCBI Desc: lysosomal acid lipase-like protein [arabidopsis thaliana]
  misc_feature (128)..(397): NCBI GI: 51091881 NCBI Desc: lingual lipase-like [oryza sativa (japonica cultivar-group)]
MLGGRHSSALASFLATLLSLGAAMAARPAPLATRPAGNGTCQSRVESFGYKCEEHTVTTADGYILSLQRIPGGRGSGQSPAAGTKIPVLLQHGLLMDGVTWLMNSPNESLGYILADGGYDVWIANTRGTVYSRGHTTLSSSDPAYWDWSWDELASNDVSAVVQYVYAQSGQQRLHYVGHSLGTLIAFAALSQHQQLGMLRSAGLLSPIAYLNKVASPLALAGADTFLAEALYWLGLDEFDPTGLFPLDLYHRASLSFAGAGDNCCLDNSSVQVFLAHEPQASATKNMVHLAQSHDPTRDACKYDYGNAADNTKHYGQATPPAYDVSAIPDDFPLFLSYGGRDTLSDQQDVSHLLQVLKSHDGDKLTVQYLEDYAHADFVFAGNARERVYAPLMAFFKLQDK

SEQ ID NO: 3779 - DNA, 528 bp, Sorghum bicolor
  misc_feature: Ceres ANNOT ID no. 6033044
  misc_feature: Encodes the peptide sequence at SEQ ID NO 3780
atggcgatagcgatgaagggaatattcagaggtctgaagatcatagcacaaatattcacagtgcagagggatgagcatgagatcgagatcgggtaccctacagacgtgaggcatgtatcgcacgtaggcctgggcgctagcgactcctgtccgagctggatgagtgaattcagaggattagaggaggtgacaacagcaggaggacggggggcatccatcgtaggctctgctgcgctgtcgaggcacacctcctgggcttccctagacttcgagcaaccagcgacaggcgcgctgccggcggcggcggaggcctgcgccgcggacagcagctcgggccaggacggcgccgcgagaggcggcggtccagtgaccgtgaccacgaagaaggcggcgaggccgaggaaagcctcccgggcgtcggcgtcgcccggcgggtcgtcgtcgtggcggtccacggcgtcgttcgccacggcgtgcgacggccactcctgcgagcttcacgtccccgccggcctgcaagccgcctga

SEQ ID NO: 3780 - protein, 175 aa, Sorghum bicolor
  misc_feature: Ceres ANNOT ID no. 6033044
  misc_feature (1)..(111): NCBI GI: 33320064 NCBI Desc: desiccation-associated protein [lilium longiflorum]
  misc_feature (1)..(72): NCBI GI: 30685713 NCBI Desc: p21-rho-binding domain-containing protein [arabidopsis thaliana]
  misc_feature (5)..(151): NCBI GI: 91806212 NCBI Desc: p21-rho-binding domain-containing protein [arabidopsis thaliana]
  misc_feature (1)..(146): NCBI GI: 15229436 NCBI Desc: p21-rho-binding domain-containing protein [arabidopsis thaliana]
  misc_feature (1)..(58): NCBI GI: 4508080
MAIAMKGIFRGLKIIAQIFTVQRDEHEIEIGYPTDVRHVSHVGLGASDSCPSWMSEFRGLEEVTTAGGRGASIVGSAALSRHTSWASLDFEQPATGALPAAAEACAADSSSGQDGAARGGGPVTVTTKKAARPRKASRASASPGGSSSWRSTASFATACDGHSCELHVPAGLQAA

SEQ ID NO: 3781 - DNA, 1887 bp, Sorghum bicolor
  misc_feature: Ceres ANNOT ID no. 6033059
  misc_feature: Encodes the peptide sequence at SEQ ID NO 3782
atggcgtacgcgcaggggcagcagccaccgccgccgcagtacggcgggtaccacccgcaggcgccgccgcctaagtacccgccccacccttacggcgcgccgctcccgcagtacccgcccgggccctacgcgcgccccatgccgccggcctactcgcacctgccgccgcaccagcagccgcctcccccctacgcgtcgcacccgccgccgccgcacgtcttgtccacgccctccccgccgccgcaccacccttacatgcacccgccgccgttcgaatccgccccgccgccgccggccgcgccccccgccgatccggagctccagaagcgcatcgacaagctcgtcgagtacatcgccaagaacgggccggatttcgaggccatgatccgcgacaagcagcacgacaacccggactacgccttcgtcttcggcggggaaggtcacgcctactacaggtacatgctctggctcttgccgcgcccgcctgtgccgtcgccctacccgccgggctcgatgcatatgatgccgcctatgggccctatgatgagggggccgccgattcaccagccggggtaccctccattctatgatcagcaccagcagtttgctgctgctcacggccatggggactatgaagctgcggcacaaccgttcaagggactgtctggggcgctccctgctgatgttgctgctgagctgcaagatgtgcttaacaatcttaatggcactaaggaatcaataaagggagcaaagtcatggtttatgcaaagattgccatttacgccggctctggctgaagctcttaaggagagagtatttgtgttggaggattcagagcggcagctgcacataatcttcctagtgaacgatattctttttgaaagcttacaaaggcgaactaatattcgggaccttgacaatgaggctattgcttttaaatccgtactgggttccatgcttgcaagggtttacaataattcacaaagtaaagatgacaaccagactcgcattgagaaaatccttcagttttggggttcaaaggaagtttacgaccaggaaacaattgctaattttgaaagagagatgaaaggtgccttgccttatcctttggtgccacgacatgtttcgccagatccctcgaccttttcaggatcagcaccactgcgctcaaaatggtcctcggaacctccagagaaggataatgcaatccatcctgttgctggtgcaacccaatctgttccctctgcacaatttccagcaaaccaacttccagctggtgtttatcctcctgtaggccaaactacttttgcagcatctttgccagtgcaaccatcgttaattccctctgtggctcctcaaagcactgctcctacaaatgattcgaatccacctccttatccactcttcccccctggcctcattcccggaatggttcggaagatgcaaataggtagtggagtgccttactctcccttaagcccgcttgacatccccacaaccatccctccatcaaccgtcccagagtctgagatccttgagcgtgtatcgaagttcttcagtgatattggggaggtaaacccatcagaaggtccaatgagacaaagcgagcccggtgactacgatgactacgagagggaacttcctgcccgaaagggaggcgcttgcattcctcccccaccgaatctgcttgtcacaaaccctgagacagggatgcgtgctgatggtagcattgacagtaaacctgggtccagtggtcggttgggtctcggagcttctgccgatccaaatgaggtgagccagtatgatgatgtatattcttcttatcggaagcaaaggagcacaacgtatcattcttccatcactgctcgctcatcgacggcaaggtga

SEQ ID NO: 3782 - protein, 628 aa, Sorghum bicolor
  misc_feature: Ceres ANNOT ID no. 6033059
  misc_feature (111)..(154): Pfam Id: Surp Pfam Desc: Surp module
  misc_feature (3)..(626): NCBI GI: 77403667 NCBI Desc: pre-mrna splicing factor [solanum tuberosum]
  misc_feature (101)..(194): NCBI GI: 34877472 NCBI Desc: similar to sr-related ctd associated factor 6 [rattus norvegicus]
  misc_feature (101)..(194): NCBI GI: 54035074 NCBI Desc: sr-related ctd associated factor 6 [mus musculus]
  misc_feature (101)..(194): NCBI GI: 25992620 NCBI Desc: sr-related ctd associated factor 6 [mus musculus]
  misc_feature (101)..(194): NCBI GI: 119672912 NCBI Desc: sr-related ctd associated factor 6 [mus musculus]
MAYAQGQQPPPPQYGGYHPQAPPPKYPPHPYGAPLPQYPPGPYARPMPPAYSHLPPHQQPPPPYASHPPPPHVLSTPSPPPHHPYMHPPPFESAPPPPAAPPADPELQKRIDKLVEYIAKNGPDFEAMIRDKQHDNPDYAFVFGGEGHAYYRYMLWLLPRPPVPSPYPPGSMHMMPPMGPMMRGPPIHQPGYPPFYDQHQQFAAAHGHGDYEAAAQPFKGLSGALPADVAAELQDVLNNLNGTKESIKGAKSWFMQRLPFTPALAEALKERVFVLEDSERQLHIIFLVNDILFESLQRRTNIRDLDNEAIAFKSVLGSMLARVYNNSQSKDDNQTRIEKILQFWGSKEVYDQETIANFEREMKGALPYPLVPRHVSPDPSTFSGSAPLRSKWSSEPPEKDNAIHPVAGATQSVPSAQFPANQLPAGVYPPVGQTTFAASLPVQPSLIPSVAPQSTAPTNDSNPPPYPLFPPGLIPGMVRKMQIGSGVPYSPLSPLDIPTTIPPSTVPESEILERVSKFFSDIGEVNPSEGPMRQSEPGDYDDYERELPARKGGACIPPPPNLLVTNPETGMRADGSIDSKPGSSGRLGLGASADPNEVSQYDDVYSSYRKQRSTTYHSSITARSSTAR

SEQ ID NO: 3783 - DNA, 906 bp, Sorghum bicolor
  misc_feature: Ceres ANNOT ID no. 6033061
  misc_feature: Encodes the peptide sequence at SEQ ID NO 3784
atgagggggtggcgagaggaggtggaggtggtggctctgtcgctgcggggctacggctacggcaacgaggaggatgaccggccggagaagccgcggcgttacggggtgacggagatgcggagccccttctactccttccgccccgcaaaccaggcgctccaggaaatattggattctcttggtccatttgttgatggtttgaagttttctggaggatgccatagtttgatgggaaaggatttggttagagagatcactgatctagcacacaagcatgacatttatgtgagcacaggtgattgggcagagcatttgctgcgtcaaggaccctcttctttcaagcaatatgtagaggaatgcaaggccttagggtttgacacaattgagctgaatcctggatctctcaacctccctgaagaagctctgttgagactagtgcgcctcatcaagagtagtggtttgagggcaaagccaatgttttcagtgaagtttgacagttctgatattcctgcatctggtgatagggcctttggggcgtacatagctccggtcaaggagaagacctcagaaagagttgaagatgttgacctgctgattaggagggcagagagatgcttggaagcaggcgcagatatgatcatgatcgacgccgatgatgtttgccagcatgctgaatctctgaggacagacatcattgccaagattgtaggccggctcggacttgataagaccatgtttgaagcttccaatcccaaaacctcagagtggtttgtcagacgatatggcccaagggtaaatctcttcgttgaccactccgatgtgatgaatctggagcgcctccggggcttcaacatgctcagaagcaacttgggctcccatgttgcctcgccgttcttcctgatgtaa

SEQ ID NO: 3784 - protein, 301 aa, Sorghum bicolor
  misc_feature: Ceres ANNOT ID no. 6033061
  misc_feature (22)..(292): Pfam Id: ComA Pfam Desc: (2R)-phospho-3-sulfolactate synthase (ComA)
  misc_feature (1)..(301): NCBI GI: 52076892 NCBI Desc: (2r)-phospho-3-sulfolactate synthase-like [oryza sativa (japonica cultivar-group)]
  misc_feature (22)..(301): NCBI GI: 54639897 NCBI Desc: phosphosulfolactate synthase-related protein [lycopersicon esculentum]
  misc_feature (27)..(281): NCBI GI: 59860474 NCBI Desc: (2r)-phospho-3-sulfolactate synthase-like protein [physcomitrella patens]
  misc_feature (25)..(281): NCBI GI: 108805355 NCBI Desc: (2r)-phospho-3-sulfolactate synthase, coma [rubrobacter xylanophilus dsm 9941]
  misc_feature (27)..(153): NCBI GI: 83588991 NCBI Desc: (2r)-phospho-3-sulfolactate synthase, coma [moorella thermoacetica atcc 39073]
  misc_feature: Useful for making plants with modulated heat sensitivity
  misc_feature: GREAT-hit functional homolog of the protein sequence given in SEQ ID NO 13432
  misc_feature: Useful for making plants with modulated heat sensitivity
  misc_feature: Functional homolog of the protein sequence given in SEQ ID NO 13432
MRGWREEVEVVALSLRGYGYGNEEDDRPEKPRRYGVTEMRSPFYSFRPANQALQEILDSLGPFVDGLKFSGGCHSLMGKDLVREITDLAHKHDIYVSTGDWAEHLLRQGPSSFKQYVEECKALGFDTIELNPGSLNLPEEALLRLVRLIKSSGLRAKPMFSVKFDSSDIPASGDRAFGAYIAPVKEKTSERVEDVDLLIRRAERCLEAGADMIMIDADDVCQHAESLRTDIIAKIVGRLGLDKTMFEASNPKTSEWFVRRYGPRVNLFVDHSDVMNLERLRGFNMLRSNLGSHVASPFFLM

SEQ ID NO: 3785 - DNA, 1170 bp, Sorghum bicolor
  misc_feature: Ceres ANNOT ID no. 6033064
  misc_feature: Encodes the peptide sequence at SEQ ID NO 3786
atgggcagcgtcggcggcggctcgccggaggaggagcagcagaccgcgggtattggcggtgacgaccctccgccgccggcggtctgcgtcacggggtccacgggctacgtcggctcctggctcgtccgcaccctgctgcgccgaggctaccgcgtccacgccaccgccagggacacaggcaaggcctggcaggtgctcggcgccgtggaagaagggagggagagggacaggtgccgccggcgcctcctccgtgtgttccgggcggacatgggcgaggaagggagcttcgacgccgccgtcacgggatgcgtggcgctcttccacgtcgcggcctccatggagctccacgtatcatcacccgccgcccatcacgacagccttgttgaggagcacgtgaggtcacgtgtgctggagccggcgacgaggggaaccatcaacgtgctccgttcctgcgtccgcgcggggaccgtgcgccgggtcgtcttcacgtcctccgtcagcacgttgacggcggcggacgccgaggggcggcggaaggccgtcctcgacgagtcctgcctcagatccctcgacgacgtctggcgcaccaagcccgtcggctggatctacatcctgtccaagcggctgaccgaggaggcggcgttcaggttcgcgcgcgagaacggcgtccacctcgtctccctcgtcctgcccaccgtcgccgggccgttcctgacgccaagcgtccccacgagcatccagctcctgctgtcacccatcacaggtgacccgaagctctacgcggtgctggcctcggtgcacgcccggttcgggtgcgtgccgctggcgcacgtccaggacgcgtgcgacgcgcacgtcttgctcatggaggcgccgcgcgccgaggggcggtacctgtgcgccgccggcgggtactcggcggcgcacctcgcgcggctcctcgcctcgcgctaccctccgttcaggcctggcgacaggctgagcagagacttcgacgacgacgcctcgtgctcgccgccggtggtttcgtcgaggaggctgctggatcttgggttcaggttccggtacggcgtcgaggacgtggtgaaggatagtgtcgcgcagtgccttgcccatggattcctggagcagcctgaaggacagagcaccttcaggctttcagcagtgtag

SEQ ID NO: 3786 - protein, 389 aa, Sorghum bicolor
  misc_feature: Ceres ANNOT ID no. 6033064
  misc_feature (28)..(301): Pfam Id: Epimerase Pfam Desc: NAD dependent epimerase/dehydratase family
  misc_feature (30)..(282): Pfam Id: NAD_binding_4 Pfam Desc: Male sterility protein
  misc_feature (29)..(329): Pfam Id: 3Beta_HSD Pfam Desc: 3-beta hydroxysteroid dehydrogenase/isomerase family
  misc_feature (83)..(375): NCBI GI: 78172244 NCBI Desc: nadph-dependent reductase [zea mays]
  misc_feature (28)..(375): NCBI GI: 17148809 NCBI Desc: dihydroflavonol-4-reductase [triticum monococcum]
  misc_feature (83)..(375): NCBI GI: 27465024 NCBI Desc: dihydroflavonol reductase [populus tremuloides]
  misc_feature (83)..(375): NCBI GI: 53830379 NCBI Desc: dihydroflavonol-4-reductase [ginkgo biloba]
  misc_feature (83)..(375): NCBI GI: 121755805 NCBI Desc: dihydroflavonol 4-reductase [gossypium hirsutum]
MGSVGGGSPEEEQQTAGIGGDDPPPPAVCVTGSTGYVGSWLVRTLLRRGYRVHATARDTGKAWQVLGAVEEGRERDRCRRRLLRVFRADMGEEGSFDAAVTGCVALFHVAASMELHVSSPAAHHDSLVEEHVRSRVLEPATRGTINVLRSCVRAGTVRRVVFTSSVSTLTAADAEGRRKAVLDESCLRSLDDVWRTKPVGWIYILSKRLTEEAAFRFARENGVHLVSLVLPTVAGPFLTPSVPTSIQLLLSPITGDPKLYAVLASVHARFGCVPLAHVQDACDAHVLLMEAPRAEGRYLCAAGGYSAAHLARLLASRYPPFRPGDRLSRDFDDDASCSPPVVSSRRLLDLGFRFRYGVEDVVKDSVAQCLAHGFLEQPEGQSTFRLSAV

SEQ ID NO: 3787 - DNA, 1059 bp, Sorghum bicolor
  misc_feature: Ceres ANNOT ID no. 6033072
  misc_feature: Encodes the peptide sequence at SEQ ID NO 3788
atgccgtcgtcgtcgtcgtcgtcgtcgtcgtcacaaagccgcagccgcccgtgctgctggctgccactgcttctcgtcctccatttctctcgcagggccaccgccgccggcaaggtgccggcgctgatcgtgttcggggactcgacggtggacgccggcaacaacaacttcatccccaccgtcgccaggggcaacttcccgccgtacggccgcgacttcgacaggggcgtcgccaccggcaggttctccaacggccgcctcgtcaccgacttcctctcggaggcgttcggcttgccgtcgtcggtgccggcgtacctggaccccggctacaccatcgaccagctcgccaccggcgtcagctttgcctccggaggcaccgggctggatgatttgacagcggaaatcgcatcagttatccccatgagccagcagctggagtacttcaaggagtacaaggcgagactgcagctcgcaaagggggagaccgcggcgaacggcatcatcgccgaggccgtgtacatcttcagcatcggcaccaacgacttcatcgtcaactacttcaccttccctctccggcaagcccagtacacgccggcggagtacgccgcgtacctcgtcggcctcgccgaggctgccgtccgcgacgcctacggcctcggcgcgcgcaagatggagttcaccggcctcgcgccgttcgggtgcatccccgccgccaggacgctcaaccgcgacgaccccggcgactgcaacgaggagtacaaccgcctggcggcgacgttcaacgccgggctgcaggaggtcgtgaggaggctcgacggcgagctcgccggcgcgcgggtggtctacgcggagacgtacagcgtcgtggctgacatcgtcgccaatccgtcggactacggattcgagaacgttgagcaaggctgctgtggcacaggactcatcgagacatctgtgatgtgcggcctggacgaaccgctgacgtgtcaagacccgtcggagcagacgtacgagatattatctgaccatagtctcaacactgcattacgagtgttcctgtga

SEQ ID NO: 3788 - protein, 352 aa, Sorghum bicolor
  misc_feature: Ceres ANNOT ID no. 6033072
  misc_feature (42)..(343): Pfam Id: Lipase_GDSL Pfam Desc: GDSL-like Lipase/Acylhydrolase
  misc_feature (19)..(352): NCBI GI: 115478062 NCBI Desc: os09g0132200 [oryza sativa (japonica cultivar-group)]
  misc_feature (17)..(352): NCBI GI: 50726533 NCBI Desc: gdsl-motif lipase/hydrolase-like [oryza sativa (japonica cultivar-group)]
  misc_feature (33)..(351): NCBI GI: 48716709 NCBI Desc: lipase sil1-like protein [oryza sativa (japonica cultivar-group)]
  misc_feature (12)..(330): NCBI GI: 51535564 NCBI Desc: anter-specific proline-rich protein apg precursor-like [oryza sativa (japonica cultivar-group)]
  misc_feature (19)..(336): NCBI GI: 92886160 NCBI Desc: lipolytic enzyme, g-d-s-l [medicago truncatula]
MPSSSSSSSSSQSRSRPCCWLPLLLVLHFSRRATAAGKVPALIVFGDSTVDAGNNNFIPTVARGNFPPYGRDFDRGVATGRFSNGRLVTDFLSEAFGLPSSVPAYLDPGYTIDQLATGVSFASGGTGLDDLTAEIASVIPMSQQLEYFKEYKARLQLAKGETAANGIIAEAVYIFSIGTNDFIVNYFTFPLRQAQYTPAEYAAYLVGLAEAAVRDAYGLGARKMEFTGLAPFGCIPAARTLNRDDPGDCNEEYNRLAATFNAGLQEVVRRLDGELAGARVVYAETYSVVADIVANPSDYGFENVEQGCCGTGLIETSVMCGLDEPLTCQDPSEQTYEILSDHSLNTALRVFL

SEQ ID NO: 3789 - DNA, 1734 bp, Sorghum bicolor
  misc_feature: Ceres ANNOT ID no. 6033100
  misc_feature: Encodes the peptide sequence at SEQ ID NO 3790
atgggattctccttcttcacctaccgagccggtgctcgattgctggacgggatcgcgcgccccggcgtctccaccgcagcacttctgttcgcggcggccagtggcggcggccttgtggcttacgcggattccgctgcagagagtgctccggagccatctcagggtgctcccaagaagaagctgctggttcttgggactggctgggctgggacgtcattcctgaagaacctcgactgctcccagtatgaagtgaaggtcatctcgccccggaactacttcgcattcacgcctctgcttccgagtgtcacgtgtgggactgtcgagccgcgcagcattattgaacctgtgcggaggatgtttgagaagaaaaacaaggatgtcacattttgtgaagcagagtgtttcaagattgacgcaaataaaaaaactgtacattgccgttctgctgttggaactaatcttgatgggaacggtgattttatgttagattatgattacttagttgttgctcttggagctactgtaagtacatttaacactcctggagtgctggagcactgctgctttttgaaggaagtagaggatgctcagaagatacggagatgtgtgatagattgttttgaaaaagcatcacttccaaatattagcgccgaggagaaaaggaaaattctacattttgtagttattggtggtggacctactggagttgaatttgcagcagagatgcatgattttcttgtcgaagatttggtgaaactataccctgccattcaagactttgtgaagataacaattattcaatcgggagagcatatattgaatatgtttgatgaaagaatagctgcatttgctgaacagaagttccagagggatggcatcgaagtgtgcacaggcttcagagtgataaaggtgtctgatgattcgattacaatgaagagcaaatcagctggcaaggaggtatcagtgccttatggaatggctgtttggtctgctggcattggtactcgtcctgtcatcatggacttcatgcaacaaattgggcagactaatcgacgtgccttggcaactaatgagtggttaagagttcgtgagtgtgaaggtgtctatgcaattggtgactgtgctacagacgatatttcaatggtattcaagatggcagacaaggacaattctggcactttaacactgaaagagatcaatgatgttttagaagatatatgtataagatatccacaagtagagctttatatgaaaagtatgcacatgcttgatattgcggatttaataaaaggcgcaataggtgattctcacaaggagtctatggtggttgacatagaggagttcaaaaaagctctgagccatgttgattcccaagtgaaaaatgctccagcaacagctcaggtcgctgcgcaacaaggacagtatctcgctgaatgtttcaacaaaatggaaaaatgcaaagaggatccagaaggccctttgcgcatgacaggggggtctggccgtcactttttccgcccatttcgctacaagcatttcgggcaattcgcacccctgggtggagaacaagccgctgcagagctcccgggcgactgggtctccatgggccacagcactcagtggctctggtactctgtgtatgccagcaagcaggtgagctggcgcacgagggtgctggtggtttcagactggacgcgccggttcatattcgggagggattcaagccgaatttag

SEQ ID NO: 3790 - protein, 577 aa, Sorghum bicolor
  misc_feature: Ceres ANNOT ID no. 6033100
  misc_feature (60)..(379): Pfam Id: Pyr_redox_2 Pfam Desc: Pyridine nucleotide-disulphide oxidoreductase
  misc_feature (225)..(332): Pfam Id: Pyr_redox Pfam Desc: Pyridine nucleotide-disulphide oxidoreductase
  misc_feature (378)..(406): Pfam Id: efhand Pfam Desc: EF hand
  misc_feature (28)..(577): NCBI GI: 5734587 NCBI Desc: external rotenone-insensitive nadph dehydrogenase [solanum tuberosum]
  misc_feature (28)..(577): NCBI GI: 87240748 NCBI Desc: fad-dependent pyridine nucleotide-disulphide oxidoreductase; calcium-binding ef-hand [medicago truncatula]
  misc_feature (23)..(577): NCBI GI: 18417151 NCBI Desc: nadh dehydrogenase-related [arabidopsis thaliana]
  misc_feature (25)..(577): NCBI GI: 7267261 NCBI Desc: at4g05020 [arabidopsis thaliana]
  misc_feature (25)..(577): NCBI GI: 14532464 NCBI Desc: at4g05020/t32n4_4 [arabidopsis thaliana]
MGFSFFTYRAGARLLDGIARPGVSTAALLFAAASGGGLVAYADSAAESAPEPSQGAPKKKLLVLGTGWAGTSFLKNLDCSQYEVKVISPRNYFAFTPLLPSVTCGTVEPRSIIEPVRRMFEKKNKDVTFCEAECFKIDANKKTVHCRSAVGTNLDGNGDFMLDYDYLVVALGATVSTFNTPGVLEHCCFLKEVEDAQKIRRCVIDCFEKASLPNISAEEKRKILHFVVIGGGPTGVEFAAEMHDFLVEDLVKLYPAIQDFVKITIIQSGEHILNMFDERIAAFAEQKFQRDGIEVCTGFRVIKVSDDSITMKSKSAGKEVSVPYGMAVWSAGIGTRPVIMDFMQQIGQTNRRALATNEWLRVRECEGVYAIGDCATDDISMVFKMADKDNSGTLTLKEINDVLEDICIRYPQVELYMKSMHMLDIADLIKGAIGDSHKESMVVDIEEFKKALSHVDSQVKNAPATAQVAAQQGQYLAECFNKMEKCKEDPEGPLRMTGGSGRHFFRPFRYKHFGQFAPLGGEQAAAELPGDWVSMGHSTQWLWYSVYASKQVSWRTRVLVVSDWTRRFIFGRDSSRI

SEQ ID NO: 3791 - DNA, 1233 bp, Sorghum bicolor
  misc_feature: Ceres ANNOT ID no. 6033103
  misc_feature: Encodes the peptide sequence at SEQ ID NO 3792
atgccggggctcatgacgatgatggcactagcaccatcgccgcccatgtcggtgaggccatgcttctgcaacaagatgaggggtactacgatgttgctggtcaagaatcgttcttcttcccaagcacatctcctcggccgccgcagctggcgcgctccggcagcgacgacggtggccaccgcagccgcaactgcctttcatgttgatgagcaggaacgggaagagatgatgatgcggcgcctggcggaggacgggtgggtggacgagcatatgctgccgctgctcacccccgtggaggaggcctggcagccggccgacctgctgccctccttcgtcgtctccgccgacgagcagcggagccaggtggcggagctccaggcccgtgcggctggcgtgcccgacgacctcctcgtctgcctcgtgggcagcatggtcacggaggagggcctgcccggctacatgtccatggccaaccgcgtggcgggcggcggcgacgccaccggctgcgacgaccacggctgggcgcgctggctgcgcggctggaccgccgaggagaaccgccacggcgacctgctcaaccgctacctctacctgtgcggccgcgtggacatgcggcgcgtcgagacgacggtgcaccacctcctcggccgcggcatgcgcgccatgctgcggccctccagcgcgtaccacagcctcatctacggctccttccaggagcgcgccaccttcgtctcccacgcccgcaccgccaggcaggcgggcctccacggcgacgcctgcctcgccaagctctgcggcgtcatcgcggccgacgagaggcgccacgaggcagcctacaccagggccgccgccagggccttcgaggacgaccaggacggcatggtgcgggcgctcgccgccgtgatgcgcgccaagatcaccatgcccggcgagctcatggacgacggccgcgacgagcgcctcttcgatcacttctcggcggttgcgcagcgctcgggggtgtacacggcggcggactacgccgacatggtggagcacttcgtgcgcaggtggaaggtggcggagctcggcgccggcctgtccggcgaggggcggcgcgcgcaggactacgtgtgcgggctgccgcgcaagatacgcaggatggaggagctggctcaagaccgtgcggcccaaatgggggcccagtcggtttgcttcagttgggtgttcgataggcccgtccgcatccactga

SEQ ID NO: 3792 - protein, 410 aa, Sorghum bicolor
  misc_feature: Ceres ANNOT ID no. 6033103
  misc_feature (71)..(407): Pfam Id: FA_desaturase_2 Pfam Desc: Fatty acid desaturase
  misc_feature (44)..(409): NCBI GI: 115475221 NCBI Desc: os08g0199400 [oryza sativa (japonica cultivar-group)]
  misc_feature (67)..(409): NCBI GI: 34222062 NCBI Desc: at3g02610 [arabidopsis thaliana]
  misc_feature (67)..(409): NCBI GI: 79387246 NCBI Desc: acyl-[acyl-carrier protein] desaturase [arabidopsis thaliana]
  misc_feature (84)..(409): NCBI GI: 2290400 NCBI Desc: stearoyl-acp desaturase [helianthus annuus]
  misc_feature (84)..(409): NCBI GI: 951427 NCBI Desc: stearoyl-acyl-carrier protein desaturase
  misc_feature (84)..(409): SWISSPROT Homolog: EC 1.14.19.2 Acyl-[acyl-carrier-protein] desaturase, chloroplast precursor
  misc_feature: The sequence is a functional homolog of SEQ ID NO. 338 in the 11/188,298 US application
MPGLMTMMALAPSPPMSVRPCFCNKMRGTTMLLVKNRSSSQAHLLGRRSWRAPAATTVATAAATAFHVDEQEREEMMMRRLAEDGWVDEHMLPLLTPVEEAWQPADLLPSFVVSADEQRSQVAELQARAAGVPDDLLVCLVGSMVTEEGLPGYMSMANRVAGGGDATGCDDHGWARWLRGWTAEENRHGDLLNRYLYLCGRVDMRRVETTVHHLLGRGMRAMLRPSSAYHSLIYGSFQERATFVSHARTARQAGLHGDACLAKLCGVIAADERRHEAAYTRAAARAFEDDQDGMVRALAAVMRAKITMPGELMDDGRDERLFDHFSAVAQRSGVYTAADYADMVEHFVRRWKVAELGAGLSGEGRRAQDYVCGLPRKIRRMEELAQDRAAQMGAQSVCFSWVFDRPVRIH

SEQ ID NO: 3793 - DNA, 1491 bp, Sorghum bicolor
  misc_feature: Ceres ANNOT ID no. 6033107
  misc_feature: Encodes the peptide sequence at SEQ ID NO 3794
atggccatcgactccggcggcggcggagcgaagcggcaaagggtggatgagcaaggggatcgatgcgaaatggtgggctcggacgcggtcccgatggaccgcatctctgcgctaccggacgagctgcggcagcgcatcctgacgcacctcccgctcaaggacgccatccgcacgggggcgctcgcgcacgggtggcgcgacctgtggaagggccggtgggcgcaccgcgcctccctcgaggtgcacctccgctcccgcgacgacccgcggagggagctggacgcgttggagcacgaaccgcgcccgcgccgacggctcgaccgcttctccctcatcgtcgacatctgcaaactcaagtcctcggagctccggcgcttcctcgactacgcctcggagtgcggcgtcgaggacctccacgtggagacgcgcaagatcacggccgcggacaagctcagcttccacctgccgctgtcgagcccgtccctcgcgtgcctctcgctccgccgcatcagcgtctccagtatgtactacaagggcgcccggtcgttccaggctctccaggtcatccggctccactcagttaacattacccaggcggcgttcagaaaaatgatggagctgtgccccagcctcctcacactcgacctgcgcgactgtgactgtgacgactgcttttggaactacgacagatgcttggtcatgcctcagaacctgaggagtgttagcgtcacggagtgtgatggattcacccttctgaacatggtgcctctgcccaaccttcgatccttccactacagtggacacttcgtcgaggcccccttcaaccttccaggcgacgccgttcttgctgatctttatattctgtttgctgattcagtatcaataaagtacgatgccaaaaggttgaatagttctctcccgaaggatttatctggcctcaacgttctcaccatctgttccaatgttctcccggttgcatctttcttgacagatgatggaaaaagtgctcatttgcccaatctcaacttaaacagtttgagagagctacagttactcatgttaaaaatggacgctgtcaacctagctgacctttatgtgttcctcaagacctgccaatgtcctaatctggagaggctctttgtgcagctcccgaaatctagttatggacccatggaatgttcaactgatgaggtgagggaagaaccaccagagaatggcttagacaaccttgtgattgtgaaggtcatgaacttcaattggcaccgcactgaggttgagctagtgagttttctattgaggaaagctagctccctgcgtaaactattaatagtttctcccaatatcgctccattggatttgcccggtgtacaagaagcagaccttgtgcttttcaaagaagctttaaccaatggcaagataattttgagtgagtctgacgatgctgcaactcaaccatatcattttgaagtgccaagttctagttgtcagtga

SEQ ID NO: 3794 - protein, 496 aa, Sorghum bicolor
  misc_feature: Ceres ANNOT ID no. 6033107
  misc_feature (33)..(80): Pfam Id: F-box Pfam Desc: F-box domain
  misc_feature (38)..(448): NCBI GI: 92877741 NCBI Desc: cyclin-like f-box; fbd [medicago truncatula]
  misc_feature (166)..(487): NCBI GI: 87162656 NCBI Desc: cyclin-like f-box; fbd [medicago truncatula]
  misc_feature (32)..(70): NCBI GI: 115457298 NCBI Desc: os04g0208600 [oryza sativa (japonica cultivar-group)]
  misc_feature (162)..(448): NCBI GI: 38344931 NCBI Desc: osjnba0018m05.22 [oryza sativa (japonica cultivar-group)]
  misc_feature (33)..(219): NCBI GI: 15623859 NCBI Desc: p0046e05.27 [oryza sativa (japonica cultivar-group)]
MAIDSGGGGAKRQRVDEQGDRCEMVGSDAVPMDRISALPDELRQRILTHLPLKDAIRTGALAHGWRDLWKGRWAHRASLEVHLRSRDDPRRELDALEHEPRPRRRLDRFSLIVDICKLKSSELRRFLDYASECGVEDLHVETRKITAADKLSFHLPLSSPSLACLSLRRISVSSMYYKGARSFQALQVIRLHSVNITQAAFRKMMELCPSLLTLDLRDCDCDDCFWNYDRCLVMPQNLRSVSVTECDGFTLLNMVPLPNLRSFHYSGHFVEAPFNLPGDAVLADLYILFADSVSIKYDAKRLNSSLPKDLSGLNVLTICSNVLPVASFLTDDGKSAHLPNLNLNSLRELQLLMLKMDAVNLADLYVFLKTCQCPNLERLFVQLPKSSYGPMECSTDEVREEPPENGLDNLVIVKVMNFNWHRTEVELVSFLLRKASSLRKLLIVSPNIAPLDLPGVQEADLVLFKEALTNGKIILSESDDAATQPYHFEVPSSSCQ

SEQ ID NO: 3795 - DNA, 2130 bp, Sorghum bicolor
  misc_feature: Ceres ANNOT ID no. 6033120
  misc_feature: Encodes the peptide sequence at SEQ ID NO 3796
atgattactttcgtggactcggcggccatggagcgggagcgggagagtgacaggtgcctggacccgcagctgtggcacgcctgcgccggcggcatggtccagatgccgccggtgcactccaaggtgtactacttcccgcagggccacgcggagcacgcgcagggccccgtcgtcgacctccccgccggccgtgtcccggccctcgtcctctgccgcgtcgccgccgtccgcttcatggccgatccggacaccgacgaggtcttcgccaagatccgcctcgccccggtccggcccaacgagccgggatacgctgctgacgccgacgacgccattggcgccgcggcggcgggcggcggcgcgcaagaggacaagcccgcgtccttcgccaagacgctgacgcagtctgacgccaacaacggcggcggtttctccgtgccacgctactgcgccgagaccatcttcccgcggctggactactccgccgacccgcccgtccagaccgtgctcgccaaggacgtgcacggcgtcgtctggaagttccgccacatctaccgcggcacgcctcggcgccacctgctcaccaccgggtggagcaccttcgtgaaccagaagaagctcgtggccggggactcgattgtcttcatgcggacggagaacggggacctctgcgtcggcatccggcgcgccaagaagggtggcatcggagggcccgagttcctgcaccaccaccagccgcccccgccgccgggcggcggcggctacgccgggttctccatgttcctgagaggaggagaagaggacggcagcaagatgatggccacgggcgcggccacgagggggaataaggtcagggtgcgggtgcggccggaggaggtcgtcgaggccgcgaacctcgccgtgagcgggcagccgttcgaggtggtctactacccgagggcgagcacgccggagttctgcgtcaaggctggcgcggtccgcgccgccatgcgcacccagtggtgcgccgggatgcggttcaagatggccttcgagacggaggactcgtccaggatcagctggttcatgggcactgtctccgccgtgcaggtcgctgaccccatcagatggcccaattcaccctggaggcttcttcaggtggcttgggatgaaccggacttgttacagaacgtgaagagagtgagcccatggctggtcgagcttgtctcaaacatgccggccatccaccacctcacgccgttctcgccgccgccgaggaagaagctgtgtgttccactgtacccggagcttccgctggagggccaccagttcccggcgccgatgttccatggaagccctctcggccgtggtgttggcccgatgtgctatttcccggatggcactcctgcaggcatacagggagccaggcatgctcaatttggcatatctttatcagatctccaccttgacaagctgcagtcgagtctgtcaccgcacgggcttcaccaccaccagctggacggccacggcgtgcagccgaggatcgccgctggcctcatcatcggccacccggcagcagctcgagatgacatctcgtgcttgctcaccattggcaccaccccacagaacaggaaaccatcatcagacgtcaagaaggcggcggcggcggcaccgcaactgatgctctttgggaaaccgattctcactgagcagcagatatctctaggcaatgtcgcgggcttcccggcgccgaagaagagcccttctgatgacgttgccgagaggacggtgagcaactcggacgtctcaagccccgggagcaaccatggtggctcgtccaggtccagtggaggagccccgtcgtgccaggacaacaaggtgcctgatctcgggctggagaccggccactgcaaggtgttcatgcagtcggaggatgttgggcgcacgctcgacctctctgctgttggctcgtacgaggagctctaccagaggctcgccgacatgtttggcatcgacaagactgagctgatgagccatgttttctaccgcgacgacgcttctggagcgctcaaacacaccggcgacaagcctttcagtgagttcacgaaaactgcccggaggctgaccatactaacggacgccgagcagcgataa

SEQ ID NO: 3796 - protein, 709 aa, Sorghum bicolor
  misc_feature: Ceres ANNOT ID no. 6033120
  misc_feature (295)..(378): Pfam Id: Auxin_resp Pfam Desc: Auxin response factor
  misc_feature (127)..(232): Pfam Id: B3 Pfam Desc: B3 DNA binding domain
  misc_feature (1)..(705): NCBI GI: 19352051 NCBI Desc: auxin response factor 10 [oryza sativa]
  misc_feature (16)..(480): NCBI GI: 7269908 NCBI Desc: transcription factor-like protein [arabidopsis thaliana]
  misc_feature (15)..(565): NCBI GI: 6165644 NCBI Desc: auxin response factor 10 [arabidopsis thaliana]
  misc_feature (13)..(706): NCBI GI: 38344647 NCBI Desc: osjnbb0061c13.15 [oryza sativa (japonica cultivar-group)]
  misc_feature (114)..(690): NCBI GI: 134103847 NCBI Desc: auxin response factor 3 [gossypium hirsutum]
  misc_feature: The sequence is a functional homolog of SEQ ID NO 118 in the 10/666,642US patent application
  misc_feature: The sequence is a functional homolog of SEQ ID NO 1184 in the 10/666,642US patent application
  misc_feature: The sequence is a functional homolog of SEQ ID NO 1185 in the 10/666,642US patent application
  misc_feature: The sequence is a functional homolog of SEQ ID NO 1404 in the 10/666,642US patent application
  misc_feature: The sequence is a functional homolog of SEQ ID NO 42 in the 10/838,616US patent application
  misc_feature: The sequence is a functional homolog of SEQ ID NO 442 in the 10/666,642US patent application
  misc_feature: Useful for making plants with modulated growth and phenotype characteristics
  misc_feature: The sequence is a functional homolog of SEQ ID NO 42 in the 20060008874 US patent application
  misc_feature: The sequence is a functional homolog of SEQ ID NO 118 in the 20070033671 US patent application
  misc_feature: The sequence is a functional homolog of SEQ ID NO 1184 in the 20070033671 US patent application
  misc_feature: The sequence is a functional homolog of SEQ ID NO 1185 in the 20070033671 US patent application
  misc_feature: The sequence is a functional homolog of SEQ ID NO 442 in the 20070033671 US patent application
  misc_feature: The sequence is a functional homolog of SEQ ID NO 1185 in the 10/666,642 US patent application
  misc_feature: The sequence is a functional homolog of SEQ ID NO 1184 in the 10/666,642 US patent application
  misc_feature: The sequence is a functional homolog of SEQ ID NO 1186 in the 10/666,642 US patent application
  misc_feature: The sequence is a functional homolog of SEQ ID NO 442 in the 10/666,642 US patent application
  misc_feature: The sequence is a functional homolog of SEQ ID NO 1428 in the 10/666,642 US patent application
  misc_feature: The sequence is a functional homolog of SEQ ID NO 1431 in the 11/479,226 US patent application
  misc_feature: The sequence is a functional homolog of SEQ ID NO 168 in the 10/666,642 US patent application
MITFVDSAAMERERESDRCLDPQLWHACAGGMVQMPPVHSKVYYFPQGHAEHAQGPVVDLPAGRVPALVLCRVAAVRFMADPDTDEVFAKIRLAPVRPNEPGYAADADDAIGAAAAGGGAQEDKPASFAKTLTQSDANNGGGFSVPRYCAETIFPRLDYSADPPVQTVLAKDVHGVVWKFRHIYRGTPRRHLLTTGWSTFVNQKKLVAGDSIVFMRTENGDLCVGIRRAKKGGIGGPEFLHHHQPPPPPGGGGYAGFSMFLRGGEEDGSKMMATGAATRGNKVRVRVRPEEVVEAANLAVSGQPFEVVYYPRASTPEFCVKAGAVRAAMRTQWCAGMRFKMAFETEDSSRISWFMGTVSAVQVADPIRWPNSPWRLLQVAWDEPDLLQNVKRVSPWLVELVSNMPAIHHLTPFSPPPRKKLCVPLYPELPLEGHQFPAPMFHGSPLGRGVGPMCYFPDGTPAGIQGARHAQFGISLSDLHLDKLQSSLSPHGLHHHQLDGHGVQPRIAAGLIIGHPAAARDDISCLLTIGTTPQNRKPSSDVKKAAAAAPQLMLFGKPILTEQQISLGNVAGFPAPKKSPSDDVAERTVSNSDVSSPGSNHGGSSRSSGGAPSCQDNKVPDLGLETGHCKVFMQSEDVGRTLDLSAVGSYEELYQRLADMFGIDKTELMSHVFYRDDASGALKHTGDKPFSEFTKTARRLTILTDAEQR

SEQ ID NO: 3797 - DNA, 1650 bp, Sorghum bicolor
  misc_feature: Ceres ANNOT ID no. 6033124
  misc_feature: Encodes the peptide sequence at SEQ ID NO 3798
atgggcgcagacgagcagccatccccgacgcggaaacgcgaccgcgaggaagaaggagaggacctctccgatgggggcgccgccgagaagcggccgcgcgcagagggcgcgtccctgctggggctggccacctacgaggacgaggatgaagacgaagcggccaggggccacgcgaatggccggcgcgcggtggagcctgatgaggaggaggatgacgatgaggaggacgacgtgaggagggctccggagaggaggcccaggcaggcggagctgcgccgggactgcccgtacctcgacaccgtgaacagacaggttcttgattttgattttgagaagttctgttcaatctccttgtcaaatttgaatgtgtatgcatgcttggtctgtggaaaatatttccaaggaagagggttgaaatctcatgcatatacacacagtcttgaagcaggccatcatgtgttcattaatcttcaaaccgaaaaggcttactgtcttcctgatggatatgagatcaatgatccatcgttagaagatattcggcatgttctcaatccaaggtttacaaaagagcaggttctaaatcttgacaaaaataagcagtggtctagagcacttgatggctccaattatctacctggaatggtgggtcttaacaacatcaaggaaactgattttgtgaatgtcacaatacagtcattaatgagagttacgcctctgagaaatttctttctaatccctgaaaactatcagcatagaaaatcaccattggttcatcgttttggggaattgacacgtaagatttggcatgctaggaacttcaagggacaggttagtccacatgagtttctgcaagcagttatgaaggccagcgacaaacggtttcagattggtgtacagtcagacccagtggaatttatgtcatggctcttgaacacactgcatgcgaaactaaaaagctcaaagaagaaaaacagaagcataatacatgattgttttcagggagaacttgaagttgttaaggaggttcataggaagcatataatggaaaagagagaggatggcgatgagccgaatggtgaggcaggttcagtggttggaactgcagatggaattgttactgaaacatctaaggtcccattcctgatgctcggtcttgacctgccacctccaccacttttcaaagatgccatggagaaaaatatcattccacaggtaccgttatttaacatactaaagaagtttgatggtgagactgtgacagaggtcgtccgaccatccattgcccgaatgaggtaccgagtcactagactaccgaagtatctgatccttcatatgcgaaggtttaccaaaaataacttctttgtcgagaaaaatcctactctagttaattttcctgtgaagaacttggaattgaaggactacattccattacctaagccgaaagagaatcataagctacgttcaaagtatgacctcatagcaaacattgtccatgatggcaaaccaggcgaggggtgctacagagtatttgtacagcggaaatctgaagaggcctggtacgagatgcaggatcttcatgttaccgagactcttcctcaaatggtagctctctcagaaacctacatgcaaatatatgagcaacacgaatga

SEQ ID NO: 3798 - protein, 549 aa, Sorghum bicolor
  misc_feature: Ceres ANNOT ID no. 6033124
  misc_feature (212)..(545): Pfam Id: UCH Pfam Desc: Ubiquitin carboxyl-terminal hydrolase
  misc_feature (54)..(341): NCBI GI: 33589748 NCBI Desc: at4g22410/f7k2_7 [arabidopsis thaliana]
  misc_feature (61)..(547): NCBI GI: 60470085 NCBI Desc: sap dna-binding domain-containing protein [dictyostelium discoideum]
  misc_feature (11)..(549): NCBI GI: 37231483 NCBI Desc: usp39 protein [homo sapiens]
  misc_feature (11)..(549): NCBI GI: 62897263 NCBI Desc: ubiquitin specific protease 39 variant [homo sapiens]
  misc_feature (11)..(549): NCBI GI: 13926071 NCBI Desc: u4/u6.u5 tri-snrnp-associated 65 kda protein [homo sapiens]
MGADEQPSPTRKRDREEEGEDLSDGGAAEKRPRAEGASLLGLATYEDEDEDEAARGHANGRRAVEPDEEEDDDEEDDVRRAPERRPRQAELRRDCPYLDTVNRQVLDFDFEKFCSISLSNLNVYACLVCGKYFQGRGLKSHAYTHSLEAGHHVFINLQTEKAYCLPDGYEINDPSLEDIRHVLNPRFTKEQVLNLDKNKQWSRALDGSNYLPGMVGLNNIKETDFVNVTIQSLMRVTPLRNFFLIPENYQHRKSPLVHRFGELTRKIWHARNFKGQVSPHEFLQAVMKASDKRFQIGVQSDPVEFMSWLLNTLHAKLKSSKKKNRSIIHDCFQGELEVVKEVHRKHIMEKREDGDEPNGEAGSVVGTADGIVTETSKVPFLMLGLDLPPPPLFKDAMEKNIIPQVPLFNILKKFDGETVTEVVRPSIARMRYRVTRLPKYLILHMRRFTKNNFFVEKNPTLVNFPVKNLELKDYIPLPKPKENHKLRSKYDLIANIVHDGKPGEGCYRVFVQRKSEEAWYEMQDLHVTETLPQMVALSETYMQIYEQHE

SEQ ID NO: 3799 - DNA, 432 bp, Sorghum bicolor
  misc_feature: Ceres ANNOT ID no. 6033125
  misc_feature: Encodes the peptide sequence at SEQ ID NO 3800
atggcgatgcggatggtggcgacggcggcagcagtggcgctggtggcggtgatgtgcgtgctggcgccccgagcggcggcgcagacgacgccgaactgcgcggcgaagctggtcccgtgctcgccgtacatcaacacgacggggacgccgccggacacctgctgcagcccgctcaaggacgccgtccagaacgacctcaagtgcctctgcgatctctacgccacgccggagatcttcaaggccttcaacatcagcatcgaggcggccctcggcgtctccaagcgctgcggcctcgacgacaccaccaccgcctgcaagggttcaccatcaggtggcagtggcagtggcagcaacgccggtcatcgcactctatctgtcggtttcccaggattgatgagcttgttcttggctttgtggtctgcattggcataa

SEQ ID NO: 3800 - protein, 143 aa, Sorghum bicolor
  misc_feature: Ceres ANNOT ID no. 6033125
  misc_feature (1)..(110): NCBI GI: 30696757 NCBI Desc: protease inhibitor/seed storage/lipid transfer protein (ltp) family protein [arabidopsis thaliana]
  misc_feature (1)..(108): NCBI GI: 6630451 NCBI Desc: f23n19.16 [arabidopsis thaliana]
  misc_feature (12)..(120): NCBI GI: 92872955 NCBI Desc: plant lipid transfer protein/par allergen [medicago truncatula]
  misc_feature (12)..(117): NCBI GI: 140058019 NCBI Desc: plant lipid transfer protein/par allergen [medicago truncatula]
  misc_feature (5)..(134): NCBI GI: 115469910 NCBI Desc: os06g0711900 [oryza sativa (japonica cultivar-group)]
  misc_feature: The plant is abnormally small.
  misc_feature: Useful for making plants with modulated biomass
  misc_feature: Functional homolog of the protein sequence given in SEQ ID NO 13171
  misc_feature: The sequence is a functional homolog of SEQ ID NO. 364 in the 11/188,298 US application
MAMRMVATAAAVALVAVMCVLAPRAAAQTTPNCAAKLVPCSPYINTTGTPPDTCCSPLKDAVQNDLKCLCDLYATPEIFKAFNISIEAALGVSKRCGLDDTTTACKGSPSGGSGSGSNAGHRTLSVGFPGLMSLFLALWSALA

SEQ ID NO: 3801 - DNA, 1836 bp, Sorghum bicolor
  misc_feature: Ceres ANNOT ID no. 6033144
  misc_feature: Encodes the peptide sequence at SEQ ID NO 3802
atgaggccaccgccgctgccgcagggcaggggagcaggcgggggtggcgcgctcggcaggcgcgcgttcgcgtccctcctcgcggcggctgtcgtcgcgctcgcgctcctctgcctcttctacggagccgcgttcgccccttccatccgccgcgcgcaccctcgccttcccctccggctgcggttccgggcccaggggacggaagcgctcccagcggacctcgtcgtctcctccatcccggtgtgcgacgcgcggcactcggagctgatcccgtgcttggaccggcgcctccactacgagctccggctccgcctcaacctctccctcatggagcactacgagcgccactgcccgccggcgtcgcgccgcctcaactgcctcatcccaccgccccacggctaccaggtgcccatcaggtggccgaggagcagggacgaggtctggaaggccaacataccccacccgcaccttgctgctgagaagtcagaccagcggtggatggtcgtcaatggcgataagatcaacttccctggtgggggcacccacttccacactggcgctgacaagtatattgtgcaccttgcgcagatgctgaattttccaaatggcaagctcaacaatggagggaacatcaggaatgtgcttgatgtcggctgtggggttgccagctttggcgcttaccttctttcgcatgatatacttgcgatgtctctcgctcccaatgacgtgcatgaaaatcaaattcagtttgcccttgagagagggatcccggcaacccttggtgtgttgggtacaaggaggctgccatacccaagccgctcattcgaaatggcacattgctcgcgttgtcggattgactggctgcagagggatggggtcttgttgctggaagtggatagggtattaaggcctggaggatattttgtgtattcatcaccggaggcctatgctttggaccccttcaacaggaagatatggagacagatgagtgaccttgctcgaaggatgtgctggcgcgttgcatctaagaagaaccagacagtgatatgggctaaaccattgactaatggatgctttatgaggagagagcctggaacactcccccccatgtgcgaacatgatgatgatccagatgctgcttggaatgtacccatgaaagcatgccaaactccatactctgagagagttaacaaggctaaaggcagcgaattacttccctggccacaaaggctcacagcaccaccaccttgcctgaaagagcttggaatcagttcaaacaatttttctgaagacaatgctatttggcattctagagtaattcagtactggaagcacatgaagtctgagatacggaaggattccttcagaaatgttatggatatgagtgctaaccttggtgggtttgcagcatctctgaagaaaaaggatgtctgggtaatgaatgtagttcctttcacggaatctggaaagctgaaggttatatatgatcgtggtttaatggggactatccacaattggtgtgaatcattctcgacgtacccacgcacctacgacctccttcacgcctggctcctattttcggagatagagaaacagggatgtagcctggaggatcttctgatcgagatggaccgcatccttaggccttatgggtacgccatcatcagagacaaagctgctgtcataaactacatcaagaagcttttaccagtgctaagatgggatgactggacatttgaggtgagacctaagaaagatgcgctcacaacaggtgatgaacgagtcttgatcgcgaggaaaaagctctggaatcagtcgttgcaagatccgtcgtag

SEQ ID NO: 3802 - protein, 611 aa, Sorghum bicolor
  misc_feature: Ceres ANNOT ID no. 6033144
  misc_feature (215)..(310): Pfam Id: Methyltransf_11 Pfam Desc: Methyltransferase domain
  misc_feature (1)..(607): NCBI GI: 52077023 NCBI Desc: dehydration-responsive protein-like [oryza sativa (japonica cultivar-group)]
  misc_feature (21)..(604): NCBI GI: 42573369 NCBI Desc: dehydration-responsive protein-related [arabidopsis thaliana]
  misc_feature (10)..(609): NCBI GI: 11994314 NCBI Desc: ankyrin-like protein [arabidopsis thaliana]
  misc_feature (78)..(609): NCBI GI: 7268141 NCBI Desc: ankyrin like protein [arabidopsis thaliana]
  misc_feature (10)..(609): NCBI GI: 21536697 NCBI Desc: ankyrin-like protein [arabidopsis thaliana]
  misc_feature: The sequence is a functional homolog of SEQ ID NO 1236 in the 11/479,226US patent application
  misc_feature: Useful for making plants with modulated growth and phenotype characteristics
  misc_feature: The sequence is a functional homolog of SEQ ID NO 1236 in the 20070022495 US patent application
  misc_feature: The sequence is a functional homolog of SEQ ID NO 1236 in the 11/479,226 US patent application
  misc_feature: Useful for making plants with altered cell wall content and/or composition
  misc_feature: Functional homolog of the protein sequence given in SEQ ID NO 13845
MRPPPLPQGRGAGGGGALGRRAFASLLAAAVVALALLCLFYGAAFAPSIRRAHPRLPLRLRFRAQGTEALPADLVVSSIPVCDARHSELIPCLDRRLHYELRLRLNLSLMEHYERHCPPASRRLNCLIPPPHGYQVPIRWPRSRDEVWKANIPHPHLAAEKSDQRWMVVNGDKINFPGGGTHFHTGADKYIVHLAQMLNFPNGKLNNGGNIRNVLDVGCGVASFGAYLLSHDILAMSLAPNDVHENQIQFALERGIPATLGVLGTRRLPYPSRSFEMAHCSRCRIDWLQRDGVLLLEVDRVLRPGGYFVYSSPEAYALDPFNRKIWRQMSDLARRMCWRVASKKNQTVIWAKPLTNGCFMRREPGTLPPMCEHDDDPDAAWNVPMKACQTPYSERVNKAKGSELLPWPQRLTAPPPCLKELGISSNNFSEDNAIWHSRVIQYWKHMKSEIRKDSFRNVMDMSANLGGFAASLKKKDVWVMNVVPFTESGKLKVIYDRGLMGTIHNWCESFSTYPRTYDLLHAWLLFSEIEKQGCSLEDLLIEMDRILRPYGYAIIRDKAAVINYIKKLLPVLRWDDWTFEVRPKKDALTTGDERVLIARKKLWNQSLQDPS

SEQ ID NO: 3803 - DNA, 972 bp, Sorghum bicolor
  misc_feature: Ceres ANNOT ID no. 6033167
  misc_feature: Encodes the peptide sequence at SEQ ID NO 3804
atgacgatggcgggcggcgggggactgaaccggtcttcatcgagggggcagctgccgccacaagagctgcttgacgatctctgcagccggttccttctgaatgtgcccaaggaggagctggagtcgttcgagcggatcctgttcctgctggagcaggcgcactggttctacgaggacaactccgtcgagcacaatcccaacctcaagtccctctccttcaaggacttcacctccctcatgttcaagagctgcactgctctcaggccctacatcgctcacctggatgatatctacaaggacttcaacaactacaagttccgtgtccccgtgtctggcgccatcatcctagatgacacttatgagagatgcttgcttgttaagggatggaaggctggggccagctggagctttcctcgtggaaagaggaataaagacgaggaagatcacacatgtgccattagagaagttctagaggaaactgggtgtgatgtttctacatttttaaatttggatgattgcattgaagtttcaattggacaacaaagggttcggctctacatcataacaggggttaaaagagatactgtgtttgcacctcaaaccaagaaggaaatcagtgaaatctcatggcacagaattgatgacctcttaccagctagtgatgacgcagtatctcgggcagtgaatggaatgaagctgtacatggttgctccatttttgactggtcttaaggcttggattgccacacatcctccaccactgcatcagaaaccagaggcatctgctagaggtactgtgtggaaggcgaagaattcaagtggcagtaccccagtggagaaccctgttgctaaagcaggatctgacgtgcaggcacatcatgttcacaaccgccccggtcgcagcttcagaaacttcaggtttgacacggcaagcatcctgcagtccatggaggcttccttcctacgcacctag

SEQ ID NO: 3804 - protein, 323 aa, Sorghum bicolor
  misc_feature: Ceres ANNOT ID no. 6033167
  misc_feature (21)..(105): Pfam Id: DCP2 Pfam Desc: Dcp2, box A domain
  misc_feature (107)..(237): Pfam Id: NUDIX Pfam Desc: NUDIX domain
  misc_feature (1)..(323): NCBI GI: 47497392 NCBI Desc: decapping protein 2-like [oryza sativa (japonica cultivar-group)]
  misc_feature (22)..(247): NCBI GI: 2388911 NCBI Desc: spac19a8.12 [schizosaccharomyces pombe]
  misc_feature (13)..(250): NCBI GI: 41055884 NCBI Desc: similar to decapping enzyme hdcp2 [danio rerio]
  misc_feature (13)..(250): NCBI GI: 46362549 NCBI Desc: similar to decapping enzyme hdcp2 [danio rerio]
  misc_feature (22)..(247): NCBI GI: 85544072 NCBI Desc: chain b, crystal structure of s.pombe mrna decapping enzyme dcp2p
MTMAGGGGLNRSSSRGQLPPQELLDDLCSRFLLNVPKEELESFERILFLLEQAHWFYEDNSVEHNPNLKSLSFKDFTSLMFKSCTALRPYIAHLDDIYKDFNNYKFRVPVSGAIILDDTYERCLLVKGWKAGASWSFPRGKRNKDEEDHTCAIREVLEETGCDVSTFLNLDDCIEVSIGQQRVRLYIITGVKRDTVFAPQTKKEISEISWHRIDDLLPASDDAVSRAVNGMKLYMVAPFLTGLKAWIATHPPPLHQKPEASARGTVWKAKNSSGSTPVENPVAKAGSDVQAHHVHNRPGRSFRNFRFDTASILQSMEASFLRT

SEQ ID NO: 3805 - DNA, 1302 bp, Sorghum bicolor
  misc_feature: Ceres ANNOT ID no. 6033183
  misc_feature: Encodes the peptide sequence at SEQ ID NO 3806
atggatttcgaggtgcaggtgatagagtcgtcgtttgtaacgcccagcgagccggcaccgaggaaggagctctggctgtcctccttggacctctggctggccaaccaaggccacactccgacgatctatctctacagcagctccaaggatgctgctgcggctgatcatttcttcgacgtggctaggctcaaggaggctatggccagagccttggtggccttctaccccctcgccggccgcctcggcgtcaacgacgccgacggcaggatggagatcagctgtaatggcgaaggtgcactctttgttgtcgctcaagctgatgatctcactgccgatgacgtcaagaaattcaagccgtcgccagagctgaggcggctgtttgttccactcgttgagccatcgtccatcatgttggccgtacaggtgactttcttgaagtgtggaggggtggcgttagggaccgctctccaccacatcgccgttgatgctttaagcgcgttccacttcttccagacatggtcggccttctccaagcatggtgaccacgctaccgtggagctcccttgccatgaccgtacccgactatgtgcacggtccccgcccacagtccatcccgatgcactcttgacgttctaccctaagcatgccttctccgaccctttggcgttgggacctcttgccatccaagtcctcaccatttccaaggaccagatcgcctccttgaagctcctctgcggcggtggcacgacgagcaccttctgcgccgtgagcgctctcatgtggcagtgcacatgcattgcacgccagctcccacctaattctcaagcgcgcctcgcgttcccggctgacctccggcgtagaatgagaccgcccctccagagccactactttggcaacgcggtgttcaggctatgcgtcactggcgtggcatgggatattgccacagagaagttgggatccgtcgctggccgtatcagaggcgccatcgatcgaatggatgatgagctagtgcgctctgcgatcgactactttgagatggacgagaaggacaaccggcctccgaggggtaccttgccgctgacggacctgcatatttcaagttggttgggtaggccacagtacgatgcagatttcggatgggggaagccagagttgatgtcgctggcagagaaccaccgtggggggtttgtgtttttgatgaacaatgacgatggtgctggcagcggcggcgtccgtctgctcatgtgcatggaggctgtaaatataaaggagctagtgcggctgctttatgcaaagctctag

SEQ ID NO: 3806 - protein, 433 aa, Sorghum bicolor
  misc_feature: Ceres ANNOT ID no. 6033183
  misc_feature (3)..(432): Pfam Id: Transferase Pfam Desc: Transferase family
  misc_feature (6)..(432): NCBI GI: 62734082 NCBI Desc: transferase family [oryza sativa (japonica cultivar-group)]
  misc_feature (2)..(346): NCBI GI: 115475267 NCBI Desc: os08g0205000 [oryza sativa (japonica cultivar-group)]
  misc_feature (5)..(430): NCBI GI: 90265141 NCBI Desc: h0711g06.15 [oryza sativa (indica cultivar-group)]
  misc_feature (5)..(430): NCBI GI: 115459250 NCBI Desc: os04g0500700 [oryza sativa (japonica cultivar-group)]
  misc_feature (1)..(430): NCBI GI: 82568711 NCBI Desc: alcohol acyl-transferase [prunus mume]
  misc_feature: Useful for making plants with altered Lignin content
  misc_feature: Useful for making plants with altered cell wall content and/or composition
  misc_feature: Functional homolog of the protein sequence given in SEQ ID NO 12900
MDFEVQVIESSFVTPSEPAPRKELWLSSLDLWLANQGHTPTIYLYSSSKDAAAADHFFDVARLKEAMARALVAFYPLAGRLGVNDADGRMEISCNGEGALFVVAQADDLTADDVKKFKPSPELRRLFVPLVEPSSIMLAVQVTFLKCGGVALGTALHHIAVDALSAFHFFQTWSAFSKHGDHATVELPCHDRTRLCARSPPTVHPDALLTFYPKHAFSDPLALGPLAIQVLTISKDQIASLKLLCGGGTTSTFCAVSALMWQCTCIARQLPPNSQARLAFPADLRRRMRPPLQSHYFGNAVFRLCVTGVAWDIATEKLGSVAGRIRGAIDRMDDELVRSAIDYFEMDEKDNRPPRGTLPLTDLHISSWLGRPQYDADFGWGKPELMSLAENHRGGFVFLMNNDDGAGSGGVRLLMCMEAVNIKELVRLLYAKL

SEQ ID NO: 3807 - DNA, 1311 bp, Sorghum bicolor
  misc_feature: Ceres ANNOT ID no. 6033191
  misc_feature: Encodes the peptide sequence at SEQ ID NO 3808
atggatttcgaggtgcaggtggtagaatcgtcgattgtaacgcccagcgagccagcaccgaggaagggactctggctctcttccttggacctctggcaggccaaccatggccacactccaacgatctacctgtacagaagctccagcgatgttgctgcggctgatcatttctttgacgtggccaagctcaaggaggctatggccagagccttggtggccttctaccccctcgccggccgcctcggcatcaacgataacgacggtaggatggagatcagctgtaacggtgaaggtgcactctttgttgtcgctcaggctcatgatctcactgtcgaagacgtcaagaaattcaagccgtcgccagagcttaggaggctgtttgttccactcattgagccattgtccatcattttggccgtacaggtgactttcttgaagtgtggtggggtggtgttagggacagctctccaccatgccgccgtcgacgccttaagcgcgttccacttcttccagacatggtcggccttctccaagcatggcgaccacgctactgtggagctcccatgccatgaccgtgacctactccgtgcacggtccccgcccacaatccatcccgatgcactcttgatgttctaccctaagcacaccttctccgacctgtcaggacctcttgccattgaagtcttaactatttccagagaccaggtcgcctccttaaagcacctttgcggtggcggcacgagcaccttttgtgccgtgagcgctctcatgtggcagtgcacgtgcattgcacgtcggctctcacctgattctgaagcacgcctcactttcccggccgacctccggcaaaggatgaggccgtccctcccgagctgctacatcggcaatgcgatgttttggctaggcatcaccagcgtagtgggagatattgccacagaggtgttaggatccgttgctggccgcatcagaggcgccatcgatcagatggatgacgagctagtgcgctccgctatcgattactttgagatggccgagatggacaaccagcctccaaggggcaccttgccgcagacggtcctgcatattaccagctggttgggcaggccacaatacgatgcagattttgggtgggggaagccagagttgatgtcacgggcggagagccactgcggggggtttgtgaacttgatgaacaatgatgatggtgctggtagcggtggcgtccgtttgctcatgtgcatggaggctgtaaatataaaggagatagagcgactgctttatgcaaagctagctctagcagcttgctactag

SEQ ID NO: 3808 - protein, 436 aa, Sorghum bicolor
  misc_feature: Ceres ANNOT ID no. 6033191
  misc_feature (3)..(429): Pfam Id: Transferase Pfam Desc: Transferase family
  misc_feature (6)..(429): NCBI GI: 62734082 NCBI Desc: transferase family [oryza sativa (japonica cultivar-group)]
  misc_feature (2)..(329): NCBI GI: 115475267 NCBI Desc: os08g0205000 [oryza sativa (japonica cultivar-group)]
  misc_feature (4)..(427): NCBI GI: 133873117 NCBI Desc: hydroxycinnamoyl-coa shikimate/quinate hydroxycinnamoyltransferase [coffea arabica]
  misc_feature (4)..(427): NCBI GI: 116486991 NCBI Desc: hydroxycinnamoyl transferase [coffea arabica]
  misc_feature (4)..(427): NCBI GI: 134035932 NCBI Desc: hydroxycinnamoyl-coa shikimate/quinate hydroxycinnamoyltransferase [coffea canephora]
  misc_feature: Useful for making plants with altered Lignin content
  misc_feature: Useful for making plants with altered cell wall content and/or composition
  misc_feature: Functional homolog of the protein sequence given in SEQ ID NO 12900
MDFEVQVVESSIVTPSEPAPRKGLWLSSLDLWQANHGHTPTIYLYRSSSDVAAADHFFDVAKLKEAMARALVAFYPLAGRLGINDNDGRMEISCNGEGALFVVAQAHDLTVEDVKKFKPSPELRRLFVPLIEPLSIILAVQVTFLKCGGVVLGTALHHAAVDALSAFHFFQTWSAFSKHGDHATVELPCHDRDLLRARSPPTIHPDALLMFYPKHTFSDLSGPLAIEVLTISRDQVASLKHLCGGGTSTFCAVSALMWQCTCIARRLSPDSEARLTFPADLRQRMRPSLPSCYIGNAMFWLGITSVVGDIATEVLGSVAGRIRGAIDQMDDELVRSAIDYFEMAEMDNQPPRGTLPQTVLHITSWLGRPQYDADFGWGKPELMSRAESHCGGFVNLMNNDDGAGSGGVRLLMCMEAVNIKEIERLLYAKLALAACY

SEQ ID NO: 3809 - DNA, 570 bp, Sorghum bicolor
  misc_feature: Ceres ANNOT ID no. 6033193
  misc_feature: Encodes the peptide sequence at SEQ ID NO 3810
atggctacctcgccattggccagcgctgaagcatgtgatgctaatgctgctttaattatgaatggtgatcttcgtgctctccaagaacctatatatcttccaaatctatatatgaaaggcggtagatttttgctgatctttgaggataacgtgctgctccatgagttccttgaggagaaaaaaggtcacggcagggtcctggtggttgatgtcggtgggagcatcagagcatgcatgcgctgtgcagttttgggtggaaacccagctggcgctgaacaagtgaacaacgggtgggtcggcgtcgtggtcaatggctgcatcagggacgtcgatgagaaaaatggttgcgacgttggcgtcagggctctgcagaactcacaccaagtcaaacaagaagggcatcggcgagaagcatgtccttgtgacctttgccgggagcccgggactagaatttgcaatggtgaatggctctatgccgattctggtggcattcttatctcaagatcagaattaactgtgcaggcctgtccctatgttatatgtgtacttttaagaatgtatgatagctga

SEQ ID NO: 3810 - protein, 189 aa, Sorghum bicolor
  misc_feature: Ceres ANNOT ID no. 6033193
  misc_feature (4)..(166): Pfam Id: Methyltransf_6 Pfam Desc: Demethylmenaquinone methyltransferase
  misc_feature (1)..(173): NCBI GI: 46805895 NCBI Desc: s-adenosylmethionine:2-demethylmenaquinone methyltransferase-like [oryza sativa (japonica cultivar-group)]
  misc_feature (1)..(173): NCBI GI: 46805897 NCBI Desc: s-adenosylmethionine:2-demethylmenaquinone methyltransferase-like [oryza sativa (japonica cultivar-group)]
  misc_feature (6)..(173): NCBI GI: 92889308 NCBI Desc: dimethylmenaquinone methyltransferase [medicago truncatula]
  misc_feature (6)..(173): NCBI GI: 21537415 NCBI Desc: s-adenosylmethionine:2-demethylmenaquinone methyltransferase-like protein [arabidopsis thaliana]
  misc_feature (1)..(153): NCBI GI: 115439647 NCBI Desc: os01g0722800 [oryza sativa (japonica cultivar-group)]
MATSPLASAEACDANAALIMNGDLRALQEPIYLPNLYMKGGRFLLIFEDNVLLHEFLEEKKGHGRVLVVDVGGSIRACMRCAVLGGNPAGAEQVNNGWVGVVVNGCIRDVDEKNGCDVGVRALQNSHQVKQEGHRREACPCDLCREPGTRICNGEWLYADSGGILISRSELTVQACPYVICVLLRMYDS

SEQ ID NO: 3811 - DNA, 1311 bp, Sorghum bicolor
  misc_feature: Ceres ANNOT ID no. 6033194
  misc_feature: Encodes the peptide sequence at SEQ ID NO 3812
atggattctgagctgcagctgcaggtgctagagtcatcatttgtaacgccgagcgagtcgacaccgagtcaggggctgtggctctcttccttggacctcatgcatgccaacagaggccacacctcaacaatctacttgtacagctcctccagtgatgctgccgcgggcgccgctgatttcttcgacgtggccaggctcaaggaggctatggccagagccttggtggccttctaccccctcgccggccgcctcggcgtcaacgacgatgacggtaggatggagatcagctgtaacggcgaaggtgcgctctttgttgtcgctcatgctgatgatctcactgtccatgacgtcaaggaattcaagccatcgcctgaacagaggaggctgtttgttccacgcattgagccatcgtccatcatgttggctgtacaggtgactttcttgaagtgtggaggggtggcattaggggcagctctccaccatgtcgccgttgacgccttaagtgcattccacttctttcaaacatggtcggccttctccaagcatggcgaccacgctaccctggagctcccttgccatgaccgtaccctactccgcgcgcggtcaccccccacggtccatccggatgcactcttgacattctaccctaagcacaccttgtccaacccatcaggacctcttgccatccaaatcatcaccatttccaaggaccagatcacctccttgaagcacctctgtggtggcacaagcaccttctgcgccgtaagcgctctcgtgtggcagtgcgcgtgcgttgcacgccggcccccaccagagtccgaagcgcgcctcacgttcccggttgacatccggcgaagagcgaggccgcccctcccaagctgctatttcggcaatgcggtgttttggctaggtgtcaccggcgcggcacgagatattgccacggaggcgttggcatccgttgctggtcgcatcaagagtactattgatcggatggacgatgagctggtgcgctctgcgatcgactactttgagatggccgagatggacagccagcctccacgaggcaccttgccacaaaccgacctgcatattaccagctggttcgggaggccacagtacgatgcagatttcggatggggaaagccagagttgatgtcgctggcggagaacagccgtggggggtttgtctacttgatgaacgatgaggggaaagcggacgatggtgctggcagcggcgacgtccgtgtgctcatgtgcatggaggctgtaaatataagggaactagagcagctactttacacaaagctctag

SEQ ID NO: 3812 - protein, 436 aa, Sorghum bicolor
  misc_feature: Ceres ANNOT ID no. 6033194
  misc_feature (5)..(435): Pfam Id: Transferase Pfam Desc: Transferase family
  misc_feature (8)..(435): NCBI GI: 62734082 NCBI Desc: transferase family [oryza sativa (japonica cultivar-group)]
  misc_feature (6)..(331): NCBI GI: 115475267 NCBI Desc: os08g0205000 [oryza sativa (japonica cultivar-group)]
  misc_feature (5)..(433): NCBI GI: 133873117 NCBI Desc: hydroxycinnamoyl-coa shikimate/quinate hydroxycinnamoyltransferase [coffea arabica]
  misc_feature (5)..(433): NCBI GI: 134035932 NCBI Desc: hydroxycinnamoyl-coa shikimate/quinate hydroxycinnamoyltransferase [coffea canephora]
  misc_feature (5)..(433): NCBI GI: 139538824 NCBI Desc: hydroxycinnamoyl-coa shikimate/quinate hydroxycinnamoyltransferase [coffea canephora]
  misc_feature: Useful for making plants with altered Lignin content
  misc_feature: Useful for making plants with altered cell wall content and/or composition
  misc_feature: Functional homolog of the protein sequence given in SEQ ID NO 12900
MDSELQLQVLESSFVTPSESTPSQGLWLSSLDLMHANRGHTSTIYLYSSSSDAAAGAADFFDVARLKEAMARALVAFYPLAGRLGVNDDDGRMEISCNGEGALFVVAHADDLTVHDVKEFKPSPEQRRLFVPRIEPSSIMLAVQVTFLKCGGVALGAALHHVAVDALSAFHFFQTWSAFSKHGDHATLELPCHDRTLLRARSPPTVHPDALLTFYPKHTLSNPSGPLAIQIITISKDQITSLKHLCGGTSTFCAVSALVWQCACVARRPPPESEARLTFPVDIRRRARPPLPSCYFGNAVFWLGVTGAARDIATEALASVAGRIKSTIDRMDDELVRSAIDYFEMAEMDSQPPRGTLPQTDLHITSWFGRPQYDADFGWGKPELMSLAENSRGGFVYLMNDEGKADDGAGSGDVRVLMCMEAVNIRELEQLLYTKL

SEQ ID NO: 3813 - DNA, 507 bp, Sorghum bicolor
  misc_feature: Ceres ANNOT ID no. 6033200
  misc_feature: Encodes the peptide sequence at SEQ ID NO 3814
atggctgccttgccattggccaccgctgaagcatgtgatgctaatgctgctttaattatgaatggtgatcttcgtgctctccaacctatcttccaaatctatggaaggcggcagatttttgctggccctgttgtgacactgaagatcttcgaggataacgttctgctccgcgagttccttgaggagaaaggtcacggcagggtcctggtggttgatgccggtgggagcatgcgctgtgcagttttgggtggcaaccttgcccagctggcgcagaacaacgggtgggctggcgtcgtggtcaatggctgcatcagggacgtcgatgagataaatggttgtgacgttggcgtgcgggctctgaactcgctccctatcaagtcaaacaagaagggtgtcggtgagaagcatgctcctgtgacctttgcagggactagaatttgtgatggcgaatggctctatgccgattctgatggaattcttatctcaagatcagaattgactgtgtag

SEQ ID NO: 3814 - protein, 168 aa, Sorghum bicolor
  misc_feature: Ceres ANNOT ID no. 6033200
  misc_feature (11)..(161): Pfam Id: Methyltransf_6 Pfam Desc: Demethylmenaquinone methyltransferase
  misc_feature (1)..(168): NCBI GI: 46805895 NCBI Desc: s-adenosylmethionine:2-demethylmenaquinone methyltransferase-like [oryza sativa (japonica cultivar-group)]
  misc_feature (1)..(168): NCBI GI: 46805897 NCBI Desc: s-adenosylmethionine:2-demethylmenaquinone methyltransferase-like [oryza sativa (japonica cultivar-group)]
  misc_feature (6)..(168): NCBI GI: 92889308 NCBI Desc: dimethylmenaquinone methyltransferase [medicago truncatula]
  misc_feature (1)..(148): NCBI GI: 115439647 NCBI Desc: os01g0722800 [oryza sativa (japonica cultivar-group)]
  misc_feature (6)..(168): NCBI GI: 21537415 NCBI Desc: s-adenosylmethionine:2-demethylmenaquinone methyltransferase-like protein [arabidopsis thaliana]
MAALPLATAEACDANAALIMNGDLRALQPIFQIYGRRQIFAGPVVTLKIFEDNVLLREFLEEKGHGRVLVVDAGGSMRCAVLGGNLAQLAQNNGWAGVVVNGCIRDVDEINGCDVGVRALNSLPIKSNKKGVGEKHAPVTFAGTRICDGEWLYADSDGILISRSELTV

SEQ ID NO: 3815 - DNA, 1365 bp, Sorghum bicolor
  misc_feature: Ceres ANNOT ID no. 6033218
  misc_feature: Encodes the peptide sequence at SEQ ID NO 3816
  misc_feature: Up-regulated in root tissues in response to methyl jasmonate treatment
  misc_feature: Up-regulated in shoot tissues in response to salicylic acid treatment
atggccaaggcgctgctctcctcctccctcctccccgcgctgccccgcgccgccgggggcagcgcgagcaggccgctgctgctcccgccgctccgtctgcggcgcggcggccggcgcgccgcctccgcgtgcgcggtgagggcgggcctgcacgggctcgactccgtcggcgggccccacctccaggccacgctggagcgcgccgaggcggcgctctacacgctcgccgacgccgcggtcgccgcggcggacgcggggggcgacgccggcgaggcggctgcggcggcggtccagaagaacggcggctggttcggcttcatctccgaggccctcgaggtcgtgctcaaggtcctcaaggatggtctctctgcagttcatgtgccatatgcctacgggtttgccatcattctgctcactatcattgttaaggcggtgacgttgcctctaaccaaacagcaggtggagtcgactctggcaatgcagaatttacagccgcagcttaaggcaatccagcagagatatgcgggcaatcaggaaaggatacagctagagactgctcggttatacaagcaagctggtgtcaaccctttagcaggatgttttccaacattggcgacaatacctgtatggattggtctttaccaggcactttcaaatgtagcaaatgaggggctgttcacagaaggatttttctggattccgtcactgggaggtcctacaacaattgcagctcggcaaagtggttctggaatttcgtggctcttcccatttgtggatggtcatcctccgctaggctggcatgacaccatatgctaccttgtattgcctgtgctacttgttgcttctcagtatgtctctatggagatcatgaagccacctcagagtgatgacccatcacagaagaacacactgctcattttgaaatttcttccatttatgattggctggttctctttgtcagtgccgtcaggattgtctatttattggcttacaaacaatgtcctcagcacagcccagcaagtttggttacggaaaatgggtggagcaaagcctgtagtgagtaagggaggtagtgggataattacagcaggacgagcaaaacgctctaatgctgaaccagctggagagaggtttaggcagctaaaagaagaagagaacaggagaaaactcagcaaagcacttgctgcaggagattcagatgcatcatcatcaacatatgacatggaggatgaagaattagatgatgagaccacagaagagggaggacctgtggaggaagcatccagtactggcagtgacaagaaacttccaagttactcggggaagaagggcaaacgatccaagaggaagcgcatggtgcagtaa

SEQ ID NO: 3816 - protein, 454 aa, Sorghum bicolor
  misc_feature: Ceres ANNOT ID no. 6033218
  misc_feature (131)..(348): Pfam Id: 60KD_IMP Pfam Desc: 60Kd inner membrane protein
  misc_feature (51)..(453): NCBI GI: 30387561 NCBI Desc: at2g28800 [arabidopsis thaliana]
  misc_feature (51)..(453): NCBI GI: 21592693 NCBI Desc: chloroplast membrane protein albino3 [arabidopsis thaliana]
  misc_feature (28)..(450): NCBI GI: 2231046 NCBI Desc: ppf-1 protein [pisum sativum]
  misc_feature (28)..(450): NCBI GI: 9886727 NCBI Desc: ppf-1 protein [pisum sativum]
  misc_feature (51)..(332): NCBI GI: 30684018 NCBI Desc: chloroplast membrane protein (albino3) [arabidopsis thaliana]
  misc_feature: Up-regulated in root tissues in response to methyl jasmonate treatment
  misc_feature: Up-regulated in shoot tissues in response to salicylic acid treatment
MAKALLSSSLLPALPRAAGGSASRPLLLPPLRLRRGGRRAASACAVRAGLHGLDSVGGPHLQATLERAEAALYTLADAAVAAADAGGDAGEAAAAAVQKNGGWFGFISEALEVVLKVLKDGLSAVHVPYAYGFAIILLTIIVKAVTLPLTKQQVESTLAMQNLQPQLKAIQQRYAGNQERIQLETARLYKQAGVNPLAGCFPTLATIPVWIGLYQALSNVANEGLFTEGFFWIPSLGGPTTIAARQSGSGISWLFPFVDGHPPLGWHDTICYLVLPVLLVASQYVSMEIMKPPQSDDPSQKNTLLILKFLPFMIGWFSLSVPSGLSIYWLTNNVLSTAQQVWLRKMGGAKPVVSKGGSGIITAGRAKRSNAEPAGERFRQLKEEENRRKLSKALAAGDSDASSSTYDMEDEELDDETTEEGGPVEEASSTGSDKKLPSYSGKKGKRSKRKRMVQ

SEQ ID NO: 3817 - DNA, 666 bp, Sorghum bicolor
  misc_feature: Ceres ANNOT ID no. 6033223
  misc_feature: Encodes the peptide sequence at SEQ ID NO 3818
atggcgggcgtgggctcggcgttgcggcggctctacctctccgtctacaactgggtcgtcttcttcggatgggcgcaggtgctgtactacgcggtcctgacgctgcgggagagcgggcacaaggccgtctacgccgccgtcgagaagccgctgcagttcgcgcagacagccgccatcatggagattcttcatgggctcgtagggttggtgaggtctccggtctctgcaactcttccacagattggatccaggctgttccttacgtggggtgtcttgtggagttttcctgagacccagtcacatcttcttgttactaccctggtcataagctggtctatcactgagatcatcagatactctttctttggaatgaaggaggcatttggctttgcaccttcctggttattatggcttaggtacagcacctttatgttgttgtatcctactggtatctctagtgaagttggtctgatctacattgccttgccttacatgaaggcatcggagaaatactgtcttaggatgcccaacaaatggaacttttcatacgattacttctattcgtctattcttgccctcctgatttatgttccaggaagcccgcacatgtaccgttacatgctctcacagaggaagaaggcactatcaaaggccaaagcggcttaa

SEQ ID NO: 3818 - protein, 221 aa, Sorghum bicolor
  misc_feature: Ceres ANNOT ID no. 6033223
  misc_feature (55)..(219): Pfam Id: PTPLA Pfam Desc: Protein tyrosine phosphatase-like protein, PTPLA
  misc_feature (1)..(221): NCBI GI: 38347039 NCBI Desc: osjnbb0067g11.14 [oryza sativa (japonica cultivar-group)]
  misc_feature (27)..(219): NCBI GI: 145334369 NCBI Desc: pas2 (pasticcino 2) [arabidopsis thaliana]
  misc_feature (2)..(219): NCBI GI: 54290219 NCBI Desc: tyrosine phosphatase -like [oryza sativa (japonica cultivar-group)]
  misc_feature (1)..(219): NCBI GI: 115434552 NCBI Desc: os01g0150500 [oryza sativa (japonica cultivar-group)]
  misc_feature (6)..(203): NCBI GI: 47027051 NCBI Desc: protein tyrosine phosphatase [hyacinthus orientalis]
  misc_feature: Useful for making plants with modulated drought sensitivity
  misc_feature: GREAT-hit functional homolog of the protein sequence given in SEQ ID NO 13082
  misc_feature: Useful for making plants with modulated drought sensitivity
  misc_feature: Functional homolog of the protein sequence given in SEQ ID NO 13082
MAGVGSALRRLYLSVYNWVVFFGWAQVLYYAVLTLRESGHKAVYAAVEKPLQFAQTAAIMEILHGLVGLVRSPVSATLPQIGSRLFLTWGVLWSFPETQSHLLVTTLVISWSITEIIRYSFFGMKEAFGFAPSWLLWLRYSTFMLLYPTGISSEVGLIYIALPYMKASEKYCLRMPNKWNFSYDYFYSSILALLIYVPGSPHMYRYMLSQRKKALSKAKAA

SEQ ID NO: 3819 - DNA, 1539 bp, Sorghum bicolor
  misc_feature: Ceres ANNOT ID no. 6033248
  misc_feature: Encodes the peptide sequence at SEQ ID NO 3820
atgggggacaactacttgttggacgacgaaggcgagccgaccatggacctcgacgaacgggagccctccccggagccccagccctacgaagacctcgatgacgacctcggcgacggcggcgattggacccgcggccgctccccgacccccgtccacggcgacgacggcggggcggggtcctcctccaagccccggaagcgccttctcaagaagggcggcggcggtggcggcggcggcatgcccggcgacgacgggctggatgactttgcgttggaggacgaggacgcggaccccgcggctgaggcgaggaagaggaagggctcgtcgtcgctgagggacctcgcgaggggcggggcgggcaaggagaagaaggagaagaaaaggcggagggaggatgacggcagggggagggatagtgggatggtgagggacaggcggggatcaggagggagggactcaggcggtagggaggaccaggatgatggggagagggagatccaggagctctgggataccattgctggtgatgattcagaggatgaccaagaaggtgttagaactgtagacgatgataatttcattgatgacactggggttgatccagctgatcgttatggcagcgataatgagcggcattcacctggacgttatgcacaggctgaggagggtgaggaggacgatgaaattgagcgactcttcaagggtggtaagaagaagaagaagaatgatcgccctcgtgcagatattggtcttatagtggaacaattcattgccgagttcgaggtagcagccgaagaagatgcgaacttgaataggcaatcaaagccagccattaataaacttatgaagcttcctctgctcatagatgttctctccaagaagaatcttcagcaggaatttcttgaccatggagttctcactcttctaaaaaattggcttgagccattacctgatggaagcatgccaaacatgaatattcgatctgctgtactgaaattattaactgattttccaattgacttggagcaatatgaccgaagggagcagcttaagaaaagtggtctcggaaaggtcattatgtttttgtccaaatctgacgaggagactactgcaaataggaaattggctaaggagctggttgataaatggagtcgaccaatatttaacaagagcacgagatttgaggacatgaggagatatgatgaggatgaaagagcaccttacaggcggccacaaatgaagaaaccttcgtcgagtagctctggaatggaatccagagatgatgatcttgatgctgacttttcacaacgcaagtctgggcaaagtagttcaaggcagcatgcttctaggccagaagcatcgcctttggacttcgtcattcgtccacagtccaaaattgaccctgagcagatacgagctcgtgctaagcaggctgtccaagaccagcgtcggctgaagcagctgaaagcgcccaagaagaaaaaccttcaggcatcgaagctcagcgtggaaggccgtggcatgatcaagtacctgtag

SEQ ID NO: 3820 - protein, 512 aa, Sorghum bicolor
  misc_feature: Ceres ANNOT ID no. 6033248
  misc_feature (251)..(508): Pfam Id: IWS1_C Pfam Desc: IWS1 C-terminus
  misc_feature (92)..(508): NCBI GI: 82182616 NCBI Desc: iws1-like protein a
  misc_feature (158)..(508): NCBI GI: 116130525 NCBI Desc: ensangp00000010073 [anopheles gambiae str. pest]
  misc_feature (126)..(508): NCBI GI: 54643421 NCBI Desc: ga22119-pa [drosophila pseudoobscura]
  misc_feature (157)..(508): NCBI GI: 66770769 NCBI Desc: ip11380p [drosophila melanogaster]
  misc_feature (176)..(508): NCBI GI: 24642454 NCBI Desc: cg9915-pa [drosophila melanogaster]
MGDNYLLDDEGEPTMDLDEREPSPEPQPYEDLDDDLGDGGDWTRGRSPTPVHGDDGGAGSSSKPRKRLLKKGGGGGGGGMPGDDGLDDFALEDEDADPAAEARKRKGSSSLRDLARGGAGKEKKEKKRRREDDGRGRDSGMVRDRRGSGGRDSGGREDQDDGEREIQELWDTIAGDDSEDDQEGVRTVDDDNFIDDTGVDPADRYGSDNERHSPGRYAQAEEGEEDDEIERLFKGGKKKKKNDRPRADIGLIVEQFIAEFEVAAEEDANLNRQSKPAINKLMKLPLLIDVLSKKNLQQEFLDHGVLTLLKNWLEPLPDGSMPNMNIRSAVLKLLTDFPIDLEQYDRREQLKKSGLGKVIMFLSKSDEETTANRKLAKELVDKWSRPIFNKSTRFEDMRRYDEDERAPYRRPQMKKPSSSSSGMESRDDDLDADFSQRKSGQSSSRQHASRPEASPLDFVIRPQSKIDPEQIRARAKQAVQDQRRLKQLKAPKKKNLQASKLSVEGRGMIKYL

SEQ ID NO: 3821 - DNA, 582 bp, Sorghum bicolor
  misc_feature: Ceres ANNOT ID no. 6033281
  misc_feature: Encodes the peptide sequence at SEQ ID NO 3822
atggccatcctgggcgccctgaagctcgccccgtgtccacccgccctcgccggcgccgcgccaccggcgacgtcttcgcccgcgcgctcctcggtgcacttccacctcgccaatgccggcgctgccgcgctcgtcgccgcctcgctcctcgtcgccgaccccgccgtggcattcattggaggaggtccgtacgggaagcaggtgacgcgggggcaggacctcaccggcaaggacttcagcggcctcacgctcatcaagcaggacttcaagacgtctatactgaggcaggcgaacttcaaaggcgcgaacctgctcggcgcaagtttcttcgacgcagacctcacaagcgctgatctctctgatgctgatcttcgaggcgccgatttctcgctagcgaatttaacaaagacaaacttatcaaatgccaacttggaaggggcacttgtcacaggaaacacttctttcaaagattttaccgatgtcccacttcgagacgatcaacgggaatacctctgcaaaatcgctgacggagtgaattcaaccactgggaaccccacaaaggagactctgttctgcagctga

SEQ ID NO: 3822 - protein, 193 aa, Sorghum bicolor
  misc_feature: Ceres ANNOT ID no. 6033281
  misc_feature (72)..(111): Pfam Id: Pentapeptide Pfam Desc: Pentapeptide repeats (8 copies)
  misc_feature (112)..(151): Pfam Id: Pentapeptide Pfam Desc: Pentapeptide repeats (8 copies)
  misc_feature (25)..(193): NCBI GI: 20196925 NCBI Desc: pentapeptide repeat family protein [arabidopsis thaliana]
  misc_feature (45)..(192): NCBI GI: 23128511 NCBI Desc: cog1357: uncharacterized low-complexity proteins [nostoc punctiforme pcc 73102]
  misc_feature (74)..(192): NCBI GI: 75909862 NCBI Desc: pentapeptide repeat [anabaena variabilis atcc 29413]
  misc_feature (36)..(192): NCBI GI: 119512324 NCBI Desc: pentapeptide repeat protein [nodularia spumigena ccy9414]
  misc_feature (73)..(192): NCBI GI: 67922307 NCBI Desc: pentapeptide repeat [crocosphaera watsonii wh 8501]
MAILGALKLAPCPPALAGAAPPATSSPARSSVHFHLANAGAAALVAASLLVADPAVAFIGGGPYGKQVTRGQDLTGKDFSGLTLIKQDFKTSILRQANFKGANLLGASFFDADLTSADLSDADLRGADFSLANLTKTNLSNANLEGALVTGNTSFKDFTDVPLRDDQREYLCKIADGVNSTTGNPTKETLFCS

SEQ ID NO: 3823 - DNA, 1224 bp, Sorghum bicolor
  misc_feature: Ceres ANNOT ID no. 6033426
  misc_feature: Encodes the peptide sequence at SEQ ID NO 3824
atgggcgctctctgcgatttctgtggggagcagaggtccatggtttactgccgatcagatgcagcatccttgtgtttatcatgcgaccgtaatgttcattcagctaatgcactttctcggcgccatacaaggacccttttatgtgaccggtgtgcttcacagcctgctatggtccgctgtctagcggagaatgcctcactttgccaaaattgtgattggaatggccacattgcaggatcctcagctgccggacacaaaaggcagactataaattgctactcaggatgtccatcatctgcagaactttctagaatatggtccttcgtttcagatattcctaatgtagcacctgagccgaactgtgagcaaggaataagcatgatgagcatcagcgacagtggtgtcagtagtcaagataatgctgcaggggacaataatttgttagatatagctagcgaaacacttataagtgatcttggtacttgtgacaagcctttggtaggttcctcttcaggagctggagtgaacctgcttccgcttgctactgatcagacagctggatctgtggactccccaccagataagatggttccctatacaccagataaagatatgttcagtaaggacagcatatatgaagatttttgtgtggatgatgttgaccttgcttttgaaaattacgaagaactctttggtacctctcatattcaaacagagcaactgtttgatgatgctggaatagacagttactttgaagtgaaggaagcacctgctgggaattccaccgagcaatccaagttgaagcaacctgctaatagcaatgcggtatctgctgactctgggatgtcgaacccaggagtgaaaggtgattccagtgtttgtatccctttgaggcaggctaggtctagtctgtctctttccttttccggtttgactggggagagtagtgctggagaccaccaagattgtgtggtatcatcattgcttcttatgggtgagcctccttggcagcctcctggccctgagggctcaattgctggaggtagtagagacagcgctatcacacgatacaaggagaagaagaagagaagaaagttcgacaagaagatcaggtatgcttctcgcaaggctagagcagatgtgcgaaagagggtcaagggacgatttgttaaggttggtgaagcatatgactacgatcctctctgccaaacaaggagttactga

SEQ ID NO: 3824 - protein, 407 aa, Sorghum bicolor
  misc_feature: Ceres ANNOT ID no. 6033426
  misc_feature (350)..(394): Pfam Id: CCT Pfam Desc: CCT motif
  misc_feature (1)..(47): Pfam Id: zf-B_box Pfam Desc: B-box zinc finger
  misc_feature (1)..(407): NCBI GI: 115467684 NCBI Desc: os06g0298200 [oryza sativa (japonica cultivar-group)]
  misc_feature (1)..(407): NCBI GI: 45736008 NCBI Desc: zinc-finger protein [oryza sativa (japonica cultivar-group)]
  misc_feature (5)..(106): NCBI GI: 42571031 NCBI Desc: zinc finger (b-box type) family protein [arabidopsis thaliana]
  misc_feature (5)..(201): NCBI GI: 45736091 NCBI Desc: zinc-finger protein c60910-like [oryza sativa (japonica cultivar-group)]
  misc_feature (5)..(201): NCBI GI: 115477535 NCBI Desc: os08g0536300 [oryza sativa (japonica cultivar-group)]
  misc_feature: The sequence is a functional homolog of SEQ ID NO 1023 in the 10/666,642US patent application
  misc_feature: The sequence is a functional homolog of SEQ ID NO 1024 in the 10/666,642US patent application
  misc_feature: The sequence is a functional homolog of SEQ ID NO 1522 in the 10/374,780US patent application
  misc_feature: The sequence is a functional homolog of SEQ ID NO 1593 in the 10/412,699US patent application
  misc_feature: The sequence is a functional homolog of SEQ ID NO 16 in the 10/412,699US patent application
  misc_feature: The sequence is a functional homolog of SEQ ID NO 1645 in the 10/374,780US patent application
  misc_feature: The sequence is a functional homolog of SEQ ID NO 1646 in the 10/374,780US patent application
  misc_feature: The sequence is a functional homolog of SEQ ID NO 1671 in the 10/412,699US patent application
  misc_feature: The sequence is a functional homolog of SEQ ID NO 1672 in the 10/412,699US patent application
  misc_feature: Useful for making plants with modulated growth and phenotype characteristics
  misc_feature: The sequence is a functional homolog of SEQ ID NO 1593 in the 20040045049 US patent application
  misc_feature: The sequence is a functional homolog of SEQ ID NO 16 in the 20040045049 US patent application
  misc_feature: The sequence is a functional homolog of SEQ ID NO 1671 in the 20040045049 US patent application
  misc_feature: The sequence is a functional homolog of SEQ ID NO 1672 in the 20040045049 US patent application
  misc_feature: The sequence is a functional homolog of SEQ ID NO. 370 in the 11/188,298 US application
MGALCDFCGEQRSMVYCRSDAASLCLSCDRNVHSANALSRRHTRTLLCDRCASQPAMVRCLAENASLCQNCDWNGHIAGSSAAGHKRQTINCYSGCPSSAELSRIWSFVSDIPNVAPEPNCEQGISMMSISDSGVSSQDNAAGDNNLLDIASETLISDLGTCDKPLVGSSSGAGVNLLPLATDQTAGSVDSPPDKMVPYTPDKDMFSKDSIYEDFCVDDVDLAFENYEELFGTSHIQTEQLFDDAGIDSYFEVKEAPAGNSTEQSKLKQPANSNAVSADSGMSNPGVKGDSSVCIPLRQARSSLSLSFSGLTGESSAGDHQDCVVSSLLLMGEPPWQPPGPEGSIAGGSRDSAITRYKEKKKRRKFDKKIRYASRKARADVRKRVKGRFVKVGEAYDYDPLCQTRSY

SEQ ID NO: 3825 - DNA, 3105 bp, Sorghum bicolor
  misc_feature: Ceres ANNOT ID no. 6033428
  misc_feature: Encodes the peptide sequence at SEQ ID NO 3826
atgaggctggtggtgcgcgtcatcgaggcgcggggcctcccgcccacggacgccgacgggacgcgggacgcctacgccaaggcgcagctcggcaagcagcgggccaagaccaaggtggtgcgcaagacgctctgccccgcctgggacgacgagttcgccttccgggtcggggacctcagggacaacctcctcgtctccgtgcttcacgaggaccgctacttcgccgacgacgtcctcggccaggtcaaggtgcccctcaccgccgtgctcgacgccgaaaaccgcacgctcgggacgcagtggtaccagctgcagcccaagagcaagaagtccaagctcaaggattgcggagaaattcgtctcaatgtttctctggctcaaaactactctgaagacacggggactattgcacattgggcctctgatgaccttgcatcaaattcagacaaatcaactgaattggtgaaaggatcttctttgccgaatattcctattgaagtatccacagcagtaccagagatcgatgagatagaagtggccaaggaggataaatcaagcgctgctccatcatttgtcaacaagctatatcaaatgtttaatagtaaaccaaaagatgcagaggcttctgctccacctccctccaagctgaacgacgcttcagatattacggaagaaacgctgtcaaccacctctgaagctcccgagaagcaggatcatgatgccagtgcaactataacctttgatgagctactgaagtccttcagttctcagcatgaggggaaagaaatgcctgaaaatttgtcaggtggagttgttcttgatcaagtttatgctgttgcaccgagtgacttgaacacacttcttttctctccaagttcagactttctgcaatcatttgcagagatgcaaggaactacaggtcttgaagttcagcaatggcgacttgaaaatgatggtgaaatcctgaggagggtggtaagctacacaaaagctcctactaaactagttaaggccgtgaaagcaacagaggacatgacatatttgaaggcagatggagagatgtttgcagtttttgcagatgttagtactcctgatgttccatttggcaatactttcagagtggaggttttgacctgtatattgccaggacctgaattaccagatgacgaaaaatcttcacgtcttatggtctcttggcgcataaattttgtccaaagtaccatgatgaagagcatgattgaaagtggagcaaaacaaggcttcaaggataactacattcagttctctgagctgctggctaaatattttaggccggttgatgcaaaagatacaacagctagtaatgaagtgctttcttctgtgcaaccagagcaagaatcggactggaagctagcatttagaatatttggaaatttcgcacttttgtcctcagtttttgcgtttgtttatgtttctgcccacatcatccttgccagccctagtataattcaaggtcttgagttcccggggctggacttgccagattctgctggtgaagttgtagtttgtggagttcttgttctacaaggaaagcgtgtgctaaatatgattgcacgatttatccaggcgaagaggaagagaggtgatcatggagtcaaagcacaagggaatggctggttgctgactgttgctctgatggagggaaccaacttggcagctaccaaatcatctggttactctgatccatatgttgtatttacatgcaatgggaagacaaagacaagttcgattaagtttcatacccttgagcctcagtggaatgaaatttttgaatttgatgccatggaagatcccccatcagtgatggaaatacatgtgtatgatttcgatggacccttcgacgaagttgcctcccttggtcatgctgaagtgaatttcttgaaatataataatatatccgagcttgctgacatttggattcctctgaaaggaaagctggctcaagcatgtcagtcaaaattgcatctaagaatcttcttaaacaatacaaggggtaatgaagttgtgaaggattacctggacaaaatggagaaagaagttggcaaaaagattgctatgaggtctcctcacacaaacttagcattccagaaaatcttttctttgccaccagatgaatttcttatcaatgattttacttgtcacttaaagaggaaaatgctaacacagggtcgtctttttctatctccaagaatatttgggttttacacaaatctttttggccacaaaacaaaattcttctttctttgggaagatattgaagacatcctactggtccctgcgacattatcttcaatgggaagtccatctctggtgattattcttcggaagggcagaggaatggatgcaaagcatggagcaaagcaactggatagtgaagggagactaaagtttcatttccagtcttttgtctcattcagtgtggcgcataaaacaataatggcactgtggaaggcaaggtccttgacccctgaacaaaaggtacagcttgtagaagaggaatcagaaacagaagacttccaaaatgaggaaggagaatctttcttagggatagaggatgccaaaatgtcaggagtgttttcatccacaaaaccttttgatgtatcaacactcatgggcatatttgagggtggtccattggagtgccgggtgatggagaaagttggctgcatggattactctgttacagaatgggaacctgtcagagctgatatttaccagaggcaagttcattataagtttgacaagaaatcagcacggcatggaggagaagcaatgagcacccagcagaagtcccctttgcctaataagaatggctggcttgttgaagaagtgatgacacttgaaggtatccctgttggtgaatgtttcaatctccatattcgataccaactggagaacaacgcatccaagcagaagacttgcactatccaggtatctattggcatagtatggttgaagagctgcaagaaccgaaagaagatcacgcaggatgtagcaaccagtgcatcttctcgcctcaagaagatatttagccaacttgagaaggaatctataccagcaaagtag

SEQ ID NO: 3826 - protein, 1034 aa, Sorghum bicolor
  misc_feature: Ceres ANNOT ID no. 6033428
  misc_feature (3)..(83): Pfam Id: C2 Pfam Desc: C2 domain
  misc_feature (554)..(636): Pfam Id: C2 Pfam Desc: C2 domain
  misc_feature (706)..(772): Pfam Id: GRAM Pfam Desc: GRAM domain
  misc_feature (143)..(1029): NCBI GI: 15218791 NCBI Desc: c2 domain-containing protein / gram domain-containing protein [arabidopsis thaliana]
  misc_feature (180)..(1029): NCBI GI: 51814441 NCBI Desc: no pollen; osnop [oryza sativa (japonica cultivar-group)]
  misc_feature (1)..(1033): NCBI GI: 116310301 NCBI Desc: osigba0106g07.15 [oryza sativa (indica cultivar-group)]
  misc_feature (1)..(1033): NCBI GI: 38344486 NCBI Desc: osjnba0022h21.21 [oryza sativa (japonica cultivar-group)]
  misc_feature (684)..(1029): NCBI GI: 51090353 NCBI Desc: c2 domain-containing protein-like [oryza sativa (japonica cultivar-group)]
MRLVVRVIEARGLPPTDADGTRDAYAKAQLGKQRAKTKVVRKTLCPAWDDEFAFRVGDLRDNLLVSVLHEDRYFADDVLGQVKVPLTAVLDAENRTLGTQWYQLQPKSKKSKLKDCGEIRLNVSLAQNYSEDTGTIAHWASDDLASNSDKSTELVKGSSLPNIPIEVSTAVPEIDEIEVAKEDKSSAAPSFVNKLYQMFNSKPKDAEASAPPPSKLNDASDITEETLSTTSEAPEKQDHDASATITFDELLKSFSSQHEGKEMPENLSGGVVLDQVYAVAPSDLNTLLFSPSSDFLQSFAEMQGTTGLEVQQWRLENDGEILRRVVSYTKAPTKLVKAVKATEDMTYLKADGEMFAVFADVSTPDVPFGNTFRVEVLTCILPGPELPDDEKSSRLMVSWRINFVQSTMMKSMIESGAKQGFKDNYIQFSELLAKYFRPVDAKDTTASNEVLSSVQPEQESDWKLAFRIFGNFALLSSVFAFVYVSAHIILASPSIIQGLEFPGLDLPDSAGEVVVCGVLVLQGKRVLNMIARFIQAKRKRGDHGVKAQGNGWLLTVALMEGTNLAATKSSGYSDPYVVFTCNGKTKTSSIKFHTLEPQWNEIFEFDAMEDPPSVMEIHVYDFDGPFDEVASLGHAEVNFLKYNNISELADIWIPLKGKLAQACQSKLHLRIFLNNTRGNEVVKDYLDKMEKEVGKKIAMRSPHTNLAFQKIFSLPPDEFLINDFTCHLKRKMLTQGRLFLSPRIFGFYTNLFGHKTKFFFLWEDIEDILLVPATLSSMGSPSLVIILRKGRGMDAKHGAKQLDSEGRLKFHFQSFVSFSVAHKTIMALWKARSLTPEQKVQLVEEESETEDFQNEEGESFLGIEDAKMSGVFSSTKPFDVSTLMGIFEGGPLECRVMEKVGCMDYSVTEWEPVRADIYQRQVHYKFDKKSARHGGEAMSTQQKSPLPNKNGWLVEEVMTLEGIPVGECFNLHIRYQLENNASKQKTCTIQVSIGIVWLKSCKNRKKITQDVATSASSRLKKIFSQLEKESIPAK

SEQ ID NO: 3827 - DNA, 528 bp, Sorghum bicolor
  misc_feature: Ceres ANNOT ID no. 6033586
  misc_feature: Encodes the peptide sequence at SEQ ID NO 3828
atgcagagccagatcgtgtgccatgcttgccggaccgttctactctacccgcgaggcgcgtccagcgtctgctgcgccgtttgccaggccatcaccaccgtgccgccaccaggactggagatggctcagcttatatgtggtggttgtcgaactttgctgatgtatactcgcagtgcagacaccgtaaggtgttcatgttgcaacacagtcaatcttgttagaccagtgaataatatagctcatgtgaactgcggccagtgccggacaactttgatgtatccgtatggcgcaccttcagtaaaatgtgccatatgcaattatgtcacgactaccggagtaaatactgtggcacccactccatctgcgaggccaacatcaaatgagtcttcatatattggctcatctacttctgctcctaaatctcaacctcagaatgtaactgttgttgttgagaaccctatgacagttgacgacaagggaaaacttgtcagcagcgttgtagttggagtcacagctgggaaagtgtga

SEQ ID NO: 3828 - protein, 175 aa, Sorghum bicolor
  misc_feature: Ceres ANNOT ID no. 6033586
  misc_feature (7)..(31): Pfam Id: zf-LSD1 Pfam Desc: LSD1 zinc finger
  misc_feature (46)..(70): Pfam Id: zf-LSD1 Pfam Desc: LSD1 zinc finger
  misc_feature (84)..(108): Pfam Id: zf-LSD1 Pfam Desc: LSD1 zinc finger
  misc_feature (1)..(173): NCBI GI: 77556573 NCBI Desc: zinc finger protein lsd1 [oryza sativa (japonica cultivar-group)]
  misc_feature (1)..(174): NCBI GI: 7268834 NCBI Desc: zinc-finger protein lsd1 [arabidopsis thaliana]
  misc_feature (1)..(174): NCBI GI: 17981380 NCBI Desc: zinc finger protein lsd2 [brassica oleracea]
  misc_feature (41)..(173): NCBI GI: 32400832 NCBI Desc: 18s subunit ribosomal protein [triticum aestivum]
  misc_feature (2)..(126): NCBI GI: 40809629 NCBI Desc: zinc finger protein [oryza sativa (japonica cultivar-group)]
  misc_feature: Useful for making plants with modulated drought sensitivity
  misc_feature: Useful for making plants with modulated oxidative stress sensitivity
  misc_feature: Useful for making plants with modulated seed size
  misc_feature: Useful for making plants with modulated cold sensitivity
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13486
  misc_feature: GREAT-hit functional homolog of the protein sequence given in SEQ ID NO 13490
  misc_feature: Useful for making plants with modulated oxidative stress sensitivity
  misc_feature: Functional homolog of the protein sequence given in SEQ ID NO 13490
  misc_feature: The sequence is a functional homolog of SEQ ID NO. 330 in the 11/188,298 US application
MQSQIVCHACRTVLLYPRGASSVCCAVCQAITTVPPPGLEMAQLICGGCRTLLMYTRSADTVRCSCCNTVNLVRPVNNIAHVNCGQCRTTLMYPYGAPSVKCAICNYVTTTGVNTVAPTPSARPTSNESSYIGSSTSAPKSQPQNVTVVVENPMTVDDKGKLVSSVVVGVTAGKV

SEQ ID NO: 3829 - DNA, 1248 bp, Sorghum bicolor
  misc_feature: Ceres ANNOT ID no. 6033588
  misc_feature: Encodes the peptide sequence at SEQ ID NO 3830
atgccaatggccgtctccactgttaccgccacccatctcgctccctcttttccagcccgtagtcgccggagacgcgccgcgccccgcgccgcggcaggcggcctaacggcgcgcgcacggcggctgcgctgcgagttcgtcgccggcggtgggaacggggcgctctccggagaggacgaccctcgcctcgtcgaccgccaaaaagctcttgatgcagctatgaatgacataaacagctcttttggaaaaggaagtgttacaagattaggcagtgctggtggtgcttttgttgagacattcccaagtggttgtctaacactagattttgctctgggcggtggccttccaaaaggaagagtagtggaggtatatggtccagagagcagtggaaagactaccctggctttgcatgcaatagctgaagtacagaagctcggaggaaatgccatgcttgtcgatgcagagcatgcttttgatccagcttattcaaaagctcttggggtagatattgaaaatctgattgtctgccagcctgacaatggagagatggcactagaaattgcggaccgtatgtgcagatctggagcaatagatcttatctgtatcgattcggtgtcagcactcactccacgtgcagaaattgaaggtgagatagggatgcaacagatgggtctacaagctcgtttgatgagtcaagcattgagaaagatgtcagggaatgcctcaaaggctggctgtactcttatgttcttgaatcaaataagatacaagattggagtgttctatggaaatcctgaagtcactagtggagggatagccttgaaattctttgcatctgtccgccttgagatacggcccattgggaagataaaatctcccaagggagatgaagatgttggtgtgaaggttcgggtcagagtgcagaagagtaaagtatctaggccctacaagcaagctgaatttgaaatcatttttggggagggtgttagtaagttggggtgcgttcttgattgtgctgagctgatggatgtagttgcaaagaagggttcatggtatagttacaaagatataagattgggccaaggcagagaaaaggcactgcagtatctccgagagagcccaaccatctgcgatgagatagaaaaggtggttcgtgctatgataccagaaggatccagacatatgagcctactagctttcgggcagacatcatcaactgaagatgaacaagtgtacgatgagcaataa

SEQ ID NO: 3830 - protein, 415 aa, Sorghum bicolor
  misc_feature: Ceres ANNOT ID no. 6033588
  misc_feature (68)..(390): Pfam Id: RecA Pfam Desc: recA bacterial DNA recombination protein
  misc_feature (52)..(415): NCBI GI: 166841 NCBI Desc: replicase
  misc_feature (58)..(390): NCBI GI: 134122760 NCBI Desc: reca [physcomitrella patens]
  misc_feature (52)..(320): NCBI GI: 145327737 NCBI Desc: dna repair protein reca [arabidopsis thaliana]
  misc_feature (65)..(413): NCBI GI: 1350564 NCBI Desc: reca protein (recombinase a)
  misc_feature (65)..(409): NCBI GI: 126657745 NCBI Desc: recombinase a [cyanothece sp. ccy0110]
MPMAVSTVTATHLAPSFPARSRRRRAAPRAAAGGLTARARRLRCEFVAGGGNGALSGEDDPRLVDRQKALDAAMNDINSSFGKGSVTRLGSAGGAFVETFPSGCLTLDFALGGGLPKGRVVEVYGPESSGKTTLALHAIAEVQKLGGNAMLVDAEHAFDPAYSKALGVDIENLIVCQPDNGEMALEIADRMCRSGAIDLICIDSVSALTPRAEIEGEIGMQQMGLQARLMSQALRKMSGNASKAGCTLMFLNQIRYKIGVFYGNPEVTSGGIALKFFASVRLEIRPIGKIKSPKGDEDVGVKVRVRVQKSKVSRPYKQAEFEIIFGEGVSKLGCVLDCAELMDVVAKKGSWYSYKDIRLGQGREKALQYLRESPTICDEIEKVVRAMIPEGSRHMSLLAFGQTSSTEDEQVYDEQ

SEQ ID NO: 3831 - DNA, 696 bp, Sorghum bicolor
  misc_feature: Ceres ANNOT ID no. 6033589
  misc_feature: Encodes the peptide sequence at SEQ ID NO 3832
atgaacatcttcaagaagaaggtcgaccccaaagaggctctcaggaccagcaaacgtgagatggcggtcgccacgcggggagttgagcgagagattggttccctgcaaatggaggagaaaaagctggtcgcagagataaagaagactgccaagactggaaatgaggccgcaaccaaaatattagctcggcaacttgtcaggctgcggcaacaaatcctcaatttgcaaggcacacgggcacagattcgtggagtagctactcacacacaggcaatgtatgccggcacttcaatctctgctggaatgaaaggtgcaagcaaagctatggcagcaatgaataagcaaatggaaccggtgaagcagataaaggttatgaaagaattccagaaacaatcaacacaattggacatgacgctcgagatgatgtccgatgccattgatgaaacacttgacaaagatgaggcggaggaggaaacagaagagcttacaaaccaggtccttgacgagattggcgtggatgtggcttctcagctttcttcggctcctaaagggcgcatcggagcaactaacaagaaagtcgataacagtcacgcacgtaatcctgcagctcctgcgaggaacgtggcggcaccacccgaatcctctgctgaagtcgacgatctggagaggcgattggcatctctgcgccgtatctga

SEQ ID NO: 3832 - protein, 231 aa, Sorghum bicolor
  misc_feature: Ceres ANNOT ID no. 6033589
  misc_feature (16)..(186): Pfam Id: Snf7 Pfam Desc: Snf7
  misc_feature (1)..(231): NCBI GI: 15241525 NCBI Desc: snf7 family protein [arabidopsis thaliana]
  misc_feature (1)..(186): NCBI GI: 29028808 NCBI Desc: at5g44560 [arabidopsis thaliana]
  misc_feature (1)..(195): NCBI GI: 16974377 NCBI Desc: at1g03950/f21m11_12 [arabidopsis thaliana]
  misc_feature (1)..(195): NCBI GI: 4204294 NCBI Desc: similar to human bc-2 protein, [arabidopsis thaliana]
  misc_feature (3)..(231): NCBI GI: 42733480 NCBI Desc: bri1-kd interacting protein 109 [oryza sativa (japonica cultivar-group)]
  misc_feature: The sequence is a functional homolog of SEQ ID NO. 288 in the 11/188,298 US application
MNIFKKKVDPKEALRTSKREMAVATRGVEREIGSLQMEEKKLVAEIKKTAKTGNEAATKILARQLVRLRQQILNLQGTRAQIRGVATHTQAMYAGTSISAGMKGASKAMAAMNKQMEPVKQIKVMKEFQKQSTQLDMTLEMMSDAIDETLDKDEAEEETEELTNQVLDEIGVDVASQLSSAPKGRIGATNKKVDNSHARNPAAPARNVAAPPESSAEVDDLERRLASLRRI

SEQ ID NO: 3833 - DNA, 1347 bp, Sorghum bicolor
  misc_feature: Ceres ANNOT ID no. 6033590
  misc_feature: Encodes the peptide sequence at SEQ ID NO 3834
atggaagcgtacgcggcaatgccgtcgccacagacgaaagccatgggcgtggtggacaagctcagctacgagatcttctccttgctcgagagcaagttcctcttcggcgccgccggcacgccggccagagcgtttcttgacggtggacgcgtgcgggtgctggccatcgacggctgcggcgccggcgcgggcgccgaggacgcgctcctggcggccgcggcgctcgcgaggctcgaggccgggctgcgggagcaggccggggaccccgacgcccgcgtggccgacttcttcgacgtggccgcgggcgccggcgccggggccgtgctggccgcgatgctgttcctgaggggccccgacggccggccacggtacacggcgcagaaggcgctcgcgttcgtcgccggcagcgtcgggaggaggaaggactggtgcgggcggcgcgggcggtgggcgaagctcttccgcggcggctctcggggcggcgaccgcatgctccgcggggtgttgggcgacgcgacgctcagggacaccgtggcgccgctgctcgtgccgtgctacgacctcgccacggccgcgcccttcgtgttctcgcgcgccgacgccgtcgagagcgacagcttcgacttccgcctccgcgacgtctgcgccgccacctgcgccgaccgtggcgctggcgcgctcgccgacgtgaggtccgtcgacggcgtcacggccatcgccgccgcgtgcgcgggcgtggcggccatgggcaacccggccgccgccgccgttacgcacgtgctgcacaacaagctggagttcccgctcgccgccagcgtcgaggacatcctcgtcttctccatcggcaccggctcctccaccaccgtctctagcgggccgccgaacacgccagtgccgcccacgcgcgcgccgtcgcagcgcgagctggcacgcgtcgccgccgagggtgtggcggacatggtggacgaatcggtggccatggcgttcggggacgcgtgtggaagcaactacgtccgtatccaggccggcaggaaatcgacggcgcctctccacgccgagacggcggccgctgccgcagaggcgatgctggcgcagcggaacgtggaatcggtgctgttccgcgggcggaggctgtcggagcggaccaacgctgagaaagtggacacgctggtggcggagctggtgaaggagcaggagcggcggaggagcagcccgttccctaacgtggccatcaagcaggttgctacgcggcggctgtcgtcggcgaccaccgcatcgtcaggcacaacgacggcgcggacaacgtcgtcgatgccgtcgccggcgtcgtgggattctcgccggtag

SEQ ID NO: 3834 - protein, 448 aa, Sorghum bicolor
  misc_feature: Ceres ANNOT ID no. 6033590
  misc_feature (54)..(245): Pfam Id: Patatin Pfam Desc: Patatin-like phospholipase
  misc_feature (19)..(402): NCBI GI: 115470565 NCBI Desc: os07g0144500 [oryza sativa (japonica cultivar-group)]
  misc_feature (19)..(402): NCBI GI: 23495752 NCBI Desc: lipid acyl hydrolase-like protein [oryza sativa (japonica cultivar-group)]
  misc_feature (36)..(437): NCBI GI: 115455741 NCBI Desc: os03g0784100 [oryza sativa (japonica cultivar-group)]
  misc_feature (1)..(439): NCBI GI: 115469510 NCBI Desc: os06g0677000 [oryza sativa (japonica cultivar-group)]
  misc_feature (1)..(358): NCBI GI: 52076903 NCBI Desc: patatin-like phospholipase domain containing protein-like [oryza sativa (japonica cultivar-group)]
MEAYAAMPSPQTKAMGVVDKLSYEIFSLLESKFLFGAAGTPARAFLDGGRVRVLAIDGCGAGAGAEDALLAAAALARLEAGLREQAGDPDARVADFFDVAAGAGAGAVLAAMLFLRGPDGRPRYTAQKALAFVAGSVGRRKDWCGRRGRWAKLFRGGSRGGDRMLRGVLGDATLRDTVAPLLVPCYDLATAAPFVFSRADAVESDSFDFRLRDVCAATCADRGAGALADVRSVDGVTAIAAACAGVAAMGNPAAAAVTHVLHNKLEFPLAASVEDILVFSIGTGSSTTVSSGPPNTPVPPTRAPSQRELARVAAEGVADMVDESVAMAFGDACGSNYVRIQAGRKSTAPLHAETAAAAAEAMLAQRNVESVLFRGRRLSERTNAEKVDTLVAELVKEQERRRSSPFPNVAIKQVATRRLSSATTASSGTTTARTTSSMPSPASWDSRR

SEQ ID NO: 3835 - DNA, 1263 bp, Sorghum bicolor
  misc_feature: Ceres ANNOT ID no. 6033596
  misc_feature: Encodes the peptide sequence at SEQ ID NO 3836
atgtcggcaaccgccgtggccccgacccctcccgccgcggccttcgcggtggcggccccgccgtcgtacccggcggccttctccgccgccgcggcgcccaccgagggccacgacggcgacttctactgtcactacaagtcgctccggcgccaccacgagttcctggagatccaggaggactacgtcaaggacgagctcaggaacctcaggcgcgaggagctccgcggggccgaggaggtgaagcggtgccgggcgacgccgctcgagatcggccagttcatggagatggtcgacgccgaccacggcatcgtggcgccgaccaccaccggcggcagcttctacgtgcgggtcctcagcaccatcggccgcgagctgctcaagccctcggcgtccgtcgcgctgcaccgccactcccacgcgctcgtcgacgtgttgccgcccgaggccgactccagcatctcgctgctcggctcgtcggagaagcccaacgtcacctacagtgatattggtggatgtgacattcagaagcaagaaatcagggaagctgtcgagttacccttgacacatcatgagttgtacaaacagattggtattgatccaccaagaggtgtgcttctgtatggtcctccaggtactggcaagaccatgcttgccaaagctgtggcacatcacacaactgctgcttttatcagagtagtcggttcagagtttgtgcagaagtacttgggtgagggacctcggatggttcgagatgtattccgtttggctaaggagaatgcccctgcaatcatatttattgacgaggttgatgctatagccactgcacgttttgatgctcagacaggtgctgaccgagaagttcagcgcattctgatggagctacttaatcagatggatggatttgatcaaacagtgaatgtgaaggttataatggcaactaatagggcagatactctagatcctgctttgttgcgtccaggtagacttgacaggaaaatcgagttccctcttcctgatcggcggcagaagaggcttgtgttccaagtctgcactgccaagatgaatttgagtgatgaggttgatttggaagattatgtttgtagaccggataagatcagtgctgctgatattgctgcaatatgccaagaagctggcatgcatgccgtcaggaaaaaccggtacgtgatcctgcccaaggactttgagaagggctaccggaccaatgtaaagaagcccgagacagacttcgacttctacaagtga

SEQ ID NO: 3836 - protein, 420 aa, Sorghum bicolor
  misc_feature: Ceres ANNOT ID no. 6033596
  misc_feature (203)..(390): Pfam Id: AAA Pfam Desc: ATPase family associated with various cellular activities(AAA)
  misc_feature (203)..(336): Pfam Id: AAA_5 Pfam Desc: ATPase family associated with various cellular activities(AAA)
  misc_feature (199)..(331): Pfam Id: AAA_2 Pfam Desc: ATPase family associated with various cellular activities(AAA)
  misc_feature (3)..(420): NCBI GI: 1155334 NCBI Desc: potatp1
  misc_feature (53)..(420): NCBI GI: 17298145 NCBI Desc: 26s proteasome regulatory particle triple-a atpase subunit3 [oryza sativa (japonica cultivar-group)]
  misc_feature (12)..(420): NCBI GI: 56382019 NCBI Desc: at5g58290 [arabidopsis thaliana]
  misc_feature (84)..(420): NCBI GI: 42602319 NCBI Desc: 26s proteasome regulatory complex atpase rpt3 [zea mays]
  misc_feature (40)..(420): NCBI GI: 55241741 NCBI Desc: ensangp00000023984 [anopheles gambiae str. pest]
  misc_feature: The sequence is a functional homolog of SEQ ID NO. 462 in the 11/188,298 US application
  misc_feature: The sequence is a functional homolog of SEQ ID NO. 471 in the 11/188,298 US application
MSATAVAPTPPAAAFAVAAPPSYPAAFSAAAAPTEGHDGDFYCHYKSLRRHHEFLEIQEDYVKDELRNLRREELRGAEEVKRCRATPLEIGQFMEMVDADHGIVAPTTTGGSFYVRVLSTIGRELLKPSASVALHRHSHALVDVLPPEADSSISLLGSSEKPNVTYSDIGGCDIQKQEIREAVELPLTHHELYKQIGIDPPRGVLLYGPPGTGKTMLAKAVAHHTTAAFIRVVGSEFVQKYLGEGPRMVRDVFRLAKENAPAIIFIDEVDAIATARFDAQTGADREVQRILMELLNQMDGFDQTVNVKVIMATNRADTLDPALLRPGRLDRKIEFPLPDRRQKRLVFQVCTAKMNLSDEVDLEDYVCRPDKISAADIAAICQEAGMHAVRKNRYVILPKDFEKGYRTNVKKPETDFDFYK

SEQ ID NO: 3837 - DNA, 1278 bp, Sorghum bicolor
  misc_feature: Ceres ANNOT ID no. 6033599
  misc_feature: Encodes the peptide sequence at SEQ ID NO 3838
atgccgaaggccggaggaggggcggcggacgaggaggagttccgcgccgaggtggaggagcgcctcatcaacgaggagtacaagatctggaagaagaacactcccttcctctacgacctcgtcatcacccacgcgctcgaatggccctccctcaccgtgcagtggctccccgaccgcaccgaacccccggggaaggaccactccgtccagaagatgatcctcggcacgcacacatccgacaacgagcccaactacctgatgctcgcgcaggtccagctgcccctcgacgacgccgaggccgacgcgcgccactacgacgatgaacacaccgacatcggggggttcggcgccgcctccggcaagataaatcatgatggagaggtcaatcgagctcgctatatgccccaaaattcatttataattgctaccaagacagttagtgcagaagtatatgtcttcgactatagcaagcacccatctaagcctccactagatggtgcatgcaaccctgatttacggctgaagggacataattctgaaggatatggcttgtcatggagtatttttaaagagggtcatttgttaagtgggtctgatgatgctcaaatttgtttgtgggacattaaagcaaatagtaaaaacaaaagtcttgatgccctgcagatttttaagcatcatgatggtgtcgttgaagatgttgcttggcacttgaggcatgagtatttatttgggtcagttggtgatgatcatcatcttttgatttgggacctgcggtctcccgcacctactaagcctgttcagtcagtggtggcacaccagggcgaggtgaactgcctggctttcaacccgttcaacgaatgggttgttgcaactggttctactgacaagactgtcaaattatttgatcttaggaagattgatacttctctgcacacctttcacaatcacaaagaggaagtttttcaagttggatggagtccaaagaatgaaactatacttgcatcctgttgtctgggcagaagactcatgatctgggacctaagcaggattgaccaagaacaaacaccagaggatgcagaagatggccctccagagctcatgttcatccatggaggccataccagcaagatctctgatttctcatggaacccctgcgaggactgggtgattgctagcgtcgctgaagacaacatcctccagatatggcagatggctgagaacatctaccatgacgaagatgatttgccaataagcgatgagccggcaaagacatcttaa

SEQ ID NO: 3838 - protein, 425 aa, Sorghum bicolor
  misc_feature: Ceres ANNOT ID no. 6033599
  misc_feature (168)..(207): Pfam Id: WD40 Pfam Desc: WD domain, G-beta repeat
  misc_feature (217)..(256): Pfam Id: WD40 Pfam Desc: WD domain, G-beta repeat
  misc_feature (263)..(302): Pfam Id: WD40 Pfam Desc: WD domain, G-beta repeat
  misc_feature (307)..(346): Pfam Id: WD40 Pfam Desc: WD domain, G-beta repeat
  misc_feature (364)..(403): Pfam Id: WD40 Pfam Desc: WD domain, G-beta repeat
  misc_feature (1)..(425): NCBI GI: 17017388 NCBI Desc: msi type nucleosome/chromatin assembly factor c [zea mays]
  misc_feature (1)..(425): NCBI GI: 82799368 NCBI Desc: msi [triticum aestivum]
  misc_feature (10)..(421): NCBI GI: 3122386 NCBI Desc: wd-40 repeat protein msi1
  misc_feature (10)..(425): NCBI GI: 21387123 NCBI Desc: wd-40 repeat protein msi1 [arabidopsis thaliana]
  misc_feature (10)..(416): NCBI GI: 69207914 NCBI Desc: wd-40 repeat protein [pisum sativum]
  misc_feature (8)..(408): SWISSPROT Homolog: EC 2.3.1.48 Histone acetyltransferase type B subunit 2
  misc_feature: The sequence is a functional homolog of SEQ ID NO. 485 in the 11/188,298 US application
  misc_feature: The sequence is a functional homolog of SEQ ID NO. 502 in the 11/188,298 US application
MPKAGGGAADEEEFRAEVEERLINEEYKIWKKNTPFLYDLVITHALEWPSLTVQWLPDRTEPPGKDHSVQKMILGTHTSDNEPNYLMLAQVQLPLDDAEADARHYDDEHTDIGGFGAASGKINHDGEVNRARYMPQNSFIIATKTVSAEVYVFDYSKHPSKPPLDGACNPDLRLKGHNSEGYGLSWSIFKEGHLLSGSDDAQICLWDIKANSKNKSLDALQIFKHHDGVVEDVAWHLRHEYLFGSVGDDHHLLIWDLRSPAPTKPVQSVVAHQGEVNCLAFNPFNEWVVATGSTDKTVKLFDLRKIDTSLHTFHNHKEEVFQVGWSPKNETILASCCLGRRLMIWDLSRIDQEQTPEDAEDGPPELMFIHGGHTSKISDFSWNPCEDWVIASVAEDNILQIWQMAENIYHDEDDLPISDEPAKTS

SEQ ID NO: 3839 - DNA, 1539 bp, Sorghum bicolor
  misc_feature: Ceres ANNOT ID no. 6033604
  misc_feature: Encodes the peptide sequence at SEQ ID NO 3840
atggcgccgcgcccccgcaagcgggcctcgcgccccaagccccgcccgggctcccgacgtggcggcggcggaggggacgacgaccccttcttcgagtccgagcccaagcgccgccgcgggggccgtgacgaggacatcgagagcgaggacagcgacgacgacggcggcgtggctgcggttggtggcggatttgatgaggatggggacgggggcggcgaggaggaggacgaggagacggtgggggagaagaagatgcgtatggcgaaggagtggctgcagaaggtcactgaggtcgctaagagggggcaggaggatgacgacgaggacgaggacgagtcgggagggagacgggtggcggagatcctgcagaggaagcagctcgaggagagcggcaggaagcggagggagattgccgcgagggtattaccaccgggccctcaggatggctttaagtttcttgtgaagcaccggcaacctgttactgctgttgctttatccaaggatagtgataagggattttcagcatcaaaagatggagtcattatgcattgggatgttgaaactgggaaatgtgagaagtatatatggccaagtgaaaatgtgttggtttcacatcatgctaaaccaccagtatcagctaaaagaagcaagcaagtgctggctttagctgccagttctgatggtcgttacttggcgagtggtggcttggaccgtcatatccatttatgggatgttaggtcacgggaacacatacaggcatttagcggccatcggggaccaatatcatgtctttcttttgcaccggactcttcagagctattctctggttcttttgaccgttcaataatgcagtggaatgcagaggatagaacatacatgaactgtttatatgggcatcagaatgaaatcttgacaatggatgcacttagcaaagacaggattctaactgtagcacgggaccgtacgatgcacctttggaagattccagaagagtcgcagttagtgttccgtgctcctgctgccgcatctttagagagttgctgctttattgatgacaaggaatttttgtctggatctgatgatggaagcattgagctttggagcataatgaggaaaaagcctattctcataataaaaaatgctcatgcagtatcatgtactaaccttaattcagttgacaatgatgatgagtcacctaaagaaaatggaatacataaacctgaaaatgtgccatccgcagcccagtcatgggttggtactgttgctgcaagaagaggttctgaccttgctgcatcaggagcaggaaatggtttagttcgtctctgggctgtcaaacctgattccaagggagtcgagccattattcgatttgaaactggatggatttgttaattctctggccatagcaaaatctggacgttttattgttgctggtgttggccaggagcctcgcctgggaagatggggacgagttcgatcggcccaaaatggagttgcaattcacccaatccgactaaaagatgagaaagaggatttgtag

SEQ ID NO: 3840 - protein, 512 aa, Sorghum bicolor
  misc_feature: Ceres ANNOT ID no. 6033604
  misc_feature (206)..(244): Pfam Id: WD40 Pfam Desc: WD domain, G-beta repeat
  misc_feature (248)..(286): Pfam Id: WD40 Pfam Desc: WD domain, G-beta repeat
  misc_feature (13)..(505): NCBI GI: 23198234 NCBI Desc: u3 snornp-associated-like protein [arabidopsis thaliana]
  misc_feature (19)..(395): NCBI GI: 62910985 NCBI Desc: u3-55k-like protein 2 [arabidopsis thaliana]
  misc_feature (11)..(384): NCBI GI: 119585563 NCBI Desc: rna, u3 small nucleolar interacting protein 2 [homo sapiens]
  misc_feature (11)..(384): NCBI GI: 123998253 NCBI Desc: rna, u3 small nucleolar interacting protein 2 [synthetic construct]
  misc_feature (36)..(384): NCBI GI: 27881844 NCBI Desc: loc402808 protein [danio rerio]
  misc_feature: The sequence is a functional homolog of SEQ ID NO. 502 in the 11/188,298 US application
  misc_feature: The sequence is a functional homolog of SEQ ID NO. 485 in the 11/188,298 US application
MAPRPRKRASRPKPRPGSRRGGGGGDDDPFFESEPKRRRGGRDEDIESEDSDDDGGVAAVGGGFDEDGDGGGEEEDEETVGEKKMRMAKEWLQKVTEVAKRGQEDDDEDEDESGGRRVAEILQRKQLEESGRKRREIAARVLPPGPQDGFKFLVKHRQPVTAVALSKDSDKGFSASKDGVIMHWDVETGKCEKYIWPSENVLVSHHAKPPVSAKRSKQVLALAASSDGRYLASGGLDRHIHLWDVRSREHIQAFSGHRGPISCLSFAPDSSELFSGSFDRSIMQWNAEDRTYMNCLYGHQNEILTMDALSKDRILTVARDRTMHLWKIPEESQLVFRAPAAASLESCCFIDDKEFLSGSDDGSIELWSIMRKKPILIIKNAHAVSCTNLNSVDNDDESPKENGIHKPENVPSAAQSWVGTVAARRGSDLAASGAGNGLVRLWAVKPDSKGVEPLFDLKLDGFVNSLAIAKSGRFIVAGVGQEPRLGRWGRVRSAQNGVAIHPIRLKDEKEDL

SEQ ID NO: 3841 - DNA, 1311 bp, Sorghum bicolor
  misc_feature: Ceres ANNOT ID no. 6033612
  misc_feature: Encodes the peptide sequence at SEQ ID NO 3842
atggagcggcagatggacttggcgcgccttctccctgacgacgtgtccgcggacatcctccgcggccgcctgccgcctcgaagtctcgccgtttgccgccgcgtctgcactagttggcgcgcgctcatcgacgactgcggcatcctgcgcgcggatctcctcccgcagtcgctggctggcctcattataagctacaacgagctaaacttcgcggagctcttcgcccgcccttccgtcgactcgggcgactacggcatgccttccggtgtcgtccaggaccactgcaacggcctcctcctgctagacggctgggtgcacaatccagccaccagtcgctatgccatgttgcccgaacgccggccggctccacgccatgatcagtatgccaccgaatatgagtacctagtgtttgatcctactatttcatcgcacttcttcgaggtgctcttgatccccaggaccgtatttagtcccggagctacctgcttgttgccttcagaatggccaccgtcaccgtggatcctcagtttcttctcgtccacgacgggggtatgggaggagaagtcgtttattcgacaaggtgaggatgcaggaacagtcgctgacatgcaactggatcgacgattagttgaagtggacggaggaaggaaagctgaatactggcgtggcgcactctacgttcactgtgaacctgacttcatcatgaggatatccttgtcaaatagctcgtaccgagtaataaaaaacccaagcggtttccaagatggaaagtttgttctggggaggtcgaagaaggggatttactatgcattacttgatgctaagtaccgcctgcgcgtctggatccttcacgaatcgagtgatgatcaggttgactggatattgagacacgacagtggtcgggggcttgcgtttcctccatatctaagctgtgatagtggaccctggatcttatcatatacgaactctgacgatgagagcgaaggtgacgatgagagcgaagacgaagaagaagcccaagtggaagaagaatacgaatggaactctgatgatgatagtgttattctacccactgatgatagactcgctcgtgaatttcatatcgttgcatttcatccttacaaagagattgtcttcttcaaaagattatcatcaagagtattggcgtatcatttgaatagctctaaactcgaagacttgggcaaattgttgccgttagataattttgatccttcagtgtatatgagaagctgttttccgtacacgccttgccggatggatgggttgccaaaacaattcgagcaaacctaa

SEQ ID NO: 3842 - protein, 436 aa, Sorghum bicolor
  misc_feature: Ceres ANNOT ID no. 6033612
  misc_feature (6)..(54): Pfam Id: F-box Pfam Desc: F-box domain
  misc_feature (7)..(361): NCBI GI: 115456876 NCBI Desc: os04g0113000 [oryza sativa (japonica cultivar-group)]
  misc_feature (7)..(361): NCBI GI: 116308824 NCBI Desc: osigba0112g01.1 [oryza sativa (indica cultivar-group)]
  misc_feature (5)..(299): NCBI GI: 50508587 NCBI Desc: protein with f-box domain-like [oryza sativa (japonica cultivar-group)]
  misc_feature (91)..(420): NCBI GI: 53370641 NCBI Desc: f-box domain containing protein [oryza sativa (japonica cultivar-group)]
  misc_feature (2)..(318): NCBI GI: 115440773 NCBI Desc: os01g0824700 [oryza sativa (japonica cultivar-group)]
  misc_feature: The sequence is a functional homolog of SEQ ID NO. 456 in the 11/188,298 US application
MERQMDLARLLPDDVSADILRGRLPPRSLAVCRRVCTSWRALIDDCGILRADLLPQSLAGLIISYNELNFAELFARPSVDSGDYGMPSGVVQDHCNGLLLLDGWVHNPATSRYAMLPERRPAPRHDQYATEYEYLVFDPTISSHFFEVLLIPRTVFSPGATCLLPSEWPPSPWILSFFSSTTGVWEEKSFIRQGEDAGTVADMQLDRRLVEVDGGRKAEYWRGALYVHCEPDFIMRISLSNSSYRVIKNPSGFQDGKFVLGRSKKGIYYALLDAKYRLRVWILHESSDDQVDWILRHDSGRGLAFPPYLSCDSGPWILSYTNSDDESEGDDESEDEEEAQVEEEYEWNSDDDSVILPTDDRLAREFHIVAFHPYKEIVFFKRLSSRVLAYHLNSSKLEDLGKLLPLDNFDPSVYMRSCFPYTPCRMDGLPKQFEQT

SEQ ID NO: 3843 - DNA, 2976 bp, Sorghum bicolor
  misc_feature: Ceres ANNOT ID no. 6033648
  misc_feature: Encodes the peptide sequence at SEQ ID NO 3844
atggacgtggactcgcgcatgacgacggagtccgactccgactccgacgcggcggccgcggccgcccacgggggcagcgctggaggctcggggtccgggagcgagacctcgtcatcgtccgcgccctcgacgcctgggacgcccgcggcagccccgaacccggcggcggtcggcgccgcggggccgaggccagcgcccgggtacacggtggtgaacgccgtgatcgagaagaaggaggacgggccagggtgccggtgcgggcacacgctcacggcggtgccggctgtcggggaggagggcacgcctggatacatcggaccgcggctgatcctgtttggtggggccaccgcgctcgaagggaactctgccacgccgccctcttcggccgggagcgcggggatccatgtccattgttatgacgtgtcatcgaacaagtggagcaggcttaccccacttggagagcctccttcacccagagctgcacatgtggcaactgcggttggaaccatggtggtcattcagggtggaattggtcctgctggtttatctgcagaggaccttcatgttctagaccttacacagcaacgaccgcgatggcacagagtggtggttcaaggacctggtccaggtccacgatatggtcatgtgatggccttggttgggcagagatttttgttgactattggtggaaatgacgggaagcggcctctggcggatgtatgggcccttgatactgcagctaagccatatgaatggaggaaacttgaaccagaaggtgaaggaccacctccatgcatgtatgccactgcaagtgcacgttctgatggacttctcttactttgtggtgggagggatgcaaatagcgtgcccttatcaagtgcatatggtcttgctaaacatagagatgggcgctgggagtgggcaattgcccccggtgtctctccatcgcccagataccaacatgcagctgtttttgtgaatgcacgtcttcatgtgtcaggaggtgctcttgggggtgggcggatggtggaagactcctcaagcgttgcagtactggacactgctgctggagtctggtgtgatacaaaatctgttgttacaactcctaggacaggaagatttagtgcagatgcagcaggaggtgatgctgctgttgagcttacacgacggtgcaggcatgcagcagctgctgttaatgatctaatattcatttatggaggtttgcgaggcggggtacttctggatgatcttcttgtggctgaggatcttgctgctgctgaaacaacaaatgctgctaatcatgcagcagcaagtgcagctgccacaaacttgcaagcaggacgagcacctgggaagtatgcatacaatgatgaacgaacaagacaaacagctacagaatcaggtcctgatggggctgtagttcttgggactccagttgcacctcctgtaaatggagacatgtatactgatatcagtcccgagaatgctgtgctgcaaggacaaaggagattaagtaaaggcgtggattacttggttgaagcatcagcagcagaggcggaggcaatcagtgctacattagctgctgtgaaggccaggcaggttaatggtgagatggagcagttgtcggacaaggagcagtctccagactccacatcgaccaccaaacattcaagcctcataaaaccagacagtactctttctaacaacatggcagttgcacctggggttcggttgcaccatagagccgttgtggtggctgctgaaactggaggtgccctaggtggcatggtcaggcagctatcaattgaccaatttgaaaatgaaggcagaagagtcagctatggcaccccagagaacgcaactgcagcaaggaagttactagatagacaaatgtctattaatagtgttcctaaaaaggtaattgcatctctgttgaaacctcgtggctggaagccccctgtccggaggcagttcttcttggactgcaatgaaattgcagatctgtgcgacagtgctgagagaatattttcaagcgaaccaagtgttttgcggcttaaagctcctgttaagatatttggagatttacacggacaatttggagacttgatgaggttattcgatgaatatggtgcaccttcgactgcaggtgacattgcttacattgattatctatttttgggggattatgtagatcgtggccagcatagtttagaaactatcactcttcttcttgcactgaaggttgaatatcctcaaaatgtacacttgattcgaggaaatcatgaagctgcagacatcaatgctttgtttggtttccgaatagagtgtatagaacgaatgggcgagagagatggtatttggacatggcatcgaatgaataggctatttaattggcttcctttggctgcacttatagaaaagaaaatcatctgtatgcatggtggcattggtcggtcaatcaaccatgttgagcaaattgagaatcttcaaaggccaattacaatggaagctggctcggttgtcctcatggatcttctgtggtctgatccaacagagaacgacagtgttgaaggactgaggcccaatgcccggggtcctggtcttgttacatttgggcctgatcgggttatggagttctgcaacaacaatgatcttcagttaattgttcgagcacatgagtgtgtgatggatggctttgagcgctttgctcaaggtcacctgatcactcttttctctgcaacaaattattgcggtactgcaaataatgccggtgcgatcttggttttgggtagagatcttgtggttgtgccaaaactaatccatcctttgccccctgcaattacgtcacctgaggcgtcaccggatcatattgaggacacatggatgcaggagctaaatgctaacagaccaccaactccgaccagggggcgtccccaagcagtagctaatgaccggggctctctcgcctggatatag

SEQ ID NO: 3844 - protein, 991 aa, Sorghum bicolor
  misc_feature: Ceres ANNOT ID no. 6033648
  misc_feature (687)..(896): Pfam Id: Metallophos Pfam Desc: Calcineurin-like phosphoesterase
  misc_feature (317)..(366): Pfam Id: Kelch_2 Pfam Desc: Kelch motif
  misc_feature (1)..(991): NCBI GI: 110832776 NCBI Desc: serine/threonine protein phosphatase bsl2 homolog (bsu1-like protein 2 homolog)
  misc_feature (1)..(991): NCBI GI: 42569377 NCBI Desc: kelch repeat-containing serine/threonine phosphoesterase family protein [arabidopsis thaliana]
  misc_feature (1)..(991): NCBI GI: 140040351 NCBI Desc: dna topoisomerase ii; serine/threonine-specific protein phosphatase and bis(5-nucleosyl)-tetraphosphatase [medicago truncatula]
  misc_feature (1)..(991): NCBI GI: 92876063 NCBI Desc: dna topoisomerase ii; serine/threonine-specific protein phosphatase and bis(5-nucleosyl)-tetraphosphatase [medicago truncatula]
  misc_feature (5)..(991): NCBI GI: 15223207 NCBI Desc: kelch repeat-containing protein / serine/threonine phosphoesterase family protein [arabidopsis thaliana]
  misc_feature (1)..(991): SWISSPROT Homolog: EC 3.1.3.16 Serine/threonine-protein phosphatase BSL2 homolog
  misc_feature: The sequence is a functional homolog of SEQ ID NO. 354 in the 11/188,298 US application
MDVDSRMTTESDSDSDAAAAAAHGGSAGGSGSGSETSSSSAPSTPGTPAAAPNPAAVGAAGPRPAPGYTVVNAVIEKKEDGPGCRCGHTLTAVPAVGEEGTPGYIGPRLILFGGATALEGNSATPPSSAGSAGIHVHCYDVSSNKWSRLTPLGEPPSPRAAHVATAVGTMVVIQGGIGPAGLSAEDLHVLDLTQQRPRWHRVVVQGPGPGPRYGHVMALVGQRFLLTIGGNDGKRPLADVWALDTAAKPYEWRKLEPEGEGPPPCMYATASARSDGLLLLCGGRDANSVPLSSAYGLAKHRDGRWEWAIAPGVSPSPRYQHAAVFVNARLHVSGGALGGGRMVEDSSSVAVLDTAAGVWCDTKSVVTTPRTGRFSADAAGGDAAVELTRRCRHAAAAVNDLIFIYGGLRGGVLLDDLLVAEDLAAAETTNAANHAAASAAATNLQAGRAPGKYAYNDERTRQTATESGPDGAVVLGTPVAPPVNGDMYTDISPENAVLQGQRRLSKGVDYLVEASAAEAEAISATLAAVKARQVNGEMEQLSDKEQSPDSTSTTKHSSLIKPDSTLSNNMAVAPGVRLHHRAVVVAAETGGALGGMVRQLSIDQFENEGRRVSYGTPENATAARKLLDRQMSINSVPKKVIASLLKPRGWKPPVRRQFFLDCNEIADLCDSAERIFSSEPSVLRLKAPVKIFGDLHGQFGDLMRLFDEYGAPSTAGDIAYIDYLFLGDYVDRGQHSLETITLLLALKVEYPQNVHLIRGNHEAADINALFGFRIECIERMGERDGIWTWHRMNRLFNWLPLAALIEKKIICMHGGIGRSINHVEQIENLQRPITMEAGSVVLMDLLWSDPTENDSVEGLRPNARGPGLVTFGPDRVMEFCNNNDLQLIVRAHECVMDGFERFAQGHLITLFSATNYCGTANNAGAILVLGRDLVVVPKLIHPLPPAITSPEASPDHIEDTWMQELNANRPPTPTRGRPQAVANDRGSLAWI

SEQ ID NO: 3845 - DNA, 669 bp, Sorghum bicolor
  misc_feature: Ceres ANNOT ID no. 6033652
  misc_feature: Encodes the peptide sequence at SEQ ID NO 3846
atgggagccgccgcttcttctcctcccccaccttccctagagacagccaccgttgcctccagtcctgatcctcctccccgagaggcagccgctacaccagccaaagaagatcaccagcactccgcccccgccgccgccgccgccgcggccggcggcgtcgcggacgatgcggcggcggcggctcctgctggtggaggcggcgcggaagataccgcggagacggtggtcatcgatgcctcagccgaggccggcggagcaggggagggggaggaggagcaagcggagtgcgggttctgcctcttcatgaagggcggcggctgcaaggacgagttcgtcgcgtgggagaagtgcgtggaggaggcggaggccgcgggtgccagcgtcgacgtcgtggagcggtgccaagacgtcacggccgcgctgcggaagtgcatggacgcgcacgccgactactacgagcctatcctccgggccgagcgcgccatggctgcggacctcgaggcctttcaggccgaagaagccgcctccgcctccgcagcgtcggcgtccgaggaaggccagaagaaggaggcggcggccgaggcagcggcgccgccgtcagacggaggccagaataagcaggtggctgaggcggcagtttcggaggagagcagagattctgcagcctga

SEQ ID NO: 3846 - protein, 222 aa, Sorghum bicolor
  misc_feature: Ceres ANNOT ID no. 6033652
  misc_feature (94)..(170): Pfam Id: GCK Pfam Desc: GCK domain
  misc_feature (41)..(217): NCBI GI: 115470659 NCBI Desc: os07g0158400 [oryza sativa (japonica cultivar-group)]
  misc_feature (18)..(191): NCBI GI: 8778401 NCBI Desc: f16a14.27 [arabidopsis thaliana]
  misc_feature (23)..(222): NCBI GI: 88863809 NCBI Desc: mucin-associated surface protein [jannaschia sp. ccs1]
  misc_feature (4)..(217): NCBI GI: 116744580 NCBI Desc: membrane-bound cytochrome c [rhodovulum sulfidophilum]
  misc_feature (3)..(222): NCBI GI: 119539134 NCBI Desc: kinetoplast dna-associated protein [nocardioides sp. js614]
MGAAASSPPPPSLETATVASSPDPPPREAAATPAKEDHQHSAPAAAAAAAGGVADDAAAAAPAGGGGAEDTAETVVIDASAEAGGAGEGEEEQAECGFCLFMKGGGCKDEFVAWEKCVEEAEAAGASVDVVERCQDVTAALRKCMDAHADYYEPILRAERAMAADLEAFQAEEAASASAASASEEGQKKEAAAEAAAPPSDGGQNKQVAEAAVSEESRDSAA

SEQ ID NO: 3847 - DNA, 1107 bp, Sorghum bicolor
  misc_feature: Ceres ANNOT ID no. 6033666
  misc_feature: Encodes the peptide sequence at SEQ ID NO 3848
atggcaaccggcgaggagcacgtggcggcggcggcggcggcggtcgaggagacgccggagaagaaggagaccagcacaaccgagctcctcgcaccctcaggctggacgaagaagcttgtcctaactcgagttggacgatttgaggttctttttgtttccccaactggtgaggaaattaagagcaagagacagctgacgcagtacctgaaagctcatcccggaggccctgcatcttcagagtttgattggggaaccagtgatactccccgacgctcagcacgcttaagcgagaaggtcaaggcaacttggaacccagagggtgagaagacccctaaacggggaagatcaagctctaagaggggcaaaaaggaggaaaaagaagatgtaaatgaggctggtgaagatggtgcttcggaggaaggtaaaggtaccgatgtggagatgaaggatgctgaaaatgctgaagacgagaagaaagaggccccaagtgcagatgctgcagagaagaccgaggaaggtgaagataagaaagaggaggctcctgctgtagatgtagcagagaagactgaggaaggtgaagataagaaagaggaggcccctgctgtagatgcagcggagaagactgatgacaaagaggtggcccctgttgtagattcagctgagaaggctgatgataaagaggtggcccctgctgtagatgcagctgagaagactgaacaaagcaccgaaggccaagcacaacctaataatgttgctgccccagaatctgaggataaaggggacggaaagccagctgagtccgaatcagctcccccagcaattgttgatgaagagaagaaagaggagaagaccgagaacggtcaggcagctgaatctgtggtgccttccctggcatcttcagagggggagaagaaagagaatggaggtgcaactgaacccgcagccccgcttgtggctgagacaaagacagatgctcctccagctgaggcagaaaagggggccgagaattcaggccaggtgaacactgccccccaagaaccgacggcagcgaactgcgacaacaagggccagatccaacctggtgcctctgctatgaggtgcacataa

SEQ ID NO: 3848 - protein, 368 aa, Sorghum bicolor
  misc_feature: Ceres ANNOT ID no. 6033666
  misc_feature (21)..(91): Pfam Id: MBD Pfam Desc: Methyl-CpG binding domain
  misc_feature (1)..(358): NCBI GI: 22135477 NCBI Desc: methyl binding domain protein mbd109 [zea mays]
  misc_feature (23)..(357): NCBI GI: 56382007 NCBI Desc: at1g15340 [arabidopsis thaliana]
  misc_feature (22)..(190): NCBI GI: 134285534 NCBI Desc: mbd6 [triticum aestivum]
  misc_feature (12)..(159): NCBI GI: 144924784 NCBI Desc: methyl-cpg binding [medicago truncatula]
  misc_feature (106)..(346): NCBI GI: 77808105 NCBI Desc: rpgr orf15 isoform [xenopus laevis]
  misc_feature: Useful for making plants with modulated drought sensitivity
  misc_feature: Functional homolog of the protein sequence given in SEQ ID NO 13846
MATGEEHVAAAAAAVEETPEKKETSTTELLAPSGWTKKLVLTRVGRFEVLFVSPTGEEIKSKRQLTQYLKAHPGGPASSEFDWGTSDTPRRSARLSEKVKATWNPEGEKTPKRGRSSSKRGKKEEKEDVNEAGEDGASEEGKGTDVEMKDAENAEDEKKEAPSADAAEKTEEGEDKKEEAPAVDVAEKTEEGEDKKEEAPAVDAAEKTDDKEVAPVVDSAEKADDKEVAPAVDAAEKTEQSTEGQAQPNNVAAPESEDKGDGKPAESESAPPAIVDEEKKEEKTENGQAAESVVPSLASSEGEKKENGGATEPAAPLVAETKTDAPPAEAEKGAENSGQVNTAPQEPTAANCDNKGQIQPGASAMRCT

SEQ ID NO: 3849 - DNA, 1047 bp, Sorghum bicolor
  misc_feature: Ceres ANNOT ID no. 6033667
  misc_feature: Encodes the peptide sequence at SEQ ID NO 3850
atgcggcccatgacgaacccgcccctgctctcaccgtccccgtgccctctcctccgccgcctcctcctccacctctcgcgtgcctctcgccgccggaaccctaccgccgggccgccacctccttgtactttccgccaccgcctcccgcgcctcctcaccgctgccatgtcctccgactccgtcgtcgccgaccccactactcttgcccgcaaggtcgcagacatccgtgccgccggacccgccaagctccaggtcatcgccgacttcgatggcacgctcacgcgatactggtacgacggcgcccgcgggcagagtagccatgggctgctcaggcaagggaacgaggagtacgacgccaagagggaggcgttgtaccagcactaccaccccatcgagatttgccccgatattccacttccggagaaggccaagctcatggaagaatggtgggagaagactcatggtctccttattgaaggtggtcttacattagaagatatcacaaaatctgtctctgatgccgcaattgctttcagagagggtgtagtggagctctttgagtacctggaggagagagatatcccagtgctggtattttctgcaggacttgcagacataattgaagaggtcttccggcagaaactacacaaatcattcaagaacatcaagattgtctccaacaggatggtgtttaacgaagaaggccgtcttgtagcatttaaagggaaaacaattcacgttctaaacaaaaatgagcatgccttggacatggctgctccagtgcatggcaatcttggggatccaaatggatttattgatgactattcattggtgaagaaaaggaccaatgtgctgctacttggcgatcacattggggacttggggatgtctgatggtttaaactatgaaaacaggattgctgttggattcctgaatgccaacattgagaaatctttgaaggattactctagctcatttgacattgtatatctgaatgatgcgccgatgcagggagttgtgaaactcgtgtctgaattatgtccataa

SEQ ID NO: 3850 - protein, 348 aa, Sorghum bicolor
  misc_feature: Ceres ANNOT ID no. 6033667
  misc_feature (92)..(347): Pfam Id: UMPH-1 Pfam Desc: Pyrimidine 5'-nucleotidase (UMPH-1)
  misc_feature (54)..(348): NCBI GI: 115454361 NCBI Desc: os03g0648900 [oryza sativa (japonica cultivar-group)]
  misc_feature (50)..(345): NCBI GI: 23272942 NCBI Desc: nt5c3 protein [mus musculus]
  misc_feature (62)..(345): NCBI GI: 117949805 NCBI Desc: cytosolic 5'-nucleotidase iii (cn-iii) (pyrimidine 5'-nucleotidase 1) (p5'n-1) (p5n-1) (pn-i) (lupin)
  misc_feature (59)..(337): NCBI GI: 83375961 NCBI Desc: pyrimidine 5'-nucleotidase [oryctolagus cuniculus]
  misc_feature (62)..(337): NCBI GI: 33334637 NCBI Desc: pyrimidine 5'-nucleotidase [gallus gallus]
MRPMTNPPLLSPSPCPLLRRLLLHLSRASRRRNPTAGPPPPCTFRHRLPRLLTAAMSSDSVVADPTTLARKVADIRAAGPAKLQVIADFDGTLTRYWYDGARGQSSHGLLRQGNEEYDAKREALYQHYHPIEICPDIPLPEKAKLMEEWWEKTHGLLIEGGLTLEDITKSVSDAAIAFREGVVELFEYLEERDIPVLVFSAGLADIIEEVFRQKLHKSFKNIKIVSNRMVFNEEGRLVAFKGKTIHVLNKNEHALDMAAPVHGNLGDPNGFIDDYSLVKKRTNVLLLGDHIGDLGMSDGLNYENRIAVGFLNANIEKSLKDYSSSFDIVYLNDAPMQGVVKLVSELCP

SEQ ID NO: 3851 - DNA, 3114 bp, Sorghum bicolor
  misc_feature: Ceres ANNOT ID no. 6033693
  misc_feature: Encodes the peptide sequence at SEQ ID NO 3852
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
atgtcggcggcggagaggaccgacgatgcgtcggcctcggcctcagcgggtgacccgcgcggggtccgcaacacgtgcatcctcgcgcacgtggaccacggcaagaccacgctggcggaccacctggtggcgtcctgcggggacgggctcctccacccgaagctcgccggccggctccgcttcatggactacctcgacgaggagcagcggcgggccatcaccatgaagtccgccgccgtcgcgctccgctcccgggccggacaccgcgtcagcctcatcgattcccccggccacatcgacttctgctccgaggtctcctccgccgcgcgcctctcggactcggcgctcatcctcgtcgacgccgtcgaaggggtgcacatccagacgcacgccgcgctgcgccaggccttcatcgagcgcctccgcccctgcctcgtgctcaacaagatcgaccgcctcatcaccgagctcagcctcacccccgccgaggcctacgtccgcctccaccgcatcgtctccgacgtcaactccatctactccgcgctgcgctcccactcctacttctccctactctccgccctcgaggacagcccctccacaagctcttcctccttagctgaggacctaccggaggactttgaagacgacgatgacaacgaggacgccttccagcccctcaagggcaatgtcgtcttcgcctgtgcacttgacggctggggctttcgcccccaacagttcgccaacctctacgccagaaagaccagagtcaacccctccgccttcctgaaaggattgtggggccccaggtatctcgataagaagacggggaaggttgtggggaagaaagctatcaagagcgcagacccacagccaatgttcgtggagtttgtgttgagtgccctgtggaagatgtacgagctggtgctggagggcggtggtgagagtaatgcggtgaagaaattgattgaaaactttgacttgaaaattccggaacgggagctgaagaacagagatacaaaggctgtgctgcagtctgtcatgagccgctggctgccgctggcagatgctgtgatggatatggtggtggagtgcacccctgatcctgttgctgctcaaggggtcagggttgcaaggcttatgccaaagagggaggttactccagaagatgctgctggttgccctgatgttgttgaggaggccgagagggtgcggaggtgtgtcgaggcctgtgatgtgagtgctgatgcgccagtcgtagtttatgtgtcaaagatgtttgctgtgccatctaagatgttgccattgaagggagtggatggtgaactgttgaaccaccatagtagtagtgagtcagaggagtgctttatggcatttgcaagggtcttcagtggtgtccttcatgcagggcagaaggtatttgtgctgtcgccattgtatgatccagtgaaaggggatacagttcagaagcatgtgcaggaggtggagcttcaatacttgtatgagatgctaggacaaggcctgaagccagttgccagtgtgggtgcggggaatgtggttgcaatccagggccttgggcagcatatattgaagagtgccacattgtcgtcgaccaagaattgctggcccttctcgagtatgatgttccaggcatctccaatgcttaaagttgcgattgagccctcaaatccagctgatctaggagctcttgttaaagggcttaggcttcttaaccgggcagatccatttgtcgagtatactgtttcgcagaggggtgagcatgtccttgctgctgctggtgagatacatttggagcggtgcataaaggatttggaggagagattttcaaaggtcaaattggtggtctcagaccccctagtttccttcaaagagacaattgacggggaaggtgtcagtttagtggagagcttgaagaacccacaggagtttgttgagaggactactccaaatgggaggtgtactgtgcgagttcaggtcctgaggcttcccaatgctctgactaaggtccttgaggaaagtgagcagttgcttggtcaaataattgatgggaaaacagcaaacagggatggtgtattggatcctcgcctttctcacgaagatggtgattctgctgcaactctcagacagcggatgatcgatgccatagacagtgaattagacacatttctagcagggtatagaaagacatggcttggacaccttgaaagaatctggtcactaggtccttggcaggttggtccaaatatccttcttctgcctgattcaaaatcaagtggtggtacaataactgtccaggatggaaggcaaggtatacttgttagtggcagagctcatgtgtctgagaaattggggtttgtgagggaaggtgataccaaagataatgatcttgacaatggtgacgaatatgcagcagatgctcctgaatcgttgcatatagagtctacggcactaaggaacagcattgtctcaggattccagattgccactaatgctgggcctttatgtgatgaacctatgtggggtcttgcgtttattgttgagccttacatattcgatgacggctctgatgctgccaaccactctgatcaatacaatgtcttcagcggtcaagtaatcactgcggttaaagaagcatgcagagcagctgttcttcagaacaagccaaggcttgttgaggctatgtacttctgtgagttgaccaccccaaccgagcagttaggtgcaacttacgcagttcttggtaagaggagagcaagggttctgaaagaagagatgcaagaaggaacctcattatttacagtgcatgcttacctgccagtcgctgagagcattgggttttcgaatcaacttaggagtttaactgcaggtgcagttagtgctctcctcgttcttagccactgggaagctattcctgaggaccccttctttgtcccaaagacacaggatgagcttgaagaatttggagatggttcaagcattgggccaaacctggctaaaaagctcatgaattctgttagacgaaggaaaggactgcatgtggaagagaaagttgtggagcatggcacaaaacagcggactcttgctaaaaaggtatag

SEQ ID NO: 3852 - protein, 1037 aa, Sorghum bicolor
  misc_feature: Ceres ANNOT ID no. 6033693
  misc_feature (20)..(367): Pfam Id: GTP_EFTU Pfam Desc: Elongation factor Tu GTP binding domain
  misc_feature (895)..(983): Pfam Id: EFG_C Pfam Desc: Elongation factor G C-terminus
  misc_feature (20)..(1037): NCBI GI: 15228918 NCBI Desc: elongation factor tu family protein [arabidopsis thaliana]
  misc_feature (12)..(1037): NCBI GI: 92877074 NCBI Desc: elongation factor tu, domain 2; translation elongation factor g [medicago truncatula]
  misc_feature (280)..(1037): NCBI GI: 9294187 NCBI Desc: elongation factor ef-2 [arabidopsis thaliana]
  misc_feature (22)..(434): NCBI GI: 94966754 NCBI Desc: elongation factor tu gtp binding domain containing 1 isoform 1 [homo sapiens]
  misc_feature (22)..(434): NCBI GI: 28374136 NCBI Desc: elongation factor tu gtp binding domain containing 1 [mus musculus]
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
MSAAERTDDASASASAGDPRGVRNTCILAHVDHGKTTLADHLVASCGDGLLHPKLAGRLRFMDYLDEEQRRAITMKSAAVALRSRAGHRVSLIDSPGHIDFCSEVSSAARLSDSALILVDAVEGVHIQTHAALRQAFIERLRPCLVLNKIDRLITELSLTPAEAYVRLHRIVSDVNSIYSALRSHSYFSLLSALEDSPSTSSSSLAEDLPEDFEDDDDNEDAFQPLKGNVVFACALDGWGFRPQQFANLYARKTRVNPSAFLKGLWGPRYLDKKTGKVVGKKAIKSADPQPMFVEFVLSALWKMYELVLEGGGESNAVKKLIENFDLKIPERELKNRDTKAVLQSVMSRWLPLADAVMDMVVECTPDPVAAQGVRVARLMPKREVTPEDAAGCPDVVEEAERVRRCVEACDVSADAPVVVYVSKMFAVPSKMLPLKGVDGELLNHHSSSESEECFMAFARVFSGVLHAGQKVFVLSPLYDPVKGDTVQKHVQEVELQYLYEMLGQGLKPVASVGAGNVVAIQGLGQHILKSATLSSTKNCWPFSSMMFQASPMLKVAIEPSNPADLGALVKGLRLLNRADPFVEYTVSQRGEHVLAAAGEIHLERCIKDLEERFSKVKLVVSDPLVSFKETIDGEGVSLVESLKNPQEFVERTTPNGRCTVRVQVLRLPNALTKVLEESEQLLGQIIDGKTANRDGVLDPRLSHEDGDSAATLRQRMIDAIDSELDTFLAGYRKTWLGHLERIWSLGPWQVGPNILLLPDSKSSGGTITVQDGRQGILVSGRAHVSEKLGFVREGDTKDNDLDNGDEYAADAPESLHIESTALRNSIVSGFQIATNAGPLCDEPMWGLAFIVEPYIFDDGSDAANHSDQYNVFSGQVITAVKEACRAAVLQNKPRLVEAMYFCELTTPTEQLGATYAVLGKRRARVLKEEMQEGTSLFTVHAYLPVAESIGFSNQLRSLTAGAVSALLVLSHWEAIPEDPFFVPKTQDELEEFGDGSSIGPNLAKKLMNSVRRRKGLHVEEKVVEHGTKQRTLAKKV

SEQ ID NO: 3853 - DNA, 2643 bp, Sorghum bicolor
  misc_feature: Ceres ANNOT ID no. 6033705
  misc_feature: Encodes the peptide sequence at SEQ ID NO 3854
atgggcgccagccggaagctgcagggcgagatcgaccgcgtcctcaagaaggtccaggagggcgtcgacgtcttcgacagcatctggaacaaggtctacgacactgagaatgccaaccagaaggagaagttcgaggcggacctcaagaaggagatcaagaagctgcagcggtacagggaccagatcaagacatggatccagtccagcgagatcaaggacaagaaggctctgatggatgcccgaaagcagattgaacgagagatggaacgatttaaagtttgtgagaaggaaacaaaaactaaggccttctcaaaagaagggttaggtcagcaaccaaaaacagatcccaaagaaaaggccaaagctgaaacaagagactggcttaataatgtggttagtgatttggaaagccagattgataactttgaagcagaggttgaagggctttcaattaaaaagggaaagcaaagaccgcctcgactggtacatttagagaagtctattaccagacataaagctcatataaagaaattggagtcaatcttgagacttttggataatgatgagttgagtcctgagcaagtcaatgatgttaaagatttccttgatgactatgttgaacgtaatcaggaagacttcgatgaattcagtgatgttgaggacctctatagcacattgcctatggagaaggttgaagcacttgaagacatggtttcacttgctccttctagtcttgtgaagggtgctgcttctgtttcgactactgcagttttgagcacaaagagttcagttgcatcttcgcctactcagcctaccatatcaacaactccttcacaaagtacatcacaagatcaaacagaggagacagcttcacaagaaagcaatcctgaatctgcgccacaaacaccacctccaaaaggtggaaatcctggaccttcagtaccagctgtgcccattgctgtcagtactggtagtgcagctgtttctgtacctccagaaacaattagttcccctgtgcgaccaactgttcccaccacagcggctgcaatactttcttctgctattccacgaagtgttcctgagaatacgcctgctattacctcaattcctgcaaacttatctaccaccttgaaggatgatgaaagcatgagttttcctccacgacgaccatctcctgctattactgaaattggaattggcaggggcatagctcgaggaataactagtagtcagggattaggtacagctcccataactattggtccagtcccaggaaatggatcggttagtgcacttcctgcaataaatgacttgtccaaaagaaatatattgaacactgacgagaagattaatagtggtggtctttctcagcagttggttacgcctcttggtagtaaagttcaaccccagcaggttcccaggactaatgatgcaattagctctgattctgctaatccaaatgaaaatcctattcttggtggaagagtattttctcctccagttgtttctggggttcaatggagacctcaagctgctgctacatttcaaaatcaaagtgaaactagtcaatttcgtggaaggcctgagatttctgctgatcacagggagaagtacatacaaagactgcagcaagtacagcagcaaggtggcagccttctgaatgtttctcatataactggcataaatcagaagcaatttccaacacagcaaccaaatccccttctacaacagttcaattcacagagttcctctatatcttcccaagtgaatcttgggcttggagttcaaggatcagttgggcaaagaaattgcaatgtttgtagttgtttgacatgcattgagaatttacccatctgtgcagatgctggccatataaaaagtgaagaacagcaacaaattttggctgaagatgttggtgtggaatcttccgcaacaacgggagcaaataaacaaacaagtgaagatgacacaaagattccatattcgaatccttcagcacctgcggcagaaagcactcagctgcctagggatactgatctatcacctgggcagcctttgcaacctggaatgtcatcatctggtgttggtgttatcggccgaagaagtgtatctgatcttggtgcaatcggagataaccttaccggaacttctgctagttcaggtcatgatcagctttataatatgcaaatgctcgaagctgcattccacaggcttccacaacccaaggactctgagcgtgctaaaacttacattccgcggcaccctgcagttacccctgctagctacccccaaattcaggcaccaatcgtatcacatcccaccttttgggaaagaattggtagcgacacattagctactgacatgctgttctttgcattctactaccaacagaacacataccaacaatacttggctgctagagaactgaagaagcaatcatggagatttcaccggaggtacaatacctggttccagcggcatgtggagccacaggtcacgactgatgagtatgagcggggatcatatgtatactttgatttccatgtcaccgaggatggctcaggatggtgccaaagaatcaagaatgacttcacatttgagtacaactaccttgaggatgagctatcagtacaaacaaactag

SEQ ID NO: 3854 - protein, 880 aa, Sorghum bicolor
  misc_feature: Ceres ANNOT ID no. 6033705
  misc_feature (2)..(239): Pfam Id: Not3 Pfam Desc: Not1 N-terminal domain, CCR4-Not complex component
  misc_feature (705)..(872): Pfam Id: NOT2_3_5 Pfam Desc: NOT2 / NOT3 / NOT5 family
  misc_feature (1)..(852): NCBI GI: 124365585 NCBI Desc: not ccr4-not complex component, n-terminal; trna-binding arm [medicago truncatula]
  misc_feature (1)..(588): NCBI GI: 18418549 NCBI Desc: transcription regulator not2/not3/not5 family protein [arabidopsis thaliana]
  misc_feature (1)..(599): NCBI GI: 22122717 NCBI Desc: ccr4-not transcription complex, subunit 3 [mus musculus]
  misc_feature (1)..(531): NCBI GI: 7657387 NCBI Desc: ccr4-not transcription complex, subunit 3 [homo sapiens]
  misc_feature (1)..(531): NCBI GI: 40788331 NCBI Desc: kiaa0691 protein [homo sapiens]
MGASRKLQGEIDRVLKKVQEGVDVFDSIWNKVYDTENANQKEKFEADLKKEIKKLQRYRDQIKTWIQSSEIKDKKALMDARKQIEREMERFKVCEKETKTKAFSKEGLGQQPKTDPKEKAKAETRDWLNNVVSDLESQIDNFEAEVEGLSIKKGKQRPPRLVHLEKSITRHKAHIKKLESILRLLDNDELSPEQVNDVKDFLDDYVERNQEDFDEFSDVEDLYSTLPMEKVEALEDMVSLAPSSLVKGAASVSTTAVLSTKSSVASSPTQPTISTTPSQSTSQDQTEETASQESNPESAPQTPPPKGGNPGPSVPAVPIAVSTGSAAVSVPPETISSPVRPTVPTTAAAILSSAIPRSVPENTPAITSIPANLSTTLKDDESMSFPPRRPSPAITEIGIGRGIARGITSSQGLGTAPITIGPVPGNGSVSALPAINDLSKRNILNTDEKINSGGLSQQLVTPLGSKVQPQQVPRTNDAISSDSANPNENPILGGRVFSPPVVSGVQWRPQAAATFQNQSETSQFRGRPEISADHREKYIQRLQQVQQQGGSLLNVSHITGINQKQFPTQQPNPLLQQFNSQSSSISSQVNLGLGVQGSVGQRNCNVCSCLTCIENLPICADAGHIKSEEQQQILAEDVGVESSATTGANKQTSEDDTKIPYSNPSAPAAESTQLPRDTDLSPGQPLQPGMSSSGVGVIGRRSVSDLGAIGDNLTGTSASSGHDQLYNMQMLEAAFHRLPQPKDSERAKTYIPRHPAVTPASYPQIQAPIVSHPTFWERIGSDTLATDMLFFAFYYQQNTYQQYLAARELKKQSWRFHRRYNTWFQRHVEPQVTTDEYERGSYVYFDFHVTEDGSGWCQRIKNDFTFEYNYLEDELSVQTN

SEQ ID NO: 3855 - DNA, 1836 bp, Sorghum bicolor
  misc_feature: Ceres ANNOT ID no. 6033706
  misc_feature: Encodes the peptide sequence at SEQ ID NO 3856
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
atggcattggaggcggggagcagtggcggcggcgggaggggatggggcggcgggttccggagcctgatgcggcggaagcaggtggactccgatcgggtccgcgccaagggccagccgcagctcgccaaggagctcaacgtgccggagctggtcgccatcgttggagctggagtatacgttctcgtgggaacagttgctagggagcacgctggtccggcattgacaatttcatttctgatagctggaatagctgccgcgctttcagctttctgttatgctgagcttgctagtcgttgcccctctgctggaagtgcctaccattattcatacatctgtgttggagaaggtgttgcctggttgattggctgggctcttgtgctggaatatactattggtggatctgctgttgcccgtggcatatctccaaatttagcattgttttttggaggacaagatagtctgccatggattttagcacgccatcagcttccatggtttggtatcattgttgacccctgcgcagctgctcttgtttttgttgtgactgttttactgtgcgtgggaattaaagagagttcatttgcacaaggagtggtaacagttctgaatgcttgtgtaatgatatttgttattgtggctggtagttatattggctttcaaataggatgggtcggctacaaggtttctgacgggtatttcccacatggagtaaatggaatgcttgctggatcagcaactgttttctttgcatacataggctttgatacagtcgctagtacagctgaagaggtaaagaatccacagagagatttgccattgggaattggagcagcgttggctatttgttgtgtgttgtatatggctgtttctgtcgttattgttgggctggtaccatatttcgccatggacccagatactcctatttcatctgccttcacagaacatggaatgcaatgggccatgtatgttgtgacaagtggtgctgttcttgcactctgctcgaccttgatgggttcacttcttccacagcctagaatacttatggccatggcacgagatggtctgttgccatccttcttctctgatgttaacaaacaaactcaagtacctgttaagagcacaattgtgactggcatttttgcagctgctctggcttttgcaatggatgtttcacagttagcaggaatggtcagtgtaggcacacttcttgcattcactatagttgctgtctcaatcttgatactcagatatgtccctccagatgaggtccctttgccaccctctatgcaagaatcattccatttgaaccaggaatgcgatgaggaaacggacaggggccttcttggcgttgggaactgtaacttgtctcagacaaagaatgtgattgtggtagtagaatcagtgaaggaccctctcattgataaaagactgcataaaggcaagatggatgagactaaacgccgaaagattgcctctttaagcatagcgtctgtgtgtgtaggggttctgatcctcacatcttcagcctctgccacatggttgcctttcttgctctcctggatcgaccaagatgctggcaggcactcctttggtcattccggaggattcacatgcccttttgttccagtgctaccagttttgtgtatcctgataaatacgtatctgttgataaacctgggtggtgacacatggatgagggttggcatatggctgctgatgggtgttcttgtgtacgttttctatggacgaacccacagctccctaacagatgtcgtctacgttccggtagcacaagctgatgagatatacaggagttcatcaggatatgtatcatag

SEQ ID NO: 3856 - protein, 611 aa, Sorghum bicolor
  misc_feature: Ceres ANNOT ID no. 6033706
  misc_feature (44)..(494): Pfam Id: AA_permease Pfam Desc: Amino acid permease
  misc_feature (16)..(611): NCBI GI: 77556625 NCBI Desc: amino acid permease [oryza sativa (japonica cultivar-group)]
  misc_feature (10)..(520): NCBI GI: 13605811 NCBI Desc: at5g36940/mlf18_60 [arabidopsis thaliana]
  misc_feature (16)..(535): NCBI GI: 77556626 NCBI Desc: amino acid permease [oryza sativa (japonica cultivar-group)]
  misc_feature (1)..(518): NCBI GI: 87162739 NCBI Desc: amino acid/polyamine transporter i [medicago truncatula]
  misc_feature (16)..(515): NCBI GI: 77556627 NCBI Desc: amino acid permease [oryza sativa (japonica cultivar-group)]
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: The sequence is a functional homolog of SEQ ID NO. 297 in the 11/188,298 US application
  misc_feature: The sequence is a functional homolog of SEQ ID NO. 510 in the 11/188,298 US application
  misc_feature: The sequence is a functional homolog of SEQ ID NO. 472 in the 11/188,298 US application
MALEAGSSGGGGRGWGGGFRSLMRRKQVDSDRVRAKGQPQLAKELNVPELVAIVGAGVYVLVGTVAREHAGPALTISFLIAGIAAALSAFCYAELASRCPSAGSAYHYSYICVGEGVAWLIGWALVLEYTIGGSAVARGISPNLALFFGGQDSLPWILARHQLPWFGIIVDPCAAALVFVVTVLLCVGIKESSFAQGVVTVLNACVMIFVIVAGSYIGFQIGWVGYKVSDGYFPHGVNGMLAGSATVFFAYIGFDTVASTAEEVKNPQRDLPLGIGAALAICCVLYMAVSVVIVGLVPYFAMDPDTPISSAFTEHGMQWAMYVVTSGAVLALCSTLMGSLLPQPRILMAMARDGLLPSFFSDVNKQTQVPVKSTIVTGIFAAALAFAMDVSQLAGMVSVGTLLAFTIVAVSILILRYVPPDEVPLPPSMQESFHLNQECDEETDRGLLGVGNCNLSQTKNVIVVVESVKDPLIDKRLHKGKMDETKRRKIASLSIASVCVGVLILTSSASATWLPFLLSWIDQDAGRHSFGHSGGFTCPFVPVLPVLCILINTYLLINLGGDTWMRVGIWLLMGVLVYVFYGRTHSSLTDVVYVPVAQADEIYRSSSGYVS

SEQ ID NO: 3857 - DNA, 1014 bp, Sorghum bicolor
  misc_feature: Ceres ANNOT ID no. 6033712
  misc_feature: Encodes the peptide sequence at SEQ ID NO 3858
atggctgccactgccaccgttgccgtccacctcccgctgcggggccccgcgcgggctccgtccgggccatccgtcgccgctgcaacccggttccgcggccggcaggagcggcgcggcctggcggctacaggcgggaggggactcgcccggtttcgggcggaggctttctccggtggtggaggcggagggcggagggaccccatggtaccgccttacaatgtcctcatcaccggctccaccaaaggtataggatacgcgttggcaaggaaatttctggaggctggtgataatgttataatctgctcgagatcagctcaaaaggtagaatctgtggtcggtgacttgaagaaggagtatggagtgcaacatgtgtggggaactgtctgtgatgttagagatggaaaggatgtaaaggcacttgtggagtttgcacgtgacaaacttaagcatattgatttatggatcaacaatgctggatcaaatgcatatacatacaaaccactagtggagacctctgacgaggctctcatggaaatcatcaccactaacacccttggattgatgatatgttgtcgtgaggcaataaatatgatgaggaaccaacctcgaggtggtcacatattcaaccttgatggtgctggttctgatggaaggccaactccaagatttgctgcatatggtgcaacaaagcgaagtgttgtgcatcttacgaagtcacttcagatgaatgaagtgaataatgtgatggtgcacaatctatcgcctggcatggtcacaacagatcttcttatgtctggtgcaactacaaaacaagcaaaatttttcatcaatatattagctgaacctcctgatgtggttgcagactaccttgttccaaacgtcagagcaatccctaccaatcaatccatgaagccaacctacattcgcttcctcacaggcttgaaagcctactcaagaattttttctagacttgcttttggtgctcgaagaaacaagtatgttactgaggattag

SEQ ID NO: 3858 - protein, 337 aa, Sorghum bicolor
  misc_feature: Ceres ANNOT ID no. 6033712
  misc_feature (72)..(245): Pfam Id: adh_short Pfam Desc: short chain dehydrogenase
  misc_feature (1)..(335): NCBI GI: 115454395 NCBI Desc: os03g0654600 [oryza sativa (japonica cultivar-group)]
  misc_feature (71)..(297): NCBI GI: 16323186 NCBI Desc: at4g13250/f17n18_140 [arabidopsis thaliana]
  misc_feature (66)..(332): NCBI GI: 68552796 NCBI Desc: short-chain dehydrogenase/reductase sdr [prosthecochloris aestuarii dsm 271]
  misc_feature (53)..(315): NCBI GI: 68548963 NCBI Desc: short-chain dehydrogenase/reductase sdr [pelodictyon phaeoclathratiforme bu-1]
  misc_feature (74)..(297): NCBI GI: 78188361 NCBI Desc: oxidoreductase, short-chain dehydrogenase/reductase family [chlorobium chlorochromatii cad3]
  misc_feature: The sequence is a functional homolog of SEQ ID NO. 389 in the 11/188,298 US application
  misc_feature: The sequence is a functional homolog of SEQ ID NO. 453 in the 11/188,298 US application
MAATATVAVHLPLRGPARAPSGPSVAAATRFRGRQERRGLAATGGRGLARFRAEAFSGGGGGGRRDPMVPPYNVLITGSTKGIGYALARKFLEAGDNVIICSRSAQKVESVVGDLKKEYGVQHVWGTVCDVRDGKDVKALVEFARDKLKHIDLWINNAGSNAYTYKPLVETSDEALMEIITTNTLGLMICCREAINMMRNQPRGGHIFNLDGAGSDGRPTPRFAAYGATKRSVVHLTKSLQMNEVNNVMVHNLSPGMVTTDLLMSGATTKQAKFFINILAEPPDVVADYLVPNVRAIPTNQSMKPTYIRFLTGLKAYSRIFSRLAFGARRNKYVTED

SEQ ID NO: 3859 - DNA, 744 bp, Sorghum bicolor
  misc_feature: Ceres ANNOT ID no. 6033727
  misc_feature: Encodes the peptide sequence at SEQ ID NO 3860
atggaatactcaggcggcggcgcgacgctgtcggagatgtaccagagcgcgcggcggctgctactctcggcgcgcgacggcgtggcccgcgtcgagcgcctcgcctcggcgcccacttcgtcctcctactcctcggcgccgctcgtcggtggcggcgctgcgggggaccccgcggtcgctgaggaggtgcggcgagaggtggcgcagatccaggggctgtgcgcgcagatggaccggctctggcgatccatccccgccaagggccagcgggacctctggaagagaaaagtggagcagctgtctgaagaggttgattcattgaaggaaacccttgacaagcattctttgcgtcagaaaaaacgaattctggaagcaaaagaaagggctgagctatttgagagagctgtaataattcctttgagcaataatatgaatggtgaatcttcacatgtcctccgaatatttgacgacgaagcccaagcgaagcaatcagctcgtaactcctcaagaatgcttgaagaagcttatgagacaggagtggctatccttcacaagtacgctgaccagagggatcgactgaagagtgctcaaaggaaagctttggatgtcctgaacactgttggtctatcgaactctgttttgaagctaatcgagaggcggcaccgtgtggacaagtggatcgcgtatgctggtatgatcatcaccgtagtggtgatgattgcgttttggcggttaacgcattag

SEQ ID NO: 3860 - protein, 247 aa, Sorghum bicolor
  misc_feature: Ceres ANNOT ID no. 6033727
  misc_feature (63)..(224): Pfam Id: V-SNARE Pfam Desc: Vesicle transport v-SNARE protein
  misc_feature (58)..(240): NCBI GI: 108879108 NCBI Desc: membrin [aedes aegypti]
  misc_feature (59)..(239): NCBI GI: 31202815 NCBI Desc: ensangp00000005595 [anopheles gambiae]
  misc_feature (68)..(239): NCBI GI: 41054421 NCBI Desc: membrin [danio rerio]
  misc_feature (59)..(240): NCBI GI: 50415204 NCBI Desc: mgc81773 protein [xenopus laevis]
  misc_feature (62)..(240): NCBI GI: 32450398 NCBI Desc: gosr2-prov protein [xenopus laevis]
  misc_feature: Useful for making plants with modulated nitrogen use efficiency
  misc_feature: GREAT-hit functional homolog of the protein sequence given in SEQ ID NO 13022
  misc_feature: Useful for making plants with modulated nitrogen use efficiency
  misc_feature: Functional homolog of the protein sequence given in SEQ ID NO 13022
  misc_feature: The sequence is a functional homolog of SEQ ID NO. 390 in the 11/188,298 US application
MEYSGGGATLSEMYQSARRLLLSARDGVARVERLASAPTSSSYSSAPLVGGGAAGDPAVAEEVRREVAQIQGLCAQMDRLWRSIPAKGQRDLWKRKVEQLSEEVDSLKETLDKHSLRQKKRILEAKERAELFERAVIIPLSNNMNGESSHVLRIFDDEAQAKQSARNSSRMLEEAYETGVAILHKYADQRDRLKSAQRKALDVLNTVGLSNSVLKLIERRHRVDKWIAYAGMIITVVVMIAFWRLTH

SEQ ID NO: 3861 - DNA, 498 bp, Sorghum bicolor
  misc_feature: Ceres ANNOT ID no. 6033728
  misc_feature: Encodes the peptide sequence at SEQ ID NO 3862
atgtcttcgtcgggcgctttgccgacgacgggaacccagcacaccggccgccaacctgaggttttgtgggctcagcgctccgagaagatttacttgactatctcactgccagatgcgaaagatgttgtgttgaagactgatgctaagggcctctttaccttgtctgctgttgcccatggggaaccgtttagcttcactttggagctttttggttcagtactgccagagggaagtaaaacgaagacaaatatgggcttgcgaaacataatctgttcaatccagaaagaaaagaaaggttggtggaagcgcttgctgaagtcagagaaaaaacatccatacatcaaagttgactggaacaaatggtgtgatgaggatgaagagtctgaggtctctggagattcagatgatggctttgatgaggcaaatgaaggagatgaaagtgatgatgacgatgggatgctttatctccctgaccttgaaaagctaaggggcaagtga

SEQ ID NO: 3862 - protein, 165 aa, Sorghum bicolor
  misc_feature: Ceres ANNOT ID no. 6033728
  misc_feature (19)..(95): Pfam Id: CS Pfam Desc: CS domain
  misc_feature (17)..(165): NCBI GI: 115454405 NCBI Desc: os03g0655300 [oryza sativa (japonica cultivar-group)]
  misc_feature (15)..(152): NCBI GI: 92878431 NCBI Desc: cs domain containing protein [medicago truncatula]
  misc_feature (17)..(148): NCBI GI: 11934654 NCBI Desc: p23 [brassica napus]
  misc_feature (17)..(135): NCBI GI: 23308253 NCBI Desc: at4g02450/t14p8_5 [arabidopsis thaliana]
  misc_feature (17)..(135): NCBI GI: 11229591 NCBI Desc: p23 co-chaperone [arabidopsis thaliana]
MSSSGALPTTGTQHTGRQPEVLWAQRSEKIYLTISLPDAKDVVLKTDAKGLFTLSAVAHGEPFSFTLELFGSVLPEGSKTKTNMGLRNIICSIQKEKKGWWKRLLKSEKKHPYIKVDWNKWCDEDEESEVSGDSDDGFDEANEGDESDDDDGMLYLPDLEKLRGK

SEQ ID NO: 3863 - DNA, 855 bp, Sorghum bicolor
  misc_feature: Ceres ANNOT ID no. 6033743
  misc_feature: Encodes the peptide sequence at SEQ ID NO 3864
atggaagcggcaccatccgtccgcaccttctcctcgtcctcgtcctcctccgcgggggctagaccctgccttctcctcgcgggcccggcgtcgcggcgcgcccgggcgctcgcggcgccgcccccgccccgcgccgtcgcctcctcccgcgcgccgctggtggtcaccagcccgccaccgccggaggcctcgggcacgcccgcccccgcgcacgccatggtcgaccgctccggccgcttctgcagcccccgcgctgcccgtgagctcgcgctgatgatttcctacgccgcgtgtctggagggaaccgacgtcgtgcggctcttcgaccgcaggatcagcgcaaggcgagagcccgggtttgttttcgataaggcatgcttattgagttacaaccatatgagctttggtggggttccgctcgaggttggaacggaggaggaggctgagaagctgaccagtcagaacgagaaggattcagccaacgaagaagatgtactttcagctcctccaaaactggtgtacaacaactttgtcttacggttgtccagggaacttttagtggctgttgctagtggatgggataagcatgtagatatcattgacaaaataattccccaggcttggaaggatgagcctgtggcaaggatacttgagctctgcattctacatattgctatggcagagatgacatcaaaaggaacacctcacaaagttgtcatcaatgaggcagtagatctggcaaagcgattttgtgatggtggtgcccctcgggtaattaatggatgccttcgaacatttgtaaaggatcatgttgacattgcaggcacgagccagggagctgaatcaaaatcgtga

SEQ ID NO: 3864 - protein, 284 aa, Sorghum bicolor
  misc_feature: Ceres ANNOT ID no. 6033743
  misc_feature (84)..(270): Pfam Id: NusB Pfam Desc: NusB family
  misc_feature (46)..(159): NCBI GI: 42573051 NCBI Desc: antitermination nusb domain-containing protein [arabidopsis thaliana]
  misc_feature (144)..(263): NCBI GI: 91225065 NCBI Desc: transcription antitermination protein nusb [vibrio alginolyticus 12g01]
  misc_feature (164)..(269): NCBI GI: 22095940 NCBI Desc: n utilization substance protein b homolog (nusb protein)
  misc_feature (164)..(269): NCBI GI: 20807741 NCBI Desc: transcription termination factor [thermoanaerobacter tengcongensis]
  misc_feature (182)..(263): NCBI GI: 118744906 NCBI Desc: nusb antitermination factor [geobacter lovleyi sz]
MEAAPSVRTFSSSSSSSAGARPCLLLAGPASRRARALAAPPPPRAVASSRAPLVVTSPPPPEASGTPAPAHAMVDRSGRFCSPRAARELALMISYAACLEGTDVVRLFDRRISARREPGFVFDKACLLSYNHMSFGGVPLEVGTEEEAEKLTSQNEKDSANEEDVLSAPPKLVYNNFVLRLSRELLVAVASGWDKHVDIIDKIIPQAWKDEPVARILELCILHIAMAEMTSKGTPHKVVINEAVDLAKRFCDGGAPRVINGCLRTFVKDHVDIAGTSQGAESKS

SEQ ID NO: 3865 - DNA, 534 bp, Sorghum bicolor
  misc_feature: Ceres ANNOT ID no. 6033745
  misc_feature: Encodes the peptide sequence at SEQ ID NO 3866
atgtatgcatctctctctctctctctctctctctctctctctctctctctctctctctctctctctctctacgctgtgtttgatgcgtttgccttaaaccagctttggttctcatgcatgcatgtatggttcatcataggcagcggaggaggaggagagagaaaccaaagggaggaggacgaggcggcggcggcggcggcggcagaggccggctacggcaggcagctggtgatgcccgaggacgggtacgagtggaagaagtacggccagaagttcatcaagaacatccagaaaatcaggagctacttccggtgtcggcacaagctgtgcggcgccaagaagaaggtggagtggcacccgcgggaccccagcggcgacctccgcatcgtctacgagggcgcgcaccagcacggcgccccggcggcggcggctcctcccggtcccggcggccagcatcacggcggcggcgcctccgacttcaacagatacgagctgggcgcgcagtacttcggcggggccggccggtcgcattga

SEQ ID NO: 3866 - protein, 177 aa, Sorghum bicolor
  misc_feature: Ceres ANNOT ID no. 6033745
  misc_feature (79)..(139): Pfam Id: WRKY Pfam Desc: WRKY DNA -binding domain
MYASLSLSLSLSLSLSLSLSLSLYAVFDAFALNQLWFSCMHVWFIIGSGGGGERNQREEDEAAAAAAAEAGYGRQLVMPEDGYEWKKYGQKFIKNIQKIRSYFRCRHKLCGAKKKVEWHPRDPSGDLRIVYEGAHQHGAPAAAAPPGPGGQHHGGGASDFNRYELGAQYFGGAGRSH

SEQ ID NO: 3867 - DNA, 450 bp, Sorghum bicolor
  misc_feature: Ceres ANNOT ID no. 6033760
  misc_feature: Encodes the peptide sequence at SEQ ID NO 3868
atggccgctgcttcagcttcgctgctccacctcgccaccccgacaaactccactcacctcgtagtccggctccccgcctcccagctgccccgccgccggccgccgggggcacgcatcgccaccgcgcagccgccgcgggcgtacaaggtgacgatcgagcacgacggcgcgtcgcgggtggtggaggtggaggaggacgagacgatcctgtcccgcgcgctggacgagggcctggaggtgccgcacgactgcaagctcggcgtgtgcatgacgtgcccggcgcggctggtctccggggtggtggaccagagcgacggcatgctcagcgacgacgtcgtcgcgcaggggtacgcgctgctgtgcgcagcgtacccgcgctccgactgcaccatccgcgtcatccccgaggacgagctgctcaaggtccagctcgccaccgccgacgactga

SEQ ID NO: 3868 - protein, 149 aa, Sorghum bicolor
  misc_feature: Ceres ANNOT ID no. 6033760
  misc_feature (52)..(127): Pfam Id: Fer2 Pfam Desc: 2Fe-2S iron-sulfur cluster binding domain
  misc_feature (19)..(149): NCBI GI: 92874759 NCBI Desc: 2fe-2s ferredoxin, iron-sulfur binding site [medicago truncatula]
  misc_feature (46)..(149): NCBI GI: 21592364 NCBI Desc: ferredoxin [arabidopsis thaliana]
  misc_feature (46)..(149): NCBI GI: 20856284 NCBI Desc: at4g14890/dl3485w [arabidopsis thaliana]
  misc_feature (87)..(149): NCBI GI: 140056999 NCBI Desc: ferredoxin [medicago truncatula]
  misc_feature (46)..(143): NCBI GI: 17228279 NCBI Desc: ferredoxin [nostoc sp. pcc 7120]
MAAASASLLHLATPTNSTHLVVRLPASQLPRRRPPGARIATAQPPRAYKVTIEHDGASRVVEVEEDETILSRALDEGLEVPHDCKLGVCMTCPARLVSGVVDQSDGMLSDDVVAQGYALLCAAYPRSDCTIRVIPEDELLKVQLATADD

SEQ ID NO: 3869 - DNA, 309 bp, Sorghum bicolor
  misc_feature: Ceres ANNOT ID no. 6033768
  misc_feature: Encodes the peptide sequence at SEQ ID NO 3870
atggcgtggaagaggaagaacggcagcgggtcgaccgggcgtggggccgacgaggaggagaaggtcccgagagggcacgtgcccatggtcgccggcggtggtggtgtcgacgacggagaggaaggcgagcgcgtgctggtgccggtgaggctgctcagcgacccttccgtcgcggagctgctggacatggcggcgcagcggtacgggtacggccagccgggggtgctgcgggtgccctgcgacgccggccacttccgccaggtcctcgacggcgccatgcacagatgcgggatcacctcagctgcctga

SEQ ID NO: 3870 - protein, 102 aa, Sorghum bicolor
  misc_feature: Ceres ANNOT ID no. 6033768
  misc_feature (1)..(93): Pfam Id: Auxin_inducible Pfam Desc: Auxin responsive protein
  misc_feature (1)..(89): NCBI GI: 90399386 NCBI Desc: h0818e11.6 [oryza sativa (indica cultivar-group)]
  misc_feature (21)..(93): NCBI GI: 38345606 NCBI Desc: osjnba0093o08.8 [oryza sativa (japonica cultivar-group)]
  misc_feature (21)..(93): NCBI GI: 90399384 NCBI Desc: h0818e11.4 [oryza sativa (indica cultivar-group)]
  misc_feature (21)..(89): NCBI GI: 49387755 NCBI Desc: auxin responsive protein-like [oryza sativa (japonica cultivar-group)]
  misc_feature (8)..(89): NCBI GI: 52077231 NCBI Desc: auxin responsive protein-like [oryza sativa (japonica cultivar-group)]
  misc_feature: The sequence is a functional homolog of SEQ ID NO. 402 in the 11/188,298 US application
  misc_feature: The sequence is a functional homolog of SEQ ID NO. 505 in the 11/188,298 US application
MAWKRKNGSGSTGRGADEEEKVPRGHVPMVAGGGGVDDGEEGERVLVPVRLLSDPSVAELLDMAAQRYGYGQPGVLRVPCDAGHFRQVLDGAMHRCGITSAA

SEQ ID NO: 3871 - DNA, 345 bp, Sorghum bicolor
  misc_feature: Ceres ANNOT ID no. 6033775
  misc_feature: Encodes the peptide sequence at SEQ ID NO 3872
atggcgaagatgctgtgtaaacgaaagcagcaggcggcggcaacgacgagcaagcagcagggctcgacagcgtcgtcgccggtccgcgcccgcgccggcgccggcgacggggcagcgatgccgagagggtacgtgcccatgcggctcgttggcgacggcggcgaggacgaggagcatgatgagactgttctggtgccggtggcgctgctcaaggagccgcgcatggtggagctgctggagatggcggagcggcagtacgggtacggccagcccggcgtgctgcggatcccctgcgacgcccggcgcttcgagcagctcatgggtctggcgtgcatggccaggtag

SEQ ID NO: 3872 - protein, 114 aa, Sorghum bicolor
  misc_feature: Ceres ANNOT ID no. 6033775
  misc_feature (4)..(113): Pfam Id: Auxin_inducible Pfam Desc: Auxin responsive protein
  misc_feature (33)..(107): NCBI GI: 90399386 NCBI Desc: h0818e11.6 [oryza sativa (indica cultivar-group)]
  misc_feature (13)..(107): NCBI GI: 52077231 NCBI Desc: auxin responsive protein-like [oryza sativa (japonica cultivar-group)]
  misc_feature (4)..(108): NCBI GI: 38345606 NCBI Desc: osjnba0093o08.8 [oryza sativa (japonica cultivar-group)]
  misc_feature (4)..(108): NCBI GI: 90399384 NCBI Desc: h0818e11.4 [oryza sativa (indica cultivar-group)]
  misc_feature (2)..(107): NCBI GI: 49387755 NCBI Desc: auxin responsive protein-like [oryza sativa (japonica cultivar-group)]
  misc_feature: The sequence is a functional homolog of SEQ ID NO. 402 in the 11/188,298 US application
  misc_feature: The sequence is a functional homolog of SEQ ID NO. 505 in the 11/188,298 US application
  misc_feature: The sequence is a functional homolog of SEQ ID NO. 443 in the 11/188,298 US application
MAKMLCKRKQQAAATTSKQQGSTASSPVRARAGAGDGAAMPRGYVPMRLVGDGGEDEEHDETVLVPVALLKEPRMVELLEMAERQYGYGQPGVLRIPCDARRFEQLMGLACMAR

SEQ ID NO: 3873 - DNA, 2187 bp, Sorghum bicolor
  misc_feature: Ceres ANNOT ID no. 6033793
  misc_feature: Encodes the peptide sequence at SEQ ID NO 3874
atgttagagtgcatccggcgaggcctcttgctcgtccggcagcccacctcccgagtcctcgccagaccgtatctccaccctgcccgcctcttcctccagcacttcgccgccgacgcgatgggtgagggttcctctgctggtaaggacgcgaagggaaaggggaaggggaaggccaaggcccccgccgcggattcgctcctggtcgctcgcgacgactcctacctagaggcggtcacacagaagaggattcgcttgttcgaggagatccaggctaggcaggccgtcgagcggctgaatatcggcggcgaagttatcaaggtaactctgcctgatggagctatcaaggaagggaagaaatggataacaacaccaatggatattgctaaggagatatcaagtggattcgcatctagttgtttgatagctcaagtggacgaaacactctgggatatggggaggccactcgaaagtgattgtaaattgcaaatgttcaagtttgataccaatgaaggccgtgacaccttctggcactcaagtgctcatattcttggagaatctattgagagagcatatggctgcaagctgtgtattgggccttgcaccacaagaggggagggtttctactatgatgcttactacaaagatcaaacattgaacgaggagcactttggtatcattgaaagccaagctaaaaaggctgttgcggaaaagcaaccatttgaacgcatcgaggtcagcagggcagaagctcttgaaatgtttgctgaaaatgaattcaaggttgaaatcattaatgagttgcccgaggacaagaccattacagtatacaggtgcggtcctttagttgacctatgccgtgggccacacatcccaaatacttccttcgtcaaagcttttgcttgtctgaaggcttcatcatcatattggagaggaaaagtggaccgcgaaagcctgcagagagtatatggaatttctttccctgattctcgacgactcacggaatataaacattttctagaggaagctaagaaacgtgatcataggatactagggaaagcacaggaactcttctttttccatgaacttagtcctggaagctgcttcttccttccacatggtgctaggatatataacaaactgatggacttcatgcggcaacagtacagagctagaggataccaagaggtgttgagcccaaatatgtacaatatgcaactctgggaaacttctggacacgctgcaaactacaaggagaacatgtttgtttttgagattgagaagcaggaatttggacttaagccaatgaattgtccaggccactgtctaatgtttgctaatagggttcggtcatacagagagttgcctctacgcatggctgattttggagtgcttcatagaaatgagcttagtggcgctcttacaggtttgacacgtgttagaagattccagcagatcaaggatgaagttaaggctgttttggacttcatcaattatgtttacgagatatttggcttcaaatatgagttggagttgtctacgagaccagagaagtatttaggtgaaattgaaacttggaacaaagcagagcaacaattgacagaagctttgaatgagtttgggaagccgtggaagattaatgaaggcgatggtgctttctacggcccaaaaattgatattggtgtgtttgatgcccttaagaggaaatttcagtgtgcaaccttacagctggattttcaactgcccattcggttcaagctggcttattctgctgaggatgaagccaaaattgaaaggcctgtgatgatacacagggcaatcctaggttctgttgaaaggatgtttgccattcttttggagcattacaatggtaaatggcccttatggctaagccctcgccaggccattgtttgctcggtttcttctggttcagtggagtatgcgaaacaggttcttgccactctacatgaagctggttttcatgctgatattgacgcgagtgacaggacaatacaaaagaaggtacgggaagcccaactagcccaattcaactacattcttgtcgtaggtgcacaagaggccgagactggaaatatctgcgttagggtaagagacaatgctgacctggccacaatgagcgtagatggcttcgtcacacgtttgaaggaggaaatcgcagccttcagatga

SEQ ID NO: 3874 - protein, 728 aa, Sorghum bicolor
  misc_feature: Ceres ANNOT ID no. 6033793
  misc_feature (376)..(529): Pfam Id: tRNA-synt_2b Pfam Desc: tRNA synthetase class II core domain (G, H, P, S and T)
  misc_feature (633)..(723): Pfam Id: HGTP_anticodon Pfam Desc: Anticodon binding domain
  misc_feature (273)..(322): Pfam Id: tRNA_SAD Pfam Desc: Threonyl and Alanyl tRNA synthetase second additional domain
  misc_feature (105)..(165): Pfam Id: TGS Pfam Desc: TGS domain
  misc_feature (70)..(727): NCBI GI: 3617770 NCBI Desc: threonyl-trna synthetase [arabidopsis thaliana]
  misc_feature (70)..(727): NCBI GI: 30690426 NCBI Desc: threonyl-trna synthetase / threonine--trna ligase (thrrs) [arabidopsis thaliana]
  misc_feature (70)..(727): NCBI GI: 29028762 NCBI Desc: at5g26830/f2p16_90 [arabidopsis thaliana]
  misc_feature (215)..(728): NCBI GI: 20429011 NCBI Desc: threonyl-trna synthetase [oryza sativa (japonica cultivar-group)]
  misc_feature (204)..(713): NCBI GI: 2191162 NCBI Desc: similar to threonyl-trna synthetase; coded for by a. thaliana cdna r65376 [arabidopsis thaliana]
  misc_feature (70)..(727): SWISSPROT Homolog: EC 6.1.1.3 Threonyl-tRNA synthetase, mitochondrial precursor
MLECIRRGLLLVRQPTSRVLARPYLHPARLFLQHFAADAMGEGSSAGKDAKGKGKGKAKAPAADSLLVARDDSYLEAVTQKRIRLFEEIQARQAVERLNIGGEVIKVTLPDGAIKEGKKWITTPMDIAKEISSGFASSCLIAQVDETLWDMGRPLESDCKLQMFKFDTNEGRDTFWHSSAHILGESIERAYGCKLCIGPCTTRGEGFYYDAYYKDQTLNEEHFGIIESQAKKAVAEKQPFERIEVSRAEALEMFAENEFKVEIINELPEDKTITVYRCGPLVDLCRGPHIPNTSFVKAFACLKASSSYWRGKVDRESLQRVYGISFPDSRRLTEYKHFLEEAKKRDHRILGKAQELFFFHELSPGSCFFLPHGARIYNKLMDFMRQQYRARGYQEVLSPNMYNMQLWETSGHAANYKENMFVFEIEKQEFGLKPMNCPGHCLMFANRVRSYRELPLRMADFGVLHRNELSGALTGLTRVRRFQQIKDEVKAVLDFINYVYEIFGFKYELELSTRPEKYLGEIETWNKAEQQLTEALNEFGKPWKINEGDGAFYGPKIDIGVFDALKRKFQCATLQLDFQLPIRFKLAYSAEDEAKIERPVMIHRAILGSVERMFAILLEHYNGKWPLWLSPRQAIVCSVSSGSVEYAKQVLATLHEAGFHADIDASDRTIQKKVREAQLAQFNYILVVGAQEAETGNICVRVRDNADLATMSVDGFVTRLKEEIAAFR

SEQ ID NO: 3875 - DNA, 651 bp, Sorghum bicolor
  misc_feature: Ceres ANNOT ID no. 6033799
  misc_feature: Encodes the peptide sequence at SEQ ID NO 3876
atggctcaccaccggcagcgcggcttcatcccgtcgttgttctccgggccgtgcctggccctcgccgtgatgaccctgctgtgcgccgccgcttccacgacggcgcagcagcaaccaccgccactgccactgccaacactgccacagccgacgacgacgacgacgacgcccgctataccgagcgtgcccgcgtgcgcgccggcgcaggccacgctgtcgccgtgcttcagctacctcatgggcaactcgtcgtcgccgcccacggagtgctgcgcccagatacgggccatgttccagtcgcaggcgccgtgcctgtgcgccgccatggcgtcggggcccgtccagcagctcgggtccgcgctcggccagatgctgccagcctcgtgcgacctgcccgcggacgcgtgctcggggggaacgagcgctaccccgacgactgatccggtgacgccggtgtcaggcacaacccctgcggcggcggcaccggcggcgactgagcccaacggtctggacgacccgacggcgccagccggtggctcaggaatcaagtcacttccaggcttgcctcactcggctgcagcagcaggctccagcggtgtatctgctgctgctctctttatgtccttgttagtcgtttatcttcttcgttga

SEQ ID NO: 3876 - protein, 216 aa, Sorghum bicolor
  misc_feature: Ceres ANNOT ID no. 6033799
  misc_feature (65)..(136): Pfam Id: Tryp_alpha_amyl Pfam Desc: Protease inhibitor/seed storage/LTP family
  misc_feature (65)..(212): NCBI GI: 92883937 NCBI Desc: plant lipid transfer protein/par allergen [medicago truncatula]
  misc_feature (63)..(203): NCBI GI: 71608996 NCBI Desc: lipid transfer protein precursor [physcomitrella patens]
  misc_feature (64)..(212): NCBI GI: 50509338 NCBI Desc: protease inhibitor-like protein [oryza sativa (japonica cultivar-group)]
  misc_feature (61)..(198): NCBI GI: 25553602 NCBI Desc: protease inhibitor-like protein [oryza sativa (japonica cultivar-group)]
  misc_feature (65)..(212): NCBI GI: 42571317 NCBI Desc: protease inhibitor/seed storage/lipid transfer protein (ltp) family protein [arabidopsis thaliana]
MAHHRQRGFIPSLFSGPCLALAVMTLLCAAASTTAQQQPPPLPLPTLPQPTTTTTTPAIPSVPACAPAQATLSPCFSYLMGNSSSPPTECCAQIRAMFQSQAPCLCAAMASGPVQQLGSALGQMLPASCDLPADACSGGTSATPTTDPVTPVSGTTPAAAAPAATEPNGLDDPTAPAGGSGIKSLPGLPHSAAAAGSSGVSAAALFMSLLVVYLLR

SEQ ID NO: 3877 - DNA, 348 bp, Sorghum bicolor
  misc_feature: Ceres ANNOT ID no. 6033810
  misc_feature: Encodes the peptide sequence at SEQ ID NO 3878
atggagatagagtcggtcaagtgcgagtgctgtggcctgagggaggactgcaccctggactacattgccagcgtgagagcaggcttccatggccaatggctgtgtgggctgtgctgtgaggccgtcagagatgaggcatgcaggaagaaggttcacccaggagtagaggaggctgtgagggctcacatggcattctgcaagatgttcaagtcgaaccctgctgtccgcgtggctgatggcatgcgccagatgctccgtaggcggtctggtgatatgtcaaagccggaatcagccaagaagtacagcacctcgcaggttggagacgaatcatcagtgacactgtattga

SEQ ID NO: 3878 - protein, 115 aa, Sorghum bicolor
  misc_feature: Ceres ANNOT ID no. 6033810
  misc_feature (1)..(100): NCBI GI: 7715593 NCBI Desc: f20b17.20 [arabidopsis thaliana]
  misc_feature (1)..(105): NCBI GI: 144923428 NCBI Desc: 4fe-4s ferredoxin, iron-sulfur binding [medicago truncatula]
  misc_feature (2)..(77): NCBI GI: 4587551 NCBI Desc: f15i1.18 [arabidopsis thaliana]
MEIESVKCECCGLREDCTLDYIASVRAGFHGQWLCGLCCEAVRDEACRKKVHPGVEEAVRAHMAFCKMFKSNPAVRVADGMRQMLRRRSGDMSKPESAKKYSTSQVGDESSVTLY

SEQ ID NO: 3879 - DNA, 1149 bp, Sorghum bicolor
  misc_feature: Ceres ANNOT ID no. 6033816
  misc_feature: Encodes the peptide sequence at SEQ ID NO 3880
atggtgcagcggacttccaccgcccaagtgatgtccatggacctcagcccaaagaaacccaacaaggcctacggcagcgatggcggcgcctactacgactggtcccccgccgacctgcccatgctcggcgctgcctccattggcgccgccaagctctgcctctccgccggaggccttgctctgcctagctactctgactctgccaaggtcgcctacgtcctccaaggcaagtgcaaatatatattctgtaagggtacgtgcggcgtggttctgccggaggcgaccaaggagaaggtgatccccgtgaaggagggtgactcgctcgcgctccctttcggcgtcgtcacctggtggcacaacgcgcacgccgcctgcagcagctccgactccgacgacctcgtggtcctcttcctcggcgacacgtccacgggccacaagcggggccagttcaccaacttccagctcaccggctccacgggcatcttcacgggcctgtccaccgagttcgtcgcccgcgcatgggacctcaccccggacgccgccgccgagctcgtctcctcccagcccggcgccggcatcatcagggtcaaggacgggcaccggatgccccaggcccgcgacgaggacagggagggcatggtcctcaactgcctggaggcgccgctcgacgtcgacatcaagaacgggggccgcgtcgtcgtcctcaacacccggaacctgccgctcgtggaggaggtcggtctcggcgccgacctcgtcaggatcgacgcgcactccatgtgctcgccggggttctcctgcgactccgcctaccaggtcacctacatcgtgcgcggcagtggccgcgtccaggtcgttgggatcgacggcacgcgggtgctggagacccgcgccgagggaggctgcctcttcatcgtgcccaggttcttcgttgtctccaagatcgccgacgaaactggcatggagtggttctccatcatcaccacccccaacccaatctttagccacttggcgggcaggacatcggtgtggaaggcaatatctcctgcggtcctggaggcgtcgttcaacaccacgccggagaaggagaagctgttccgttccaagaggcttgactcggagatcttcttcgcgcctgcttcaaactaa

SEQ ID NO: 3880 - protein, 382 aa, Sorghum bicolor
  misc_feature: Ceres ANNOT ID no. 6033816
  misc_feature (15)..(182): Pfam Id: Cupin_1 Pfam Desc: Cupin
  misc_feature (215)..(364): Pfam Id: Cupin_1 Pfam Desc: Cupin
  misc_feature (1)..(381): NCBI GI: 37730876 NCBI Desc: legumin-like protein [zea mays]
  misc_feature (13)..(382): NCBI GI: 28950668 NCBI Desc: legumin-like protein [zea mays]
  misc_feature (12)..(382): NCBI GI: 28950670 NCBI Desc: legumin-like protein [zea mays]
  misc_feature (11)..(381): NCBI GI: 21593610 NCBI Desc: globulin-like protein [arabidopsis thaliana]
  misc_feature (11)..(381): NCBI GI: 4580389 NCBI Desc: legumin-like protein [arabidopsis thaliana]
MVQRTSTAQVMSMDLSPKKPNKAYGSDGGAYYDWSPADLPMLGAASIGAAKLCLSAGGLALPSYSDSAKVAYVLQGKCKYIFCKGTCGVVLPEATKEKVIPVKEGDSLALPFGVVTWWHNAHAACSSSDSDDLVVLFLGDTSTGHKRGQFTNFQLTGSTGIFTGLSTEFVARAWDLTPDAAAELVSSQPGAGIIRVKDGHRMPQARDEDREGMVLNCLEAPLDVDIKNGGRVVVLNTRNLPLVEEVGLGADLVRIDAHSMCSPGFSCDSAYQVTYIVRGSGRVQVVGIDGTRVLETRAEGGCLFIVPRFFVVSKIADETGMEWFSIITTPNPIFSHLAGRTSVWKAISPAVLEASFNTTPEKEKLFRSKRLDSEIFFAPASN

SEQ ID NO: 3881 - DNA, 612 bp, Sorghum bicolor
  misc_feature: Ceres ANNOT ID no. 6033823
  misc_feature: Encodes the peptide sequence at SEQ ID NO 3882
atggcggccaacgccgggaacaagatccgcaacgccaagctggttcttcttggagatgtgggtgctggcaaatctagcttggttcttcggtttgttaagggacagtttgttgaattccaggaatcaacaattggagcagctttcttttctcagaccttagcggtcaatgatgagactgttaagtttgaaatctgggatactgctgggcaggagaggtatcatagcttggcccccatgtactataggggtgccgctgccgccattgttgtctatgacatcacaaatccggcctcctttacccgtgccaaaaaatgggttcaagaacttcaagctcaaggaaatccgaatacaatagtggctcttgctggaaacaaggctgatatgctagatgcgaggcaggtgccagcagaggaagcaaagacgtatgcccaggagaatgggctcttcttcatggagacatctgctaaaagtgcaatcaatgtgaatgacatattttatgagattgcaaagagattgcttcaaggacaacaggctccaagcccacaggctggaatggttctgaatcagagaccaaacgagaggatggtcagctcttcttcatgctgctcttga

SEQ ID NO: 3882 - protein, 203 aa, Sorghum bicolor
  misc_feature: Ceres ANNOT ID no. 6033823
  misc_feature (13)..(174): Pfam Id: Ras Pfam Desc: Ras family
  misc_feature (13)..(127): Pfam Id: Miro Pfam Desc: Miro-like protein
  misc_feature (1)..(172): Pfam Id: Arf Pfam Desc: ADP-ribosylation factor family
  misc_feature (1)..(203): NCBI GI: 12057010 NCBI Desc: rab5a protein [oryza sativa]
  misc_feature (1)..(203): NCBI GI: 13774086 NCBI Desc: small gtp-binding protein [oryza sativa]
  misc_feature (1)..(203): NCBI GI: 4741844 NCBI Desc: small gtp-binding protein [triticum aestivum]
  misc_feature (3)..(203): NCBI GI: 296878 NCBI Desc: ras-related gtp-binding protein [nicotiana tabacum]
  misc_feature (3)..(203): NCBI GI: 20453279 NCBI Desc: at5g45130/k17o22_15 [arabidopsis thaliana]
  misc_feature: The sequence is a functional homolog of SEQ ID NO. 400 in the 11/188,298 US application
MAANAGNKIRNAKLVLLGDVGAGKSSLVLRFVKGQFVEFQESTIGAAFFSQTLAVNDETVKFEIWDTAGQERYHSLAPMYYRGAAAAIVVYDITNPASFTRAKKWVQELQAQGNPNTIVALAGNKADMLDARQVPAEEAKTYAQENGLFFMETSAKSAINVNDIFYEIAKRLLQGQQAPSPQAGMVLNQRPNERMVSSSSCCS

SEQ ID NO: 3883 - DNA, 1407 bp, Sorghum bicolor
  misc_feature: Ceres ANNOT ID no. 6033833
  misc_feature: Encodes the peptide sequence at SEQ ID NO 3884
atggatcgccgggaccagcagggcgaggctgcggcagaggataagacgtgcccgctggcgctgctccccgacgacgtgctagcggacgtgctccgccgcctcccgccgcgtggactcgccgtgtccaggtgcgtctgcaaggcgtggctcgccgtcgtcgacgccctccgcctgctgcgggcggatctcctcccgttgtcgctgggtgggttcttcttgaacttcaacacctacagcatctcggagttcttctcgcccctctcggacggcccctgcatctccggcaagcacgactacctgcctcagaaatcaaccgattcctggggctacgtagacgaccactgcaatggtcttgtgctgatccacgactccgacgacaacggcgacaggattagctacctacttaatccggccactcgatggctggctctcgtgcactcgtgcccaccctcacccatggagatcaagaacaccttccaagtccagtacatcgtgtacgatccagccgagtcgccatactatgatgtggtttcagttacccgttttcagtggtacgagagttccagggatgcactagaccctgagatagaacaatctgagtggccaccattggtatacaccttacatgtgttctcatcgagaactggacagtgggaggaaaagtcttttgttcgagaaggtgattccatgggaactgtgtctgacatgagatactacccaggtaaccaacgcaatgctgtgttctggcgaggagttctgtatgtgcattgtcaaactgattatgttatgagaatatctttgtcgagtgataagtatcacgtgattaaaccaccactgggtattgaagtagaacactatccacagttttatctggggaagtcatctaatggggtttattgtgcatcaatcaagagaggctgtcagatggagtgggtgctgaagcatgacagggacctttctaagtggttgttgaagcataagcttgagtcttcaagaccacatgggaattatggtcgaaaaatccaaggaccttgggccttccaggatactaattactattatgacgatcacaatagagatcacgatatggaagcaccagtggaagagaaaattgaatggacctcacaagcatctgaagatgacgaatttacatggagctctgatgatgaatgtggacacactggatacatggagattcttgggtttcatccatgcaaagagattatcttcttgagtgaatcaataacgcgaggattggcctatcacttgaatagctccaaggttgaagtcttgggcaatatttatccagcaggatatgagaatgaattaccaaatgaacagcttttagaatcatctttttcgaacacaccctgctggattacacaagctgcagacgagaatagttga

SEQ ID NO: 3884 - protein, 468 aa, Sorghum bicolor
  misc_feature: Ceres ANNOT ID no. 6033833
  misc_feature (17)..(64): Pfam Id: F-box Pfam Desc: F-box domain
  misc_feature (19)..(429): NCBI GI: 53370641 NCBI Desc: f-box domain containing protein [oryza sativa (japonica cultivar-group)]
  misc_feature (21)..(467): NCBI GI: 115456876 NCBI Desc: os04g0113000 [oryza sativa (japonica cultivar-group)]
  misc_feature (21)..(467): NCBI GI: 116308824 NCBI Desc: osigba0112g01.1 [oryza sativa (indica cultivar-group)]
  misc_feature (21)..(349): NCBI GI: 57900269 NCBI Desc: f-box domain containing protein-like [oryza sativa (japonica cultivar-group)]
  misc_feature (21)..(349): NCBI GI: 115440773 NCBI Desc: os01g0824700 [oryza sativa (japonica cultivar-group)]
MDRRDQQGEAAAEDKTCPLALLPDDVLADVLRRLPPRGLAVSRCVCKAWLAVVDALRLLRADLLPLSLGGFFLNFNTYSISEFFSPLSDGPCISGKHDYLPQKSTDSWGYVDDHCNGLVLIHDSDDNGDRISYLLNPATRWLALVHSCPPSPMEIKNTFQVQYIVYDPAESPYYDVVSVTRFQWYESSRDALDPEIEQSEWPPLVYTLHVFSSRTGQWEEKSFVREGDSMGTVSDMRYYPGNQRNAVFWRGVLYVHCQTDYVMRISLSSDKYHVIKPPLGIEVEHYPQFYLGKSSNGVYCASIKRGCQMEWVLKHDRDLSKWLLKHKLESSRPHGNYGRKIQGPWAFQDTNYYYDDHNRDHDMEAPVEEKIEWTSQASEDDEFTWSSDDECGHTGYMEILGFHPCKEIIFLSESITRGLAYHLNSSKVEVLGNIYPAGYENELPNEQLLESSFSNTPCWITQAADENS

SEQ ID NO: 3885 - DNA, 678 bp, Sorghum bicolor
  misc_feature: Ceres ANNOT ID no. 6033838
  misc_feature: Encodes the peptide sequence at SEQ ID NO 3886
atggcgggaaagtttggcgccatctgctcccgcgccgccgcctgcctatttatcccccgcccccgcaatctcctcctccactcaaccccaactcctgccagatttctccccttcccccgccggctgcacccaagaagcctctcgaccttagccatggccgctaccaacggcgccgccaccgactccgtccaggagcatcccgccgccgccaccgagtccgtccaggagcctccccagaagatctccaagatctcccccctgctcaaggtgaagaagctctccgacaaggccgtgctgccgtctcgcggctccgccctcgccgccggctacgacctctcgagtgccgtggagatcgtggtgcccgcgcgtggcaaggcgctcgtgccgaccgacctcagcgtcgccatcccccacggaacctacgcgcgcatcgcgccgaggtcgggcctagcgctgaagcactccatcgacgtgggcgccggcgtgatcgacgctgactaccgcggccccgtgggcgtcatcctcttcaaccactcggacgccgacttcgccgtgaagcccggcgacaggatcgcgcagatgatcatcgaggtgatcgcgacgcctgaggtcgcggaggtggaggacctcgacgccaccgtccgtggcgagggagggttcggatccaccggcgtctga

SEQ ID NO: 3886 - protein, 225 aa, Sorghum bicolor
  misc_feature: Ceres ANNOT ID no. 6033838
  misc_feature (95)..(224): Pfam Id: dUTPase Pfam Desc: dUTPase
  misc_feature (54)..(214): NCBI GI: 115454523 NCBI Desc: os03g0669100 [oryza sativa (japonica cultivar-group)]
  misc_feature (74)..(225): NCBI GI: 416922 NCBI Desc: deoxyuridine 5'-triphosphate nucleotidohydrolase (dutpase) (dutp pyrophosphatase) (p18)
  misc_feature (71)..(225): NCBI GI: 38566986 NCBI Desc: probable dutp pyrophosphatase [neurospora crassa]
  misc_feature (77)..(224): NCBI GI: 116180580 NCBI Desc: dutp pyrophosphatase [chaetomium globosum cbs 148.51]
  misc_feature (71)..(224): NCBI GI: 145611280 NCBI Desc: deoxyuridine 5'-triphosphate nucleotidohydrolase [magnaporthe grisea 70-15]
  misc_feature (74)..(225): SWISSPROT Homolog: EC 3.6.1.23 Deoxyuridine 5'-triphosphate nucleotidohydrolase
MAGKFGAICSRAAACLFIPRPRNLLLHSTPTPARFLPFPRRLHPRSLSTLAMAATNGAATDSVQEHPAAATESVQEPPQKISKISPLLKVKKLSDKAVLPSRGSALAAGYDLSSAVEIVVPARGKALVPTDLSVAIPHGTYARIAPRSGLALKHSIDVGAGVIDADYRGPVGVILFNHSDADFAVKPGDRIAQMIIEVIATPEVAEVEDLDATVRGEGGFGSTGV

SEQ ID NO: 3887 - DNA, 1116 bp, Sorghum bicolor
  misc_feature: Ceres ANNOT ID no. 6033860
  misc_feature: Encodes the peptide sequence at SEQ ID NO 3888
atggaagactcgagcatattcctgcagtgggcgatgaacacgctgcggcacgagcaaccagcggcggccgccgtcaacgacgactgcagcagcgaggcgacgttcccctcgctccaagcgctccgggaggcctcacacgcagccgagatggtgcaggagctgatcgaggaggcccccgcgaacagctggagctccggcgacaccaccgacggcagcagcggcggtggcaacaacaacaacaactcggcccctgctgctgcggcagcggcggcggccatggatcacgatgtcgtctggcctgcgtcaaagacgacctcgccggtcagcaggcccaccttgagcaggagcagcagcgtcaccaaccctcctctgagctggaacttcagcgccgccgcctcggcacagctaggcagcgacggcggcatgctgccggaattcgcccacaagcgcgccctaccgctggaccaagtgtacggatcgccaccggcgaggagagccggcttgaggagcccggctggatccatgtcggcgccgtacgctcaagaccacatcatcgctgagcggaagcggagggagaagatcaaccagcggttcatcgagctctccaccgttatcccaggcctcaagaagatggacaaggcaacgatcctttcagacgcgaccaagtatgtgaaagaactccaagaaaagctcaaggacctggaggctggcggcagcaacggacgcagcaggagcatcgagaccgtggtactcgtcaaaagaccgtgcctccatgctgcggcggcagcgccagacgacgatggctccccattgtcagcgtcgtcgggcacgtcgccggcagagaggaagacgcagctgccggagatcgaggcccggttctcggagaagagcgtcatggtgaggatccactgcgaggacggcaagggggtggccgtgaaggtgctcgccgaggtcgaggagctccatctcagcataatccatgccaacgtcctgcccttcgcagagggcactctcatcataaccatcacggcaaaggtggaggagggattcactgtaactgcggaggagatcgttggcagactgaactcgatctggactagtgcacaaccagcataa

SEQ ID NO: 3888 - protein, 371 aa, Sorghum bicolor
  misc_feature: Ceres ANNOT ID no. 6033860
  misc_feature (179)..(228): Pfam Id: HLH Pfam Desc: Helix-loop-helix DNA-binding domain
  misc_feature (175)..(366): NCBI GI: 3399777 NCBI Desc: symbiotic ammonium transporter; nodulin [glycine max]
  misc_feature (78)..(367): NCBI GI: 144922982 NCBI Desc: helix-loop-helix dna-binding [medicago truncatula]
  misc_feature (153)..(362): NCBI GI: 91806240 NCBI Desc: basic helix-loop-helix family protein [arabidopsis thaliana]
  misc_feature (180)..(367): NCBI GI: 92883256 NCBI Desc: basic helix-loop-helix dimerisation region bhlh [medicago truncatula]
  misc_feature (164)..(363): NCBI GI: 30691602 NCBI Desc: basic helix-loop-helix (bhlh) family protein [arabidopsis thaliana]
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1238 in the 10/412,699US patent application
  misc_feature: The sequence is a functional homolog of SEQ ID NO 1272 in the 10/666,642US patent application
  misc_feature: The sequence is a functional homolog of SEQ ID NO 1273 in the 10/666,642US patent application
  misc_feature: The sequence is a functional homolog of SEQ ID NO 1274 in the 10/666,642US patent application
  misc_feature: The sequence is a functional homolog of SEQ ID NO 1275 in the 10/666,642US patent application
  misc_feature: The sequence is a functional homolog of SEQ ID NO 1276 in the 10/666,642US patent application
  misc_feature: The sequence is a functional homolog of SEQ ID NO 1701 in the 10/374,780US patent application
  misc_feature: The sequence is a functional homolog of SEQ ID NO 1702 in the 10/374,780US patent application
  misc_feature: The sequence is a functional homolog of SEQ ID NO 1703 in the 10/374,780US patent application
  misc_feature: The sequence is a functional homolog of SEQ ID NO 1704 in the 10/374,780US patent application
  misc_feature: The sequence is a functional homolog of SEQ ID NO 1705 in the 10/374,780US patent application
  misc_feature: The sequence is a functional homolog of SEQ ID NO 2 in the 10/374,780US patent application
  misc_feature: The sequence is a functional homolog of SEQ ID NO 42 in the 11/375,241US patent application
  misc_feature: The sequence is a functional homolog of SEQ ID NO 464 in the 11/435,388US patent application
  misc_feature: The sequence is a functional homolog of SEQ ID NO 943 in the 10/374,780US patent application
  misc_feature: The sequence is a functional homolog of SEQ ID NO 955 in the 10/374,780US patent application
  misc_feature: The sequence is a functional homolog of SEQ ID NO 96 in the 10/374,780US patent application
  misc_feature: The sequence is a functional homolog of SEQ ID NO 960 in the 10/374,780US patent application
  misc_feature: Useful for making plants with altered alkaloid content
  misc_feature: Useful for making plants with modulated growth and phenotype characteristics
  misc_feature: Functional homolog of the protein sequence given in SEQ ID NO 13317
  misc_feature: The sequence is a functional homolog of SEQ ID NO 12 in the 20040045049 US patent application
  misc_feature: The sequence is a functional homolog of SEQ ID NO 1238 in the 20040045049 US patent application
  misc_feature: The sequence is a functional homolog of SEQ ID NO 1701 in the 20060162006 US patent application
  misc_feature: The sequence is a functional homolog of SEQ ID NO 1702 in the 20060162006 US patent application
  misc_feature: The sequence is a functional homolog of SEQ ID NO 1703 in the 20060162006 US patent application
  misc_feature: The sequence is a functional homolog of SEQ ID NO 1704 in the 20060162006 US patent application
  misc_feature: The sequence is a functional homolog of SEQ ID NO 1705 in the 20060162006 US patent application
  misc_feature: The sequence is a functional homolog of SEQ ID NO 955 in the 20060162006 US patent application
  misc_feature: The sequence is a functional homolog of SEQ ID NO 96 in the 20060162006 US patent application
  misc_feature: The sequence is a functional homolog of SEQ ID NO 960 in the 20060162006 US patent application
  misc_feature: The sequence is a functional homolog of SEQ ID NO. 483 in the 11/188,298 US application
  misc_feature: The sequence is a functional homolog of SEQ ID NO. 414 in the 11/188,298 US application
MEDSSIFLQWAMNTLRHEQPAAAAVNDDCSSEATFPSLQALREASHAAEMVQELIEEAPANSWSSGDTTDGSSGGGNNNNNSAPAAAAAAAAMDHDVVWPASKTTSPVSRPTLSRSSSVTNPPLSWNFSAAASAQLGSDGGMLPEFAHKRALPLDQVYGSPPARRAGLRSPAGSMSAPYAQDHIIAERKRREKINQRFIELSTVIPGLKKMDKATILSDATKYVKELQEKLKDLEAGGSNGRSRSIETVVLVKRPCLHAAAAAPDDDGSPLSASSGTSPAERKTQLPEIEARFSEKSVMVRIHCEDGKGVAVKVLAEVEELHLSIIHANVLPFAEGTLIITITAKVEEGFTVTAEEIVGRLNSIWTSAQPA

SEQ ID NO: 3889 - DNA, 1158 bp, Sorghum bicolor
  misc_feature: Ceres ANNOT ID no. 6033863
  misc_feature: Encodes the peptide sequence at SEQ ID NO 3890
atggaggactcgagccagttcttgcagtgggccctgagcacactgcagcacgacgacctcccaccggcaacgccggcggccaccgccgcctacgacgataatggctgcaatactgccgccttctcctcaatcccggcgttgggatactccgctgcgtcagtgaacagcatggtcccgggcgaaccaccagcgcgagaaggccaccgggccgccgccgccaccaacagctggagctcggccgacaccgacagcgggagcggcggcggtggcaccgcgtccgtcacggccgcgcagcgcgacgcctggtcgccgtcctcgcagcagaacttggtcaactgtgccacgccacgcagcagcggcagtagcggcgccaaccagcaagtgggctgggacttcaattcggcgtcggcgcagctaatcaaagaagcccaggccaactctgccgccgccgccgctgccgccgcaagggcagagagcaacggtggcggtggcgtgccggtgccacagccacagatggtgcacaacaacgggccaccgccgacgaagagagcctctgccaaaatgtcggcgccttcttcgtcgccaccgtgctcgcaggatcacatcgtcgccgagcggaagcgccgggagaagatcaaccagcgtttcattgagctgtcagcagtcattccctgcctcaagaagatggacaaggcgacgatcctctccgacgcgacgaggtacgtgaaggagctccaagaaaagctcaaggcgctccaggaagacggccgaggcatggagtcggcggtgctcgtcaagaagccgcgcatcgcggcgccgggggatgacgaggacggcggcgcgccttcgccttcgtcctgcgcgacagctggggctgcggcgaccgccaggaacgcgctgccggagatcgaggcgaggatcttggacggcaacgtcgtgatgctgaggatccactgcgaggacggcaagggggtgctcgtcagggtgctggccgaggtcgagggactctgcctcagcatcacgcataccaatgtcatgcccttgtcggcttgcatcctcatcataaacataatggcaaaggtgttggagggcttcaacgccacggcggatgacattgtagggaggcttaatgctgtgcttgctggaccagcgtgttag

SEQ ID NO: 3890 - protein, 385 aa, Sorghum bicolor
  misc_feature: Ceres ANNOT ID no. 6033863
  misc_feature (197)..(246): Pfam Id: HLH Pfam Desc: Helix-loop-helix DNA-binding domain
  misc_feature (153)..(381): NCBI GI: 3399777 NCBI Desc: symbiotic ammonium transporter; nodulin [glycine max]
  misc_feature (181)..(377): NCBI GI: 91806240 NCBI Desc: basic helix-loop-helix family protein [arabidopsis thaliana]
  misc_feature (175)..(379): NCBI GI: 144922982 NCBI Desc: helix-loop-helix dna-binding [medicago truncatula]
  misc_feature (197)..(380): NCBI GI: 4206118 NCBI Desc: transporter homolog [mesembryanthemum crystallinum]
  misc_feature (183)..(381): NCBI GI: 30691602 NCBI Desc: basic helix-loop-helix (bhlh) family protein [arabidopsis thaliana]
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1238 in the 10/412,699US patent application
  misc_feature: The sequence is a functional homolog of SEQ ID NO 1272 in the 10/666,642US patent application
  misc_feature: The sequence is a functional homolog of SEQ ID NO 1273 in the 10/666,642US patent application
  misc_feature: The sequence is a functional homolog of SEQ ID NO 1274 in the 10/666,642US patent application
  misc_feature: The sequence is a functional homolog of SEQ ID NO 1275 in the 10/666,642US patent application
  misc_feature: The sequence is a functional homolog of SEQ ID NO 1276 in the 10/666,642US patent application
  misc_feature: The sequence is a functional homolog of SEQ ID NO 1701 in the 10/374,780US patent application
  misc_feature: The sequence is a functional homolog of SEQ ID NO 1702 in the 10/374,780US patent application
  misc_feature: The sequence is a functional homolog of SEQ ID NO 1703 in the 10/374,780US patent application
  misc_feature: The sequence is a functional homolog of SEQ ID NO 1704 in the 10/374,780US patent application
  misc_feature: The sequence is a functional homolog of SEQ ID NO 1705 in the 10/374,780US patent application
  misc_feature: The sequence is a functional homolog of SEQ ID NO 2 in the 10/374,780US patent application
  misc_feature: The sequence is a functional homolog of SEQ ID NO 42 in the 11/375,241US patent application
  misc_feature: The sequence is a functional homolog of SEQ ID NO 464 in the 11/435,388US patent application
  misc_feature: The sequence is a functional homolog of SEQ ID NO 943 in the 10/374,780US patent application
  misc_feature: The sequence is a functional homolog of SEQ ID NO 955 in the 10/374,780US patent application
  misc_feature: The sequence is a functional homolog of SEQ ID NO 96 in the 10/374,780US patent application
  misc_feature: The sequence is a functional homolog of SEQ ID NO 960 in the 10/374,780US patent application
  misc_feature: Useful for making plants with altered alkaloid content
  misc_feature: Useful for making plants with modulated growth and phenotype characteristics
  misc_feature: Functional homolog of the protein sequence given in SEQ ID NO 13317
  misc_feature: The sequence is a functional homolog of SEQ ID NO 12 in the 20040045049 US patent application
  misc_feature: The sequence is a functional homolog of SEQ ID NO 1238 in the 20040045049 US patent application
  misc_feature: The sequence is a functional homolog of SEQ ID NO 1701 in the 20060162006 US patent application
  misc_feature: The sequence is a functional homolog of SEQ ID NO 1702 in the 20060162006 US patent application
  misc_feature: The sequence is a functional homolog of SEQ ID NO 1703 in the 20060162006 US patent application
  misc_feature: The sequence is a functional homolog of SEQ ID NO 1704 in the 20060162006 US patent application
  misc_feature: The sequence is a functional homolog of SEQ ID NO 1705 in the 20060162006 US patent application
  misc_feature: The sequence is a functional homolog of SEQ ID NO 955 in the 20060162006 US patent application
  misc_feature: The sequence is a functional homolog of SEQ ID NO 96 in the 20060162006 US patent application
  misc_feature: The sequence is a functional homolog of SEQ ID NO 960 in the 20060162006 US patent application
  misc_feature: The sequence is a functional homolog of SEQ ID NO. 483 in the 11/188,298 US application
  misc_feature: The sequence is a functional homolog of SEQ ID NO. 414 in the 11/188,298 US application
MEDSSQFLQWALSTLQHDDLPPATPAATAAYDDNGCNTAAFSSIPALGYSAASVNSMVPGEPPAREGHRAAAATNSWSSADTDSGSGGGGTASVTAAQRDAWSPSSQQNLVNCATPRSSGSSGANQQVGWDFNSASAQLIKEAQANSAAAAAAAARAESNGGGGVPVPQPQMVHNNGPPPTKRASAKMSAPSSSPPCSQDHIVAERKRREKINQRFIELSAVIPCLKKMDKATILSDATRYVKELQEKLKALQEDGRGMESAVLVKKPRIAAPGDDEDGGAPSPSSCATAGAAATARNALPEIEARILDGNVVMLRIHCEDGKGVLVRVLAEVEGLCLSITHTNVMPLSACILIINIMAKVLEGFNATADDIVGRLNAVLAGPAC

SEQ ID NO: 3891 - DNA, 1629 bp, Sorghum bicolor
  misc_feature: Ceres ANNOT ID no. 6033864
  misc_feature: Encodes the peptide sequence at SEQ ID NO 3892
atggccgcctccaccaggactaccagctcgttcccctacctagtcgccgcctcctctcccgcggcccgccgccacggggccagccaccggatccgcgcctcggtgggggaggcggcgatggacgtggtgtcggaggcggagctgcgggagaaagggttcatggggatgcggaagaccaagctcgtgtgcacggtggggcccgcatgcgtcgaggcgctgccggcgctggcgcgcggcgggatgggcgtggcgcgggtcaacctctgccacggtggccgcgagtggcaccgcgccgccatgcgcgccgtgcggaggctcaacgaggaggaaggcttctgcgtgacgcttatggttgacaccgagggctcccagctcctcgtcgcggaccacggaggcgccacctcagcgaaggccgaggatgggtcagagtggatatttacaaacagaagagctgatgaagcccatcagttcacaatgcatgtgaattttgataagttttctgaaggcattttggttggtgacgagcttgtaatagacggtggaatggcaacatttgaagttaatgagaaaataggaaatgatttgcgctgtaagtgcacggacccaggtttgcttcttcctcgagccaagttgtcattctggaggaacggaaaattagttcaaaggaactttggccttcctacattgtcaacaaaggattgggcagacatcgaatttgggatagctgaaggagttgattgcattgctctatcatttgtaaatgatgctaatgatataaagcagttgaaggcttacctctctagaagatcattagaacacatcaaagtttttgcaaagattgagagtctagaatctctcaagaacctgaaagacatcatagaagcatctgatggagttatggtagcacgaggggatcttggagttcagattcctctagaacaaatcccagccattcaagagtcaattgttaaactatgtagacacctgaacaagcctgtgatagttgcttctcagcttctcgaatcaatggttgaatacccaacaccaactcgagcagaggtggccgatgtttctgaagcagtgcggcaatacgcagatgctgtgatgatatcagcagagtcagctataggtgcatatccccagaaagcactatctgtacttcgtgtggccagtgagaggatggaatcatggagccgtgaggaaaacatgcataaacgtcttccacaacatcagcttgcaattgctctgcctgaccggatctcagagcaaatttgcaactgtgctgtagaaatggcaaacaaccttgctgtggatgccatatttgtttacacaaaacatggtcacatggcctcacttctgtcacgcaaccggcccaaccctcccatatttgcattcactgataatgccaattcaagaaagagcatgaacctctactggggagtgattccacttcatctaccattgtcaaatagcatggaagataactttaataaaaccatcagcctgatgaagtcaaagggttcagtgaaacctggagacacggtcttggtggtatcagactctgatctaaaccgaccttgtgctgccacctcagtgttccaatccattcaggtccggttagtggagtag

SEQ ID NO: 3892 - protein, 542 aa, Sorghum bicolor
  misc_feature: Ceres ANNOT ID no. 6033864
  misc_feature (56)..(404): Pfam Id: PK Pfam Desc: Pyruvate kinase, barrel domain
  misc_feature (421)..(542): Pfam Id: PK_C Pfam Desc: Pyruvate kinase, alpha/beta domain
  misc_feature (40)..(520): NCBI GI: 2497539 NCBI Desc: pyruvate kinase isozyme a, chloroplast precursor
  misc_feature (19)..(520): NCBI GI: 115470887 NCBI Desc: os07g0181000 [oryza sativa (japonica cultivar-group)]
  misc_feature (19)..(520): NCBI GI: 482936 NCBI Desc: pyruvate kinase; plastid isozyme [nicotiana tabacum]
  misc_feature (79)..(520): NCBI GI: 169705 NCBI Desc: atp:pyruvate phosphotransferase
  misc_feature (57)..(542): NCBI GI: 482938 NCBI Desc: pyruvate kinase; plastid isozyme [nicotiana tabacum]
  misc_feature (40)..(520): SWISSPROT Homolog: EC 2.7.1.40 Pyruvate kinase isozyme A, chloroplast precursor
MAASTRTTSSFPYLVAASSPAARRHGASHRIRASVGEAAMDVVSEAELREKGFMGMRKTKLVCTVGPACVEALPALARGGMGVARVNLCHGGREWHRAAMRAVRRLNEEEGFCVTLMVDTEGSQLLVADHGGATSAKAEDGSEWIFTNRRADEAHQFTMHVNFDKFSEGILVGDELVIDGGMATFEVNEKIGNDLRCKCTDPGLLLPRAKLSFWRNGKLVQRNFGLPTLSTKDWADIEFGIAEGVDCIALSFVNDANDIKQLKAYLSRRSLEHIKVFAKIESLESLKNLKDIIEASDGVMVARGDLGVQIPLEQIPAIQESIVKLCRHLNKPVIVASQLLESMVEYPTPTRAEVADVSEAVRQYADAVMISAESAIGAYPQKALSVLRVASERMESWSREENMHKRLPQHQLAIALPDRISEQICNCAVEMANNLAVDAIFVYTKHGHMASLLSRNRPNPPIFAFTDNANSRKSMNLYWGVIPLHLPLSNSMEDNFNKTISLMKSKGSVKPGDTVLVVSDSDLNRPCAATSVFQSIQVRLVE

SEQ ID NO: 3893 - DNA, 1269 bp, Sorghum bicolor
  misc_feature: Ceres ANNOT ID no. 6033875
  misc_feature: Encodes the peptide sequence at SEQ ID NO 3894
  misc_feature: Up-regulated in shoot tissues in response to salicylic acid treatment
atggcggtggagtaccactgctgctcggcggccttcttcgagcacatcgtcatcatcgtcgtgctcgtgctcttcgcgggactcatgtcgggcctcaccctcggcctcatgtccctcagcctcgtcgatctcgaggtgctcgccaagtccggcaccgagcaggaccgcaagcacgcagctaagattttacctgttgtgaagaaccagcaccttctgctatgcactcttctaatctgcaatgctgccgcaatggaggctttgcccatattccttgatagcttggtgactgcttggggtgcgattttgatatcagtgacactgattctgctgtttggtgagatcttaccacagtccatctgctcacattatgggctggctattggtgcttcagttgctccattagtccgtgtgcttgtttggatctgctttcctgttgcctatcctataagcaagctattggactatgtgctgggtcatggtcagacagctctcttccgtagagctgaactaaaaacacttgtcactctgcatgggaacgaggctggcaaaggtggagaattaacgcatgatgaaactaccataatagcaggagctcttgaactgactgaaaagaaagctaaagatgctatgacacccttgtgtcaaacatttgcaattgatataaatgcaaaacttgacaggaatctaatgcaagaggtacttgagaaagggcatagcagggttcctgtttattatgaaaagaaaacaaatattattggactgatattggtgaagaatttgttatcagttagtgctgatgatgaggttcctataaaaagtgtaactattcgcaaaattcctcgtgttctagaagatatgcccctctatgacatcctaaacgaatttcagaaaggtcacagccacatggcagtggtcataaggaaaaacaatccaagttacccaccagctgaacaagctgccaatgatggtggaactttcgaggtgtctgttgcgattgatgataagaacagcgaaaaggtcgtgaaaaaccttccatcaccactgcaaagatggaagagctaccctaacactcagaatgcatcaaatagaggaaataggcctaaaaaatggtccaaagatcaagcagacgttcttcaggtccataaagagcccttgcccacgctgaaggaagatgaagaggctgttgggatcataaccatggaggatgtcattgaggagcttctgcaggaggagatatacgatgagacagacgtacatgaggaacaatga

SEQ ID NO: 3894 - protein, 422 aa, Sorghum bicolor
  misc_feature: Ceres ANNOT ID no. 6033875
  misc_feature (210)..(324): Pfam Id: CBS Pfam Desc: CBS domain pair
  misc_feature (1)..(421): NCBI GI: 92882068 NCBI Desc: cbs [medicago truncatula]
  misc_feature (1)..(421): NCBI GI: 42569036 NCBI Desc: cbs domain-containing protein [arabidopsis thaliana]
  misc_feature (1)..(421): NCBI GI: 20856058 NCBI Desc: at4g33700/t16l1_190 [arabidopsis thaliana]
  misc_feature (86)..(421): NCBI GI: 144922987 NCBI Desc: cbs [medicago truncatula]
  misc_feature (7)..(345): NCBI GI: 42568492 NCBI Desc: cbs domain-containing protein-related [arabidopsis thaliana]
  misc_feature: Up-regulated in shoot tissues in response to salicylic acid treatment
MAVEYHCCSAAFFEHIVIIVVLVLFAGLMSGLTLGLMSLSLVDLEVLAKSGTEQDRKHAAKILPVVKNQHLLLCTLLICNAAAMEALPIFLDSLVTAWGAILISVTLILLFGEILPQSICSHYGLAIGASVAPLVRVLVWICFPVAYPISKLLDYVLGHGQTALFRRAELKTLVTLHGNEAGKGGELTHDETTIIAGALELTEKKAKDAMTPLCQTFAIDINAKLDRNLMQEVLEKGHSRVPVYYEKKTNIIGLILVKNLLSVSADDEVPIKSVTIRKIPRVLEDMPLYDILNEFQKGHSHMAVVIRKNNPSYPPAEQAANDGGTFEVSVAIDDKNSEKVVKNLPSPLQRWKSYPNTQNASNRGNRPKKWSKDQADVLQVHKEPLPTLKEDEEAVGIITMEDVIEELLQEEIYDETDVHEEQ

SEQ ID NO: 3895 - DNA, 1308 bp, Sorghum bicolor
  misc_feature: Ceres ANNOT ID no. 6033877
  misc_feature: Encodes the peptide sequence at SEQ ID NO 3896
atgagtgctgagttttgcgctgctgctggtggtggcggtgcggctgtggccatggagttcggagtcgtcggggatgtgatggggctgcagcaaggcatcgccgtcacagcgccatcgcccagggacagcagcgacctgggtctcctcaagcgagcagccctcacccaggcagcggcggcggctgctgccccctacccctcccccttcctcgacgaacagaagatgctcaggttctccaaggcggctcacacattgccctcaggcttggattttggaggcccaagcgagcaggctttcctgctgtccaggaccaagaggccatttactccctcgcagtggatggagctggagcaccaggctctgatatacaagtatctcaatgcaaaggcccccattccttccagcctgctcatttcaatcagcaagagcttcagatcatccaatagagtgagctggaggcctctctatcaaggctacacaaacgcagattccgacccggagcctggaagatgccgacgaacagatggaaagaagtggcgatgctccaaggaggcaatggctgatcacaagtactgtgagcggcacatcaacagaaaccgtcaccgttcaagaaagcctgtggaaaaccaacctaagaagaccaccaaggaggtgcctgctgctgctggctcattgccatgtgctgggccacaaggtagcttgaagaaggcaaaagttaacgactccaagccaggcactgtcagctattggacagataatttaaacaggacaatgctgaacagagagaaagcaaacaaactgacggaagacaactctttgctgcttaattctacgaatagccagcccaccttgtccctgctctctcaactgaagcagcagaataaaccggataagttaggtcccacactggaaaatgagtcaaactcagacacaatattgaaagcatggggaggcaaccagcctagccacaagggcatttcctccgcacagcgccatgatgctgactccctccaatcagtccttcaaaatttcagcctagcccagaatgagaagatggagtcagaaaagaacaaatattctgattccatgctagtttcatcaactttctattctgcagacggtccacgatctacctgccttacacctaacatgacacaagtgcagcaggattgcatatcaagctcttgggagatgcctcaaggtggacctctaggtgagatcttatcgaacaacaagaatagtgaggacttgagcaagtgtgaatcaaggtcatatggttggttattgaatcttgaccaagcaccatga

SEQ ID NO: 3896 - protein, 435 aa, Sorghum bicolor
  misc_feature: Ceres ANNOT ID no. 6033877
  misc_feature (165)..(210): Pfam Id: WRC Pfam Desc: WRC
  misc_feature (106)..(142): Pfam Id: QLQ Pfam Desc: QLQ
  misc_feature (88)..(278): NCBI GI: 51039843 NCBI Desc: tpa: growth-regulating factor 7 [oryza sativa (japonica cultivar-group)]
  misc_feature (107)..(222): NCBI GI: 51039835 NCBI Desc: tpa: growth-regulating factor 3 [oryza sativa (japonica cultivar-group)]
  misc_feature (107)..(222): NCBI GI: 38345778 NCBI Desc: osjnba0083n12.16 [oryza sativa (japonica cultivar-group)]
  misc_feature (107)..(222): NCBI GI: 115460326 NCBI Desc: os04g0600900 [oryza sativa (japonica cultivar-group)]
  misc_feature (107)..(222): NCBI GI: 116310919 NCBI Desc: b0403h10-osigba0105a11.9 [oryza sativa (indica cultivar-group)]
  misc_feature: The sequence is a functional homolog of SEQ ID NO 1781 in the 10/374,780US patent application
  misc_feature: The sequence is a functional homolog of SEQ ID NO 1806 in the 11/479,226US patent application
  misc_feature: The sequence is a functional homolog of SEQ ID NO 660 in the 11/435,388US patent application
  misc_feature: Useful for making plants with modulated growth and phenotype characteristics
  misc_feature: The sequence is a functional homolog of SEQ ID NO 1781 in the 20060162006 US patent application
  misc_feature: The sequence is a functional homolog of SEQ ID NO 660 in the 20060272060 US patent application
MSAEFCAAAGGGGAAVAMEFGVVGDVMGLQQGIAVTAPSPRDSSDLGLLKRAALTQAAAAAAAPYPSPFLDEQKMLRFSKAAHTLPSGLDFGGPSEQAFLLSRTKRPFTPSQWMELEHQALIYKYLNAKAPIPSSLLISISKSFRSSNRVSWRPLYQGYTNADSDPEPGRCRRTDGKKWRCSKEAMADHKYCERHINRNRHRSRKPVENQPKKTTKEVPAAAGSLPCAGPQGSLKKAKVNDSKPGTVSYWTDNLNRTMLNREKANKLTEDNSLLLNSTNSQPTLSLLSQLKQQNKPDKLGPTLENESNSDTILKAWGGNQPSHKGISSAQRHDADSLQSVLQNFSLAQNEKMESEKNKYSDSMLVSSTFYSADGPRSTCLTPNMTQVQQDCISSSWEMPQGGPLGEILSNNKNSEDLSKCESRSYGWLLNLDQAP

SEQ ID NO: 3897 - DNA, 426 bp, Sorghum bicolor
  misc_feature: Ceres ANNOT ID no. 6033887
  misc_feature: Encodes the peptide sequence at SEQ ID NO 3898
atggcggcaacaccgccgcaagtgggcttcgaattcgaccccacagccagcccattcccagctcaacctccggcgacagcctcgcccgaggtcgacacagccgccgcgggggagtctgagtccgccgacgagcgtcgccttcggcggcggatctcgaaccgggagtccgcgcggcgatcccgcgcgcggaagcagcggcgcctcgacgagctccgcgacaccgccgcggtcctggagcgcagggggcgcgagctggccgccggcgcgcgcgccgctcgcggccgcctggccctcgccctgctcgccaacgccgggctccgcgccgaggccgccgtgctgtcccgccgcctcgcggcctcgggcgcctgtacgacgccgccggcagcgtctggcacgtggacattgagcagacgatcgcctcgctga

SEQ ID NO: 3898 - protein, 141 aa, Sorghum bicolor
  misc_feature: Ceres ANNOT ID no. 6033887
  misc_feature (41)..(104): Pfam Id: bZIP_1 Pfam Desc: bZIP transcription factor
  misc_feature (26)..(122): NCBI GI: 14289165 NCBI Desc: glip19 [oryza sativa]
  misc_feature (24)..(117): NCBI GI: 71061098 NCBI Desc: bzip protein [oryza sativa (japonica cultivar-group)]
  misc_feature (26)..(121): NCBI GI: 62898531 NCBI Desc: bzip transcription factor [triticum aestivum]
  misc_feature (25)..(117): NCBI GI: 444047 NCBI Desc: ocs-binding factor 1 [zea mays]
  misc_feature (22)..(117): NCBI GI: 113367232 NCBI Desc: bzip transcription factor bzip41 [glycine max]
  misc_feature: The sequence is a functional homolog of SEQ ID NO 1226 in the 10/412,699US patent application
  misc_feature: The sequence is a functional homolog of SEQ ID NO 1342 in the 10/374,780US patent application
  misc_feature: The sequence is a functional homolog of SEQ ID NO 1343 in the 10/374,780US patent application
  misc_feature: The sequence is a functional homolog of SEQ ID NO 1737 in the 11/479,226US patent application
  misc_feature: The sequence is a functional homolog of SEQ ID NO 86 in the 10/412,699US patent application
  misc_feature: The sequence is a functional homolog of SEQ ID NO 866 in the 10/412,699US patent application
  misc_feature: The sequence is a functional homolog of SEQ ID NO 923 in the 10/374,780US patent application
  misc_feature: Useful for making plants with modulated growth and phenotype characteristics
  misc_feature: The sequence is a functional homolog of SEQ ID NO 1226 in the 20040045049 US patent application
  misc_feature: The sequence is a functional homolog of SEQ ID NO 86 in the 20040045049 US patent application
  misc_feature: The sequence is a functional homolog of SEQ ID NO 866 in the 20040045049 US patent application
  misc_feature: The sequence is a functional homolog of SEQ ID NO 1342 in the 20060162006 US patent application
  misc_feature: The sequence is a functional homolog of SEQ ID NO 1343 in the 20060162006 US patent application
MAATPPQVGFEFDPTASPFPAQPPATASPEVDTAAAGESESADERRLRRRISNRESARRSRARKQRRLDELRDTAAVLERRGRELAAGARAARGRLALALLANAGLRAEAAVLSRRLAASGACTTPPAASGTWTLSRRSPR

SEQ ID NO: 3899 - DNA, 1923 bp, Sorghum bicolor
  misc_feature: Ceres ANNOT ID no. 6033903
  misc_feature: Encodes the peptide sequence at SEQ ID NO 3900
atggctgcactgcaaccctcattttcaccagcaatgactttgaagagtagctgcagtgccctgaagttcccgcaaactgcactgttacctggttttggtggcattccacgccctcaagacaggaaagctagcttcgcttgtttgatccccaaagttgcttcagtgactgaccaatcaatagcagagccatcgaaacccaagcaaaacaggcacacggtcgaccctacagctccagaatttctgcctctcccatcttttgaggaatgctttccaaggagtaccaaagaatcaagcgaaatcattcatgaggaatctggtcatgtcctcaaggttccattccggagagtccatttgactggagatcagaagcactttgatacatatgacaccagtggccctcaaaatataagcccaaggattggactcccaaagataaggaaggagtggattgataggagggaaaaacagggtagtcctcggtacacacaaatgtattatgccaaacagggaatcataacagaggagatgttatactgtgccagccgtgagaaccttagtcctgaatttgttcggacagaagttgcccgtggacgagccataattccttccaacaagaggcacctggaattggaacccatgattgttggaagaaacttccttgtaaaggtgaatgcaaatattgggaattcagctgttgtgagctccattgaggaggaagttcacaagctccagtgggccacgatgtggggagctgatactgtcatggacctttcaacagggcgacatatccatgagacccgggaatggattattcgcaactctccggttcctattgggactgttcctatttaccaagcacttgagaaagtaaatggcattgctgaaaatctgagctgggaaatctttagggataccttgattgaacaagccgagcagggcgttgattacttcacaatccatgctggtgtcctgcttcgttacattcctcttacggcaaagagaatgacgggcatagtttcacgtggtggctcaattcatgcaaaatggtgcttaacttatcacaaggagaactttgcatatgaacattgggatgacattcttgacatatgcaatcagtatgatgtggcattatcaattggtgatggtttgaggcctggttccatttatgatgcgaatgatagtgcacagtttgcagaactgctgactcaaggtgaactaacacgtcgagcatgggcaaaagatgtgcaggtgatgaatgaaggcccaggtcacatcccaatgcataaaattcctgaaaacatggagaaacaactggagtggtgtaatgaagcgcctttctatacattgggtcctttgacaactgatattgcacctggttatgatcacatcacctcagccattggtgctgccaacattggggctcttggcactgcgcttctttgctatgtaacaccaaaggagcaccttggcttgcctaatcgtgatgatgtcaagactggtgtaatatcctacaaaatttctgctcatgctgctgatttggcaaagggtcatccctatgcacaagcttgggatgatgcacttagcaaggcaaggtttgagtttagatggcttgaccaatttgctttgtctctggatccagtaactgctatggctttccatgatgaaacattgccctctgagggtgccaaagtggcacatttctgctcaatgtgtgggcccaagttttgttcaatgaaaatcacggaggatatcaggaagtatgctgatgaaaatggatatggaacagtagaggaagctttgatacaaggaatgaatgctatgagtgctgaatttttggctgcaaggaaaacaattagtggggaacagcatggtgaagcaggaggggagatctatgtaccagaaagctatgcagcacagaaataa

SEQ ID NO: 3900 - protein, 640 aa, Sorghum bicolor
  misc_feature: Ceres ANNOT ID no. 6033903
  misc_feature (162)..(585): Pfam Id: ThiC Pfam Desc: ThiC family
  misc_feature (152)..(613): NCBI GI: 117927263 NCBI Desc: thiamine biosynthesis protein thic [acidothermus cellulolyticus 11b]
  misc_feature (183)..(611): NCBI GI: 15600166 NCBI Desc: thiamin biosynthesis protein thic [pseudomonas aeruginosa pao1]
  misc_feature (183)..(611): NCBI GI: 24638284 NCBI Desc: thiamine biosynthesis protein thic
  misc_feature (183)..(611): NCBI GI: 84317584 NCBI Desc: cog0422: thiamine biosynthesis protein thic [pseudomonas aeruginosa c3719]
  misc_feature (183)..(611): NCBI GI: 84323683 NCBI Desc: cog0422: thiamine biosynthesis protein thic [pseudomonas aeruginosa 2192]
  misc_feature (147)..(638): SWISSPROT Homolog: EC 2.5.1.3 Thiamine-phosphate pyrophosphorylase
MAALQPSFSPAMTLKSSCSALKFPQTALLPGFGGIPRPQDRKASFACLIPKVASVTDQSIAEPSKPKQNRHTVDPTAPEFLPLPSFEECFPRSTKESSEIIHEESGHVLKVPFRRVHLTGDQKHFDTYDTSGPQNISPRIGLPKIRKEWIDRREKQGSPRYTQMYYAKQGIITEEMLYCASRENLSPEFVRTEVARGRAIIPSNKRHLELEPMIVGRNFLVKVNANIGNSAVVSSIEEEVHKLQWATMWGADTVMDLSTGRHIHETREWIIRNSPVPIGTVPIYQALEKVNGIAENLSWEIFRDTLIEQAEQGVDYFTIHAGVLLRYIPLTAKRMTGIVSRGGSIHAKWCLTYHKENFAYEHWDDILDICNQYDVALSIGDGLRPGSIYDANDSAQFAELLTQGELTRRAWAKDVQVMNEGPGHIPMHKIPENMEKQLEWCNEAPFYTLGPLTTDIAPGYDHITSAIGAANIGALGTALLCYVTPKEHLGLPNRDDVKTGVISYKISAHAADLAKGHPYAQAWDDALSKARFEFRWLDQFALSLDPVTAMAFHDETLPSEGAKVAHFCSMCGPKFCSMKITEDIRKYADENGYGTVEEALIQGMNAMSAEFLAARKTISGEQHGEAGGEIYVPESYAAQK

SEQ ID NO: 3901 - DNA, 1950 bp, Sorghum bicolor
  misc_feature: Ceres ANNOT ID no. 6033916
  misc_feature: Encodes the peptide sequence at SEQ ID NO 3902
atggctacttattactcgagccctggtagtgaaagagattcacaaacaatgtactcaacagagtcaggcaatgcatcatatccggtgccatcagccctagggaacttcctttatccaaacaatgcatcttctgggccttatacagaatttagtggaattgtgcagcctcagcagaatttcatggaacttactggtcatccttcagcaatgtcgcatgattcatcatccaatgaagctactaacatgagtacttcactcacagagcagcgctcttttggtcctttgaaagatatgagaaatgagatgttgatgcatttgatggatggagcacacagcagtggcagtgatctcatccacaatgatgcccatagcactgcacaacttgagtttggcatgttaaacaaccacaactcaagtgttccatcagcaccaggccaagggctgtctctgagcctcaatacgcatatcttggcgccttcctatccatactggtctgcaaagcaagatttactgacaccaaattcttaccagggtgatgacaacagaatgaagaatatgcagtctgaggcctcacaggcaatccggaactctaagtatctgaaggcagcacaggagttgcttgatgagattgtcagtgtttggaagagtgttaaacagaaaacagataaaggccctgctgaagcaggaaaggcagatggaaaagagactgatggggggactaaaagtgatggagtatcttccgatccacaagagtctggtgccaatgcagcagctgagctttcaactgctgagaaacaagagctccagaataagatggcgaaacttatggcaatgttagacgaggtggatcgaaagtacaaacactattatcatcagatgcaacttgtaatgtcatcgttcgatatggttgctggttctggagctgccaagccttataccgcagttgccctccagacaatctcacggcatttccgatgtctaaaggatgctatcaatgatcaaattagtgttatccggaagaaacttggagaggatgacactacatctggcaaagagggcaaactaactcgccttcgttatatcgatcagcaaataaggcaacagcgagctttccaacagtatggtatgctacagcaaaatgcttggaggccacagaggggactacctgaaaattcagtctcgattctccgggcttggctttttgaacacttccttcacccgtatccaaaagattccgaaaagataatgttatcgagacaaactgggttaacaagaagtcagatttcaaattggttcatcaatgcccgtgtccggctgtggaagccaatgatcgaagacatgtacaaagaagagattggtgaggcagagctagactccaactcttcctctgacaatgggcagcgaaacagggacaaagcaccatcttcggaagaaaaggaggacctgaagacctcgacaagccaggtttgccaaaccagccagcttgacgaatccaaagccagcgttggtggaatgatgagctttagtggagcgccagctggcggcttccacaacgaggccaaccccgatgacagcttcatgagcctgatgctgaaggcccagagagcgggtgaaactgatggcagcggttttctccatgatgccgtcgcccatcactcggatgagagcgcgcggttcatggcttaccacatggcagagtttgggaggtacggaaacaacaacgtctcactgacgctgggtttgcagcacgccgagaacagcctttcagtcccaccaaacacccagccaggcttccccggcgtccgagaccaagacatctacaacgccacagctcctctcaacgtcgcctccacatcttcagagtatgattcggcaagccaaatagatcaacaacaacaacaacggcagcggtttgagccgtcacctctgatgcatgatttcgtggcctga

SEQ ID NO: 3902 - protein, 649 aa, Sorghum bicolor
  misc_feature: Ceres ANNOT ID no. 6033916
  misc_feature (192)..(333): Pfam Id: POX Pfam Desc: Associated with HOX
  misc_feature (1)..(649): NCBI GI: 42528295 NCBI Desc: benzothiadiazole-induced homeodomain protein 1; bth-induced homeodomain protein 1 [oryza sativa (indica cultivar-group)]
  misc_feature (1)..(582): NCBI GI: 62896427 NCBI Desc: bel1-like homeodomain protein hb2 [oryza sativa (japonica cultivar-group)]
  misc_feature (1)..(632): NCBI GI: 22652127 NCBI Desc: bel1-related homeotic protein 30 [solanum tuberosum]
  misc_feature (241)..(487): NCBI GI: 23308413 NCBI Desc: at2g16400/f16f14.10 [arabidopsis thaliana]
  misc_feature (145)..(488): NCBI GI: 7270411 NCBI Desc: homeodomain-like protein [arabidopsis thaliana]
  misc_feature: The sequence is a functional homolog of SEQ ID NO 1877 in the 11/479,226 US patent application
  misc_feature: The sequence is a functional homolog of SEQ ID NO 1510 in the 10/666,642 US patent application
  misc_feature: The sequence is a functional homolog of SEQ ID NO 964 in the 11/435,388 US patent application
  misc_feature: The sequence is a functional homolog of SEQ ID NO. 320 in the 11/188,298 US application
  misc_feature: The sequence is a functional homolog of SEQ ID NO. 499 in the 11/188,298 US application
MATYYSSPGSERDSQTMYSTESGNASYPVPSALGNFLYPNNASSGPYTEFSGIVQPQQNFMELTGHPSAMSHDSSSNEATNMSTSLTEQRSFGPLKDMRNEMLMHLMDGAHSSGSDLIHNDAHSTAQLEFGMLNNHNSSVPSAPGQGLSLSLNTHILAPSYPYWSAKQDLLTPNSYQGDDNRMKNMQSEASQAIRNSKYLKAAQELLDEIVSVWKSVKQKTDKGPAEAGKADGKETDGGTKSDGVSSDPQESGANAAAELSTAEKQELQNKMAKLMAMLDEVDRKYKHYYHQMQLVMSSFDMVAGSGAAKPYTAVALQTISRHFRCLKDAINDQISVIRKKLGEDDTTSGKEGKLTRLRYIDQQIRQQRAFQQYGMLQQNAWRPQRGLPENSVSILRAWLFEHFLHPYPKDSEKIMLSRQTGLTRSQISNWFINARVRLWKPMIEDMYKEEIGEAELDSNSSSDNGQRNRDKAPSSEEKEDLKTSTSQVCQTSQLDESKASVGGMMSFSGAPAGGFHNEANPDDSFMSLMLKAQRAGETDGSGFLHDAVAHHSDESARFMAYHMAEFGRYGNNNVSLTLGLQHAENSLSVPPNTQPGFPGVRDQDIYNATAPLNVASTSSEYDSASQIDQQQQQRQRFEPSPLMHDFVA

SEQ ID NO: 3903 - DNA, 498 bp, Sorghum bicolor
  misc_feature: Ceres ANNOT ID no. 6033919
  misc_feature: Encodes the peptide sequence at SEQ ID NO 3904
atggcgagcccgtcttcctcctcgtcgtccccgtcccgcaaggccctgagcaagatcgcgtgcagccgcctgcagaaggagctcgcggagtggcaggtcagcccgcccgccggcttcaagcacagggtcaccgacaacctccagaggtgggtcatcgatgtagccggggcaccaggcacgctctacacgggcgagacctacaagctgcaggtggatttccccgagcattatcccatggaggcacctcaggttatatttctgcatccagcaccgatgcatccacacatttacagcaacggacacatatgtttagatatattgtatgactcgtggtccccagcgatgactgtcagttctatctgtatcagcatattatctatgctgtccagctcaccagcaaagcaacgcccagccgataatgatcgctatgtcaggaactgtcgcaatgggagatcaccgaaggagaccaggtggtggttccatgacgacactgtgtga

SEQ ID NO: 3904 - protein, 165 aa, Sorghum bicolor
  misc_feature: Ceres ANNOT ID no. 6033919
  misc_feature (23)..(162): Pfam Id: UQ_con Pfam Desc: Ubiquitin-conjugating enzyme
  misc_feature (6)..(165): NCBI GI: 20856300 NCBI Desc: at5g42990/mbd2_19 [arabidopsis thaliana]
  misc_feature (6)..(165): NCBI GI: 22658 NCBI Desc: ubiquitin-conjugating enzyme [arabidopsis thaliana]
  misc_feature (6)..(165): NCBI GI: 66354440 NCBI Desc: ubiquitinating enzyme [arabidopsis thaliana]
  misc_feature (6)..(165): NCBI GI: 92888972 NCBI Desc: ubiquitin-conjugating enzyme, e2 [medicago truncatula]
  misc_feature (6)..(165): NCBI GI: 4090259 NCBI Desc: ubiquitin-conjugating enzyme e2 [pseudotsuga menziesii]
  misc_feature (6)..(165): SWISSPROT Homolog: EC 6.3.2.19 Ubiquitin-conjugating enzyme E2-18 kDa
  misc_feature: Useful for making plants with modulated oxidative stress sensitivity
  misc_feature: GREAT-hit functional homolog of the protein sequence given in SEQ ID NO 13045
  misc_feature: Useful for making plants with modulated oxidative stress sensitivity
  misc_feature: Functional homolog of the protein sequence given in SEQ ID NO 13045
MASPSSSSSSPSRKALSKIACSRLQKELAEWQVSPPAGFKHRVTDNLQRWVIDVAGAPGTLYTGETYKLQVDFPEHYPMEAPQVIFLHPAPMHPHIYSNGHICLDILYDSWSPAMTVSSICISILSMLSSSPAKQRPADNDRYVRNCRNGRSPKETRWWFHDDTV

SEQ ID NO: 3905 - DNA, 576 bp, Sorghum bicolor
  misc_feature: Ceres ANNOT ID no. 6033920
  misc_feature: Encodes the peptide sequence at SEQ ID NO 3906
atgtctatgccggaggcggggcaggccgcggagagggatgagcagcagcaggcccaggtgatcaaggcgctgatgcagggcatctgcgccgtgcggtaccgcaaggccgataacacgccctgccccatcgcgcagggtctctacttgggatctgttggagcagcattcaataaggaggctctcaagagcttgaacatcacccatatcttgattgttgcaaggtcgctggacccagtatttccagctgaattcaattacaagaagatcgaggtacttgacagcccagacactgatctgttaaagcattctgatgaatgctttagtttcatagatgaagctataagctctggaggcaattgtttagtccattgctttgctgggcggtcaaggagtgtgacaatcgttgttgcatatctcatgaagaagtatcaaatgagcctcgaaagtgccttgtcgctagttagaagtaaacgacctcaagtggctcctaatgaggggtttatttcccagctggagaagtttcagaaatcctttcaagtggagcaggaacggagaatgcaatctgtgcagaattaa

SEQ ID NO: 3906 - protein, 191 aa, Sorghum bicolor
  misc_feature: Ceres ANNOT ID no. 6033920
  misc_feature (39)..(176): Pfam Id: DSPc Pfam Desc: Dual specificity phosphatase, catalytic domain
  misc_feature (1)..(90): NCBI GI: 74318854 NCBI Desc: dual-specificity protein-like phosphatase 2 [zea mays]
  misc_feature (8)..(183): NCBI GI: 9294518 NCBI Desc: dual-specificity protein phosphatase-like protein [arabidopsis thaliana]
  misc_feature (11)..(183): NCBI GI: 4150963 NCBI Desc: dsptp1 protein [arabidopsis thaliana]
  misc_feature (21)..(179): NCBI GI: 74474915 NCBI Desc: dual specificity protein tyrosine phosphatase 1 [solanum tuberosum]
  misc_feature (47)..(187): NCBI GI: 123980606 NCBI Desc: dual specificity phosphatase 19 [synthetic construct]
MSMPEAGQAAERDEQQQAQVIKALMQGICAVRYRKADNTPCPIAQGLYLGSVGAAFNKEALKSLNITHILIVARSLDPVFPAEFNYKKIEVLDSPDTDLLKHSDECFSFIDEAISSGGNCLVHCFAGRSRSVTIVVAYLMKKYQMSLESALSLVRSKRPQVAPNEGFISQLEKFQKSFQVEQERRMQSVQN

SEQ ID NO: 3907 - DNA, 951 bp, Sorghum bicolor
  misc_feature: Ceres ANNOT ID no. 6033923
  misc_feature: Encodes the peptide sequence at SEQ ID NO 3908
atggaggggaaggaggaaggtcggatcttcgtgggcggcctgtcgtggcaaacggacgagcgcaagcttcaggacgcctttggccgcttcgggaaggtcgtcgacgcccagatcatgctggagagacacactaaccgccacaggggatttggcttcgtgacatttgaagatcggagggcagttgacagcgctatcaaagagatgcatggcgaagagttagatggtcgcaccatctcagtgaacaaggctgagcctaagatgaatacagacgacacaaggtatgaaagtggtggtggacgaggagagtatcgtggtggcagaggtgatggtccacccccaggcaattgctttgagtgtggtcgtcctggtcattgggtccgtgactgccctagtgctgctggtggtcgttctggcagattctcgtccaagttcagtggtggtggtggcggtggcaggggagaccgtttttctggatcagataggtttggtgatcgttacatggatgatcgttatgacggtggtcgttatgggtaccgtgatcaagttgatgcaagggacaggtatgctgggggccgagatcgttatgccaatgatcgctacccctctggtggcgatcactttggtggagacaggtatggaggtggcccggatcgttacgtgccaggtggttatggtagggagcgagaaagaagctacgagagagatggagttcgtggtggcggcggcagcggctatgataggagtggcccaaggggtggtgctggctatgacagggatgtccctagaggtggcgggggtggtggctatgacagggatggtccacgtggtggtgtcgctgatcgttatggcggtggaggacctgcacgctatgatggaggaagttgcagggataggcctgggccatatgatcgccctggcagaggaggaggacgttttgatgatcgctactga

SEQ ID NO: 3908 - protein, 316 aa, Sorghum bicolor
  misc_feature: Ceres ANNOT ID no. 6033923
  misc_feature (9)..(80): Pfam Id: RRM_1 Pfam Desc: RNA recognition motif. (a.k.a. RRM, RBD, or RNP domain)
  misc_feature (114)..(131): Pfam Id: zf-CCHC Pfam Desc: Zinc knuckle
  misc_feature (1)..(316): NCBI GI: 33146923 NCBI Desc: glycine-rich rna-binding protein-like [oryza sativa (japonica cultivar-group)]
  misc_feature (1)..(310): NCBI GI: 21387121 NCBI Desc: rna-binding protein-like [arabidopsis thaliana]
  misc_feature (5)..(213): NCBI GI: 1435062 NCBI Desc: rna binding protein, rz-1 [nicotiana sylvestris]
  misc_feature (1)..(171): NCBI GI: 12659074 NCBI Desc: rna-binding protein [triticum aestivum]
  misc_feature (8)..(269): NCBI GI: 51769129 NCBI Desc: similar to 2610510d13rik protein [mus musculus]
  misc_feature: The sequence is a functional homolog of SEQ ID NO 1039 in the 10/374,780US patent application
  misc_feature: The sequence is a functional homolog of SEQ ID NO 1042 in the 10/374,780US patent application
  misc_feature: The sequence is a functional homolog of SEQ ID NO 849 in the 10/666,642US patent application
  misc_feature: The sequence is a functional homolog of SEQ ID NO 852 in the 10/666,642US patent application
  misc_feature: Useful for making plants with altered alkaloid content
  misc_feature: Useful for making plants with modulated growth and phenotype characteristics
  misc_feature: GREAT-hit functional homolog of the protein sequence given in SEQ ID NO 13097
  misc_feature: The sequence is a functional homolog of SEQ ID NO 1039 in the 20060162006 US patent application
  misc_feature: The sequence is a functional homolog of SEQ ID NO 1042 in the 20060162006 US patent application
  misc_feature: Useful for making plants with altered lignin content
  misc_feature: Useful for making plants with modulated nitrogen use efficiency
  misc_feature: Functional homolog of the protein sequence given in SEQ ID NO 13674
  misc_feature: Useful for making plants with modulated flowering time
  misc_feature: Functional homolog of the protein sequence given in SEQ ID NO 13675
  misc_feature: Useful for making plants with modulated biomass
  misc_feature: Functional homolog of the protein sequence given in SEQ ID NO 13677
  misc_feature: Useful for making plants with altered alkaloid content
  misc_feature: Functional homolog of the protein sequence given in SEQ ID NO 13848
  misc_feature: The sequence is a functional homolog of SEQ ID NO. 339 in the 11/188,298 US application
MEGKEEGRIFVGGLSWQTDERKLQDAFGRFGKVVDAQIMLERHTNRHRGFGFVTFEDRRAVDSAIKEMHGEELDGRTISVNKAEPKMNTDDTRYESGGGRGEYRGGRGDGPPPGNCFECGRPGHWVRDCPSAAGGRSGRFSSKFSGGGGGGRGDRFSGSDRFGDRYMDDRYDGGRYGYRDQVDARDRYAGGRDRYANDRYPSGGDHFGGDRYGGGPDRYVPGGYGRERERSYERDGVRGGGGSGYDRSGPRGGAGYDRDVPRGGGGGGYDRDGPRGGVADRYGGGGPARYDGGSCRDRPGPYDRPGRGGGRFDDRY

SEQ ID NO: 3909 - DNA, 1089 bp, Sorghum bicolor
  misc_feature: Ceres ANNOT ID no. 6033940
  misc_feature: Encodes the peptide sequence at SEQ ID NO 3910
atgaagatgagctcatcatccgtgcccgcggcggcggcggtggcggcggtgctgctgctctcggcggtgtggacgacgacgactgtgacggggcaggcgctggtgccgggcgtgatgatcttcggcgactcggtggtggacgccggcaacaacaaccggctggccacgctggtgcgcgccgacttcccgccctacggccgcgacttcccggcgacgcacgcgcccacgggacgcttctgcaacggcaagctcgccacggactacaccgtggagagcctggggctgagctcgtacccgccggcgtacctgagcgaggaggcgcagagcaacaacaagagcctcctccacggcgccaacttcgcgtccggcgccgccggctacctcgacgccaccgccggcctctacggcgccatctcgctgaggcgtcaggcggagtacttccgggagtaccagtcgcgggtggcggcgtcggccggcgagcggcgcgcccgggagctgacgtccgggtccatctacgtggtgagcgccggcaccagcgactacgtgcagaactactacgtgaacccgatgctgagcgccgcctacacgcccgaccagttcgccgacgcgctcatgccgcccttcacctccttcgtcgagggcctgtatagtctgggcgcccgtcggatcggcgtgacgtcgctgccgccgatggggtgcctcccggcgtccgtgaccctgttcggcggcgggaacacaggctgcgtggagcgcctcaacaacgactccctcaccttcaaccggaagctcggcgtggccgcggacgccgtgaagcgccggcactcggacctcaagctcgtcgtcttcgacatctaccagccgctcctcgacctcgtccaaaaccccaccagcgccgggttcttcgagtcccggcgggcgtgctgcggcacgggcacgatcgagacgtccgtgctgtgccaccagggcgcgccggggacgtgcaccaacgccacgggctacgtcttctgggacggcttccaccccacggacgccgccaacagggtgctcgccgacgcgctcctcctgcagggcctccagctcatcgcgtga

SEQ ID NO: 3910 - protein, 362 aa, Sorghum bicolor
  misc_feature: Ceres ANNOT ID no. 6033940
  misc_feature (38)..(353): Pfam Id: Lipase_GDSL Pfam Desc: GDSL-like Lipase/Acylhydrolase
  misc_feature (30)..(362): NCBI GI: 9758010 NCBI Desc: proline-rich protein apg-like [arabidopsis thaliana]
  misc_feature (15)..(361): NCBI GI: 9279719 NCBI Desc: proline-rich protein apg-like; gdsl-motif lipase/hydrolase-like protein [arabidopsis thaliana]
  misc_feature (39)..(361): NCBI GI: 2062167 NCBI Desc: proline-rich protein apg isolog [arabidopsis thaliana]
  misc_feature (17)..(361): NCBI GI: 92890372 NCBI Desc: lipolytic enzyme, g-d-s-l [medicago truncatula]
  misc_feature (1)..(354): NCBI GI: 140061185 NCBI Desc: lipolytic enzyme, g-d-s-l [medicago truncatula]
MKMSSSSVPAAAAVAAVLLLSAVWTTTTVTGQALVPGVMIFGDSVVDAGNNNRLATLVRADFPPYGRDFPATHAPTGRFCNGKLATDYTVESLGLSSYPPAYLSEEAQSNNKSLLHGANFASGAAGYLDATAGLYGAISLRRQAEYFREYQSRVAASAGERRARELTSGSIYVVSAGTSDYVQNYYVNPMLSAAYTPDQFADALMPPFTSFVEGLYSLGARRIGVTSLPPMGCLPASVTLFGGGNTGCVERLNNDSLTFNRKLGVAADAVKRRHSDLKLVVFDIYQPLLDLVQNPTSAGFFESRRACCGTGTIETSVLCHQGAPGTCTNATGYVFWDGFHPTDAANRVLADALLLQGLQLIA

SEQ ID NO: 3911 - DNA, 2223 bp, Sorghum bicolor
  misc_feature: Ceres ANNOT ID no. 6033946
  misc_feature: Encodes the peptide sequence at SEQ ID NO 3912
atgccgtcgtcacccccgcggccggcgatggagcatcgccgccgccagcagcctccagcgccctccgcgcccgcctacctcgccgcaacgctcgccttcctcaccctcgccgcggtcgcctactcccgcgtcgccttccccagcttcccgcacccgctggccacacgcgggtgccgccccgacgccgaggggtcctggtccgccggcgtcttccgcggggactcccccttctccctcaagcccatcgagcactgggggatctctagtggccctggagcggcatggccagtggcgaacccggtcgtgacgtgcgccgacgtggcgaaggttggattccctagcagcttcgtcgctaatccctttctcttcatccagggggactccatttatatgtttttcgagaccaagaaccccatttcatcacaaggcgacattgctgctgccgtgagcaaggatgccggcacaacatggcagcagctgggtgtagtgttggatgaggagtggcacctttcttatccatatgtgttcagttatggaaacgagacttacatgatgcctgaaagcagcaagaaaggaatccttaagttataccgtgccgtggactttccccttaagtgggaattagaaaaggtccttctggagaggccgcttgtagattcggtcatcatatatttcaagggttcctattggctccttggatcagatttaagttcttatggcgcaaaacagacaggtgatctctttatttggtacagcagctctcctcttggtccttggaatcgacacaagcagaacccaattcttaatacaggcaacaggccgagtgccagaaatggaggcaggccattcatttacaatgacaatctttatcgcataggaaaaatccgtggtggtggatctggctataccatccaaatattcaaagttcaattcctgacagcagatcaatacaaggaagttgcggtcccatttgtccttgacaaacccctcaaaaaccgaaatgcatggaatggtgcaaggtcccatcaccttgatgttcagcagcttccattaagtcaacattggattggggtaatggatggtgacagagtgctctcaggtgactcaattcaccgtctgacggtaggctgtatgttttatggtgctgcttgcattttggttcttctacttggtgggcttattggtgcaatcaagtgcaccttaccacttaaatggtatttaccacatactgagaagcggagtgacacctttgatatagagaagcaggtattgctgtgccataagtttagttggcttatctgcaatgtgaacaggttgggatctcttattggtgggaaaattaattacagagcttggaaagaccgagtttatatagctgttataatattgatattagtagtcctaacttttttggggactaactacatctttggtggcaatggtgcagaagaaccatatcctattaggggtaggtactcacagttcacattgttgaccatgacctatgatgcccgattttggaatctgaagatgtttgtggagcattactctaaatgtgcatcggtgagggagattgtagtggtctggaacaaaggtcgagccccagtgcaaggtgaattgaactctatggtgcctgttaggatcagagttgaaaataagaatactctgaacaacagattcaaaatagacaaagaaattaaaacgggagctgttatggagcttgatgatgatatcatgatgacatgtgatgacttagagcgtgggttcaaggtatggagggagcaccctgataggattgttggatactatccacgccttgctgagggctcgcctctagaataccgcaatgagaggtatgctcggcaacaaggaggttataacatcatactaacaggagcagcatttatggatcatgagctagcctttaagaggtactggagcaaagaggctgagataggaaggcagattgttgatagtttctttaattgtgaggatgttctcctaaatttcttatttgcgaatgcaagctcggcaagcacagtggagtatgtaaaaccagcttgggcaattgatatgtctaaattctcaggagtagccattagtcgaaacacgcaggcacattaccatgttaggagcaaatgccttgctatgttttcaggaatctttgggaatttgacttccaagaggtcttttaacagcaggggtgatggctgggatgtatag

SEQ ID NO: 3912 - protein, 740 aa, Sorghum bicolor
  misc_feature: Ceres ANNOT ID no. 6033946
  misc_feature (495)..(731): Pfam Id: EXTL2 Pfam Desc: EXTL2, alpha-1,4-N-acetylhexosaminyltransferase
  misc_feature (61)..(740): NCBI GI: 115454639 NCBI Desc: os03g0684500 [oryza sativa (japonica cultivar-group)]
  misc_feature (487)..(728): NCBI GI: 46250443 NCBI Desc: exostosin 2 [homo sapiens]
  misc_feature (487)..(728): NCBI GI: 3599568 NCBI Desc: glucuronyl/n-acetylglucosaminyl transferase [bos taurus]
  misc_feature (487)..(728): NCBI GI: 117935049 NCBI Desc: exostoses (multiple) 2 [bos taurus]
  misc_feature (487)..(728): NCBI GI: 119588476 NCBI Desc: exostoses (multiple) 2, isoform cra_c [homo sapiens]
  misc_feature: Useful for making plants with altered carbohydrate content
  misc_feature: Functional homolog of the protein sequence given in SEQ ID NO 13847
MPSSPPRPAMEHRRRQQPPAPSAPAYLAATLAFLTLAAVAYSRVAFPSFPHPLATRGCRPDAEGSWSAGVFRGDSPFSLKPIEHWGISSGPGAAWPVANPVVTCADVAKVGFPSSFVANPFLFIQGDSIYMFFETKNPISSQGDIAAAVSKDAGTTWQQLGVVLDEEWHLSYPYVFSYGNETYMMPESSKKGILKLYRAVDFPLKWELEKVLLERPLVDSVIIYFKGSYWLLGSDLSSYGAKQTGDLFIWYSSSPLGPWNRHKQNPILNTGNRPSARNGGRPFIYNDNLYRIGKIRGGGSGYTIQIFKVQFLTADQYKEVAVPFVLDKPLKNRNAWNGARSHHLDVQQLPLSQHWIGVMDGDRVLSGDSIHRLTVGCMFYGAACILVLLLGGLIGAIKCTLPLKWYLPHTEKRSDTFDIEKQVLLCHKFSWLICNVNRLGSLIGGKINYRAWKDRVYIAVIILILVVLTFLGTNYIFGGNGAEEPYPIRGRYSQFTLLTMTYDARFWNLKMFVEHYSKCASVREIVVVWNKGRAPVQGELNSMVPVRIRVENKNTLNNRFKIDKEIKTGAVMELDDDIMMTCDDLERGFKVWREHPDRIVGYYPRLAEGSPLEYRNERYARQQGGYNIILTGAAFMDHELAFKRYWSKEAEIGRQIVDSFFNCEDVLLNFLFANASSASTVEYVKPAWAIDMSKFSGVAISRNTQAHYHVRSKCLAMFSGIFGNLTSKRSFNSRGDGWDV

SEQ ID NO: 3913 - DNA, 762 bp, Sorghum bicolor
  misc_feature: Ceres ANNOT ID no. 6033947
  misc_feature: Encodes the peptide sequence at SEQ ID NO 3914
atggctttgctgcagagccagagccgcctgcccggcattggctgcagcagcagcatcgtcttggcaagagcgagggtgcagcagtgtctggcagcggcgtcgcactcacgcgcgcccctcctgcgagctaatggcggcaggaggagcacgacgggcctccccacctcctcctcctcctcctttaaggctggcaatgcgatcagcctcagccggcggagaataagggacctgcgcgtcgtcgcggaggcggccaccgcgggggcggccaaggtggtcacgccggcgtcgtctggcggcgtcagcgtcagcgacgtgctctggccttccgccggagcgttcttggccatggcggtactgggaaaaatggaccagatggtggcgttcaagggagtatccttgacgattgcgccccttggagcagtctgctgcgtgctttttagcgctccaggctcccctgcagccaagaaatataatatgttcgtcgcccagattggttgtgcggcttttggcgtattagccctctcgttgtttgggcctggctggttagcaagaggcgcagctctttcagccagcatagcattcatgaccatcacgggtgcctcacatccaccagctgcaagcttgcccctcttgtttatcgatggcccgaagtttcacaatctgcaactttggtacgcgcttttccctggagctgcaggctgcatcgtcctttgcttgattcaagaggtggtgctttacctgaagaagaacttcaagttttga

SEQ ID NO: 3914 - protein, 253 aa, Sorghum bicolor
  misc_feature: Ceres ANNOT ID no. 6033947
  misc_feature (119)..(250): Pfam Id: HPP Pfam Desc: HPP family
  misc_feature (33)..(210): NCBI GI: 42573774 NCBI Desc: integral membrane hpp family protein [arabidopsis thaliana]
  misc_feature (94)..(253): NCBI GI: 92114519 NCBI Desc: hpp [chromohalobacter salexigens dsm 3043]
  misc_feature (90)..(247): NCBI GI: 117923778 NCBI Desc: hpp family protein+b94 [magnetococcus sp. mc-1]
  misc_feature (104)..(249): NCBI GI: 78355550 NCBI Desc: membrane protein, hpp family [desulfovibrio desulfuricans g20]
  misc_feature (100)..(240): NCBI GI: 110638398 NCBI Desc: cbs-domain-containing membrane protein [cytophaga hutchinsonii atcc 33406]
MALLQSQSRLPGIGCSSSIVLARARVQQCLAAASHSRAPLLRANGGRRSTTGLPTSSSSSFKAGNAISLSRRRIRDLRVVAEAATAGAAKVVTPASSGGVSVSDVLWPSAGAFLAMAVLGKMDQMVAFKGVSLTIAPLGAVCCVLFSAPGSPAAKKYNMFVAQIGCAAFGVLALSLFGPGWLARGAALSASIAFMTITGASHPPAASLPLLFIDGPKFHNLQLWYALFPGAAGCIVLCLIQEVVLYLKKNFKF

SEQ ID NO: 3915 - DNA, 564 bp, Sorghum bicolor
  misc_feature: Ceres ANNOT ID no. 6033948
  misc_feature: Encodes the peptide sequence at SEQ ID NO 3916
atggcctgccccgccgccaccacggctcgcatcggggcgcggagagggccgtgcctgtggaggagcgagaggagcatcagcgtcctcgtcggttccgcgtccctgctcccggaccgcgcggcccgggacacgagggcgcgcgcctcggagctgcagcaagcgccccgcccggcctccgctaccgtccccacgcacaaggtcaccgtccacgaccgccagcgcggggtcgtccacgaattcgtcgtgccggaggaccagtacattctacacaccgcggaggcgcaggacatcagattgccgttcgcgtgccgccacggttgctgtacaagctgtgcagtccgaataaaatcaggacaaataaggcagccagaagcacttggaatatctgcagaactaaaagatcagggttatgctttgttgtgtgttggtttcccatctggtgatgtcgaagtcgagactcaagatgaagatgaggtatattggctccagtttgggagatattttgcacgagggcctgtggaaagagatgattacgcgctagaacttgcaatgggagacgaatga

SEQ ID NO: 3916 - protein, 187 aa, Sorghum bicolor
  misc_feature: Ceres ANNOT ID no. 6033948
  misc_feature (71)..(147): Pfam Id: Fer2 Pfam Desc: 2Fe-2S iron-sulfur cluster binding domain
  misc_feature (64)..(174): NCBI GI: 23127555 NCBI Desc: cog0633: ferredoxin [nostoc punctiforme pcc 73102]
  misc_feature (58)..(173): NCBI GI: 86609724 NCBI Desc: ferredoxin, 2fe-2s [cyanobacteria bacterium yellowstone b-prime]
  misc_feature (64)..(174): NCBI GI: 17230411 NCBI Desc: ferredoxin [nostoc sp. pcc 7120]
  misc_feature (64)..(174): NCBI GI: 75907204 NCBI Desc: ferredoxin (2fe-2s) [anabaena variabilis atcc 29413]
  misc_feature (64)..(173): NCBI GI: 86604760 NCBI Desc: ferredoxin, 2fe-2s [cyanobacteria bacterium yellowstone a-prime]
MACPAATTARIGARRGPCLWRSERSISVLVGSASLLPDRAARDTRARASELQQAPRPASATVPTHKVTVHDRQRGVVHEFVVPEDQYILHTAEAQDIRLPFACRHGCCTSCAVRIKSGQIRQPEALGISAELKDQGYALLCVGFPSGDVEVETQDEDEVYWLQFGRYFARGPVERDDYALELAMGDE

SEQ ID NO: 3917 - DNA, 2223 bp, Sorghum bicolor; identical to SEQ ID NO: 3911
  misc_feature: Ceres ANNOT ID no. 6033950
  misc_feature: Encodes the peptide sequence at SEQ ID NO 3918

SEQ ID NO: 3918 - protein, 740 aa, Sorghum bicolor; identical to SEQ ID NO: 3912
  misc_feature: Ceres ANNOT ID no. 6033950
  misc_feature (495)..(731): Pfam Id: EXTL2 Pfam Desc: EXTL2, alpha-1,4-N-acetylhexosaminyltransferase
  misc_feature (61)..(740): NCBI GI: 115454639 NCBI Desc: os03g0684500 [oryza sativa (japonica cultivar-group)]
  misc_feature (487)..(728): NCBI GI: 46250443 NCBI Desc: exostosin 2 [homo sapiens]
  misc_feature (487)..(728): NCBI GI: 3599568 NCBI Desc: glucuronyl/n-acetylglucosaminyl transferase [bos taurus]
  misc_feature (487)..(728): NCBI GI: 117935049 NCBI Desc: exostoses (multiple) 2 [bos taurus]
  misc_feature (487)..(728): NCBI GI: 119588476 NCBI Desc: exostoses (multiple) 2, isoform cra_c [homo sapiens]
  misc_feature: Useful for making plants with altered carbohydrate content
  misc_feature: Functional homolog of the protein sequence given in SEQ ID NO 13847

SEQ ID NO: 3919 - DNA, 762 bp, Sorghum bicolor; identical to SEQ ID NO: 3913
  misc_feature: Ceres ANNOT ID no. 6033951
  misc_feature: Encodes the peptide sequence at SEQ ID NO 3920

SEQ ID NO: 3920 - protein, 253 aa, Sorghum bicolor; identical to SEQ ID NO: 3914
  misc_feature: Ceres ANNOT ID no. 6033951
  misc_feature (119)..(250): Pfam Id: HPP Pfam Desc: HPP family
  misc_feature (33)..(210): NCBI GI: 42573774 NCBI Desc: integral membrane hpp family protein [arabidopsis thaliana]
  misc_feature (94)..(253): NCBI GI: 92114519 NCBI Desc: hpp [chromohalobacter salexigens dsm 3043]
  misc_feature (90)..(247): NCBI GI: 117923778 NCBI Desc: hpp family protein+b94 [magnetococcus sp. mc-1]
  misc_feature (104)..(249): NCBI GI: 78355550 NCBI Desc: membrane protein, hpp family [desulfovibrio desulfuricans g20]
  misc_feature (100)..(240): NCBI GI: 110638398 NCBI Desc: cbs-domain-containing membrane protein [cytophaga hutchinsonii atcc 33406]

SEQ ID NO: 3921 - DNA, 564 bp, Sorghum bicolor; identical to SEQ ID NO: 3915
  misc_feature: Ceres ANNOT ID no. 6033952
  misc_feature: Encodes the peptide sequence at SEQ ID NO 3922

SEQ ID NO: 3922 - protein, 187 aa, Sorghum bicolor; identical to SEQ ID NO: 3916
  misc_feature: Ceres ANNOT ID no. 6033952
  misc_feature (71)..(147): Pfam Id: Fer2 Pfam Desc: 2Fe-2S iron-sulfur cluster binding domain
  misc_feature (64)..(174): NCBI GI: 23127555 NCBI Desc: cog0633: ferredoxin [nostoc punctiforme pcc 73102]
  misc_feature (58)..(173): NCBI GI: 86609724 NCBI Desc: ferredoxin, 2fe-2s [cyanobacteria bacterium yellowstone b-prime]
  misc_feature (64)..(174): NCBI GI: 17230411 NCBI Desc: ferredoxin [nostoc sp. pcc 7120]
  misc_feature (64)..(174): NCBI GI: 75907204 NCBI Desc: ferredoxin (2fe-2s) [anabaena variabilis atcc 29413]
  misc_feature (64)..(173): NCBI GI: 86604760 NCBI Desc: ferredoxin, 2fe-2s [cyanobacteria bacterium yellowstone a-prime]

SEQ ID NO: 3923 - DNA, 1038 bp, Sorghum bicolor
  misc_feature: Ceres ANNOT ID no. 6033953
  misc_feature: Encodes the peptide sequence at SEQ ID NO 3924
atgttactggtgcgcgccccgccgtctccgccgccgctctcggcggcgaccaacttcccggcgaacctggagcgcccccttcgccttcgcggcgtgtcctcttcccatgccggcgttgctacggccgctgccgcggcgaagccggcggcttcctccctgggcgggcaaaagcgcaagcaggtggcgagcgtggcgaacccgctggtgaagcactgcgtcaagctccggctctccgcagcgtaccgccgctcctgccgccgcctcctcctcgtcggcctcgcgcccatcctggaggtgtgtaggtttgagctcgacgccatcgattacttgcttctcatggacggcgtagaggtcccggaggcgctgcgcgagttctccggtgacgtcgtgcatgtcagcgccgcggtgatgaagaaggtgtccgggatgcagtcggttgattccaccgaggcgattgctgtcatgcacatgcctaaccatttccgcgacctcgggagccatgaggacggggatgcccttgatgggttgctcagttatccaaagaggattctagtccttgatgggattcaggatcctggtaaccttggaacactgataagatcagcttgtgctttcaaatgggatggagtattccttcttccggcttgttgtgatcctttcaatgaaaaggctattcgtgcagcccgtggagcctctttgcagcttcctattgtctctggtacctggcatgacctgcatgcattgatgacaaagtatggtatgaagatgatggcaggccatccagaaagtagcagtgatgcatccaaaggaatctactcgctgtccaaagaactagctgattcactgttgaatgagtctctgtgcttagtgttaggaagtgagggcaatggcctctctgcagagaccctccaggcatgtgagcttgtaaacattccaatggaaggtacttttgaatcactgaatgtttcagttgcaggtggcatatttttgttcatgttacaacccaaaggtcaaattgacaggacttcaaccccttaa

SEQ ID NO: 3924 - protein, 345 aa, Sorghum bicolor
  misc_feature: Ceres ANNOT ID no. 6033953
  misc_feature (181)..(331): Pfam Id: SpoU_methylase Pfam Desc: SpoU rRNA Methylase family
  misc_feature (56)..(338): NCBI GI: 144925014 NCBI Desc: trna/rrna methyltransferase (spou) [medicago truncatula]
  misc_feature (181)..(334): NCBI GI: 138896271 NCBI Desc: rrna methyltransferase [geobacillus thermodenitrificans ng80-2]
  misc_feature (92)..(334): NCBI GI: 76796252 NCBI Desc: trna/rrna methyltransferase (spou) [thermoanaerobacter ethanolicus atcc 33223]
  misc_feature (92)..(334): NCBI GI: 114844162 NCBI Desc: trna/rrna methyltransferase (spou) [thermoanaerobacter ethanolicus x514]
  misc_feature (61)..(331): NCBI GI: 76259206 NCBI Desc: trna/rrna methyltransferase (spou):trna/rrna methyltransferase (spou) [chloroflexus aurantiacus j-10-fl]
MLLVRAPPSPPPLSAATNFPANLERPLRLRGVSSSHAGVATAAAAAKPAASSLGGQKRKQVASVANPLVKHCVKLRLSAAYRRSCRRLLLVGLAPILEVCRFELDAIDYLLLMDGVEVPEALREFSGDVVHVSAAVMKKVSGMQSVDSTEAIAVMHMPNHFRDLGSHEDGDALDGLLSYPKRILVLDGIQDPGNLGTLIRSACAFKWDGVFLLPACCDPFNEKAIRAARGASLQLPIVSGTWHDLHALMTKYGMKMMAGHPESSSDASKGIYSLSKELADSLLNESLCLVLGSEGNGLSAETLQACELVNIPMEGTFESLNVSVAGGIFLFMLQPKGQIDRTSTP

SEQ ID NO: 3925 - DNA, 1398 bp, Sorghum bicolor
  misc_feature: Ceres ANNOT ID no. 6033975
  misc_feature: Encodes the peptide sequence at SEQ ID NO 3926
  misc_feature: Up-regulated in root tissues in response to methyl jasmonate treatment
atggccacctccccagccgcctcgtcctcttccgctccgaccgcctccgccgccgctgcggccacgatggctgccgaggccaccgacgggccggtgctcagcgtagtatcgaagcgtctccgcgcgctgcggaagaagtacaaccgcatcacgcagatggaggagtcgctcgccgccggcaagacgctcaaccgagagcaggaggaggttctccgctccaagcccgtcgtcgccgccctgatcgacgagcttgagcgcctccgccccccgctcgcatccgccgtcgcggaggagctctcctcccgccccgcccccgcccctgcccctgcccccgccgccgccgcttcctcctccgactcagattcgtcagtccaggacctcctcgcgctcatctacttcggctccctcttcgacgtcaagcagcaaagcgacttcgtctctttggtttacgcgagcgagctcgagcggagcagctgcatcacttatgactacgtcggggatgatccggaggacagtctcgcggagaccgatctgaacgcggtttctgcccttgcctccctcgccgcgtcgcgccctccagctgcagccggagtctcgcaccgtgacgcccttcaggcttgtgcccatcacgcccgcctctggctccgccgtgcggatgaacccatccaccctgactccaccgtcacatatgctggggtgagggcaaagctggataggatcatggcatcgggctactacacagctcagctagaaatgaggccaccattggatctggctgctgcagtggcaagctttggagctggaggtgctcagatgcaggagagtatggttgtgtcgcctcaggcaccggaagcagttgaggagaacccagctgttgaaggacacaaggatgagaaggatgattcgcaggctactgaaatctacagtgaccatcaggctcctgttgttgatgctgaacatgtggaggatgaaggcctggtgaatccaactgatgaggttccttcagctgaggcagagcaggagacatttgatgctgatgtggaggatcaggaacaaaaagaccaacaattcacccagcggcggtcttaccagaaccagcgtgggggtggtggtcgtggtggcggcaggaggggctatcctaatggtcgtggagggcgtggtggccgaggcggtgggtaccagaacggccgtggcggtggtggataccagaacggccgtggcggaggcggtgggtactactatgaatctggatactaccagccgaggaactacaacaacaacagaggccggggtggtcgctctggcggtggcaactcttactacaacaaccatggtggaggtgcacagggaggcggccatggcaatcctgggagggttgagcttggtgcaaacgcctag

SEQ ID NO: 3926 - protein, 465 aa, Sorghum bicolor
  misc_feature: Ceres ANNOT ID no. 6033975
  misc_feature (338)..(457): NCBI GI: 21388660 NCBI Desc: glycine-rich rna-binding protein [physcomitrella patens]
  misc_feature (363)..(457): NCBI GI: 49402291 NCBI Desc: heterogeneous nuclear ribonucleoprotein a1 [danio rerio]
  misc_feature (301)..(453): NCBI GI: 92874469 NCBI Desc: rna-binding region rnp-1 (rna recognition motif) [medicago truncatula]
  misc_feature (364)..(456): NCBI GI: 45553351 NCBI Desc: cg16901-pd, isoform d [drosophila melanogaster]
  misc_feature (254)..(457): NCBI GI: 86158618 NCBI Desc: translation initiation factor 2 [anaeromyxobacter dehalogenans 2cp-c]
  misc_feature: Up-regulated in root tissues in response to methyl jasmonate treatment
MATSPAASSSSAPTASAAAAATMAAEATDGPVLSVVSKRLRALRKKYNRITQMEESLAAGKTLNREQEEVLRSKPVVAALIDELERLRPPLASAVAEELSSRPAPAPAPAPAAAASSSDSDSSVQDLLALIYFGSLFDVKQQSDFVSLVYASELERSSCITYDYVGDDPEDSLAETDLNAVSALASLAASRPPAAAGVSHRDALQACAHHARLWLRRADEPIHPDSTVTYAGVRAKLDRIMASGYYTAQLEMRPPLDLAAAVASFGAGGAQMQESMVVSPQAPEAVEENPAVEGHKDEKDDSQATEIYSDHQAPVVDAEHVEDEGLVNPTDEVPSAEAEQETFDADVEDQEQKDQQFTQRRSYQNQRGGGGRGGGRRGYPNGRGGRGGRGGGYQNGRGGGGYQNGRGGGGGYYYESGYYQPRNYNNNRGRGGRSGGGNSYYNNHGGGAQGGGHGNPGRVELGANA

SEQ ID NO: 3927 - DNA, 3162 bp, Sorghum bicolor
  misc_feature: Ceres ANNOT ID no. 6033977
  misc_feature: Encodes the peptide sequence at SEQ ID NO 3928
atggtggtgatggagggtaatggcggcgccggcaagatcaccattggcgtctgtgtcatggagaagaaggtgttctcttctccaatggagcagattctcgagcggctccgcgcgtttggagaattcgagattataatatttggagataaggttattctcgacgatcctattgagatgtatgtttatctacattctttttggccaaactgtgattgtttgattgccttctattcctccggttttcctctgcaaaaggtccaagcatatgctgctttgagaaggccttttttggtgaatgaattggagccacaatacctcctccatgaccgcagaaaagtgtacgagcatctggagaagtatggaattcctgtgcccagttatgctcttgtcaatagagaatatccgtaccaagagctggactacttcattgagcaagaagattttgttgaggtccatgggaagcggtttttgaaaccttttgtggagaaacctgtcaatggggacgaccaccgaataatgatatattatcctagttctgctggcggtggaatgaaggaattattcagaaaggtgggtaaccgatctagtgaatttcatcctgatgttaggagagtgaggcgtgaaggttcctacatatatgaggaattcatgcctactggtggcactgatgttaaagtttacactgttggccccggatatgcacatgccgaggcacgtaaatcgcctgttgttgatggtgttgttatgaggaaccctgatggcaaagaagtacgataccctgtacttttgacccctactgagaaacaaatggcaagagatgtctgcaatgcttttagacagatggtttgtggttttgatctcttaagatgtgatgggagatcatatgtctgtgacgttaacggatggagctttgtgaagaactcatataagtattatgatgatgctgcttgcatcttgagaaaaatatttcttgatgcaaaagctcctcatctttcgtcaaccatccccccaactcttccttggaaatctgaacctgttcagcccaccgaaggtcttacacgacagggaagcggaattattggtacatttgggcagtcagaagaactgcgctgtgtaattgttgtgatacgccatggcgatcggacaccaaagcagaaggtgaaattgaaagtgacagaagaaaagctcctgaatttgatgttgaagtacaatggtggaaaaccaagagttgagacaaaactaaaaagtgctgtacagttacaagacttgctggatgctacaagacaacttgtaccaccaactaggtctggtcgggagagtgatagtgatgctgatgatattgagcatattgagaaacttcgccaagtcaaagcagtactagaggagggtggacatttctctggcatttataggaaagtgcagctaaagccattaaaatggataaaagttccaaagcgttatggtgatggtgaagaggaacgaccggttgaagccctgatgattttgaaatatggtggtgtgctcactcatgctgggagaaaacaggcagaggagttgggaaggtttttcagaaataacatatacccaggtgaaggaactggtttgcttcgtctgcatagcacttacagacatgatttaaaaatatacagctcagacgaaggtcgtgtacagatgtctgcagcagcatttgcaaaaggccttcttgatttggaagggcagttgactcccatactggtatctctagtaagtaaagactcatctatgctagatggactggaagatgcaagcaccgagatggatgaagctaaggctagattgcatgagattattatttcaagtgcaaaaacaaagaacgcagaagggccagtggaatttccatggatggttgatggtgcaggattgcctgcaaatgcttcccaattcctgcctaagatggttaagttgactaaagaagtgacttcacaagtcaagctacttgctgaaggtgaagatgaaagacttgcattgacgagcacattttcaaaatatgaccaagcaaaagctcttgggaagacaactattgatgtggctcgtattgctgccgggttgccttgtggtagtgaaagcttcctcttgatgtttgccagatggagaaaacttgagagggatttatacaatgaaagaaaggaccgttttgacattacacagatcccagatgtatatgattcctgcaagtatgaccttttgcataatgctcatctcgatcttaagggtttggaagagctattcaaagttgctcaaatacttgctgatggtgttattccaaatgagtatgggatcaacccaaagcaaaaactgaaaatcggctcaaagatagcgcgccgtttattgggaaaaatcctaattgatctacgcaacactcgtgaagaagctatcagtgttgccgattcaaaatttgttgaagacgaagctcaattcctaccaacaaaagaagcagagcaccagcaaaagattcaagttagaaatgaggatggaagaagatctagctctacgagcgagaagtcattagaccaagaagatgaagatgatagagaaactaaataccgactagatcccaagtatgccaatgtaaggacacctgagcgtcatgtccgcacaagactttacttcacatcggaatctcatatacactccttgatgaatgttcttcgttactgcaatttggacgaaagtctacaaggagaggaaagccttgtctgccagagtgctttggaccgtctacatagaactagggagcttgattacatgagtaatattgtgcttagaatgtttgaaaacacagaggttcctttggaagatgagaagaggttcaggattgaaatgacattcagtcgtggtgccgatctcagtcccctagaggacaaaaccagtgaaagttccttgcttcaggagcacactttgcccataatgggacctgagagactacaggaagttgggtcctgcctgacgatggacaagtttgagaaaatggtgcgaccatttgccatgcccccagaggacttcccccctgctgcccctccacaagccttaggctacttctccaaaggggcaggaggagtgcttgaaaggttggttagcctctggcctttccacaagagcgcaaatgcggctaatggaaaatag

SEQ ID NO: 3928 - protein, 1053 aa, Sorghum bicolor
  misc_feature: Ceres ANNOT ID no. 6033977
  misc_feature (368)..(955): Pfam Id: Acid_phosphat_A Pfam Desc: Histidine acid phosphatase
  misc_feature (12)..(1053): NCBI GI: 124359918 NCBI Desc: histidine acid phosphatase [medicago truncatula]
  misc_feature (1)..(1053): NCBI GI: 79295367 NCBI Desc: acid phosphatase [arabidopsis thaliana]
  misc_feature (12)..(657): NCBI GI: 41281583 NCBI Desc: kiaa0433 protein [homo sapiens]
  misc_feature (12)..(657): NCBI GI: 40788260 NCBI Desc: kiaa0433 [homo sapiens]
  misc_feature (12)..(661): NCBI GI: 37359944 NCBI Desc: mkiaa0433 protein [mus musculus]
MVVMEGNGGAGKITIGVCVMEKKVFSSPMEQILERLRAFGEFEIIIFGDKVILDDPIEMYVYLHSFWPNCDCLIAFYSSGFPLQKVQAYAALRRPFLVNELEPQYLLHDRRKVYEHLEKYGIPVPSYALVNREYPYQELDYFIEQEDFVEVHGKRFLKPFVEKPVNGDDHRIMIYYPSSAGGGMKELFRKVGNRSSEFHPDVRRVRREGSYIYEEFMPTGGTDVKVYTVGPGYAHAEARKSPVVDGVVMRNPDGKEVRYPVLLTPTEKQMARDVCNAFRQMVCGFDLLRCDGRSYVCDVNGWSFVKNSYKYYDDAACILRKIFLDAKAPHLSSTIPPTLPWKSEPVQPTEGLTRQGSGIIGTFGQSEELRCVIVVIRHGDRTPKQKVKLKVTEEKLLNLMLKYNGGKPRVETKLKSAVQLQDLLDATRQLVPPTRSGRESDSDADDIEHIEKLRQVKAVLEEGGHFSGIYRKVQLKPLKWIKVPKRYGDGEEERPVEALMILKYGGVLTHAGRKQAEELGRFFRNNIYPGEGTGLLRLHSTYRHDLKIYSSDEGRVQMSAAAFAKGLLDLEGQLTPILVSLVSKDSSMLDGLEDASTEMDEAKARLHEIIISSAKTKNAEGPVEFPWMVDGAGLPANASQFLPKMVKLTKEVTSQVKLLAEGEDERLALTSTFSKYDQAKALGKTTIDVARIAAGLPCGSESFLLMFARWRKLERDLYNERKDRFDITQIPDVYDSCKYDLLHNAHLDLKGLEELFKVAQILADGVIPNEYGINPKQKLKIGSKIARRLLGKILIDLRNTREEAISVADSKFVEDEAQFLPTKEAEHQQKIQVRNEDGRRSSSTSEKSLDQEDEDDRETKYRLDPKYANVRTPERHVRTRLYFTSESHIHSLMNVLRYCNLDESLQGEESLVCQSALDRLHRTRELDYMSNIVLRMFENTEVPLEDEKRFRIEMTFSRGADLSPLEDKTSESSLLQEHTLPIMGPERLQEVGSCLTMDKFEKMVRPFAMPPEDFPPAAPPQALGYFSKGAGGVLERLVSLWPFHKSANAANGK

SEQ ID NO: 3929 - DNA, 687 bp, Sorghum bicolor
  misc_feature: Ceres ANNOT ID no. 6033985
  misc_feature: Encodes the peptide sequence at SEQ ID NO 3930
atggcttccgctgcggcggcgcagaggctcctcgcgtcgagcacgaagatcatcggggttgggcgcaactacatcgcccacgccaaggagctcaacaacccggtccccaaggagcccgtcctgttcctgaagccgacctcgtcgttcctccacgctggcgtggccaccgccgccgtcgagatcccggagccgctcgagtcgctgcaccacgaggtcgagctcgccgttgtcatttcccggcgtgggcgcgacattcctgaggcgtccgccatggacttcgtcggaggttatgcacttgctttggacatgacagcaagggaccttcaatctgttgctaagtctgcaggccttccatggactttggctaaaggacaagataccttcactccaattagtgcagtagttccaaaatcggctgtcactaatcccgacgatcttgagctctggctaaaggtagatgatgaactaagacagaaaggatccacaagtgacatgatattcaagattccttttctgataagctatatcagttccatcatgacattaatggagggtgatgtgatactaacaggtactcctgagggtgtgggtcctgtccgagtaggtcagaagatcaaagctggtataaccgacctaattgatgtcgagtttgatgttcagaggcgcaatcggtcattttctgcatga

SEQ ID NO: 3930 - protein, 228 aa, Sorghum bicolor
  misc_feature: Ceres ANNOT ID no. 6033985
  misc_feature (31)..(201): Pfam Id: FAA_hydrolase Pfam Desc: Fumarylacetoacetate (FAA) hydrolase family
  misc_feature (4)..(228): NCBI GI: 71040689 NCBI Desc: isomerase-like protein [arachis hypogaea]
  misc_feature (8)..(227): NCBI GI: 21593651 NCBI Desc: isomerase like protein [arabidopsis thaliana]
  misc_feature (8)..(227): NCBI GI: 7268342 NCBI Desc: isomerase like protein [arabidopsis thaliana]
  misc_feature (16)..(225): NCBI GI: 28829830 NCBI Desc: similar to arabidopsis thaliana (mouse-ear cress). at4g15940/dl4011w (isomerase like protein) [dictyostelium discoideum]
  misc_feature (1)..(221): NCBI GI: 62901958 NCBI Desc: dkfzp566j2046 [synthetic construct]
MASAAAAQRLLASSTKIIGVGRNYIAHAKELNNPVPKEPVLFLKPTSSFLHAGVATAAVEIPEPLESLHHEVELAVVISRRGRDIPEASAMDFVGGYALALDMTARDLQSVAKSAGLPWTLAKGQDTFTPISAVVPKSAVTNPDDLELWLKVDDELRQKGSTSDMIFKIPFLISYISSIMTLMEGDVILTGTPEGVGPVRVGQKIKAGITDLIDVEFDVQRRNRSFSA

SEQ ID NO: 3931 - DNA, 1767 bp, Sorghum bicolor
  misc_feature: Ceres ANNOT ID no. 6033988
  misc_feature: Encodes the peptide sequence at SEQ ID NO 3932
atggcgattagggctggccgctcggtcctccacctcctcaccctcgccttcctcctcatcctcgccgcctcgccctgcctccaagctcgagtggaccatcgcaaacatatatctgactggagtaggcaacccaactttgaattgcagaatatctcctcgagtcggaaggatggccctcatctcctgagcagatcagaggaaataacacacaggaaattaagagggagaattggtgtaaggaagaaaatggaagtaatgcagcaggatgatgaagcattagttaaacttgagaacgcaggtatcgaacgctcaaaagctgttgattctgctgtgctgggaaaatacagtatctggagacgcgaaaatgaaaatgagaaggcagattcaagggttcgtctgatgcgagatcaaatgatcatggccagaatatattctgttcttgccaaatcgagggacaagcttgatctctatcaggagctgcttgcaaggctcaaggaaagccagcgctcccttggggaagctactgctgatgccgaacttcccaagagcgcttcggatagaataaaagcaatgggacaagttttatcaaaagcaagggatctattgtatgattgcaaggaaattaccgagcgtttgagagcaatgcttcagtcagcagatgagcaggtccggagcttgaagaagcagagcacctttcttagccagctggcagctaagacaatcccaaatggcatccattgtctttccatgcgcttaacaattgattattaccttctgtctccagagaaaagaaagttccccaatagtgagaatttggaaaatcctgatctttaccactatgctcttttctcggacaatgttttggcagcatcagttgtggtcaactcaaccatcatgaatgcaaaggagcctgaaaaacatgtatttcatcttgttaccgacaaactgaactttggggccatgaacatgtggtttttgctgaatccacctggggatgcaacaatccatgtggaaaatgttgatgacttcaaatggttaaactcttcttactgccctgttctgaggcagcttgagtctgcagccatgagagaatactatttcaaggccggtccgaaaacactctctgctggctcttctaatctgaagtatcgaaacccaaaatatttgtccatgctcaaccatctaagattttacctcccccaagtttatcccaagctgaataaaatccttttcctggatgatgacatagttgtccagagggatctaactggactctgggaggttgaccttaatggaaatgtaaatggagcggtggaaacatgtggagagagttttcatcgatttgacaagtacctcaatttctcaaacccaaatatttctcagaattttgatcctaatgcatgtggttgggcttatggaatgaacatgtttgatctggaagaatggaagaataaagacattactgggatttaccacaaatggcagaacatgaacgagaacaggctgctctggaaactggggacattgcctccagggcttctaactttttacaagctgacacaccctctggacaaatcatggcatgtgcttggcttagggtacaatccaaccattgagcgctcagagatagacaatgctgcggtcatccactacaatggtaacatgaagccgtggctggaaatcgcaatgacaaagtatcggccttactggacaaagtacatcaattatgagcacccgtacattcatggatgcaagatcagccaatag

SEQ ID NO: 3932 - protein, 588 aa, Sorghum bicolor
  misc_feature: Ceres ANNOT ID no. 6033988
  misc_feature (247)..(562): Pfam Id: Glyco_transf_8 Pfam Desc: Glycosyl transferase family 8
  misc_feature (29)..(588): NCBI GI: 52077221 NCBI Desc: glycosyl transferase family 8 protein-like [oryza sativa (japonica cultivar-group)]
  misc_feature (43)..(588): NCBI GI: 7271113 NCBI Desc: 68 kda protein [cicer arietinum]
  misc_feature (108)..(566): NCBI GI: 115480325 NCBI Desc: os09g0531800 [oryza sativa (japonica cultivar-group)]
  misc_feature (44)..(525): NCBI GI: 23308453 NCBI Desc: at3g61130/t20k12_30 [arabidopsis thaliana]
  misc_feature (59)..(588): NCBI GI: 30691875 NCBI Desc: glycosyl transferase family 8 protein [arabidopsis thaliana]
  misc_feature: Useful for making plants with altered cell wall content and/or composition
  misc_feature: Functional homolog of the protein sequence encoded by LOCUS at2g46480
  misc_feature: GREAT-hit functional homolog of the protein sequence encoded by LOCUS at3g61130
  misc_feature: Useful for making plants with altered carbohydrate content
  misc_feature: Functional homolog of the protein sequence given in SEQ ID NO 13787
  misc_feature: Useful for making plants with altered cell wall content and/or composition
  misc_feature: Functional homolog of the protein sequence given in SEQ ID NO 13838
MAIRAGRSVLHLLTLAFLLILAASPCLQARVDHRKHISDWSRQPNFELQNISSSRKDGPHLLSRSEEITHRKLRGRIGVRKKMEVMQQDDEALVKLENAGIERSKAVDSAVLGKYSIWRRENENEKADSRVRLMRDQMIMARIYSVLAKSRDKLDLYQELLARLKESQRSLGEATADAELPKSASDRIKAMGQVLSKARDLLYDCKEITERLRAMLQSADEQVRSLKKQSTFLSQLAAKTIPNGIHCLSMRLTIDYYLLSPEKRKFPNSENLENPDLYHYALFSDNVLAASVVVNSTIMNAKEPEKHVFHLVTDKLNFGAMNMWFLLNPPGDATIHVENVDDFKWLNSSYCPVLRQLESAAMREYYFKAGPKTLSAGSSNLKYRNPKYLSMLNHLRFYLPQVYPKLNKILFLDDDIVVQRDLTGLWEVDLNGNVNGAVETCGESFHRFDKYLNFSNPNISQNFDPNACGWAYGMNMFDLEEWKNKDITGIYHKWQNMNENRLLWKLGTLPPGLLTFYKLTHPLDKSWHVLGLGYNPTIERSEIDNAAVIHYNGNMKPWLEIAMTKYRPYWTKYINYEHPYIHGCKISQ

SEQ ID NO: 3933 - DNA, 456 bp, Sorghum bicolor
  misc_feature: Ceres ANNOT ID no. 6033995
  misc_feature: Encodes the peptide sequence at SEQ ID NO 3934
atgatggcggagctggacgcgccgctgcacgccctcgggttcgagatggaggagctctccccgtcgcggctcaccggccgcctccccgtcactcgcatctgctgccagccgttcaaggtgctgcacggcggcgtgtcggcgctggtggcggaggcgctggcgagcatgggcgcgcacatggcgtccgggtacagccgcgtcgccggcgtgcagctcagcatcaaccacttccgcagcgccgccctcggcgacaccgtcctcgcgcaggccgtccccgtccacgtcggacgctccacacaggtttgggaggtaaagctctggaagatggatgcatccacaggagagaaggggcctcagatcgccgaatccagagtcaccctgctgtctaacctgccgttgtcggagaagcacaagacggcaggagatgctctaaagaaatatgcatcaaaactgtag

SEQ ID NO: 3934 - protein, 151 aa, Sorghum bicolor
  misc_feature: Ceres ANNOT ID no. 6033995
  misc_feature (38)..(115): Pfam Id: 4HBT Pfam Desc: Thioesterase superfamily
  misc_feature (5)..(148): NCBI GI: 33589776 NCBI Desc: at1g48320 [arabidopsis thaliana]
  misc_feature (32)..(148): NCBI GI: 115461977 NCBI Desc: os05g0137700 [oryza sativa (japonica cultivar-group)]
  misc_feature (5)..(105): NCBI GI: 42573630 NCBI Desc: thioesterase family protein [arabidopsis thaliana]
  misc_feature (9)..(127): NCBI GI: 51892109 NCBI Desc: srfb or comab [symbiobacterium thermophilum iam 14863]
  misc_feature (12)..(106): NCBI GI: 121607543 NCBI Desc: uncharacterized domain 1 [verminephrobacter eiseniae ef01-2]
  misc_feature: Abnormal phyllotaxy, leaf number higher than wild-type
  misc_feature: The plant is abnormally small.
  misc_feature: Useful for making plants with modulated biomass
  misc_feature: GREAT-hit functional homolog of the protein sequence given in SEQ ID NO 13187
  misc_feature: Useful for making plants with modulated biomass
  misc_feature: Functional homolog of the protein sequence given in SEQ ID NO 13187
MMAELDAPLHALGFEMEELSPSRLTGRLPVTRICCQPFKVLHGGVSALVAEALASMGAHMASGYSRVAGVQLSINHFRSAALGDTVLAQAVPVHVGRSTQVWEVKLWKMDASTGEKGPQIAESRVTLLSNLPLSEKHKTAGDALKKYASKL

SEQ ID NO: 3935 - DNA, 1383 bp, Sorghum bicolor
  misc_feature: Ceres ANNOT ID no. 6033999
  misc_feature: Encodes the peptide sequence at SEQ ID NO 3936
atggaggccgccgccccgtgcccgcgcgcccaccccgtggacctccgctggctgctctccgtggccgccggcggcctcttcgcgctgctgctcctgctggccacctccccgtcgttccagctcccctcctcctccgccgccacctcccgcctcttcctcacccccgcgtcccgctcctcctcggcgcgccccgcgctgcccccgctcttcgtcgagcccgcgctctcccgcccgccgcccccgcccgccgcgtccctcccgcgcttcgcctacgtcatctccgggtccgccggggacgccgggatgatgcggcgctgcctgctggcgctgtaccacccgaggaaccgctacgtgctccacctggacgcgcaggcgcccgacgccgaccgcgccgacctcgccgctttcgtcgccgcgcacccggtgctcgccgcggcggggaacgtgaaggtggtcgagaaggccaacctcgtcacctacaggggacccaccatggtgaccaccacgctgcacgccgccgcgctgctcctgtggggcgacggcaggggacgcggcggcgccgactgggactggttcatcaacctctccgcctccgactacccgctcgtcacgcaggatgatttgatgcatgtgttctccaagctgccgcgcgatctcaacttcatcgatcacacgagtaacatctcctggaaagcgtacctcctgtttgcgagggcgatgccggtgatcgtagacccggcgttgtacatgaagacaaagggcgacctggtctggatgccggagaggcggagcttgccgacggcattcaagctattcactggttcggcgtggatggtgctgtcccgtccgttcgtggagtacctgatctgggggtgggacaacctcccgcgcacgctgctcatgtactacgccaacttcatctcctccccggagggctacttccacacggtggcgtgcaacgccgacaagttccgcaacacgacggtgaacagcgacctgcacttcatctcctgggacaacccgccgatgcagcacccgcactacctcaccgtcgccgactgggaccgcatggtcgccagcgacgcgcccttcgcgcgcaagttcctcagggacgaccccgtgctggaccgcatcgacgccgagatcctcgggggccgggggcccggcatggtcgcgccgggaggctggtgtcaggcagcagcagctgccggcgccggcggggagaacagtaacgggaccgacgacgacccgtgcgcggcggtggggaacgccgcgttcctaaggcccggaccgggtgctgagcggctgcagaggctcgtcacgtcgctgctgtcggaggagaacttccggcccaggcagtgcgtagtagaagacgagaagtga

SEQ ID NO: 3936 - protein, 460 aa, Sorghum bicolor
  misc_feature: Ceres ANNOT ID no. 6033999
  misc_feature (89)..(323): Pfam Id: Branch Pfam Desc: Core-2/I-Branching enzyme
  misc_feature (61)..(454): NCBI GI: 46358506 NCBI Desc: glycosylation enzyme-like protein [triticum monococcum]
  misc_feature (55)..(454): NCBI GI: 77556820 NCBI Desc: glycosylation enzyme-like protein [oryza sativa (japonica cultivar-group)]
  misc_feature (29)..(454): NCBI GI: 102139993 NCBI Desc: glycosyl transferase family 14 protein [musa acuminata]
  misc_feature (16)..(454): NCBI GI: 42567183 NCBI Desc: glycosyltransferase family 14 protein / core-2/i-branching enzyme family protein [arabidopsis thaliana]
  misc_feature (13)..(454): NCBI GI: 20856992 NCBI Desc: at3g15350/k7l4_15 [arabidopsis thaliana]
  misc_feature: Useful for making plants with altered carbohydrate content
  misc_feature: Functional homolog of the protein sequence given in SEQ ID NO 13849
MEAAAPCPRAHPVDLRWLLSVAAGGLFALLLLLATSPSFQLPSSSAATSRLFLTPASRSSSARPALPPLFVEPALSRPPPPPAASLPRFAYVISGSAGDAGMMRRCLLALYHPRNRYVLHLDAQAPDADRADLAAFVAAHPVLAAAGNVKVVEKANLVTYRGPTMVTTTLHAAALLLWGDGRGRGGADWDWFINLSASDYPLVTQDDLMHVFSKLPRDLNFIDHTSNISWKAYLLFARAMPVIVDPALYMKTKGDLVWMPERRSLPTAFKLFTGSAWMVLSRPFVEYLIWGWDNLPRTLLMYYANFISSPEGYFHTVACNADKFRNTTVNSDLHFISWDNPPMQHPHYLTVADWDRMVASDAPFARKFLRDDPVLDRIDAEILGGRGPGMVAPGGWCQAAAAAGAGGENSNGTDDDPCAAVGNAAFLRPGPGAERLQRLVTSLLSEENFRPRQCVVEDEK

SEQ ID NO: 3937 - DNA, 723 bp, Sorghum bicolor
  misc_feature: Ceres ANNOT ID no. 6034001
  misc_feature: Encodes the peptide sequence at SEQ ID NO 3938
atgaagctgctgtgcagccacggcggccgcttccagccctgcgggcccgacggcgagccccggtacgtcggcggggagacgcgcgtcctcgtcgttccgcgcgccgtgtccttccgcgacctggcggcgcggctggcggagatggcggccggcggcggcaaggcggcggaggtgcgcgcgatcagcatcaggcaccgcctcgcggacgacgagggcctcgaggacgtcctcgtgacggtcacctgcgacgaggaggtcgcgcacatgcgcgacgagtacgaccgcctgcgcgccacgcggccggccgcgaggttccgtctcttcgtcaccaccacctccgccggtccaaagagagcgacgacgacggccgggctcccacccctggcgccgcagtcgtcgatgcggcgcgtgcagagcgagcaggcggttgccgctcgagcgcagcaaaagcaccggccgacgcggcgcgtccacagcgcgctggagctcgcgggaggagtccacatgcagccgtcgttccaccagcaccaccatcgccaccggcgctgctgctgctgctcctgccagcgccgtgaccggtacacgcccgcgccaccgcctgcgcgtccgacgtacgcactgccctacatgtccaagaagtgggtagccgctcctccttcgctgtctgcggcggaggcggcagggcgggtggcgaacagaagagcaatctgggagttggagtga

SEQ ID NO: 3938 - protein, 240 aa, Sorghum bicolor
  misc_feature: Ceres ANNOT ID no. 6034001
  misc_feature (15)..(112): Pfam Id: PB1 Pfam Desc: PB1 domain
  misc_feature (2)..(116): NCBI GI: 124359217 NCBI Desc: octicosapeptide/phox/bem1p [medicago truncatula]
  misc_feature (1)..(160): NCBI GI: 115466754 NCBI Desc: os06g0181100 [oryza sativa (japonica cultivar-group)]
  misc_feature (1)..(138): NCBI GI: 15809940 NCBI Desc: at4g05150/c17l7_70 [arabidopsis thaliana]
  misc_feature (1)..(109): NCBI GI: 87240487 NCBI Desc: octicosapeptide/phox/bem1p [medicago truncatula]
  misc_feature (1)..(109): NCBI GI: 92870234 NCBI Desc: octicosapeptide/phox/bem1p [medicago truncatula]
  misc_feature: The sequence is a functional homolog of SEQ ID NO. 426 in the 11/188,298 US application
MKLLCSHGGRFQPCGPDGEPRYVGGETRVLVVPRAVSFRDLAARLAEMAAGGGKAAEVRAISIRHRLADDEGLEDVLVTVTCDEEVAHMRDEYDRLRATRPAARFRLFVTTTSAGPKRATTTAGLPPLAPQSSMRRVQSEQAVAARAQQKHRPTRRVHSALELAGGVHMQPSFHQHHHRHRRCCCCSCQRRDRYTPAPPPARPTYALPYMSKKWVAAPPSLSAAEAAGRVANRRAIWELE

SEQ ID NO: 3939 - DNA, 1782 bp, Sorghum bicolor
  misc_feature: Ceres ANNOT ID no. 6034004
  misc_feature: Encodes the peptide sequence at SEQ ID NO 3940
atgcgccggcaacgccgcaccgccggcggcctccgcccggtgctgctgctactccccttcgccgcgctcatttcggtcggaaccttctccctacactacgccgaccgcctcctcagctctgacacgggcacggcgcagcgggccgcttcgccgtcccggcaccagcagcagcgtcggctgcccgtctccaccctcgacgtgcgcgcgctcgacgccgccgccccggccccgccgctgcacgaggccgccgcgcgcgccttccggtccggcgggcgcctcctccgcgacgccctctcttcctccccctcgtcatccgcccccgcgccgccgcccgcggccgcgggtgccgacggcgcgacgcggtgcccggcctcgatcacgcggtcgggcgcgtatctgcacctgccctgcgggctggcgctggggtcacacgtcacgctggtcggcgcgccgcggggcggtcgaggcgcggctggcgtcgcgcagttttcggtggagctgcgcggtgaaggcgacggggacgcggcgccgacgatactgcacttcaacccgcggctcagcggggactggagccgccgcccggtgatcgagctgaatacgcgcttccgcggacaatggggacccgcgctccggtgcgagggccgcccgtcgcgccacgacgaggagaccgttgatggattagtgacatgtgaggaatggtctggaaacattggtggtgcatcagaggagttgaagagattgcagttgcagaaccgtgttgctggaaagaataacagaaattggatacattggccatatccattcttggaggaagaattgtttgttctaacactaagtactggtttagaaggctaccattttcatgttgatgggaagcatgtcgcatcttttccttatcgtgttggctttgttcttgaggatgccaaaatcttttctgtgaatggtaatattgatatcaaatcaatagtagctggttctttaccgacggctcatccaaaactaaaaacccctcctcttgggaaagagaatattgagctgttcataggtgttctttcagcagggagccatttcactgagcgtatggccgtgaggagatcttggatgtctttgatgcgaaattcatcaagcatagtggcacgtttttttgttgcattgaacggcagaaaggaagtgaatgaagatttgataaaagaagcagatttcttcagggacattgtcattgtcccttttgcggatagctatgatctggttgttctgaagactgttgccatttgtgactatgtggctcatgttgttccggcgaagtatgtcatgaagtgtgatgatgatacctttgttggacttgattcggtaatggctgaagttaagaaaattccagatggcaaaagcttttatttggggaacatgaactactaccacaggccactgcgggagggaaaatgggccgtctcatatgaggagtggcccagagaagagtacccgccttatgctgatggtgcaggctatgtcgtttcttctgacattgcaaacttcgtcgcaaccgaaatgaagaatggcagactaaatctgttcaagatggaggatgtgagcatggggatgtgggtggggcaattcaacctctcgcggacggggaacgccgtggcgtacgtccacagcgccggtttctgccagtccggctgcgtcaatggctacctcaccgcgcactaccagtcgccggcgcagatggtgtgcctctgggagaagctacggcgaggcaacacatggtgctgcaacgcaaggtga

SEQ ID NO: 3940 - protein, 593 aa, Sorghum bicolor
  misc_feature: Ceres ANNOT ID no. 6034004
  misc_feature (130)..(324): Pfam Id: Gal-bind_lectin Pfam Desc: Galactoside-binding lectin
  misc_feature (358)..(546): Pfam Id: Galactosyl_T Pfam Desc: Galactosyltransferase
  misc_feature (386)..(593): NCBI GI: 115456021 NCBI Desc: os03g0803600 [oryza sativa (japonica cultivar-group)]
  misc_feature (152)..(593): NCBI GI: 34393273 NCBI Desc: galactosyltransferase family-like protein [oryza sativa (japonica cultivar-group)]
  misc_feature (151)..(593): NCBI GI: 5882743 NCBI Desc: ests gbh36134 and gbh36132 come from this gene. [arabidopsis thaliana]
  misc_feature (151)..(593): NCBI GI: 19699371 NCBI Desc: at1g74800/f25a4_38 [arabidopsis thaliana]
  misc_feature (160)..(593): NCBI GI: 56202233 NCBI Desc: galactosyltransferase-like [oryza sativa (japonica cultivar-group)]
  misc_feature: Useful for making plants with altered carbohydrate content
  misc_feature: Functional homolog of the protein sequence given in SEQ ID NO 13850
  misc_feature: The sequence is a functional homolog of SEQ ID NO. 346 in the 11/188,298 US application
MRRQRRTAGGLRPVLLLLPFAALISVGTFSLHYADRLLSSDTGTAQRAASPSRHQQQRRLPVSTLDVRALDAAAPAPPLHEAAARAFRSGGRLLRDALSSSPSSSAPAPPPAAAGADGATRCPASITRSGAYLHLPCGLALGSHVTLVGAPRGGRGAAGVAQFSVELRGEGDGDAAPTILHFNPRLSGDWSRRPVIELNTRFRGQWGPALRCEGRPSRHDEETVDGLVTCEEWSGNIGGASEELKRLQLQNRVAGKNNRNWIHWPYPFLEEELFVLTLSTGLEGYHFHVDGKHVASFPYRVGFVLEDAKIFSVNGNIDIKSIVAGSLPTAHPKLKTPPLGKENIELFIGVLSAGSHFTERMAVRRSWMSLMRNSSSIVARFFVALNGRKEVNEDLIKEADFFRDIVIVPFADSYDLVVLKTVAICDYVAHVVPAKYVMKCDDDTFVGLDSVMAEVKKIPDGKSFYLGNMNYYHRPLREGKWAVSYEEWPREEYPPYADGAGYVVSSDIANFVATEMKNGRLNLFKMEDVSMGMWVGQFNLSRTGNAVAYVHSAGFCQSGCVNGYLTAHYQSPAQMVCLWEKLRRGNTWCCNAR

SEQ ID NO: 3941 - DNA, 579 bp, Sorghum bicolor
  misc_feature: Ceres ANNOT ID no. 6034011
  misc_feature: Encodes the peptide sequence at SEQ ID NO 3942
atgcggcgtctcgctctcctcctcctgcctctcctcctcgccgccggcgccaccacggcgtcggcggagctcgcgacccctcccgccgcctctcctactcctcctccatctcccccaacgcctccccctcctccgcctccgcgtccgccgaccctcgccgagctcctcccgaagtacggcctgcccccgggcatcttcccctcgaccgtcaccgccttctcgctcgctagcaacggcagcctcaccgtcgacctcgcgggcccctgctacgtccacttcgagtacctcacctactttgacgcccacatcacgggggtgctccgctacggctccctctccgacctccagggcgtccaggtccgccgcttcctcatctggtacaacgtggtccgcatcaaggtcgacctgcccccgccgccgcgctacgtctacatcgacatcgggtggatcacgcgcaagctccccgccgacgacttcgagtcgctccacgcctgcgaggactccaagaggtgccgcctgtcctccgcgctcgccgtcgccgccaaatggttccaggacttctttgcccaatttttttag

SEQ ID NO: 3942 - protein, 192 aa, Sorghum bicolor
  misc_feature: Ceres ANNOT ID no. 6034011
  misc_feature (6)..(185): NCBI GI: 115462699 NCBI Desc: os05g0221200 [oryza sativa (japonica cultivar-group)]
  misc_feature (2)..(183): NCBI GI: 115472661 NCBI Desc: os07g0548800 [oryza sativa (japonica cultivar-group)]
  misc_feature (3)..(183): NCBI GI: 115463963 NCBI Desc: os05g0421100 [oryza sativa (japonica cultivar-group)]
  misc_feature (12)..(165): NCBI GI: 115458574 NCBI Desc: os04g0443200 [oryza sativa (japonica cultivar-group)]
  misc_feature (17)..(165): NCBI GI: 32479663 NCBI Desc: p0041a24.4 [oryza sativa (japonica cultivar-group)]
MRRLALLLLPLLLAAGATTASAELATPPAASPTPPPSPPTPPPPPPPRPPTLAELLPKYGLPPGIFPSTVTAFSLASNGSLTVDLAGPCYVHFEYLTYFDAHITGVLRYGSLSDLQGVQVRRFLIWYNVVRIKVDLPPPPRYVYIDIGWITRKLPADDFESLHACEDSKRCRLSSALAVAAKWFQDFFAQFF

SEQ ID NO: 3943 - DNA, 1602 bp, Sorghum bicolor
  misc_feature: Ceres ANNOT ID no. 6034021
  misc_feature: Encodes the peptide sequence at SEQ ID NO 3944
atgcctatccccaaggccgacgagctggttgtgcacgccgtcaaggagcagttcgtcggcctcgacttctgcatcaccagccccccgccatggctcacgacgatcctcgtgggcttccagcactacctggtgatgctcggcaccaccgtcctcatcgccaccatcatcgtcccgctcatgggcggcggccattatgagaaggcgattgtgatccagaccatcctgttcctgtccgggatcaacacgctgctgcaggtccacttcggcacgcggctccccgccgtgatgagcggctcctacacctacatctacccggccgtcgccatcatcctcagcccccgatacgcgctcgtcatcgaccctctcgagaggtttatcttcacgatgaggtcgctccagggcgcgctcatcatcgccggcgtcttccaggccgtcgtcggcttcttcggcatatggagagtcttcataaggttcctcagccctctcgcggcggtccccttcgtcacgctctcgggcctgggactcttctacttcgcgttccccggggtgactcttctacttctcgtcaccaaatgcatcgaagtgggtctcccggccctcgtcctcgtggtgatcttcgcggagtacgccgcccactacttcgccaaggggagcatcgttttcggccggtgcgccgtgctggtgaccatcatcgtcgtgtggatctacgccgagatcctgacggcggccggcgccttcaacaataggggccccgtgacgcagttctcctgccgctccgaccgcgccgggatcatcgagggctcaccttgggtgaggtttccgtatccgttccagtggggatacccgattttctgcttccaggattgcttcgccatgatggctgcttcttttgcatcacttattgagtctaccggcaccttaattgcagtgtcaagatacgcaggcgccacgttcaccccaccctccgtgttctcgcgtggagttggctgggagggcatatctatcatactggacgggatgtgcggtacactgacaggaactgcagcttcagttgagaatgcaggcctgttggcagtgacgcgcgttggaagccggcgagttgtaaagatcgcagccttgttcatgattttcttctcattgtttggcaaattcggggcggttcttgcatccattccattgccgcttttcgctgcggtgtattgtgtcctctgggcttatgcagctggtgcaggcttcgccttccttcagtactgcaacctcaactccttgagaacaaagttcatactcagcatctcgatattcctgggactgtccatcccacagtacttccggatctacgagatgttcttcggcttcggaccagttcacacccattcagtcgcgttcaatgtgatggtcaatgtcatcttctcgtcgccggcgacggtggccgccatactggcctactttctggacgtcacccacctgtactgggaggctagtgtgaagaaggacaggggttggttctggtgggagaagttcaagaactacaagtatgatgccaggagcgaggagttctaccgtcttccttatggcttgagcaggtacttcccctcgctttag

SEQ ID NO: 3944 - protein, 533 aa, Sorghum bicolor
  misc_feature: Ceres ANNOT ID no. 6034021
  misc_feature (32)..(445): Pfam Id: Xan_ur_permease Pfam Desc: Permease family
  misc_feature (1)..(533): NCBI GI: 7844006 NCBI Desc: permease 1 [zea mays]
  misc_feature (2)..(533): NCBI GI: 89330191 NCBI Desc: leaf permease 1 [oryza sativa (japonica cultivar-group)]
  misc_feature (2)..(533): NCBI GI: 30696385 NCBI Desc: xanthine/uracil permease family protein [arabidopsis thaliana]
  misc_feature (5)..(532): NCBI GI: 8569102 NCBI Desc: identical to permease homolog (at per-x) partial cds gbu83501 and contains a xanthine/uracil permease pf00860 domain. est gbaa712474 comes from this gene. [arabidopsis thaliana]
  misc_feature (14)..(533): NCBI GI: 3202038 NCBI Desc: permease 1 [mesembryanthemum crystallinum]
MPIPKADELVVHAVKEQFVGLDFCITSPPPWLTTILVGFQHYLVMLGTTVLIATIIVPLMGGGHYEKAIVIQTILFLSGINTLLQVHFGTRLPAVMSGSYTYIYPAVAIILSPRYALVIDPLERFIFTMRSLQGALIIAGVFQAVVGFFGIWRVFIRFLSPLAAVPFVTLSGLGLFYFAFPGVTLLLLVTKCIEVGLPALVLVVIFAEYAAHYFAKGSIVFGRCAVLVTIIVVWIYAEILTAAGAFNNRGPVTQFSCRSDRAGIIEGSPWVRFPYPFQWGYPIFCFQDCFAMMAASFASLIESTGTLIAVSRYAGATFTPPSVFSRGVGWEGISIILDGMCGTLTGTAASVENAGLLAVTRVGSRRVVKIAALFMIFFSLFGKFGAVLASIPLPLFAAVYCVLWAYAAGAGFAFLQYCNLNSLRTKFILSISIFLGLSIPQYFRIYEMFFGFGPVHTHSVAFNVMVNVIFSSPATVAAILAYFLDVTHLYWEASVKKDRGWFWWEKFKNYKYDARSEEFYRLPYGLSRYFPSL

SEQ ID NO: 3945 - DNA, 345 bp, Sorghum bicolor
  misc_feature: Ceres ANNOT ID no. 6034024
  misc_feature: Encodes the peptide sequence at SEQ ID NO 3946
atggttatccctccaccagctagggctcctgcaatcaccaagttcttgaagccctatattttgaagatgcatttcacaaacaattttgtgagtgctcaggtcatccacaccccgacggccacagtcacatgctctgcaagctctcaggagaaactgctgaggccaagcatggagtcgacgcgggatgttgctgcggctgcaaagattggcaagttgctcggggagcgcctgttgttcaagggtatccctgcagtatctgtctccatctcaagagaccagaagtaccatggcaaggtcaaggccgtgatagattctcttagagatgcaggtgtgaaattgctgtaa

SEQ ID NO: 3946 - protein, 114 aa, Sorghum bicolor
  misc_feature: Ceres ANNOT ID no. 6034024
  misc_feature (4)..(113): Pfam Id: Ribosomal_L18p Pfam Desc: Ribosomal L18p/L5e family
  misc_feature (1)..(114): NCBI GI: 140068966 NCBI Desc: ribosomal protein l18p/l5e [medicago truncatula]
  misc_feature (21)..(112): NCBI GI: 84394574 NCBI Desc: 50s ribosomal protein l18 [vibrio splendidus 12b01]
  misc_feature (21)..(112): NCBI GI: 91791555 NCBI Desc: ribosomal protein l18 [shewanella denitrificans os217]
  misc_feature (21)..(112): NCBI GI: 113951297 NCBI Desc: ribosomal protein l18 [shewanella baltica os195]
  misc_feature (21)..(112): NCBI GI: 145627544 NCBI Desc: ribosomal protein l18 [shewanella baltica os185]
MVIPPPARAPAITKFLKPYILKMHFTNNFVSAQVIHTPTATVTCSASSQEKLLRPSMESTRDVAAAAKIGKLLGERLLFKGIPAVSVSISRDQKYHGKVKAVIDSLRDAGVKLL

SEQ ID NO: 3947 - DNA, 711 bp, Sorghum bicolor
  misc_feature: Ceres ANNOT ID no. 6034036
  misc_feature: Encodes the peptide sequence at SEQ ID NO 3948
atggcgaagaccacgcaacccaccgcgggggcgcgggatcccctgctccccacctctggcgccgccgtcgcctccccgccgccctacctcgacccgcacccggccgactcctacacggtcctcctcgtccccgtccgcctccgccaccgcctgcgccgcggcagcggccgctgctgcggcgtcggcccctgcctcaccgcgctcttcctcctcctcgcgctcgcgggcttcctcctctggcccgccgacccggacgtctccctcgcccgcctccgcctcgcgcacgtctccgtcgtggcgcgccccgccgtcgccgtcaccatatccgccgcgctcaaggtccgcgtccgcaacccggacttcttcgcgctcgactacaaccgcctcgacgtcgccatcgcctaccgcggcgcgccgctcggccgggtcacgtccggcggcgggcgggtccgggcgcgcgctgtgtcgtacgtcgacgccgacctgcagctcgacggcatacgcgtcgttgaggacgcgatctacctggtcgaggacctcgcgaggggatccgtgccctttgataccatcgtcgaggtcgagggccatctccacttcttcttcctcagcatccctgtcaaggggagaatatcttgcgtggtgcatgttaatccacacaacgaaaccatagtacatcaagactgctatcctgagttggtcatagaagattag

SEQ ID NO: 3948 - protein, 236 aa, Sorghum bicolor
  misc_feature: Ceres ANNOT ID no. 6034036
  misc_feature (78)..(212): Pfam Id: Hin1 Pfam Desc: Harpin-induced protein 1 (Hin1)
  misc_feature (54)..(228): NCBI GI: 92896037 NCBI Desc: harpin-induced 1 [medicago truncatula]
  misc_feature (56)..(228): NCBI GI: 16323356 NCBI Desc: at2g01080/f23h14.5 [arabidopsis thaliana]
  misc_feature (32)..(228): NCBI GI: 94549041 NCBI Desc: plant cell wall protein sltfr88 [lycopersicon esculentum]
MAKTTQPTAGARDPLLPTSGAAVASPPPYLDPHPADSYTVLLVPVRLRHRLRRGSGRCCGVGPCLTALFLLLALAGFLLWPADPDVSLARLRLAHVSVVARPAVAVTISAALKVRVRNPDFFALDYNRLDVAIAYRGAPLGRVTSGGGRVRARAVSYVDADLQLDGIRVVEDAIYLVEDLARGSVPFDTIVEVEGHLHFFFLSIPVKGRISCVVHVNPHNETIVHQDCYPELVIED

SEQ ID NO: 3949 - DNA, 2229 bp, Sorghum bicolor
  misc_feature: Ceres ANNOT ID no. 6034056
  misc_feature: Encodes the peptide sequence at SEQ ID NO 3950
atgccgatctctgcgtcctctgcggcaggcgtcgacggcggcgcggtggcggccggcacgcccatgaagaatgcgacagcggcggctgctgtcgccgagatggcgaggcatctcaccgtcgacacggaagacgccttcgcaggcctgctggagttcgccgctgacgacaacgcggaggggctgcgccgcgcgctggagcgcgcgccgcctgccgccgcggacgaggccggcctctggtacggccgccggaaggtcctggagcaccgcaccccgctaatggtcgccgccacctatgggagccttgctgcgctccgactgctggtgtccctcccgtctgttgacgtcaaccgccgctcgggcacggacggcaccactgccctccactgcgccgcctctggtggctcacggacggcggttgaggccgtgaagctgctgctgggagcgggggcagacgctgacaccatggatgacgctgggcgccgtccggctgatgtgatctctgtgccaccgaagatgttcgacgccaagttcgcccttcaagatcttcttggattccccaagtctgagcatggcatgctacgggtggtgacaaggtccaccaactcaatctcatcgcccgtttcatcccccactgcagaggatgcacggtcaccgtctgcttctgtgatgatgatttcaaagtttggtgacttgcctagggttgcgacatcggagaagaaggaatacccagtggatccgtcccttccagacatcaagaacagcatctatgcttccgatgaattccgcatgtactcgttcaagatccgcccttgctcacgggcgtactcgcatgactggactgagtgcccctttgtccacccaggagagaatgctcgacgccgagacccccgcaagtaccactacagttgtgtgccatgcccagatttcaggaagggcgtgtgcaggcgcggagatatgtgtgagtatgctcatggagtgttcgagtgctggctccatccagcgcagtatcggacacgcctatgcaaggatggtacaagctgtaaccgccgcgtctgtttctttgcccacacaactgatgaactccggccattgtatgtctccactggatcagcagtgccatccccaagggcttctgcaacagctgctatggagatggctgcagcaatgggcttaatgcctggttccccgtcatcggtttcagcggtaatgtccccatttaccccaccaatgtcgccttcgggcaatgggatgcccccttcgttgggttggcagcagccaaatgttccaacattacaccttccaggcagcagccttcagtcaagcaggcttcgaacatcacttagtgcaagggatatgcctgctgatgactactccatgatgccagatcttgattcccaacttatgaatgatctgtgctattcccgtctcagttcatccacagggaaccactctgctcggaccaagtccctgaatccatcaaacctggatgatctcttctctgctgaaatggtctcatccccgaggtatagtaatgctgaccagggtgctatgttttcaccttctcacaaggctgctattctgaatcagttccagcagcagcagcaagcactgctttctccaatcaacacaggagtttactctccaaaggcagacaaccagcagttaccttcacactcatctctgctgcaagcatcacttgggatgtcctcccctggccggatgtctccacgatgtgttgaatcaggctccccaatgaactcccacctagctgctgctcttgtccagcgtgagaaacaacagcagacaatgagaagtctcagttctcgtgaccttgggcctagtgcggcacgagcttcagctctcggctcccctctaagctcatcatggtctaagtggggatctccttcagggacaccagattggggcgtaaatggtgaagaattgggtaagctccgccgctcatcgtcctttgagctgaggtctggtggtgatgaccctgatctctcttgggtgcatacactggttaaggaatctccaccagagaagcaagttactacagctgaatcaattaattctgttggaccctcacccctaatgcctcccggcatgaacagcggcgaaggttctggtctgaacacccagctggatgcacatgaccaagccgcagttataggagcattgcttgaacagatgcagcttgatcagcagattggtagtctagcaacatag

SEQ ID NO: 3950 - protein, 742 aa, Sorghum bicolor
  misc_feature: Ceres ANNOT ID no. 6034056
  misc_feature (122)..(157): Pfam Id: Ank Pfam Desc: Ankyrin repeat
  misc_feature (301)..(326): Pfam Id: zf-CCCH Pfam Desc: Zinc finger C-x8-C-x5-C-x3-H type (and similar)
  misc_feature (37)..(737): NCBI GI: 124360202 NCBI Desc: zinc finger, ccch-type [medicago truncatula]
  misc_feature (15)..(737): NCBI GI: 140039408 NCBI Desc: zinc finger, ccch-type [medicago truncatula]
  misc_feature (43)..(631): NCBI GI: 7630041 NCBI Desc: zinc finger transcription factor-like protein [arabidopsis thaliana]
  misc_feature (43)..(631): NCBI GI: 22136426 NCBI Desc: zinc finger transcription factor-like protein [arabidopsis thaliana]
  misc_feature (46)..(692): NCBI GI: 113129056 NCBI Desc: cys-3-his zinc finger protein [capsicum annuum]
  misc_feature: The sequence is a functional homolog of SEQ ID NO 1138 in the 11/479,226 US patent application
  misc_feature: The sequence is a functional homolog of SEQ ID NO 500 in the 10/412,699 US patent application
MPISASSAAGVDGGAVAAGTPMKNATAAAAVAEMARHLTVDTEDAFAGLLEFAADDNAEGLRRALERAPPAAADEAGLWYGRRKVLEHRTPLMVAATYGSLAALRLLVSLPSVDVNRRSGTDGTTALHCAASGGSRTAVEAVKLLLGAGADADTMDDAGRRPADVISVPPKMFDAKFALQDLLGFPKSEHGMLRVVTRSTNSISSPVSSPTAEDARSPSASVMMISKFGDLPRVATSEKKEYPVDPSLPDIKNSIYASDEFRMYSFKIRPCSRAYSHDWTECPFVHPGENARRRDPRKYHYSCVPCPDFRKGVCRRGDMCEYAHGVFECWLHPAQYRTRLCKDGTSCNRRVCFFAHTTDELRPLYVSTGSAVPSPRASATAAMEMAAAMGLMPGSPSSVSAVMSPFTPPMSPSGNGMPPSLGWQQPNVPTLHLPGSSLQSSRLRTSLSARDMPADDYSMMPDLDSQLMNDLCYSRLSSSTGNHSARTKSLNPSNLDDLFSAEMVSSPRYSNADQGAMFSPSHKAAILNQFQQQQQALLSPINTGVYSPKADNQQLPSHSSLLQASLGMSSPGRMSPRCVESGSPMNSHLAAALVQREKQQQTMRSLSSRDLGPSAARASALGSPLSSSWSKWGSPSGTPDWGVNGEELGKLRRSSSFELRSGGDDPDLSWVHTLVKESPPEKQVTTAESINSVGPSPLMPPGMNSGEGSGLNTQLDAHDQAAVIGALLEQMQLDQQIGSLAT

SEQ ID NO: 3951 - DNA, 774 bp, Sorghum bicolor
  misc_feature: Ceres ANNOT ID no. 6034057
  misc_feature: Encodes the peptide sequence at SEQ ID NO 3952
atggcggattcaatggtagcgagcttctgggggcctgttacgtcaacgactgagttgtgcgaggagaattatgcacactcatcatatatcgcagaattctacaataccatctctaatgtcccatgcgttcttttggcggttattggattagtgaatgctttccgccaaggttttgagaaacggttcagtgtccttcacgtatccaatatgatacttgctattgggagtatgattttccatgccaccttgcaacttctcctgcaacagagtgatgagactccgatggtctgggagatccttctttatatgtatgtcctttattcaccggactggcactacaggagcacaatgccaactttccttttcctatatggtgctgcctttgcagtagttcatttctttgcccggttccaagttgtattcaagttgcattacattgtcctgtgcttcctctgcatcccccggatgtacaagtactacatactgacgaaagacatggcggcgaagcggcttgcaaagctttgggttcttacattaacccttgggactctctgctggctagttgatcgcatcttctgtaagaagctttcacattggtatgtcaacccgcaggggcacgcatggtggcatgtgcttatgggcctcaactcatactatgcaaacacattcctaatgttttgtcgggctcagcaacgtgggtgggagccgcggatcacacaccttcttggattcttgccttacgtcaaggtccagaaaccagaaaagagggaatga

SEQ ID NO: 3952 - protein, 257 aa, Sorghum bicolor
  misc_feature: Ceres ANNOT ID no. 6034057
  misc_feature (7)..(256): Pfam Id: aPHC Pfam Desc: Alkaline phytoceramidase (aPHC)
  misc_feature (1)..(256): NCBI GI: 87162688 NCBI Desc: alkaline phytoceramidase [medicago truncatula]
  misc_feature (88)..(256): NCBI GI: 87241163 NCBI Desc: alkaline phytoceramidase [medicago truncatula]
  misc_feature (9)..(248): NCBI GI: 19923527 NCBI Desc: phytoceramidase, alkaline [homo sapiens]
  misc_feature (6)..(233): NCBI GI: 44986149 NCBI Desc: agr199wp [eremothecium gossypii]
  misc_feature (6)..(233): NCBI GI: 45201295 NCBI Desc: agr199wp [eremothecium gossypii]
MADSMVASFWGPVTSTTELCEENYAHSSYIAEFYNTISNVPCVLLAVIGLVNAFRQGFEKRFSVLHVSNMILAIGSMIFHATLQLLLQQSDETPMVWEILLYMYVLYSPDWHYRSTMPTFLFLYGAAFAVVHFFARFQVVFKLHYIVLCFLCIPRMYKYYILTKDMAAKRLAKLWVLTLTLGTLCWLVDRIFCKKLSHWYVNPQGHAWWHVLMGLNSYYANTFLMFCRAQQRGWEPRITHLLGFLPYVKVQKPEKRE

SEQ ID NO: 3953 - DNA, 1557 bp, Sorghum bicolor
  misc_feature: Ceres ANNOT ID no. 6034063
  misc_feature: Encodes the peptide sequence at SEQ ID NO 3954
atggcgacgcggcggcgcctctctccgactttcttcggcggtctacgggcccgggagctcggcggcgccagtggctgctcccgcgccatggcggggctcccgtacctcgctgacctctcctccgaccccggcggccgtggcggcggggtcatagccgtcgaccactccggcgacgccgccatccccttcgccatctccttcggcaagactgcacagacctgtaacctcctggcggtcgccgacgaagacgggtacgttggcctctacgacacccgccggcgcctcccttccgcatcctcgtcaatagagaagtcagctgaaacgagggtgtccgactgggttgctcacaacaatgcaatctttgacgtgtgctggatcaaggagggatcccaaatgctgactgcatcgggcgatcaaactgtcaaaatatggagtgtaggaaacaggaaatgcattggtgtcttgtcaggacatactgggagtgtgaagtcgctgtcttgccattcttcaaatcctgagctcattgtttctggttcaagggatggttcatttgctctttgggatctaagatgcgaccctaaatctccaaacagccatggtgaaacgtgcctcacgtcttctgctgttgtcagagaagcccacagtcccatacagaggaaccgaacccggtctcgagcaaaggcggcttcaacaagtatcacatcagttctttatctgaaagatgatgtctccattgctacttctggagctgcagacaatgttgtgaagatatgggatacacggaacctgaaagtgccggtctctaacaaaagctctcaagcaggggcccagcctttggagggggtgaaacatggcatctcttgcctgtctcaagattcgtgtggtgcatacattgctgcgtcatgtatggataacagtgttctccatgtgaacaagggtcccataaaggcttacactggcagcaaaatagagtctttctttgtcaagtctgctatcagtcctgatggaactcacatccttggtggatcaagtgatggaaatgtatacctgtggcaggtggatcgacctgaaagtgctcctatagttttgaaaggccatgaaggcgaagcaacttcggttgactggtgtgcatcagaggttggaaagatagcaacatcttctgatgattctacggtacgtgtgtggagtaccaagaaaatggactgcacaaatgtaagctcaccaacagtgattcggaagcggataactgcaccaaacactgagtaccgaaggtccagtagccatgagcatgctactacatcaagagatgcagttgcctgcactagtggtgatggtgaattgcaaagtggttgccactctccccttcaacccagagcactggacttcggcactcctgaatcgacaaagaagagggccttcacattggtccaggaggaggcccttgatgcaaggaagagcccggaagttcagatgaacagtccctcttctgttctgagcccaccaccgtcattgaaacggagaacgattcgggactactttgccagtgctgcatcttga

SEQ ID NO: 3954 - protein, 518 aa, Sorghum bicolor
  misc_feature: Ceres ANNOT ID no. 6034063
  misc_feature (107)..(145): Pfam Id: WD40 Pfam Desc: WD domain, G-beta repeat
  misc_feature (149)..(188): Pfam Id: WD40 Pfam Desc: WD domain, G-beta repeat
  misc_feature (357)..(396): Pfam Id: WD40 Pfam Desc: WD domain, G-beta repeat
  misc_feature (49)..(517): NCBI GI: 92885781 NCBI Desc: wd40-like [medicago truncatula]
  misc_feature (309)..(518): NCBI GI: 115454769 NCBI Desc: os03g0699100 [oryza sativa (japonica cultivar-group)]
  misc_feature (51)..(395): NCBI GI: 27545239 NCBI Desc: denticleless homolog [danio rerio]
  misc_feature (51)..(395): NCBI GI: 56207913 NCBI Desc: denticleless homolog (drosophila) [danio rerio]
  misc_feature (51)..(395): NCBI GI: 28279515 NCBI Desc: denticleless homolog [danio rerio]
  misc_feature: The sequence is a functional homolog of SEQ ID NO. 502 in the 11/188,298 US application
  misc_feature: The sequence is a functional homolog of SEQ ID NO. 485 in the 11/188,298 US application
MATRRRLSPTFFGGLRARELGGASGCSRAMAGLPYLADLSSDPGGRGGGVIAVDHSGDAAIPFAISFGKTAQTCNLLAVADEDGYVGLYDTRRRLPSASSSIEKSAETRVSDWVAHNNAIFDVCWIKEGSQMLTASGDQTVKIWSVGNRKCIGVLSGHTGSVKSLSCHSSNPELIVSGSRDGSFALWDLRCDPKSPNSHGETCLTSSAVVREAHSPIQRNRTRSRAKAASTSITSVLYLKDDVSIATSGAADNVVKIWDTRNLKVPVSNKSSQAGAQPLEGVKHGISCLSQDSCGAYIAASCMDNSVLHVNKGPIKAYTGSKIESFFVKSAISPDGTHILGGSSDGNVYLWQVDRPESAPIVLKGHEGEATSVDWCASEVGKIATSSDDSTVRVWSTKKMDCTNVSSPTVIRKRITAPNTEYRRSSSHEHATTSRDAVACTSGDGELQSGCHSPLQPRALDFGTPESTKKRAFTLVQEEALDARKSPEVQMNSPSSVLSPPPSLKRRTIRDYFASAAS

SEQ ID NO: 3955 - DNA, 1860 bp, Sorghum bicolor
  misc_feature: Ceres ANNOT ID no. 6034064
  misc_feature: Encodes the peptide sequence at SEQ ID NO 3956
  misc_feature: Down-regulated in shoot tissues in response to aminocyclopropane carboxylic treatment
  misc_feature: Down-regulated in shoot tissues in response to salicylic acid treatment
atgccgaagcactaccgccctgcgggtaagaagaaggaggggaatgcggcaaagtacatcacgaggaccaaggcggtcaactacctgcaagttagcctcgcaatcttcaggaagctatgcattctaaagggtgtctttccgcggcagccaaagaagaaggtggaagggaaccacaagacctactaccacacgaaggatattgcattccttgctcatgaccctttgatcgagaagttcagggagattaaggtccatcgaaggaaggttaaaaaggctgttgctaagaaaaacagggatctcgcagacaggctgttgaatcggccaccaacttacaaacttgataggcttgtccttgaaaggtatccaacatttgttgatgctcttcgtgacttggatgactgccttacaatggtgcatctgtttgcggcattacctgctgttgatggtgaacgcgttgaagtcaaacgaattcataactgccgcaggttaagccatgaatggcaagcatacatatcccgaactcattccctgaggaagacatttatttccgtcaagggcatatatttccaggctgaagttcaaggacaaaagatcacctggctaacccctcatgctcttcagcaagtattaaccgatgatgttgatttcaatgtgatgctctcttttctagaattctatgagactcttttaggatttgtgaacttcaagctctatcattcaataaatgtaaattatcctcctattctggatccacgtctggaagctttagctgctgagctctatgcattgtgccgatacatgtctgctggttccagaagaatgattgggaattcacaatctgacgaagtaatggaggataaggatgagaagagtaaagctgatggaataactgaggaagagaaggatgtgaagaataaagcaagctcaaaagcagatgaatctgagctcagattagcacagcttcaacatcagctcccaactaatgaacctggtgcactgatgaatcttgtagaagaatcaactgctgatgatgcagatgatgacgatactaaagaatgtaaaggtttatttaagaacttaaagttctacctgagtcgggaggtgcctagggagtctctattatttattatcccagcatttggagggactgtttcatgggaaggagaaggagctccatttaaagaagtagatgaagatatcacccaccagattgttgataggccgacacaaagccatgttttcctctccagggagtatgttcaaccgcagtgggtctttgattgtgtaaacgctcgtatcatattgccaacagaaggttatcttgttggaagagtacctccaccacatttgtctccttttgtggacaatgatgcagagggctacattcctgagtatgcagaaacaataaagaggctgcaagctgctgctcgcaatgaggtcttgcctcttcctggtattggtgatgaagatctagacaattcattggtagcagcaatgatggatcgaacagaatctaacgaagctgctgaaaagaagaggaagttggagatgctagagaagcaataccatgatgaactgaagatggaaattgacggtgttgctttctctagtctgtcaaataaggaagcaaataaatcaccagatgccaaagatgatactcagtcagatcacgaggcggatgccattaaacaagaggagaaggatgatgatgacattggtactgctctcatgtctcgcaagcagcaaggcctttataaagctatgaagatgggcaaagaaaagaaaaaagagaaaattgagctacttaagaagaggaaaaagaatgcggattctagtgcttcttccaagaagcggcactga

SEQ ID NO: 3956 - protein, 619 aa, Sorghum bicolor
  misc_feature: Ceres ANNOT ID no. 6034064
  misc_feature (8)..(286): Pfam Id: Pescadillo_N Pfam Desc: Pescadillo N-terminus
  misc_feature (352)..(429): Pfam Id: BRCT Pfam Desc: BRCA1 C Terminus (BRCT) domain
  misc_feature (1)..(274): NCBI GI: 7573301 NCBI Desc: pescadillo-like protein [arabidopsis thaliana]
  misc_feature (3)..(616): NCBI GI: 92897913 NCBI Desc: brct; pescadillo, n-terminal [medicago truncatula]
  misc_feature (10)..(616): NCBI GI: 3080524 NCBI Desc: spbc19f5.05c [schizosaccharomyces pombe]
  misc_feature (10)..(316): NCBI GI: 109452014 NCBI Desc: pes1 [synthetic construct]
  misc_feature (10)..(316): NCBI GI: 47678609 NCBI Desc: pes1 [homo sapiens]
  misc_feature: Down-regulated in shoot tissues in response to aminocyclopropane carboxylic treatment
  misc_feature: Down-regulated in shoot tissues in response to salicylic acid treatment
MPKHYRPAGKKKEGNAAKYITRTKAVNYLQVSLAIFRKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRLSHEWQAYISRTHSLRKTFISVKGIYFQAEVQGQKITWLTPHALQQVLTDDVDFNVMLSFLEFYETLLGFVNFKLYHSINVNYPPILDPRLEALAAELYALCRYMSAGSRRMIGNSQSDEVMEDKDEKSKADGITEEEKDVKNKASSKADESELRLAQLQHQLPTNEPGALMNLVEESTADDADDDDTKECKGLFKNLKFYLSREVPRESLLFIIPAFGGTVSWEGEGAPFKEVDEDITHQIVDRPTQSHVFLSREYVQPQWVFDCVNARIILPTEGYLVGRVPPPHLSPFVDNDAEGYIPEYAETIKRLQAAARNEVLPLPGIGDEDLDNSLVAAMMDRTESNEAAEKKRKLEMLEKQYHDELKMEIDGVAFSSLSNKEANKSPDAKDDTQSDHEADAIKQEEKDDDDIGTALMSRKQQGLYKAMKMGKEKKKEKIELLKKRKKNADSSASSKKRH
